United States Patent 10,888,096 (BIOPESTICIDES FOR POTATO LATE BLIGHT DISEASE) - sequence listing, part 4

SEQ ID NO: 3 - DNA, 6837781 bp, Pseudomonas chlororaphis 189 (residues 5,128,339-6,837,781 of 6,837,781)
ggctcgacgggcgccgggtggtcacccactggacccgctgcgagcaactggcgcggcaatatccgcagctgcgggtggaagccaacccgatcttcatcaacgaggggccggtgtggacctcggccggcgtcaccgccggtatcgacctggctctggcgctggtggaggcggacctggggcacgccatggcgctggacgtggcccggcaactggtggtgttcctcaagcgcccgggcggccagtcgcagttcagcgcgaccctggccctgcaaaaacagggcagccgcttcgacgacctgcacgcctggatcgccgaaaacctcggtcgcgagctgaacatcccggccctggccgagcgggccggcatgagcgaacgcagctttgtccgccactaccgcgccgacaccggccagaccccggcccgggccatcgaacagatccgcgtggaaagcgcccgacgcctgctcggcgacagcggcgtggcgatcaagcgcatcgccgtgcagtgcggcttcggcagcgaagaaaccctgcgccgcagcttcctgcgggtcgtcggcgtgacgccgcaggcgtatcgggagcgcttttcgccagagggggagtcaggcttccagtagttccagcaacgcctgcaaggtggcgtgcggcgcttcctgtggcacgttgtggccgaccccgggcaagacccggcgctggtaagggccggtgaacaggccgatgtcttcgtcctcttcgctcgccgggccgaccccgtcatcgccgccgcacaacgagagggtcggcacgcggatcggcggctgctgcgccagggcctgctcgatatgttccaggctcgggtcgcccggcgcgtacatgaagcgatgccggtaggagtggatcaccacctcgacgaagtccgggttgtcgaacgacggcgcgctcagatcatagagttcgcggccgcgatcccaggtcggcgaccacagtcgccacagcagtgcgcacagttcgcggcggttggcggtcaggccgtcgaccccgcgttgggtgtggaaatagtactgataccagagccggtgctcggtctcgggcggtcgcggctgggtcgagcgggcaatgtcctggatgttgtagccgtcggcgctcaccaggcagcgcacccgctccggccacagggccgcgacgatgcaggcggcgcgaccgccccagtcgaaaccggcgagggcggcccgggggatctccagggcgtccatcaggtccagcaggtcctgggccagcgccgcctgttgcccggaacgcgggatgtccgggccggcgaaacgggtcgggccgtagccgcgcaggtacggcactatcacccgatagccgcgcgccgccagctcgggggcgatctcgtcgtaacagcgagggtcgtagggaaaaccatgcaacagaatcaccggctcgccgtcggcggggccgtggtgttcgtaggcgatacgcagggacggggtctggatgtactggacagagagcgagctgttcatgacggatccggcgacagggaaagcagcaaccttagctcaaactgcatgcctggtcagtgtcgggccagaacttcattcgtgggctttgccctgggcatgaagcgttgacgaatgcttcagacctcagccagcggctacaggaaggcgagctcggcgctggtcgtgaggtgcttgaaatggtgctgccacaaccgcacgcccaactgcccgctgcggtccagtgacgagcccagggtcaggtcggtgatcagcgtcggttgcaagccggcgtcgaacagggcgaagccggcggcgagtacgcaggtgtcggtctggatgccgcagaccagcacgcggtccggggccaggctgcgcaggtaggcgatggtctctggcgtgggggcgtagccgtgcttgatgaacacgcggtcggcggcgaccaggctggggtcatcggcggcggggcgccagccgagctggcggacgaagggcgtgcgactttcgtcatggcgctcgacggtggccaccgagggcaactggccgagcagggcgttgatgccgttcaccagccagtctggcgggttgaacgagggttgcacatcgatgatcagcagcacctggcgcatgggaatccttgagcgggccgggcggcctattctgcccgcaaaccgccgttgccgcgaatggcttgtcttctgtaggcgccaggcgatggggcgtattgcgggtcaaggctgccagagaatcttctcgccactgagccggcgatcgagaaaactcgcggcgctgatcagggccaggtgggtcagtgcctggggggtgttgcccaggtgccgggcatggctgtcgaactcttcggcgtacagccccagcgggttggcgtagcgcagcagttgctcgaactccaggtgggcctggtccagccggccggcgcgggccaggcattcgacgtaccagaacgagcaggcggcgaatgcgccttcggtgccggccaggccgtcgatctggctgtcttcgttgcggtagcggtagaccatgccgtcgcgcaccagggtcctctcgatggcttccagggtcgccagccagcgcgggtcgcgggcgccgacgaagcgcactagcggcatcagcagcatcgaaccgtccagcgcggtgccgccccggcactggacgaaatgcccgccttcggcgttccagaagttgctccagatatcgtcgtagatcgcctggcgggtctggtcccagcgggcgaacggcgccggcagcgagcgcttggaggcgaggcggatggcccggtccagggcgacccagcacatcagccgcgaatgcaggaaatggtgctgctcgccgcgcatttcccagatgcccacatcctcgccgtcccagctgctgcagacctgatccaccacgtccaccacgtgtttccagccttcgtgggaaatcgcctcgccgtatttgttgaccaggtacaccgcgtccagcagctcgccgaagatgtccagctggacctgttcataggcctggttgccgatacgcaccggcgtcgcgccgccatgcccggacaggtgcggcagttgggtttccggcagctgctggcggccgtcgatggcgtacaggatattcagcttggccggctggccacagcagtcgctgacccgtccgcgcagccaacgcatataggcgttggcctcctcgacgaagcccaggcgcatgaaggcgtagacggtgaacgaggcgtcgcggatccaggtgtagcggtaatcccagttgcgttcgccgcccggggtttccggcaggccgaaggtggcggcggcgaggatcgccccgtgcttgcgcgaggtcagcagcttcagcgccagggccgagcggttgaccatctcgcgccagcggccgcggtagttggactggccgatccagtcgcgccagaacttcagggtgcgttccaggcacagctcgctgccacctgtgaccagccgcggatcgtcgagcccgcccagcatgaattcggcgctctgcccctgttccagctcgaactcggccaccgccgcctgccggtcgatgcgcaggggctggctggccaccaggcgcagccccggctgccgctcggcctcgaagcacaccgcgtcgccgtccaaccgcgcgcgggtggtggcgcgggcatagtcatggcgcaccgcgcagcgcaggcgcagggtagcgcggccgctgaccacccgtacccggcggatcaacagcggcaggtcgtcctcgctgtcgccgatggtcagcaggtcggtggcttcgaccacggcccgctcgctcagccaacgggtctgcaggacgttgctgtcgggcaggtagatctgttcgtggcgggcgtcgggcaggtccggcgccagctggaagatgccggcgtccggggtgtcgagcagcgagcagaagatcgacgggctgtcgaactccggccagcagaaaaaatccacgctgcccttgtcgttgaccagcgcggcgctgcgcaggtcgccgatgatgccgtgggcgtcgatcggcgcctgtcgttcagtgtcagccatggtcgcgaaactccgggtacaggctcatgccgccatcgatcaccagggtgctgccgagcacgtagtcggacgcatcgctggccagccagaccacggcgttggccacgtccttgacgtcgccgatgcgcccgtagggaatcagctcgagcagcttgcgctcggccgcgccctcggtggccttgcgattgagcggcgtggcgatcgcgcccggggcaatggcattgacacggatgcgctggtggctgacttcctgggccaggctgcgcatcagcatgtccacgccgcccttggacgccgcgtagttgacgtgcccggcccagggaatccgctggtgcaccgagctcatgtgaatgatcttgccggcggcgcgcgacacgccgctgcggatgccctggcgatggaaaatgcgcagggcggcgcgggcgcagaggaactggccggtgaggttgacgctgatcacctggttccagtcctccagggtcatgtccaccgtggcggcgtctttctgcaggcccgagttggccaccaggatatcgaggaaaccgaaggcttccagggccttgtcgaacaggtgctggacctggtcttcctgggagatgtcggcgcccacggcaatggcccggccgccgcaggcgttgatatcggcggcgagtttttccgcgggcgccgcctgccgatggtaattgagcaccaccgaggccccggccgcggccagggcggtggccgccgcggcgccgatgccggaactggcgccggtgaccagggcgacttgttggttcagggagatattcatgagcacgcaccttaaccggagagcctgttcagctgactggctagagcgggcaggagttcaccgcagttacgaagtcccggaggagggcggggccggtgccaagcatccggcgccagggctcagcgcacccgcaagccctgcagcagcgcctccagcccggccagtgcctgctgcaatcgttgccccggatgctcgtcccgggcgatccacagcgaagcgtcgagcaggctgccgttgatcaggcgcgccagggcttcgctgggggcgttgaccaccaggccggcctgcatcagctcatccagcagcgcgctcaaggacgccacgcactgctcctcgctggcctcggtcaggtcgccgagtaccgcgcgcgcatcctgcaggacgatgcgctggatctccgcttcctgggccatttccaggtaggtgcggcagcgctggacgaaggcggcccagaggtcgtcggtgccgcgcgagattgcctccaggcgctggtccatttccgcgtcgagctgttccaccaccgccgccagcaggcctttcttgtcgccgaaatggtgatacaaggcaccccgggtcaaacccgcctcggccgtcagctcgtccatcgaggtgttggcataacccaggctgccaaaggcctggcgggcactggcgatgagtttgctgcgggtttcttcgatcatctcggcgcgttgacgcgggctcatggcgggcactcacacaactgatacatggattgacatacgccgcgtatgttctcatgctttcccacatacgcgccgtatgtatttttgtcttgcggtgcatttctggcaagcctcaaacaaggtgtgatgacgatggcaaacccttaccgcgaactgttcaacgcccccggcagccgcgctttcgtggtggcggggatgattgcgcggatgccgatgtcgatgaccggcatcggcctgatcaccatgctggcccagctcaagggcggttatgcgctggccggtgcggtggcggcgactttcgctctggccacggccttctgcgcgccccaggtgtcgcgcatggtcgaccgtttcggccagggccgggtactgccgatcgccgccggtgtgggcggcggggcactgctggcgttgctgctgtgcacccgcttgcagacgccgcactggacgctgttcctgttcgccgccctggccggctgcatgccgagcatgccggccatggttcgcgcccgctggaccgaactgtaccgcggccagccacagttgcagaccgcctatgccctggagtcggtgctcgatgaggtgtgctttatcgtcggcccgccgttgtcggtggggctgtgcgtggcggccttccccgaggccggaccgctggcggcgctgctgatgctggcgatcggcgtcaccgcgctggtggcgcaacgggcgaccgagccgccggtgcatccccatgaggcccggcacgacgtgtcgatcattcgctcgctggagttgcagctgctggtgctgttgatgatcgccatgggcatgatcgtcggcgtggtggatgtggtcagcgtggcgttcgcccagcagcaggggcaacccgcggcggcgagcatcgtgctgtcggtgtacgccatcggttcctgcctggcgggtatcgccttcggcgtgctgaaactgaatatcccgctgccgcgactgttcatgtacggcggcatcgccaccgccgtgaccaccctgccattgctgctggcgagcaatatcttcggcctgtccctggcggtgttcgtctccggcctgttcttcgccccgaccctgatcgtcgccatggccctggtggaaaacatcgtgccgccggccaagctcaccgagggcctgacctggctggtcaccggggtcagtatcggcgtggccatcggtgcggccagttccggctggctggtggatgcctttggcgcgcgcagcggcttctgggtagcgcaggcggcgggagtggtggtgctgggggcggcggtgcagagctggcgccggctgacccggggccagccggcggtcgcctgagccttaccagccgcgcccggagttgacccagaaattcaccgacagcgaggtggataccgactgcacctggtggaaccagccctcgggcaggaacagcaggtcgccggcttccaggatgacccgcaggaaggtcacgtcccgcgacgccggaaaacgctcgtagtccggcgcgtccgggttgacctcgcaaccgtcgagcccgccctggggcgcggtcgaccaggtgcccagcgcctcacggtggtggggcgcggcgaggatgaaggacttctgcccccagacctgggcgaacaggttgtcggtgtcgtcgcggtgcagcggggtcagggtgcccttggggccgatccagatccgtggcgggatgaacagcgagcggtcgaagtagggcgggtactggatctgctccagcaattgcgccggcaggatgttgttgcccatgtaggcgggcggttcgccgtcggcgtttttcggcgccgggttatccagcgaggcgatgaactcggccatggaggtcgagcgaaagtcgcgctcggtggaaaaggtcttcttcacgtagtcgccgtggcgggtgatgccttgcagttcggcgaagtgcaccagcgattcttcgcggctgagctggaacagcggccagtcctgcagggcatcgctgatcaccacgggaatgccctggggcaggtaacgcgtcctgaactcctccaccgacagcccgctgcgcggacgccgttccaccgtgtgctgggtcggcaggccggccgagacttgttcgctgtagcgcggcggggtggggtagcgggtgttcatctcgactttcttttccagcgcgccaccgccatgccgggcatggtcgatgatctgcggcagcagcgtggccaggcccatgttgccgccgatcttcaggcggccgctggcgaacagttcctcgacgttggcgctgccgcccatgatcccgagaaagtcggcctgggcgacctcgatggtgacatcaggcgtcggatgccggccggcttcggtgcggctgtgtgccttgacctctgaccagaatgccagttgtggaccgaacacgaattgaaaggtgccttcgattcccacggcaccggcattggcgaacagctttgacagaatggtctgcaagtccacggcgatctctcttgtttgcggtttgatctgcagcagagaacgaaggctgtatcgggaaatttatggggacgactgactcaatgacgaccggtcaagcgaaggggatctattgtaggagcgaagcttgctcgcgatgaacctgagaacactgcgtttacccaatgcaagacgcggtgtcgttaacgaccatcgcgagcaatcgagtgtcgaccggctgctcctacagatgggcgtcaggcgggctgccgcactaatttgccggccaggtggcacgtccagtctttaccatcatttttctcaaggggaacaccgtgacccagctgacgttgctatgcctgccgtattccggagccagcgccatggtctacagccgctggcggcgcaagctgcccgaatggctgaaattgcagccggtggaactgccggggcggggcgcccgttatgccgagccgctggccaccgacatgcgcgagctggcgcggcaactggcgctggaagttcgcgcgggcctgcgtacgccctatgccttgttcggccatagcctgggggcgctgctggcctacgagctggcccacgccctgcgggccctgggtggtccggaaccggtggcgctgttcgcttcaggaaccgcggcgccgaacctgcgcaccgactacgaccgaggttttgccgaccccaagacggacgaacaactgatcgaacagttgcgcaccctcaatggcaccagtgaagaggtattggccaaccaggagttgatgagcctgaccctgccgatcctgcgcgccgactttcttttgtgcggccgttttcgcccgctgcagcgaccgttgctgaactgcccggtgcatgtcctgggaggcaaggccgaccgggccaccaccgaacagttgattggctggaggaaggaaacccagggcagcttctccgtggacatgctggcgggcgggcacttcttcatccacgaacacgaagccagggtcctgagcctgatcaagggccaccttgaggtgcatcgtcggcgccacctgcaacgcgaaaccgcggtttcctgagccaggcaatgtagccgctgccgcaggctgcgaacggccggcacggccgcggcgttctcggtggccccatcgccagatcgtcaagcaaggccctgcgggccttatcgcagcctcgcgggctcggcagcggctacaggagtgggtgtagccgctgccgcaggctgcgaacggccggcacggccgcggcgctctcaaggcccaggcagatctgtcagcccaacgacgtgcccaggcgccagtagcccatcagggtcaggttgcggcgttcctggccgcgttcgttgatcaggtggcggcggatgctcatcaccgtggcggactcgccggccacccaggcatagaagctgttgtcggccggcgtggcggtctcccaggggcgttgttcttcgtcgccctcgcggaccttgatcggccggtgcgcggtgtggggcggcggcagctcggccagctcccgggcggcatggatcagggtttccccgtgctgggcgcccaacaggtcccgcggcagccagttgagccgggtctgggggttgcagcgcaagtcgatgcagtcgctttcgtggggcacttcgataaacgcctgcacgtccgggtaatccggatactcctgcagctcctcgagaatccctgcaatggccggcagggcggtttcatcgcccatcagcagcactttgcggatatctgccggcggcatccattcataaccgccgggatcgccgctgtaggccttgttcggcaccaccatctgcaggcggtcgccgggccgggcgtgggtggcccagctggacgcggggccgttgaccccgtgcagcacgaagtccacatccagttccgccggcagcaggcgcagggcgcggatggtataggtgcgcatcggcggctgctgctcggccggcagcttgcgccgggcggcgtgccagtcaccttccaccggcagttgcggggcgctgccgtcggcgccggggaacagcagcttgatgcgctggtccggggccagggtgcgggcctgggcgatgtcctcgccggcgaacaccaggcgcaccagggacggactgaggacgatgcgtcgcttgagctcgacgttgatcacccggtagcccttgggtctgggccggtcgatgcccgtcagtttgcgcaagccttgggtgaggatgtcggtcagcgattgagcggaggacatgggcgggtacctgttgcaaggggggataagcaaggaacgaaggggggtgggtccgatttaccgtcggcgccgctggtcggcctgtcctgcgcggccctggggttggcggccggcgtggcgcgcggggttaattttcccgggccttcatccgttccgtagggatgaccgagccaatgctcgataccccacacgcaagtacggatgacccccgatgaatgccgaagactccttgaagctcgcccgtagattcattgaactgccgctggaaaagcgccggctgttcttgaaggctctggacaaggaaggcgtcgacttctctctgctgcctattcccgcgggggtcgcagtgcctgaccgccaggcgttgtcctacgcgcagcagcgcatgtggtttctctggcagctggacccgcagagcgcggcctacaacctgcccaacgcggtgcgcctgagcgggccgctggatcgggtggtgctggcccgggccttcgactggctgctggagcgccatgaaagcctgcgcacggtgttccgcctggagcaggacgagccgcggcaggtcatcctgacgacccaggtgaacatcgattaccaggacctgagcgaccttgaccctgcgctgcgcgaagccagcgtacggcagcgggccgacgccgaggcgcgccgacccttcgatctgcagcaggggccgctgttgcgggtctgtgtgctgggattgggggagcaggagcacgtcatgctgctgaccttgcaccatatcgtcgccgacggctggtccatgggcgtgctgatcgaggagttcctgcaagcctacgacgcgctgctccagggcgcggcgccgagtgcgccggccctgccgatccagtaccgcgactacgccctgtggcagcgcagctggctggaggcgggggagcaggaacggcagctggcgtactggcgggccaagctcggggacgagcatccggtgctcaggctgcccaccgatcatccgcgccaggcccattccagccgccaggggcggcgcctggatgtcgaactggcgccggacctggcccagcagctgggcgccctggcgcgacagcagggggtgaccctgttcgccgtgctgctggccggtttcaagctgctgctggcgcgctacagcggccagcaggatatccgcgtgggcgtgcctatcgccaaccgcacgcgccaggaagccgaagggctgatcggcttcttcgtcaacacccaggtgctgcgcagcgagttgagcccgcacttgacggtggagcaactgctggcggatatccgcgagaccaccctgggcgcgcaggcccaccaggagctgcctttcgagcggctggtggaggccctgcaactcgagcgcagcctgagccacagcccgctgttccaggtgctctacaaccaccagccgcaggtcaccgagctgaccaccctgcgcagccgctccggtcttgaggtgcaggccctggcgcgcaacgagcgcacggtgcagttcgacctgaccctggacaccttcgagcgcggtggccggctgcaggccgccttcacctacgactgccagctgttcgaggaacagaccgtcgagcgcatggccggccactggcagaacctgctgtgggcgatggtgcgtgagccgcgttcggcgatcgccgagctgccgctgctcagccccgaacaacgccaggccaccctggcccagggcgtcggtgcgcatgaggcgttcgccgccgtttcggtgcttgagctgttcgccgagcaggtgcgcgtacggcccgaggccccggccctggtgttcggcgagcagtgcctgagttaccgccagctggatcagcgcgccgcgcgcctggcggcggccctggtactgcgtggcgtgggccccgaagtgctggtggggatcgccgtggagcgctccctggagatggtggtgggcctgctggcggtgctcaaggccggcggtgcctatgtgccgctggatgcccagtaccccgagcaacgcttgcgctacatgctgcaagacagcggcgttgccctgctgctgagcgagaccgcggtgcaggcgcggctgccgctggcggcccaggtcagcgtgctgttgctggaccagccggacagctgggcgccggccaccgacccgcaggcgccattgccgcgggtcgaggccgggcacctggcctattcgatctacacctccggttccaccggggccgccaagggcgtcaccatcacccacgcagccctggccaactacgtgcaggcgatcctggcgcgcctgccgctgggggccgcgcgcaacatggcggtggtctccaccattgccgccgacctggggcataccacgctgtttggcgccctgtgctccggcagctgcctgcatgtgatcgacctggataccggcctggacgccgaggccttttcggcctacctggacgcccggcaaatcgatgtgctgaagatcgtcccttcgcatttgcaggcgctgatgagcggcgcggagccggcccgtgccctgccaaggcagtgcctggtgctgggcggcgaagcctgcccggcggcgctggtcagaaagatcgcggcgctggcgccgcagtgcgcggtgttcaaccactacggcccgacggaaaccacggtcggcgccctgaccctggccgccgctgccgtggatcaggccctggcggtggtgcccctgggccagccgctggccaacgttcgcgcccgggtcctggatgcctcgttgcagcccgtggcgcccggcaccccggccgagctgtacctggggggcgccggcctggcgcggggctaccaccgccggccggccttgaccgccgagcgtttcgttcccgaccctttcagtgccgatgggcagcggctggaccgcaccggtgacttggcgcgctacctcgatggcggggtcatcgattacctggggcgcatcgatcaccaggtaaagattcgcggctaccgcatcgagctgggggaaatcaccgcggcgctcaagcagttgccgcaggtcgaagacgccgtggcccaggtggtcagcgtggcggatgagccgcaagtggcggcttatgtggtgctggccaaagccagtgtccaggagccggaagcggcctggcaggagattcgccggcagctggcggtggcgttgcccgactacatgctgccgatgcatttcatggccctggaaggcatgccgttgaccgccaacggcaagctcgacctgcgggccttgccgccgttgcagcagcaggcgccggtggcggtctacgttgccccggtcagcgagttgcagcggggcatcgcggcgatctggcaggacgtgctcaaggtcgagcgggtgggcctgagcgacaacttcttcgccctgggcgggcattcgttgctggccacccagatcatttcccgggtccgccggctgctggcggcggaggtgccgctgcgggtgctgttcgagaccgcgcgcctggatgagttcgtcgagcaagtgcaggcttgcgccggcgcgggttcgctgccgctgatcgaggctctagggcgcgacgagccattgccggcttcccatgcccagcagcggcagtggctgttctggcagatgcatccacagagcaccgcctaccacacaccgatcgtggtccggctccagggggcgctggaccggcaggcgctgcagcacagcttcgacgccctggcccgacgccatgaagccttccgcaccacctttacccagcaccaggacagcctgtgccaggtggtgcacccccagggtgaaattaccctggcctgggaacgcctggccccgggcctgtcccgcgaggcggtcgaggccagggccctggaagaaacccaggtgctgttcgacctggagcacggccccttgtgccgggcccgggtgctgcagatcgccgagcaggactgcctgctggtggtgaccctgcaccacatcatttccgatggcgcctccatgagtgtgctggcccgggaattcgtcgccctctaccgggggttcatccagggccaggcgccgcggttcgatgaactgagcgtgcagtacgccgagtacgccagctggcaccgggcctggctcgagcagggcgagcagcagcggcaactggattactggcgcgagcagctggggctggagcacccggtgctggaactgccggtggaccatccgcgccaggccctggtgagccatcgccaggaacgcctgggtttgcgtctgccgctggacctggagcagggcctgcggcgcctggcgcgcgagcatgacatgaccctgttccagctgttcctcggctcgttcgccctgctgctgcaccgctattgcgatcagcccgatatccgtatcggcgtgccagtcagcaaccgtcgccaccaggaaatggaaggcgtgatgggcttcttcgtcaacaccctggtgatacgcgtcgacctggcgccgaaccttgcagtggggcagttgctgcgccaggtcaaggccacggccctggctgcccaggcccatcaggacctgccgttcgatcgcctggtggatgcgctcaagccccagcgcgcgctggaccagaacccgctgttccaggtgatgtacaaccacctgagcattgccggggaaagcgccgatggcgccagcctgccgggcctgcaggccgaggagatggtcctgcagggcggtaccgcgcaattcgacctgaccctggaaaccctggagaccgacgccgggatcaacgcgtcgttcatctatgccgctgagttgttcgaggtgtcgaccatcgagggttttgccgatcactggcgcaacctgctgcaaggcatgctcgaaccgcgacaggcgattggcgagctgccgatgctgggccgggaggagcaggggcggattcgccaggactgggatcacacgcatgcggtctatccgacccagcgctttgtccaccagctgttcgccgaccaggcggccagggcgccggaggcgccggcggtgttcttcgccgaacaacgcctgagctatcgcgagctggacattcaggccaaccaactggcgcacaagctgatcgagctgggcgtcggcccggaagtgcgggtggccatcgccatgccgcgttgcgcggaaatcatggtggccttcctggccgtgctcaaggccggtggggtctatgtaccgctggacattgaatatccccaggatcgcctgcgctacatgatgcaggacagcggcgcgtggctgctgttgacccagagtcacttgctggagcgcctgccgattcctgaaggactgccgaccctgtcggtggagcgggccgccgattttgccagctacccggccagcgccccccaagtggatctggccgaggaaaacctcgcctatgtgatctacacctccggctccaccggcctgcccaagggcgtggcggtgtcccacggcccgctggccatgcacagcctggccaccggcgagcgttatgaaatgagcccggcggactgcgaactgcactttatgtccttcgctttcgacggttcccatgaaggctggatgcatccactgatctacggtgccagcgtgctgatccgtgatgacagcctatggtcgccggaattcacctatgagcagatgcaccgttatggcgtcaccgtgggggtgttcccgccggtgtacctgcaacagctggcggtgcatgccgaacgcgacggcaatccgccggcggtgcgggtgtattgcttcggcggcgacgcggtaccccaggccagttacgacctggcctggcgggtgctgcggcccaagtacatcttcaacggctacggtccgactgagacggtggtcaccccgttgatctggaaggccaaggctggcgatctgtgtgatgcggcctacgcgccgatcggcaatatcgtcggcaatcgcagcgcctacgtggccgatgccaacctcaacctattgccggttggggtggcgggcgagctgtacctgggtggcctcggtgtagcccggggttacttggaccggccagggctgacagcggaacgttttattcccgacccttacagcaccacgggggcgcggctgtaccgcagcggcgacctgacccgctaccgcaccgacggtctggtggagtacgtcggccgtgtcgaccatcaggtcaaggtgcgcggcttccgtatcgagctgggtgaaatcgaggcacgactgctggaacaggacccggtgctggaagtggcggtgatcgcccagccggggccgagcggccagcagctggtgggctacatcgtgccggtggacgcgcaggttacttcgagcaacgaacgccaggcgcagctgcgggaaagcatcaaggcccgcctgcgggaaaacctgccggactacatggtgccgacttacctgctgttcctcgaggctttgccgctgacgccgaacggcaagctggaccgcaagtcgctgccgaaagtcgatgcgcagctgatgcagcagacctacgtggcgccgcaaaacgacctggaacagcagatcgcggcgatctgggccgatgtgctgaagctggagcaggtgggcgtcaccgacaacttcttcgagctgggcggcgattcgatcatctcgatccaggtggtcagccgcgcccgtcaggccggcatccgctttaccccgaaagacctgttccagcaccagacggtgcaggggctggccacggtggcggagcagggcgagggcgggttgcagatcgaccagggcccggtgcgtggccagatggcgctgctgccgatccagcagtggttcttcgacaccccggtgccggagcgtcatcactggaaccagtcagtgctgctcaagccgttgaaagccctgagtgccaaggcgctggagcacgccttgcacgccttgctcgaacaccacgacggcctgcgcctgaattttgtcgaggcaggcgcagcctggagcgcgacttatgcgccgtcggcgccggtgacttcggcaccgttggccgcgatgcaagccgatgcgctgctgtggctggtggacgacgccactgaggattcgctgcaagccctgtgcgatacagcgcaacgcagcctcaatctgcaacaggggcctttgctgcgtgccgtgctctgtaccttgcaggacggcagccagcgtctgttgttggcgatccatcacctggtggtggacggcgtgtcctggcgggtgctgctggaagacctgcatcgggccctggtgcagcaagcggccgggcaagccatccggcttccggccaagaccagctcgacccaggcctgggccgggcaactgcaagcctatgccagcagcacggcgctgcagcgggagctgggttactggcaggcgcagttgcagggtgtcgagtcgggcctgccctgcgaccgggtaacggatcgggtggtgatcaaggatgccctgagcgtcagcaccgagctggatcaggcctacacccagcgcctgctgcaggatgccccggcggcctaccgcacccagatcaacgacctgctgttgaccgcgctggcccgagtcatcacccgctggacctgtagcgacagcgccctggtgcaactggaaggccatggccgcgaagagctgttcgacaacatcgacctgagccgcaccgtgggttggttcaccagcgtgttcccagtcaagctgacaccgcaggcggccctggccgactcgatcaagcagatgaaggaacaactgcgcgcggtgccgaacaagggcatcggcttcggcgccctgcgttacctgggggatgccaatgcccaggcaaccctcgcggccctggcggtaccgcgcatcaccttcaactacctgggccagttcgacgccagcttcgacgagccggatgcctggtttgccccaagcgccgaagccaagggcgcagaccagagtgccgaggcgccgctgggcaactggctaagcatcaatggccaggtctatggcggtcagttgaagctgggctggagcttcagccaggcgatgttcgagccagcgaccatccagcgcctggcggatgactatgccgaggaactcaaggcgctgatcgagcattgcagccagccgcagcatcgtggcgtgacgccgtcggacttcccgctggcgggcctgagccagcagcaactggatcgcctgccgctgtccctggcccaggtcgaggacctctacccgctgtcgccgatgcagcagggcatgctgttccacaccctgtacgagcagcagggcggcgactacatcaaccagttgcgggtggatgtggacgggctcgatcccgagcgcttccagcaggcttggcaagaggtcatcgaccgtcacgatatcctgcgcagcggtttcctctggcagggcgagttgccggcgccgatccaggtggtgcacaagcgcattgccctggattttgccgagcatgactggcgtgccgtggcatcggcggccgaggacctggatgccctggccgagcaggagcgccagcgcggtttcgacctggcggcggcgccgttgctgcgcctgaccctggtacggatcgacgaccagcgttatcacctgatctacaccaaccatcacatcctcatggacggctggagcaactcgcggctgttgggcgaagtcctgcaacgttactcggggcaatcggcgggggcggcgcctggccgctatcgcgactacatcgcctggttgcagcgtcaggatgcgcaggccggcgagcgtttctggaaagagcaactggcggccctggacgagccgacccgcttggcccaggccatcggccgcagcgggccgagcaccgtggataaaggccatggggcttaccagcagcagttggacgagcagcagacccagcgcttgagcgagttcgcccgccagcagaaggtcacggtcaataccctggtgcaagccgcctggctgttgttgctgcaacgctacaccgggcaggacacggtggtgttcggcgccacggtgtccgggcgtcccgcggaactcaaaggcgtggagcagcagatcggcctatttatcaacaccctgccggtggtggcctcgccgcggccggacatggccgccagcgcctggctacagctggtgcaggaacgcaacctggccctgcgcgatttcgagcacacgcccttgtatgacgtgcagcgctgggctggcctgggtggtgaagccctgttcgacaacatcctggtgttcgagaactacccggtgtccgaagccctggcacaaggcgctccggcgcagttgagctttggcgtggcggccaaccacgagcagaccaactacccgttgaccctgtcggtctacctggggcagaccctggccttcgactacagctatgcccgcgagcattttgcccaggcggacatccagcaactggccggctacctggagcaactgctcatgggcatgctggcgagcccgcagggcagcatcggcgagctgtcgttgcgtggcgccaccgagcgccggctgatcgacgagcagctcggccggaccccggcgcgggacctggcgccgcagtgtgtccatcaattgatcgaggcccaggcccagcgcaccccggatgccgtggcactgctgtgtggcggccggcaactgagctacggccagttcaaccagcgggccaaccaactggcccacaagttgatcgagcagggcatcggcccggatgtccgggtcggtatcgccgtggagcgcgggctggacatgattgtcggcctgctggcggtgctcaaggccggtggcgcctacgtgccgctggaccctgaatacccccaggaccgcctgcactacatgatgcaggacagcggcatccagctcttgctgacccaggcgccactgcttgaacgcttgaaggacggcgtagcggtgccgcacctgtgcctggacctgcatgagcacagcctgcacggctaccccctggacaatccgcgctcgcgggcccaggccggcaacctggcgtacgtgatgtacacctccggttccaccgggcggcccaagggcgtggatatcagccacgctgccttgagccggcacgcccaggtttcccgggattatttcaagatgaccgccgaggaccgtgggctgcagttctccaccttcaacttcgacgccttcgtcgagcagctgtacccggcgctgatctgcggcgcctcggtggtgatccgtggcaaggacctgtgggacagcgagaccttctaccgtgagctgatcgggcagggcatcagcatcgtcgacttgagcaccgcctactggttcatgctcggcaaggattacgcctgccgcgaaccccgggacttcgggcgcctgcgccagctcaacctgggcggcgaagccatggcggccgaaggcgtggccgcgtggaaaaaggccgggttgaaggacgtttgcctgctcaatacctacgggcccaccgaggccacggtgagtgtcaccgcccatgactgcagccgctacctgcgggacgacgcaaccctgccgagccagatccccctgggcaagggcctgccgggccgttccatctacctgctggacaacagcggcaacctgaccctcaagggcgccaccggcgagctgatgatcggcggcgagctgttggcccggggttaccacgatcgcccgggtctcacggcggagcgtttcatccccgacccgttcagccagaacggcgggcgcctgtatcgctccggtgacctggcgcgctacgacgccgagggcgtgatcgattacgccgggcgtatcgaccaccaagtgaagatccgtgggttccggatcgagatgggcgagatcgaagcgcgcctgctggaacagccccaggtgcgcgaagccgtggtgctggcccaggaaggggcgggaggtccgcagttggtggcctatctggtcgccgcagaaggcgtcgcggcgcagagccaggacgaccaggcccggttgcgcgacgagttgaaagcggcgctcaaggcggtgctgccggactacatgctgccggcgcacctgctgttcctcgaagcgctgccgctgagccccaacggcaagctggaccgcaaggccctgcccaaggccgacgccagcctgctgcagcaggcctatgtcgcgccgcagagcgagctggaacaacaggtcgcggcgatctgggccgaggtgctcgaagtcgagcgagtgggcatgaacgataacttctttgaatcaggtgggcattccttgttggtaaccgcgatggtctctcgagtccagctcaagcttgggcgtcaagtcagtgtgcagatggcgttcgaatttccaaccctgggactgttcgtcagtcagttgcagcaggccccgggccaggcgcagggcgccgacctgagtgcgctggcgctgttgctcgacgaaatggaggctgtgtaatggataacgccaccgcgctgaagattgtcaaaggcttcatcctgctgccgctggagaagcgcaaggtctacctgcagaagatgctggagcagggcatttccccggccaacctgccgattccgcaggtgcgtctgagccaggcgcgcctgccgctttcctatgcccagcaacgccagtggtttctctggcaactggcgccggacagcaccgcctatcacatccccaaggccctgcgtctgcgtggccggctggacgtggaggccttgcagcgcagcttcgacacattgattgcccgtcatgaaagcctgcgcacgcatttcgtcgaggacgccgacgcggctgtgcaagtggtactgcccgaggtgcgcctggaaatcgcccgccagtcgctgccggccatggccgatgaacgcgagatcgacagcgcggtgcagggcttcgtgcaggcccagacccggcagttgttcgatctgctgcaagggcctttgctcagggtcggcctgttgcgggtggccgaggacgaccatgtgctggtcctgacccagcaccatatcgtttccgatggctggtcgatgcaggtcatggtggatgagctgatgagcctctacatcggctacagccaggggcaacagccccagctgccgccactgccgatccactacgctgactacgccatctggcagcgcaactggatggaagccggtgagaaggaacggcaactggcctactggactgtgcagctggggggcgagcagcccctgctggaactgccgctggaccgtccgcgcccggccgtccagagccatcgcggcgcgcgcctggaactgatcctggagcagccgttgagtgaagccctgggcagcctggcccagcgtgaaggggggaccctgttcatgttgctgctggcctcgttccagaccttgctgcaccgctacagcggccaggcggatatccgcgtcggcgtgcccatcgccaaccgcaaccgggtcgagaccgagcgcctgatcggcttcttcgtcaatacccaggtgctcaaggccgagatcgacgggcagatgtccttcagccaactgttgcagcaggtgcggcaaaccgccctggcggcccaggcgcatcaggacctgcctttcgagcaattggtggaggcgctgcaaccggagcgcagcctgagccacaacccgctgttccaggtgatgttcaaccatcaggtcgaggccgcggctccagccggcgccctcaacctgccgggcctgagcatcgaagccctggactcggcggggcagtcggcgcagttcgacctgaccctggacaccgtcgagacccagggccggatcgccgccgcgctgatctatgcgaccgatgtattcgatgccgcgaccatcgagcagatggccggccactggcgccagttgctgcagggcatggtccgccagcccgagcagcgcattggcctgttgccgatgctcgacgccggggagcaggcgcggatcgtggcccagtggaatccgcagccgcaggcattcccctcgacggcctgcgtgcaccagctgatcgaggcgcaggcggcgcaggcgcccgaggccatcgccctgacgttccaggggcagcacctggactaccggcagctcaatgaacgggccaaccgcctggcgcacaaactcatcgagcagggcgtggggcccaatgtgctggtggggttggcggcggagcgtggcctggagatgctgatcggcctgctggcgatcctcaaggccggcggtgcctatgtgccgctggacccggcctatccccaggaccgcctgcaacacatgatgcaggacagcggcatcaggctgctgctgacccaggcgcctctgcggcaggggctgccggcatttgccggcagcaccctgttgctcgagcagccgctcgaggactacggggtgcacaaccccgaggtcggggtgaccccgcaggacctggcctatgtgatctatacctcaggctccaccggcaagcccaagggcaccttgcagccccatcacaacgtgctgcggctgttcgcggcgaccgccgactggttccgcttcggcccgcgggatgtctggagcctgttccattcctatgccttcgacttctccgtgtgggagatctttggtgccctgatgcatggcgggcgcctgttgatcgtgccccaggaggtggcgcgctcggcccaggacttctacccgctgctctgcgccgaaggggtcacggtgctcaaccagacgccgtcggccttccgccagttgatgcacgtggcctgcgccgccgaacagggacatgcgctgcgctacatcgtgttcggcggcgaggccctggaggtcaataccctgcaaccctggttccagcgattcggcgaccgccagccgcagctggtgaacatgtacggcatcaccgaaaccacggtgcatgtcacctaccgcccgctgtcccgggcggacgtgacgctggcgggggccagtccgatcggcgagctgatccccgacatgtcctggtacctgctggacggcaatctgcaaccggtgcccaagggttgcatcggtgagctgtatgtcgggcgcgccgggctggcctggggctacctgaaccgcggcgacctgagcgccgcgcggtttgtcccggaccccttcggcgaacctggcgcgcgcctgtaccgtaccggcgacctggcgcgttaccaggccgatggttcgatcggctacatcggtcgcatcgaccatcaggtgaagatccgcggtttccgcatcgaactgggcgagatcgaggcacgcctgctggaactgccggcggtgcgcgaggcagtggtcctggcccaggaggggccggacggtccgcaactggtggcctatgtggtgccggctggcccggcctggaatgacctggcctggaacgacacggccctggccgacgtgcaactgaccctgcgcgaacacctcaaggccgggttgcgcgagcatctgccggcgtacatggtgccggcccacgtgctgttcctgccggccttgccgctgaccgccaacggcaagctcaatcgcggtgccttgcccgctgtcgacagcggcttgcggcagcgcgcccatgtggccccgcgcacggaacttgaggcacaggtggccgggatctgggcccaggtgctgaagctggaccgggtgggcctgagcgacaacttcttcgaactgggcggccactcgctgctcgccacccaggtgatgtcgcggctgcgccaggaactgggcatcgaggcgccgctcaaacggctcttcgaaggcgagtcgctggaacacttcgtgggtctgctggcagctgaaaccccggccgcgctggaagcgattcccctagtggatcgccagcagcccctggcggtctcctatgcccaggaacgccagtggttcctttggcaactggatgccgatagcagcgcctaccacatccccatggccctgcgcctgcgcggcgccctggatgacgcggcgctgcagagcagcttcgatgccctgatcgctcgccatgaaaccctgcgtacgcgctttgtcgagggcccccagggcctgactcaggtgatcgaggcccaggcccgcttgcagatcgaccggcaggatctgtccctgctggtggagcccggcaacgccgaacaattgatcgagcaggtgctcgaggcccaggtacgccaggccttcgacctgcgccaggggcctttgctgcgggccaccctggtgcgcctggcggcggacgagcatgtgctggtgctggtgcagcaccatatcgtctccgatggctggtcgatgcaactgatggtcgaggagctgatccagctgtatggcgcccatgcccaggggcacccggcacagctgccggcgctggcggtgcagtacgcggactacgcggcctggcagcggcaatggatggacgccggcgagcgtgaacgtcaattgggctactggctgcggcaactggaaggcggcacccaggtgctggacctgccactggaccatccccgtccgttgcagcaaagccaccgcggcgcgcgcctgggcatcagcctggacggcgcgttgccgggcgccttgaagcaactggcgcagcgcgaaggggtaaccctgttcatgctgttgctggcctcgttccaggtgctgctgcaccgctacagcggccaagcggatatccgcgttggcgtacccaccgccaaccgcaaccgggtcgagaccgagcgcctgatcggcttcttcgtcaatacccaggtgctcaaggccgaggtcgacgggcaatcgagcttcagcgacttccttggtcaggtcaaaggccgtgccctggaagcccaggagcaccaggacctgcctttcgaacagttggtggaggccctgaacccggagcgcagcctgagctacagcccgctgttccaggtgctgttcaaccaccaggccgccgcccgccagggcgcccggggcctggtggtgcccggcttgcaggtggagatgctcagcggcgaggagagcagtacccagttcgacctgagcctggacaccttcgagtccgacgatggcctgtgggcgtccatgacctatgccaccgacctgttcgaggcgtcgaccatcgagcgcctggcccagtcctgggtgcagttgctgcagggcattgtccagcagccgcgccagcgcctgggggatctgccgctgctggcggcctccgagcagaataagttgctgcacgagtggaccccggccacgggtgaattcccctgcgatggctgcgtgcagcaactggtggaagcgcaagcactgaaaacccccgaggccgaagccctgttgttcgccgggcaaagcctgagctaccgggaactcaatgcccgggccaaccgtctggcgcacaagctgatcgaactcggcgtcgggcctgaagtgcgcgttggcgtggccttgcagcgcaccccagagatggtcgtggccctgttggcggtgctcaaggccgggggcgcctatgtgccgctggacccggcttatccacaggaccgcctggcccatatgctgcgcgacagccaggcgcagattctgctgaccgagggcgcactgttgtcgctgctaccggctgtcgaggccctgcaaaccctgcaactggatgcgcaaccgggctggctggatgcttactcgaccgacaatccggcgccgcgagcgaccgcggacaacctggcctatgtgatctacacctccggttccaccggcctgcccaagggcgtggcgattgcccatcgcaacgtgctggcgctgatcgactggtccagccgggtgtactcggccgatgacctgcaaggggtgctggcctcgacttcgatctgcttcgacctgtcggtgtgggagctgttcgtgaccctggccagcggtggctccatcgtcctggcgcgcaacgccctggagctgccggaactggccgatcgcgaccgggtacggctgatcaacaccgtgccgtcggcgatcgctgcgctgcaacgcagcgggcagattccgcccagcgtgcggatcatcaacctggcgggcgagccgctgaagcaggcgctggtggatagcctctaccagcagccggggctggtgcatgtctacgacctgtatggcccttcggaagacaccacctactcgacctacacccggcgcgaggccggcggccaggccaatatcggccgggccatcagcaatacccagagctatatcgtgagcccggatttgcaaccggtgccggtgggcagcgccggcgagttgtacctggccggtgccggggtgacccgtggttatctggcgcgtccggggctgaccgccgagaagttcgtgcccaatccgttctccagcgacggtggccggctgtaccgtaccggcgacctgacccgctatcgtgccgatggggtgatcgagtacatcggccgtatcgaccatcaggtgaagatccgcggtttccgtatcgagctgggggaaatcgaggcacggctggtgcggcaggcggcggtgcgcgaggccttcgtcctggcccatgacggtgaaaacggccagcaactggtggcctatatcgtgccgagcgaaaccaccgcggccgtcgaggcccaggctgcgctccgggaaagcatcaagactgccctgaaagaacatctgccggactacatggtgccgacctacctgctgttcctcgaagcgttgccgctgacgccgaacggcaagctggaccgcaaggccctgcccaaggtcgacgcgcagttgatgcagcaggtgtatgtggcgccgcagagcgagctggagcagcaggtcgcggcgatctgggcggatgtgttgaaactggaccgggtgggcctgagcgacaacttcttcgaactgggcggccattccctgctggtggcccaggtcgtgacccgggtcaagcagcagttcggggtggatattcccatcaagtcgctgttcggcgcggagagcctgtcggcctttgtcgagaaggttcaggccctgcgggaaacaacctcttcactgcaggatgaattggctaaatctttggaggccctcaaacgtttatctcctgatgatcttgaaaaaataatttcttaggagaggtagtacatgcaagctttaatcgactcggtaggcacgctttctgccaaagaaagaaaagccctggcgattttgcttaaagaaaagggcatcaacctttttggtatcgctcctatctgcagccgcggcgccgatgaggcgccggttctctcctatacccaggaaagccaatggttcctttggcaactggagcccgacagcagcgcctaccacatcaccacggcgttgcgcttgaccggagagctggacctggacgcgctgcgccatgggttcgacagcctgattgcccggcatgaaaccctgcgtactaccttttgcgaagaagatggcatcgcggtgcaggtggttcatccaccggcgccgctggacatcgaggtcatcgatctgcaagccggcggcctgtcttatgaggaacaggtcaacgccctgaccgacagcaagcgccagcctcccttcgacctgcgtaacggcccgctgctgcgagccagcctgttgcgagtgacggcggatgagcatgtgctggtcctgacccagcaccatatcgtctccgatggctggtcgatgggggtgatggtcgatgagctgatccagctctatgccggctaccgccagggacgcacggtcaacctgccggccctgccgatccaatacgccgactatgccaactggcaacggcagtggatggacgccggcgagcgtgagcggcaactgggctactggctgcagcaactgggcggggaacagccgctgctgatgctgcccctggaccattcgcgcccggcgatccagagctatcgaggcgcgttgttcgacatcccgctgggagatgaactgcgggtcggcctcaagcaactggcgcagcgtgaaggggcgaccctgttcatgctgttgctggcctcgttccaggtgctgctgcaccgctacagcggccagacggatatccgcgttggcgtgcccaccgccaaccgcaaccgggtcgagaccgaacgcctgatcggtttcttcgtcaacacccaggtgttcaaggccgaggtcgatggccagctgggcttcattgacttcctgcaacaggtcaagcagaccgccttgatggcgcagtcccatcaggacctgccttttgaacagctggtggaggccctgcgccccgagcgcagcctgagccacagtccgctgttccaggtgatgttcaaccatcagaccgcggtcaagaagggcgcgcagagccagcgcctggacgacctcagcatcgagaccctgagctggcaggggcgcgccgcgcagttcgacctgaccctggacaccttcgagtccgaggatggcctgtgggcttcgctgacctatgccaccgacctgttcgagccctcgaccatcgagcgcctggcccagtcctgggtgcagttgctgcagggcattgtccagcagccgcgccagcgcctgggggatctgccgctgctggcggcctccgagcagaaccagctgctgcacgagtggaccccggccaccggtgaattccccagcgatggctgtgtgcagcagttagtggaagcccaggcacggaaggcccctgaagccgaagccctgttgttcgccgggcaaagcctgagctaccgggaactcaatgcccgggccaaccgtctggcgcacaagctgatcgaactcggcgtcgggcctgaagtgcgcgttggcgtggccttgcagcgcaccccagagatggtcgtggccctgttggcggtgctcaaggccgggggcgcctatgtgccgctggacccggcttatccacaggaccgcctggcccatatgctgcgcgacagccaggcgcagattctgctgaccgagggcgcactgttgtcgctgctaccggctgtcgaggccctgcaaaccctgcaactggatgcgcaaccgggctggctggatgcttactcgaccgacaatccggcgccgcgagcgaccgcggacaacctggcctatgtgatctacacctccggttccaccggcctgcccaagggcgtggcgattgcccatcgcaacgtgctggcgctgatcgactggtccagccgggtgtactcggccgatgacctgcaaggggtgctggcctcgacttcgatctgcttcgacctgtcggtgtgggagctgttcgtgaccctggccagcggtggctccatcgtcctggcgcgcaacgccctggagctgccggaactggccgatcgcgaccgggtacggctgatcaacaccgtgccgtcggcgatcgctgcgctgcaacgcagcgggcagattccgcccagcgtgcggatcatcaacctggcgggcgagccgctgaagcaggcgctggtggatagcctctaccagcagccggggctggtgcatgtctacgacctgtatggcccttcggaagacaccacctactcgacctacacccggcgcgaggccggcggccaggccaatatcggccgggccatcagcaatacccagagctatatcgtgagcccggatttgcaaccggtgccggtgggcagcgccggcgagttgtacctggccggtgccggggtgacccgtggttatctggcgcgtccggggctgaccgccgagaagttcgtgcccaatccgttctccagcgacggtggccggctgtaccgtaccggcgacctgacccgctatcgtgccgatggggtgatcgagtacatcggccgtatcgaccatcaggtgaaggtccgcggcttccgtatcgagctgggggaaatcgaggcgcggctggtgcggcaggcggcggtgcgtgaagccttcgtcctggcccatgacggtgaaaacggccagcaactggtggcctatatcgtgccgagcgaaaccaccgcggccgtcgaggcccaggccgcgctccgggaaagcatcaaggctgccctgaaagaacatctgccggactacatggtgccggcgtacctgttgttcctcgaagcgttgccgctgacgccgaacggcaagctggaccgcaaggccctgcccaaggtcgacgcgcagcagctgcaacaggtctatgtggcaccgcaaagccagctggagcaacggatcgcggcgatctgggctgatgtgttgaagctggaacaggtgggggtcaccgataacttcttcgaactgggcggcgactcgatcatctcgatccaggtggtcagccgcgcgcgccaggccggtattcgcttcaccccgcgggacctgttccagtaccagacggtgcaaggtctggcggcggtggccgagcagggcgagggcggggtgcggatcgaccagggtccggtgcgcggcagcacgacgctgttgccggtgcagcagtggttcttcgaggcgtccatgagcgagcgccatcactggaaccagtcggtgctgctcaagccggcccagccgttgcgtgccgacgtggtggaaaacgccttgcaggcgctatgggtgcagcatgacgccctgcgcttgcagttcaaccagcaggccgatggctggtcggcgcggttcgccgatgccggccagcggccgagcctgctctggcagatcacggcgcagagcacccaggccatggagcaatcggcgatcgaggcccagcgcagcctgaacctgcaggacggaccgctgttgcgggccgtgctgttcagcctggcggacggcagccagcgcctgttgctggtgatccaccacctggtggtggacggggtgtcctggcggatcctgctggaggacttgcaactggcccacgcgcaactgagcgccgatcagcccctggcattgccggccaagaccagctcgacccaggcctgggccgagcagatgcaggcctatgcccaaagcgcggcgctgcaacaggaactcaagtactggcaggcccagttgcaaggcgtcgagtcgagcctgccgctggatcgccccgtgaccgcgttgcagaaccagcatgccagcagcctgagttcgcgtctggacaaggcgcatacccagcgcctgttgcaggacgccccggcggcctaccgcacgcagatcaacgacctgctgctcacggccctggcccgggtcatcacccgctggaccggcgaggccagcgccctggtgcaactggaaggccatggtcgcgaagagctgttcgatgacctggacctgacccgcaccgtgggttggttcaccagcatgttcccggtcaagctgacgccgcaggcggccctggccgactcgatcaagcagatcaaggaacagctgcgcgccgtgccgaacaagggcatcggctttggcgccctgcgttacctgggggacgaggcggcccggcaggccctggcgaccctggccgtaccgcgcatcaccttcaactacctggggcagttcgacggcagcttcgacgaccaggattccctgttcaaacctaccggtgaagccaagggcgaagaccagagcccgctggccccgctgagcaactggctgagcctggatggccaggtctatggtggcgagctgagcctgagctggaccttcagcacgcagatgttcgacgccgcgaccatccagcgcctggcggacgactatgccgaggaactcaaggccctggtggagcattgctgcgagccgggccagggcggggcgacgccgtcggacttcccgctggccggcctgaaccagcagcagctggaccgcctgccggtggcgctggcccagatcgaggacctctaccccctgtcgccgatgcagcagggcatgctgttccacaccctgtacgagcaggccgcgggcgactacatcaaccagctgcgggtggacgtggacgggctcgatccgttgcgcttccagcaggcctggcaggcggccatcgatcggcatgacatcctgcgcaccggctttatctggcagggcgaggtgtcgacaccgctgcaggtggtgcacaagcacatcgccctggagtgcagcgagcacgactggcgtggccagccacagccgcaggaagccctggccgccctggccgccgccgagcgccagcgtggcttcgaactggatgcggtgcctttgctgcgcctgaccctggtgcgtatcgacgaccagcgtcatcacctgatctacaccaaccatcacatcctgatggacggctggagcaactcgcagttgctcggcgaagtgctgcagcgttatgccggccaggcgccgaaccatgcgcccggtcgctaccgggattacatcgcttggctgcaacgccaggatgcccaggcctgcgaacgtttctggaaagaacaattgcaggcgctggacgaaccgacccgcctgacccaggccctgtcccgggtcgcgcagatgccggccggcgccggccatggccagcaccatcgcgagctggacctggcgcagacggcacgccttggcgaatttgcccggcagcagaaggtcaccatcaataccctggtgcaagccgcctggctgctgttgctgcagcgttgcaccggccaggaaagcgtggtgttcggcgccacggtggcggggcgtccggcggagctcaagggcatcgagcagcaagtgggcctgttcatcaacaccttgccggtggtggccacgccacgtccggacatgaccgtgagccaatggctgcaggcggtgcagagccgcaacctggcgctgcgcgactatgaatacacgccgctgtacgaagtgcagcgttgggccgggatgggtggcgatgcgctgttcgacaacatcctggtgttcgagaactacccggtgtccgaggcgctggaaaaaggcgcgccggcacaactgcagttcggcgcggtgggcaactttgagcagaccaactacccgctgacggtcgcggtcaatctgggccagagcctgtcgttcgaattcatctacgcccgcgagtcgttctccgaggcttcgatggtgcagttgggcgggcacttgcagagtctgttgctgagcctgatggcgcatccgcagacgggcctgggcgagttgccattgttgaccctggaagagcagcgcggaatccgccaggactgggatcacacgcatgcggtctatccgaccaaccgctttgtccaccagctgttcgccgaccaggcggccagggcgccggaggcgccggcggtgttcttcgccgaacagcgcctgagctatcgcgagctggatattcaggccaaccagttggcgcacaagctgatcgagctgggcgtcggcccggaagtgcgggtggccatcgccatgccgcgttgcgcggaaatcatggtggccttcctggcggtgctcaaggcgggtggagtttatgtgccgctggatatcgagtatccccaggatcgcctgcgctacatgatgcaggacagcggcgcgtggttgttgctgacccagagccacctgctggatcgtttgccgatcccggacggtttgccgaccctcagcgtcgaaggcgcggccgattttgcggcctatccggtgaccagcccagaggtagacctggccgaggaaaacctcgcctatgtgatctacacctccggctccaccggcctgcccaagggcgtggcggtgtcccacggcccactggccatgcacagcctggccaccggcgagcgctatgaaatgagcccggcggactgcgagctgcatttcatgtccttcgctttcgacggctcccatgaaggctggatgcatccactgatctacggtgccagcgtgctgatccgcgacgacagcctgtggtcaccggaattcacctacgaacagatgcaccgttatggcgtcaccgtgggcgtgttcccgccggtgtacctgcaacaactggcggtgcacgccgaacgcgacggcaacccgccggcggtgcgggtgtattgcttcggcggcgatgcggtgccccaggccagctacgacctggcttggcgggtgctgcggccgaagtacatcttcaacggctacggtccgactgagacggtggtcaccccactgatctggaaggcccgtgccggcgatccgtgtgacgcggcctatgcgccgatcggcaatatcgtcggcaaccgcagcgcctacgtggccgatgccaacctcaacctgttgccggtgggcgtggcgggcgagctgtacctgggtggcctgggcgtggcccggggttacctggatcgtccgagcctgacggccgagcgttttatccccgacccttacagcaccacgggggcgcggctgtatcgcagcggcgacctgacccgttaccgcaccgacggtctggtggaatacgttggccgtgtcgaccatcaggtcaaggtgcgcggcttccgtatcgaactgggtgaaatcgaggcacggctgctggagcaggacccggtgctggaagtggcggtgatcgcccagcccgggccgagcggccagcagctggtgggttatatcgtgccagtggacgccgaggtggcgttgagcaacgagcgtcaggcgcaactgcgggaaagcatcaaggcccgcctgcgggaaaacctgccggactacatggtgccgacctacctgctgttcctcgaagcactgccgctgacaccgaacggcaagctggaccgcaagtcgttgcccaaggtcgatgcacagttgatgcagcagacttacgtggcgccgcaaaacgcgctggagcagcagatcgcggcgatctgggccgatgtgctgaagctggagcaggtcggcgtcaccgacaacttcttcgagctgggcggtgattcgatcatctcgatccaggtggtcagccgcgcccgtcaggccggcatccgctttaccccgaaagacctgttccagcaccagacggtgcaaggactggccacggtggcggagcagggcgagggcgggttgcagatcgatcaaggcccggtgcgtggcagcaccgcgctgttgccgatccagcagtggttcttcgacaccccggtgccggagcgtcagcactggaaccagtcggtgctgctcaaaccggcccagcctgtgcaagcggctgtcctggagacggccttgcaggctctgacggtgcagcacgacgccttgcgcctgcggtttgtcgagggcgaggagggctggagcgcagcgttcgccgagttcgacgagcagacgcaactgctgtggcaggccagcgtggccaacgaccaggcgttgcagcaattcagtgagcgcgcccagcgcagcctgaacctgcaggacggcccgctgctgcgtgccgtgctctttaccctggctgaccagagtcagcgcttgctgctgatcttccatcacctggtggtggatggggtgtcctggcggatcctcctggaagacctgcaggcgttgctgggcaaccggccgctgccggccaagtccagttcgacccaggcctgggccgggcagttgcaggcttatgccagcagcgcggccctgcaacaggagctgggttactggcaggcacagctgcaaggcgtcgactcgagcctgccctgggatcacgccagcgacgggctgcagaaccagcacgcgtgcagtgtcgatacccggctgagcaagcgcgatacccagcgcctgctgcaggatgcgccggcggcctaccgcacccagatcaacgacctgctgctgacggcattggcgcgggtcatcacccgctggaccggtagcgacagtgccctggtgcaactggaaggccatggccgcgaagagctgttcgacagcatcgacctgagccgcaccgtgggttggttcaccagtgtgttcccggtcaagctgacgccgcaggcggccctggccgactcgatcaagcagatcaaggaacaactgcgcgccgtgccgaacaagggcatcggctttggcgccctgcgttacctggggagcgaggctgcccagcagactctggcggcgctggcggtgccgcgtatcaccttcaactacctgggccagttcgatgccagtttcgatgaagagcaggcgctgttcacgccggcccgtgaagccaagggtgaagaccagagtgccgaggccccgctgggcaactggctgaccctcaacggccaggtctatggcggcgagctgagcctgggctggagcttcagccaggcgatgttcgagccagcgaccatccagcgcctggcggatgagtacgccgaggagctcaggacgctgatcgagcattgcagccagcccgaccaccgtggcgtgacgccgtcggacttcccgctggcgggcctgagccagcagcaactggatcgcttgcccgtgccggtggcgcagatcgaggacctctacccgctgtcgccgatgcagcagggcatgctgttccacaccctgtacgagcaggccgcgggcgactacatcaaccagctgcgggtggacgtggacgggctcgacccgcggcgcttccagcaggcctggcaggatgccatcgatcgccacgacattttgcgcagcggctttatctggcaaggcgagctatcgacgccgcttcaagtcgtgcacaagcagatcgtgctggactgtgtcgagcatgactggcgtggccaacctcaacagcaagaggccctggatactctggccgatgccgagcgtcagcgcggtttcgagctgagcgctgcgccgttgctgcgcctgaccctggtgcgcactggcgaaaaccgtcatcacctgatctacaccaaccaccacatcctgatggatggctggagcaactcgcagctgctcggcgaggtgttgcaacgttatgccggtcagttgccgagccatgtgcccggccgctaccgcgattacatcgcttggctgcagcgtcaggacgcccaggccggcgagcgtttctggaaagagcaactggtggccctggacgagccgacccgcctggcccagtccatggtggcggctgcgcaggcgttgagcgccagcggccatgccacccatctgcacagcctggatgcgcagcagacccgacgcctgggcgagttcgcccgccagcagaaggtcacggtcaacaccctggtgcaagccgcctggctgctgttgctgcaacgctgcaccgggcaggacacggtggcgtttggcgccacggtgtccgggcgtcccgcggaactcaaaggcgtggagcagcagatcggtctgtttatcaacaccttgcccgtggtggccacgccacgtccggacatgacggcgcgcgactggctgcaagcggtgcaacgccacaacctggccttgcgtgactacgaacatacgccgctgtatgaagtgcagcgctgggccggcctggggggcgaagccctgttcgacaacatcctggtgttcgagaactaccccgtctcgcaagccctggagcagggcgcgccaggacaattgcgcttcggtagcgtgggcaactttgagcagaccaactacccgctgaccttgctggtgggcgtgggtgaaagcctgtccctggagttcaaatacgccctggcgtcgttctccccggcagccatgacccggttgggcgagtacctggaaaacctgctgctgggcatcatgctcgacgcgcagcagtccctgggcgagttgccgttgctgggggccgccgagcagtcgcggattctccatgaatggaatccgccggccagccatttcccgagcgagcgctgtgtgcatgagctgatccaggctcaagcggttaaaaccccggatgcccaggcactgatcttcggtgagcaacgcgtcagctatcaggcattgaatgcccgggccaaccgcctggcgcacaagctgatcgaactcggcgtcgggcctgaggtgcgcgtcggcgtggccttgcaacgctcgacgcaaatggttgtggccttgctggcggtgctgaaagccggcgcggcctatgtgccgctggacccggattatccgcaggatcgcctggctcatatgctgcaagacagtcaggcgcagattctgttgaccgagcgcgcattgttggaagtcctgccaacccttgagtccgtgcgaaccctgcaactggatgccgacgctggctggctcgatgggtactccgcggagaatccacaggcggtggcgaccccggataacctggcctatgtgatctacacctcgggttcgaccggcctgcccaagggcgtggccatcgctcaccgcaacgtgttggcgctgatcgactggtcgctgcaggtttacagcccggcggatctgcaaggggtcttggcttcgacctcgatctgtttcgacctgtcggtgtgggagctgttcgttaccctgtccgctggcggttatatcgtcctggcccgtaatgccctggagttgcctgagctgccggcacgcgatcaggtgcgcctgatcaatagcgtgccgtcggccattgccgctctgcagcgtggcgggcagatcccggatggcgtacgcatcatcaacctggccggcgaaccgctgaagcagagcctggtcgacaagctttatgagaacccggggttgcagcacgtctatgacctgtatgggccgtcggaagacaccacttactcgacctatacccgtcgggaaaaaggcggtcgggccaatatcggccgggcgatcagcaacacccagggctacatcctcggcgcggacctgcaagcggtgccggcgggtagcgcggcggagctgtacctggccggtgccggggtcacccggggttacctggcccgcccggcgctgaccgccgagaagtacgtgcccaatccgttcgccacggacggcggtcgcctgtatcgcaccggcgacctgacgcgttatcgcgacgacggggtgatcgagtacatcgggcgtatcgaccatcaggtcaaggtgcgcggtttccggatcgagctgggcgagatcgaagcgcgactggtgcaacaggaggcggtacgcgaagcctttgtcctggcgcaggacggcgatggtggccagcaactggttgcgtacatcgtgccggccgataccgacgtagcgctcgatgtggcgcgccaggccaatctgcgtgaggccatcaaggcgcggctcaaggacaacttgccggactacatggtgccggcttatctgttgttccttgaggccttgccactgacgccgaacggcaagctggaccgcaaggccctgcccaaagccgatgccagccaggtgcagcaggcctatgtcgcgccgcaaaccgagctggaacaacaactcgcggcgatctgggccgatgtactgaaactggaccgggtcggcctgaccgacaacttcttcgaactgggcggccattcgctggatgccttgcgactggtcagtgagatcaggcaggccttggggctggagttgagcctcaacaccgtcttcacttcgcccgatgtgcagcaaatggcccggttcgcgactacgcgccaggcgtccaaggctgacaacatcgtcgcgctgggcggaaccgggcagccggttttctgtttccacccggcgggcgggaccgtctattgctacctctcgctggcggcgcggctcaaggaccgttatgcggtctacggggtgctgaacgaggcctatctgcaggaggactggagcgaaacctcatggcaggccatggtgcagcgttatgtcggcaatatcaggcaggtccagccgcacggcccttatcgtttactgggttggtccctgggcggttccatcgccatggacgccgccagcgaactggaggccatgggcgaagaggtcagcttcctcggactgttcgacccaaccccgcccgaggatgccgcgcatcggcaggtcgagttgcaggttcctgccgcaacattggccgccgagtccgaatggcgggccgtgatcgacaagctgagcctgctctatccggcacaggccgggctgattggcagccgcttgagagacgaggcgcaactgtcctgggacagcatctttgcctggatggtcgcccataccgacctgccgcgcgcggagctggaccgggcggtgacgctgttcaaggccgagttcgacagcgcgctggtgaacacggtgttcaacgacctgcgtcggctgtttgccgcctatagctaccgaccgctgcgggtcagcccgcatctgtggtggtccgcggactacagcgaggcccgggtcatgcggctggaggaggccatcagtgccctggcgggaggtcagcgtccaggcagttcgctcagggtcgagtcttgccatgaagacatgatcgtttcgcctgccttgctcgacagcctcagggagcgctttctggctcagcgttaagtgccacgccaaaggcccggatcagcgatgatccgggcctttttcattgcgttctgctgagtttgcggccgccccgcgggtgcagatgacttccggcacccggggtgggctcggcgatgaggcgcacaggcgtccggcggccgctgcaacagcggataaggtgtggctcggtcgagcgggaaggggagcgaggcggggaggggaggggagggaagcccaggatgagcgcggtcatcctgggggggagccctgggtcagccggtgggccgggcagggcgggcagcggggttcaagcggggctcaaagcgaccagcgtaccgttaccatggcattgcgcggatcgccatactggttgatgccatagaccgtgttggtgccgatgctctgatagtacttcttgtcgaaaacgttattgaggttcaggcggatatcgacatgctccgaggctttgtagctggtcatcaggtcgaccagggtgtaggcctcttgttcgatgcggaatttgctcgtcgtgtcatagaagttggtgccctggttgtagatggtgttctgccgatacacgccgccaccgatggtccagcgattgagatcgccgggcagctggtaggtggtgaaggccttgaacacatggcgcgggatatcggtgtcgtacaggcgacccttgttgtccgggttggagtccttggtgtatttgactgaggcgtaggtgtagccggcccccagttcccagcccggggccagggatccgttgatttccagctcgataccttggctgcggacttcgccggcggcttcatagcaggtggtgcctgccggggtgcactggttggggctcacttccttggcgcggttttcctggtcgatgcggaagatcgccgcgctggcattcaggctgccgtcgaagtactcgcccttgatacccagttcgtagttcttgccttcgatgggcttgagggcgttgttggaggtgtcgagttcggtctgcggcttgaagatgtcggtgtagctgacatagaccgagtgatgttcgtccaggtcatagatcgccccggcgtagcgggtcaggtgccgcgttaccttgttgggcaggctggaggaatacggcctgccgttccaggcggtggtgacgtcgtatttgtaccagtccaggcggccgccgaggatcagcttgaggtcatcggtgaggttcaggcgcgtggtgacataggtgccttccagctcgctggtgcggtgctgcgtccaggggttggcgctcatgtccggcttgggaatgccgctggggttgttcaggtcggtatgggtctccaggtcgatgggcaagcccttgccgttgaacgtcagttcgcgcttgctggcgcccaccaccagttcatgggtacggccgaacagcgagaacggcccggtgacataaccgtcgtagctgctttgcttgtccttgtagtcgtaccggccgatgttctggccgaactcatcgtagtcggggcccatgcgctccgggatggagccgagcatgctcaggtcggaccagctcctgctggcggccaggagcattttccagttgttggcgaagcggtactccaggcgggtgaacgccgtggtgttgtcctggtcccagtattcccagtcgctgcccaggtaagtggagcgcttgaggtgcaggtcgctgccgtccttggccacgggcaggccgccccaggcagtattgttattggcgttctggttggagatgccgaaggtgaaggtggtgtcttcgttcaggtcggcctcggtgatgccatagaacaccgagcgctcggagctggtgaaatcctggaagctgtccttggtctggtaggcggtgactatccggccacgcagggtgccactgtcgttcaaggcattggaggcgtcgaattcggtgcggtagttgtcccagctgccggcgctgccggtgacggtgacccgcggggtggcggtcgggcgcttgcgcaccatgttgaccgccgccgaagggctgccggccccctgcatcatgccggtggcgccacgcaccacttccacccggtcgaagatcgccatgtcgggggtggagttcatatcccggctgaggtagtgggtcaggtcattgggcaagccatcggtcatcaggttttcgatggtaaagccgcgggagtagaaggtcggccgctgcggaccgtccttggtcacggaaatccccggggtgctcttgagcacgtcctccagggttttcatgttctggtcatccatgcgctggcgggtgatgaccgtgaccgattgcggtgtttcccgggccgtgagggccagcttgctggcggtctgcatggccccggtggtgtaggagccggtgtcctcggtggtcatgcccaggccctgggcggtgatggtgctggcccccagttccagcgagcctgtggaagcacggttgagaatggtcaccgagttgcccttgagggaataggcgacccccgtgccattgagcagcaccgcgatggcccgctccgccgaatagctgccggtcagcgcgttgctgcgcttgccttgcacatcgtcagggctgtacagcacttgcaggttggcctggcgcccgaactcctgcagggccgacgccatggattgcgaagcgatgttgaaatggacttcctgggcctggacctgcgccatcaagggcagggtcaggcccaggcccagggtgcgcgaagccattctcggcgagaacgcctggcaaaggagggctttggccagaggagtcagtcgatgttgtgcgggcatgctcatgtgctcttagaagtccggcagatgtaatgattgttaatgctagtaattctcagttctgtctgtatgacgcaccagtggccataaaccggaaacaatcacgccggttgcagatcagtcatgactttgccggccttcatgcgcaccagttggtcggcgatatcgaagtaacgatcgtcgtgactgatgacgatgatggtcttgcccaggcgcttgaggtccggcagcagctcggtgtagaaaatccgccggaaggccgggtcctggtccgccgcccattcgtcgaacaccagcaccgggcgcccttcgagccaggcgttgaccagggccaggcgcttgcgctggccggtggagaggtcggtggtggtgaaggcgccgtccttgacgctgaccttgtgcgcgatctccaggcggtccaggtactggctggcgctgtccagtgactgctggccgccgccctggaccaggtcgtcgaacaggtagtagtcggcgaacacggtggtgaacagctggcggtagtcgtcccgggccaggtcggtcacggcctcgccgttcaggcgtatttccccggcctggggctggtacagccccagcagcagcttgatcagggtggtcttgccacagccgttctcgccgacgatgaacacgatatcgccctgcttgatgtccaggttgatcggccccaggtggaacggctcgctgccttccaccgcgggcgggctgtagctcacgccacgcagttcgaggctgtgcaccacgggtttcggcgcctcggtagcgtccagcagcaggtggggttcgggggaagagaaacgctcggacagctcgctgatgcggccgaaggcgatcttcgccttgcccaccaccggcaggtaggacaccaggttttccagcgggcctttcatgtacagcagcaccagcacgaagccggtgatcacggtcgggtccgggttcgggttgtaggcctgcatggccagggccaggccgatgaccacgaagaacagcatcgagccgaaggtcttggccaggatatagatgttcaccgaacgcacctggatcgaggcgatgcggtccgcggtttcccggatccggtgggtgttcatccggtagcggcgcgggcggtgcatgcgcagttccttggcgccggaggcaatggcgttgtagtagcgctgcagctcgtcttcctggtcgcgggccaggtcgaagccgcggatccctttgccgccggccacgtactgcacgctgatgccgatgatgatggcgaccaccatcatcaggaacatcggcaccgacaggtacgccaggtagcccaggcagccgagggtgacggtggcggcgatggccagcggggtgaaggcgaaggagaagtcgctgatggtgtcgacgtcgtgggtcagcaccgggatcaggcggtgggagcggtagcgttcgatctgggtgatgggcgccgagagcactttttcccccaggtccttgcgcagggcggcgatgatccgctggcccacgtagttggtgccgatatccgagacgatcgagctggtcagggccagcaggcacagggcggcgaaggtcagcaccacgccctgggtcatgccggtcgccgagtgcagggcgttgttgatagtggccagcagcagggtgatggccaggccgcctaccatgcccagggcaacggaaatcaccacagtggtacgaaagggtctgagcagggcgagcagtccgtgaaaggctccgcgcttggggtcggtcataaggggttcccggcagtgaatgaagggtcgaggcacaaagacccgtactcatgacagacgaaccgttggcgggagtatttagcgcggccgcgggcgtggataaattgcccggcgcctgattcgttcttgttttgcaggtgcgcgcgtaacgacgtcgtgcctggcccattcagcgagagcgagcaaatgacgaaaaagaatctggtgtatgtctggtccctgaggaacgcggcggccgacaaggccgggcagccggtggcctacaaggatcacgagcgctacatgaagtcggtgctggagttcctggtggagacgctgaaccagacgcccctgggcgacgcttataacctggtcggggtggtgtatgacgacgacgagcagtcgccacgggaccggcaactggtgagtgactacggcttcgcctatcagcccggccggcaatggctgtacccggcggacctgcgcgtgcaggggcgcctggtcaatgagctgctgctcagcgtgccgtccacctatcgccgccatccgcgcggttcggccgagcacatcgccggcaagcaggatttcgagcgtcgcctgcacgacaccctggtggaactgaaagccgacatcgtggtgctcgacggcctgctggtaatcctcgacgagctggtgcgtcccggcgcgcctttcgcgcggcggatcatgaacatccatccgggtatcactcgcctcgaatcgccctacgagcgccgcggtgcctatgccacctggaatgcgctgtacggtgcccgggggcagaaggtggtggactggaccacccgggaaaccgagccggtcgagccgctgtacatgaccggtgcctcgttccactacgtggacaacggcatcgattccggcgaggtgttccacgatgtgctcaacaccaccatcgcgccggaggacaccatcctcgaactgcgctggaacaacttcaacaacagcctgttcccggccttgcaggaaggcctggcgctgctggccgagacgctgcgcgagcagccggttggcgaatcccgcgccggcgcctgaggcttgcggcggtcaagcgcggcatcgcacttgaccgctgtcgatcggcctcttatttgtggccggtgccaggttgttccagctcacgggctacgcgaaagcccaggaagtcgccgcgaacctcgcgcttgcggctgttgcggttgcccgagcgggagaacaccggggcctcgccccagtcgttgccgcgaatctgcgcgtcgagacacacgccgcccgagtcttccatccaggcactgccatcggtgggcgcaccgacatagtcggggtgccagcagtcggcgacccactcatagacattgccgtgcatgtcatacatgccgaaggcgttgggcggatagctgcccaccggggagctgtagctgtagccgtccttggggccgtaagtgttggcgtgcttgctgatctggtactggccttcttcatcgaacgggaaggggaaggagccggtgctgccggcgcgcgcggcgtactcgcgttcggcctcgctgatcatccggtagtgctggccggtcttcttcgacagccactgggcatacgcctggacctcggcatagtcgacgcagaccgcgggctggcgcgggccttgttgataacgcggcttgctggcctggcacaggcggccgggccggtcgtcgccgtccttgatcaccgtgccggtctcgcggatgtaggcatccagctcgccggcggtcacgtggaaacggctgatggcgaagggcttgctgaaggtcaccttgtgcagcgggccttcgtcgggttccctgccgacctcgccttcgggggagcccatgacgaagctgccggcgggcagcaccaccatttccgggcagttcttgcagtccttgaacacgctgccgggcttggcgggttcggcggcctgggcagtgaggctgaccaggcagccgagcagcgcggcgagtgaggagcaggcgataggtttcatcatcaataaccttgtgcgatgtagagaaaagagatggacgaggctcaggcggtcttgccgccacgcagtcgcttgctcagcaggtccatggcgcggtcgatatccgcctcgctgttgagcaggccaggcgccatgcgcactacgggtcccgcgtcgcggtccaccgcatccaccaggacgcggttctcgatcagccaggcggcggtggcgtcggtgtccaggttcgggccacggaagaaggtgaagccggcggacagctgcgggctcaggggcgtcaccagctcgatgcctggcagttcctgcaggcgctgcttgaggtagctgttgagttggtggatgcgcgcctggacgttggccttgcccagttgcatgtgcagttcgaacgcctggtccacggcccagcggtgttcgaagctgtggtagccgccaggggtcatggtggtggcgaagtcctggttctcggagaaggtcgccaccatcggcgtcaggtgctcgagctttgccgaacgcgagcagaagatcccggtgccccgcgggccgaacatccatttgtgggtgccggcgacgaagaagtcgcaattgaggtcggcaaacgtgacgtcctccacccccaggccgtggacgccgtcgacgcagtagagaatccgctcgccctcgtcgcgattgcggttgtgctggtccaccagcttgccgatctcgccgatcggcagcttcacgctgctgcccgattgcacccaggtcatccccaggacgcgggtgttggggcggatgctgcgatcgatattgcccagcacctcgtcgatggagacctggtggggcgacttgaacagctcgatggtgcgcacctgggtgccatcgcgctgggtgcggtacttgagtgcgttacgggtcgagtagtgttcatgcaccgtggtcagtatttcctgcccggggcgcacgtggatgccgccatacatcatggccaggccttcggtggtgctgccggtcagggccacctgggcgggcttgatctgcaggtagcggccgacgctctcgcgcacctgggcctcgtgcttccaggtgtactgggtgtcgtagtccatggccatggccgggttgcgatccagcaccgcgcggtactgttcgatggcctcgcgcacgggcctggggtgcgaggtgatgaggaagttggccaggtgcacatagtccggatcgaggtcgaacagctggcgcaattgggcccattgctgggggctggtggcgggcgtggcggcggcccgggcctggccgatggcgaagctgcccaggggcagggcggcggccagcaggcccgcgtgcttgaggaaggtccggcgattggtcacgggaggggtctcgttcagggttcggtcggtcatggttcagtcggcgacggcggcgtgttcggttaaggcatgttcgacggcacgatcgatggcgtgtgcggcaggttgcgcggtgggttgcgccggcttggcgagttggcgcacctgttcccagacgcgcaggtagttctcgccccagagcttggcgatctcgatgtcggtgtagccgcgctggatcagctcggcggtgacgttgcggttgtccgccacgctcatccagccgttgacgccgccgccctcgttgaagtccgagctgatgccgacgtgatcgatgccgatctttttcaccgtgtagtcgatggcgtcgacatagtccttgaggctggccttgggctcttcttcaaggatgccgtacagggcgctggcgtactcgccgaagcgttgttccggccagatggtgatgaccgagtcgcccggcatcagggcgttctccaggccgggtagcggggccaggtcgaagcgcttgcgcagggcgttgagcttgtccagggtcggctggctgaggggccgcaggtaggtggagaagcccacgacctggaccaccccgccggtggccttgatgacctgcagttccttgtcgctgaggttgcgcgggatatccaccagggcccggggcgcggagtgcgaggccaccagcggcgcgcgggtcagggccgcgacatcgtccagggccttgctggacatctgcgagacgtcgatcaccacccccaggtcattgagccggtgcacggcctgcttgccgatcggcgagaggccgccgagggcgtcccgggtgtcgttgaagaacggcagcgggcgcgaggagtcggcccagtcgttgttgcccacatagctgaagccgaacaggcgcatgccgcgggcggcccacttgtccagctggtcgaggtcgtcgcccatggcataggcattgagcaggctgaccaccaccgccagcttgccttcggaggcgatgcggcgcaggtcggcgggggtataggcgatggctacctggttggggaagtcgcgcaccaggccctggatgatccggtagcgggtctcgcgctggtgccgggcttcttcgacgaagccggcggtggggcggtgcggggcgttggggccgttccacatttccggccaggcgagaatgctcagggccacgccggacatcctgccgcgaccggccttgaccaggtcgaactggcgatgggtgtccttgtccgcctcggtgccttcggtgccgaaatccaggggcacggtgacatggctgtcgaaggagatgatgcgctcctgcaggtcgttggcacgcttgacgatgtcgctggggtaagacacccggcctttccagtagtagtgccaggcggccccggcaccgacaccgagtacggcgacaataagtaccagcaggctcaggtagagggttttcttaccaggtaatttgatcattgctatcccagtcgcaggcgggctgatgacggggtcggggttgcaaacgcagtgcttccaggtccgaccttttgtgtacatctatccgcgataaacgagctggccggcggcaaatttagcggcctgggagtggctcgccggtaaatttccgtgcaaatccaacgttctagctagatgcgtgacgcgccactggatataggtagagcgatgaggttttcgagacgaggatttttgaccggtctggcggtgacgggggcggctattcctgtggcgctctacacccgcaaggagttgcagcgccaggacgtgcgccgtcaggaagagctggaaatcaccccgggggaagccaagctggaagtcgccctcgatccgggcgtgcgtctcgccgatcacctgcggggcatctgggacatcgagtttctggacacccaggcaccgctaccgcgtcgcggctgtgagctggtgctcgatgtcggtccgaccgggcgcggcctgcgtggctttctggggcgtccgcaaagcctgcgcggtgacggtccggtggagtttcgggtgcagggcgagctggcggcggtggacgccgcgaaattgtgctggcggctgttcgccgcaggccagatcggcggcgcgcccagccatgagtgccaggtggtgctcgacgaggtctgggcgagctggggcaatgccggcagcggcaccctcagtggcagcctgcaatcgttgcaggcttcgcccttggcgccggtctccgcggtgcgcttcgtggcgcgcaagcgggcctttcccgcggcccgggagcagaacggcctgagccccgagttgctggcctggctggtgtcgccgcagcatcgcctgttccaccagctctggcatgcctcccgggatcgctggcattccttgcccaaggacaagcgcaacagcctgcgggggcttggctggcagccgggaccgctcaagcacgagcgcgacgcccgtgggcggcgcaagcatcgcaacgcctcgggagtcgacttcctcttcatgcaccggcacatgctgttgcaggcccgttcgttacagccggacctggtgtcctggcaacagttgcccttgccgtcgccgcgcctggagcaggaccgccagggctttatccgctactacgaaaaccacgacggctgctcggtgccgccggcctggatcgccgacgacgatgaagagttcacccgctggctgcatggcttgaagagcgatgcggccttttatggcaatttccaggtctgggagtcgcagtaccaggaccccgaatacctcagccgcctgaccctggggcagttcggttcggaggtcgagctgggcctgcatgactggttgcacatgcgctgggccgatgtcgcccgggaccctgccaacggcatgccggtcatggaggcccgggtttcctcggacttcgccggacgctggtacctggcgcagaacgactttctcggcgacccgttctcgtcccatgtgcatccgatgttctggaagttccatggctggatcgacgaccgcatcgacgattggttccgcgcccatgagcgcttccatcctggcgaagtgctgcgtcgcgaggtcaacggtgtgccgtggttcgcgcccgggcgctgggtcgagatcgacgacccctggctgggggcctcgacccatggctgcggcccgctgggcaacgcgcctggagagatgtcgctggagatggaccaggaggtcatgaagctggccctgcgtatcgccctgagccgtgacgaggaggtaccacagctgctcaagcgggcaccgcggcgtccctggtacgcccagcacctgaaactctgaaccggtggaaaaggagcacgcttggggagtggttacttttgacatctacggctgtggggtgtccgttgaaaccgtagcgaaggttcttgaagggctcttcaaaccctagagattcgagtgggagattgtgtaggcacaccatttcgtcgcgcgttgcctgctactgctccgtcattagacgattgaatcaatatcaagcgtgtgtggcgcgccaatggcgtgtccgtagattgaagccaacagaccatcatcaacgtttgcagtgggggccatggccaattgttcgacgactctgttttccgggtgggcattccagcgaggcaggctctcggtcagcaggtcaggctgtgttgaaaccgacccataaacaaacttctggtcaatcgtcactcggcgcagggtctccaaacgctcgagggtcatttgcactttatcgacctcgcgattaagcgcctcgatgactagttcatgggctcgggcatagggaccagggttagcgttgagcatgcggcgcttgaggcgcagttggtcagtgatttttgtcaggtcccctttgacccgttcgacctctccatcggtcactcgcgaacgcttgagctccagggcctcctgccagcgtcgcaatgttgcccagcaaccagggatatagccgccgaccattgaatgattacccccggcaagaatctgcgaaatcaagcccggtctttcaggcaatcccttgttctgttgaatggccagggtgcaggccgcatgctgggtaatggtgtcgcaacctggctcccaaaggatggcggatttctccttgccacccaggtctactggaaagaagtggtacaacgtcccgtgatgctcatagggttctccgctcaggttggtaatacctgctacgaacaccgagaggcccaaggggacgttgacgaaggtcaaggctgcccctgtgccatagacagatgccttggtgttcatccaggtccccggcacgctgggcactgggtcgttatggttgaccatgcggtaatgcactaaatcggcagcaccttttacgaaggtcgcgtcagcggctcttggggagccgtaggtgtacagcacgatgtcatagcggtcagcacgacgacgtagcatctccgagagcagcaaggtgattgccccgcccaggctatggccgcaaatgaccagcttctgtccagtgtagaacttttcgagatagctggttgcgaggtcatagaccttcagtgcagcgtcatagaaccctcggtgcaccttacccttatccttgcctgtaccctgctcaaagggaacttgaagtgcatcggcatcacggagcccatccgcgaacttctcattggtgccgcgtactgcaattaggaccaactcatcgttatgcgtgataaacgcttgggtgtcggtgtccttgttctggcctcggtcatcaagaaaatgaatgctggccgggtgctcttgttcctctcctaaatccgggctattcgatggatacaggtcaggatcaaacggcacgatctccaggcgcttggagtacggtacgtcttcgtagagtgggtagtacgccttggcttgcccagggtccaccttccagatttcatcgaacttggccagggcatcgccaaaccagttacccatgctcggtttctgtggaaaactgacctccttctcgccgataggtgtcttatccggttcctgaccaaatgggttatagctcaaggtggccatgatggcgagttgatataggttcagcgcacagaactgcgaatcggtggagagcatcgggcgcaaggcccgtaaaggccgaacttccagtacgttgtgcttgttgggaagcaggcaaacaccgcgctcgccatactcgcacatcaacttggcccatcccggacggagtggatagtggcaatcgacctcaggtggtaagtgcgcaacatgttcgacgaaatgacgaacttcaacttggcagaagaaatccgcgcaagcttgcgccgggttgctttgggtccgcgagccgtctttatgatagtaacgggtttgctcggcacgaacttgaagctcggttattgggagagggtagaactgcctctgttgtagataggcataaagctcattgcttccttgatacttctcttcgataattaatgcgattgggccagcaaaatgattatctactttacctttgcccgtgccgtcgagctttccggtgtatgtgtagccctctgtgtcgatgactttataagacagtcctgcatatggctgcccctcgccaaactcatcgactaactgaaagctggtccatttaccttgaacagggcaggtaaacatacggttatttaacgggtgctttaattcttcatccaaggtggccattgagtgatttccttattctgtgcagccagggtaaatggagcattgcttgccatcgggcatgcggaatgtactgaagtctttatagttgccgaagcagaatgcatattggtcttcaaagcttttgcccatgcaacgtttccagccacccgggaccttgacccacgtatcgcctatagatggcttttcctcatcagccagtttgatattcagcttcacggttttacccggtagttgatccaaggtgtaagccccagcggggcgccctttcgtcaccatgccctgagcgtcaacttttttgcattcgaggagttttctaaggatgcgagtctttcctgatgtacggaacgaccattgacactggccatttatggcgctttctccagcagtatcaaaagttcttttttggtgttcttcaagttgctcgcgaacaacaattactgccgtatcactgccgaagtctccacgatcttctccataagtcgcgtaaatacccaattcgacgcgatagatggccagtcgacagcctttaactgtgcggtaaattggaactttatgttctggtttgtattccgtgcgccattcccgattaaaacccaggtaaggatcatcatcgagagtcaccgtacaggtttctccctcggcaggtgcatatttagctatcgcgtaataagcgaagttgggaggcagatcagcagtaaaggtaaagctctccgatttaccgatagcgcaccctgctaccagggccatacaggaaccccaaaataagcttttaaatattcgtgtcattgcgaggcgtctccttgccaaaattgcgttgccttataaacccgctggaaatgagctgccggagtttcctcagggtgcgcctgccagcgctcggcaagtgtaccgtctgtttcctttaaactctgggccaacaagaactccagttgctccgatgattgccagccccaagcatcagccaaggccaactgagcgttcagccataggccgggatcttgttgctcggccatttgggcataggcgtcgagatgttccgccaacagatagcgacgggcattgaccttgcgtaggtaggccgattggtcgccctcagcgggcacgttccaccacgcggggctttcagggactggatggtcacccggtgagggattgctgagcgttttccagtgctgaccttgccagtagcaagcgctgataatgggccccaagtagcccggaatggctcctgtgcttaaatgcatcagtgcgcgggtcaatactcggttgtcatggaagcgatagagggcctgatgcggccgcgttccgacaatcagccgttcgcgccaatgtctgaccagctcgtttagtcctgcttctggcgcaacactggccaaccaaccccagttcctttctggggccttgagcaactcgttcagttgtccatcttccgggttgtcgatgaggaacataaagggccctgcatccgccagatcagagaccggtgtctcgctgtacacgctgcaatactggccagcatcctgactgcctgatagaagccggcgagtgttgagttctccctcagagtccagaatcaggcatagcgaatgcccaagacggtgttgttcgatcatccattgctgaggcgccgttctggtcatgccgtggctccttcagtcaggcaaagaccatttttgcaggcctcgcagatcggacagaagtcagggcttttcaccttggagatggccatcagggcattctgggagggggcaatcatcggcgggagtgctggaggggtcgtcagggctgtcagtgccccaggcaatatgggattggccgcagtgcctcctaccggggcgccaccgagttgaatatcggaactgctgaagatccctccagggccaatcacgatgtgttgaccaccggccttcaaggtaatgctggcgcctgcgtccagaatcagattggctccggccttaaggtggacttcctgccccgcttcggcgaccagcgtttgacctacgcgggtatggctgctgttacctaccaacaagtagtcgttggccttgagctggactttgcggtcagcggtgacggtgcgctggtcctcagcttccagcacgacgatgctgttgcccttgatggtttccttacgctcgttgccgacttccaagcggctatcgttttcgactttctgttccatgtcacgttgggcgcgcaggtagatcagctcttggccgctacggtcttccagatgcaattcgttgaagccggtgctgtcgggcgagctgcgactgcggaaaacgctgcgagtcttgtgggcgggcagctcgtaagggacagggttagcgctattactcaagcaaccactgatcagcggaaaatccgggttgccctccaggaatgaaaccagtacctccataccgacccgagggatggtcaccgcaccgtggctggttcctgcccaactggaagcgacccgcaaccagcaactgcttttgtcatcgatcaggcctgcgcggtcccaatggaactggaccttgacccgcccatactggtcacaatggatttcctcgccttgggggccggtgaccacagcggtctgactgccgagtatccggggtttctcgtaggcctgttgcgggcggtagaacacgtcccacggagtggccgtgaaagtgttgcgatagccctgatggaagtcgtccttgcgctcgcgggtatcactgggaaggctctcttccagcacctggggttgcaagccttcgtggcgaattgaagtgagcagccagaggtcattccactcttggcgtggatgctcgcaaagctccagaaagtggccgctgaccagcgagggttgatcgcttttaccttcggcctgacggtagtcggcacgatgtccttccagggtccgttggctcaattgcttgccccgttcgcgctgaaggaaaccaccagggtagcggtaatcttccagatcaggctgcccgtcccgaggtgctgggcgatagtccgcctccagcgtcatgcgggctttctcgaagtcatagtcacgttgcgtggttcgactggtgcgggtcgcaaggcgcaggctaaaacgtttgatcacgggggcatcggcaaccagaccactgtcttgcacataggctgtcggtctgctcagcctggggaatatcgtctggtcgtcacccaataccagtacgtggccttgttgcgaatgttgaaagtggtaatggatgccttcttcccagcacaggcgctgaatgaagtagaggtcagattcgttgtactggacgcaatagtcacgggctgggtagatcgaccccaactgaaactggtaggcattgctttggataccgtgctcttcaagaacctgcgcgatgatgtgcgagacggtttgctgctggaatattcgttggttggtccggtgcgccagataggttaactgcgggaccagggtcaggctgtaacgggtcagacgcttaccggagtcgccttgcgcgatgcgataaacctgtccatgaataccggcgccactgttgttgaaggccagaaaggcctgcttgtgcaatagattttcaatgtccaggtcgggccgttcgctgaccaactccagatcaaatgaatagggcgcgctgatggattcttggccagtgaaggaaaggacctgaaggtcgtgcttgaagtcgttgagggtcaggctgaactgcgtctgtggactcgcattgaacatcccatgttccttttccaatcatgttgcgtggacccacatacccggagcaggcgcacggttcgcctgtgagtttgtggaaagccaaatcgattcacgctaacaagcaggaaaaagaaaagatctaggaaaggtcctgaaaacggcctgaattgtcatttgttcagggtttggcttgataacgcagcttttgctgggtgaacgggtccatcgcgagcaagaacaaggcgtcgctcctacagtcgctccactatcgaccttaacggactggcattaccccaagagagcgtttggtttaaggcttcttcgcttaccggctcttccagtcaccgcccagggctttgtacagggcaatgctcgactgcacccgggacagccgcagttgcacgttctggtcctgggcggcgtacagggtgcgctgggtttccagtacggtgagcaggtcttcggcgccagcctggtaacggctctgggcgatttcgaaggcccgctgcgcctgattcagttcttcgccttgccattgccgctgctggtccaggccgcgaatgctgttgagggccttttccacatcggcgaagccattgatgatcgccccgcggtagctttccagcagttcctgctggcgtgccgtggccctgtcgcgctcggcgcccaggcggccgttgttgaagatcggcgccaccagcgcggcggtcaggttgtagaaggggctgcgtagcacgtcatcgaatgtgttggcgccggagccgaggttggcggtcagggtcacgttgggcagcatcgccgcccgtgccaccctgacatccgcccgggccgccgccagccgggcttcggcgctggcgatatcggggcggcgggccagcaggtcgctgggcactccggcatcgatgtccggccagttcagctgggcgaaaggctggtcgctcagggtcaggctctgcactggccggccgaggagagcggcgagggcgatcagggcttcttcggcctgttgccggacctgcggcacctggcgctgctgggccgccaccaggcttttctgctgggccagctcgagagcggtggccgagcccgcgtcgtagcgggtctgcaccagcctgagcacgctctgcgcattggccaggttgagctcggcaatccggctctgttcccgcagcgacagcacctgggcgtaactgttggccacgccgctgagcagggtcaattccacggtggcccggtcgaactcgctggcctgtacgtccagcagggcgctgtcccgggcggcgcgcttgccaccccagaaatcgatttcataggtggcgctcaggccggcattgaaatagtccacggccttgttgttgctgtcggtatccagctggctgtagccgctgccccgcaggagcttctgccggttggcgttgaaggtgccgttgacggcgggcagcaagggcgcgccggcaatgacggcgctggcctgggcctgttggacccgggccatggccgccgccaggtcgtggctgccggcgcgggcttcggcgatcaggcggtcgagttccgggctgccgaattgcagccaccagcgtggatcttgctggcgcggcgcgtggctgacggcggagtgccaggcggcgggggcttgcaggccgctgtccgggcgcggcgccgggctgctgcaggcggccagcgccaggctggcggccaggagggtcaggtgcactttcataggtcgatcattcactggttagggccttgaccggatcgagccgggcagctttgcgggctggcatgaagccgaaggtgacgccggtgatcagggcgcaaccgaaggcccccagtatcgcggccagggagaaggccacggccacctcgctgaggatcagcacgccgccgatgatcagcgccacgccgatgccggccaggccgccgaccaccgagagcatcaccgcctcggtgaggaactggcgcaggatgtcgcgctggcgggcgccggtggccatgcggatgccgatctcccgggtgcgctcgcgcacggtcatgagcatgatgttcatcaccccgatgccacccaccagcagcgagatcgcggcgatggcgccgagcatcagcgacagggtgttctgggtccgtgcctcggcctggatcatcgcggcgttgttggtcagttcgaagtcgcgtttgccgccgtgcatgcgcagcatcagttcgtcgatttcgcgttcggtctgcttgacccggctggcatcggcggcggcaatcgccacgtactgcgggttgtggtcgccgaacaggcggatgctggcggcggagtagggcacggcgatgcggtcgtcgctgtcgctgtcgccggaactggcgcccttttccgagagcacgccgaccacctggaacggcacgttctcgatcaggatgtattggccgatggggttggccacgtccttgaggagtttttcccggaccttgtggccgatcaccgccaccgccgccgccgagcgttcgtcggcgtcgctgaagtagctgccctgggccacgggccagttgaaaatctccgggaagttggtgtcgttgccacctacatagctcatgtagtcggcgttgccgaagcggactccggccttcgcgccattgaccggcatgatgcgttttacctggggcaggttggccagggccgcgacgtcgtccagggtgacgatgccctcgggcgtgcgcgggttgggcgagtagccgctcaagtagatgatgttcgagccgaaggcgcccatctgcgccatgacctggcgcttgctgccttcgcccaccgccagcatcaccaccaccgaggccacgccgatgacgatccccaagagggtcagggcggtgcggaagcggttgatccacatcacccgccaggctgcttgcacggcgtccagcagctcgcctttccaggcgccgttgtgttcgctgccgtcggccaggcgctggcgcaggtccactgcctgcagggcgccgctgttggcgctggcctggacctcggggtgctcgtcggcggtgtcgctgacgatctcgccgtcgcggatttcgatgatgcgcttggcccgcgccgcgacttcgcggtcgtgggtgatgaggatcaccacgtggccctggctggccagttcgtcgagcaggctcatgacctcggcgccgctgtggctgtcgagggcgccggtgggttcgtcggcgaggatgatgtggccgccgttcatcagcgcgcgggcgatcgacactcgctgctgctggccgccggacaactggtgcgggcggttgccggtacggctggccaggcccaggcggtcgagcagggcggcggcgcgggcgtggcgctcggccgccggggtgccggcatagatcgccggcatctcgacgttttcctgggccgagccggacgcaatcaagtggtagccctggaacacgaagccgaaggcctggcgacgcagccaggccagttcgtcgctgtccagccgggcgacgttttccccggcgaacaggtactcgcccgaggtcgggcggtcgaggcagccgagaatgttcatcagcgtcgacttgccggagccggaggcaccgacgatggcgacgaactcgccggcgtggatcgacaggtcgatgccacgcagcacgtccacttgcggcgtgtcgccgccgccataggatttgcggatgcccttgaggtcgatcagcggggtttgcattcagcctccgctgctttgcgcgggaccgatcagcaagtgatcgccttcggcgaggccgtccaggacctggatgcgcaagcggtcgctgatgccgacccgtaccttgcgctcctcgatcgagccgtttttcgccaccacccgggccagctggacgccgctctcggtgctgccttgcagggcggcgatcggcgcggtgagaacgtcctgcgcgcgctcggcgacaaaaaacacctgggtggtcatctcggccatcagcgcgttgtcggcgttatccacatccagcagcacggtgtagagcaccacccggccgctgccgctcttgcttgaactgttggggctgccgctgccctggctgctttcattcagcggcttgggcgggatcggcaggatctgccgcacggtgctggtccagcgtcgggcgccgccgctcaaggtggtgaagtaggcggtcatgcccggcttgacgtggccgatatcggcttcggagacttcggcccagacggtcatcggcgacagccgggcgatacgcaggatcaacggcgtctgttgctgggcgttgagggtctggccttcgcgggcgtccaccgcgaccacggtgccggacatcggcgcgtagatccgcgtatagcccagctcggcctggtcgctgcgcaggctggcctgggcctggcggatctgtgcctggatcatgtcgatccgcgcctgggtggccttgagttcggcgcgggcggtctgcacgtcttcgtcgcgggtcgcgccgccggcggcgaggttctgctggcgctggtacttctgtcgggccagctcgttctgcgcccgctgctcttgcaactgggcctgcaggttctcgatggagaaacggctggcatcgagcttggcctgctgggtggcggggtcgatctccaccagcagctggccttccttgaccgggtcgccggcctcaacgtggatcttgcggatctgcccggacgcctgggcgccgacatccacgtaacgccgcggttgcagggtgcccagggcggtcacgctgctttcgatggtgccgcggctgacttggatggtggcgagctggtcgcgccccggtggcaggaactgccaggcggcaaaggcaacgacaggaatcagacacagggtgacaagcagggcgcgtcgggtatgacggggacgtttcatgcagggttccggccaatggaagtcggcccgtcgtccggcctggtccagggggtgggcagggctggaggctgtcgccagagcgacagatacggggagctgtcaggtagacgagaagcgccggagggaatttaagtcatgacacatggcgttacaggtgcgggggttacaggttaggcgacgaaaataaaaccggcgaatcgacacagcactttaaatctatatgagaattactataaattacgccacttctaaactgccatcatcgaatcgcccgcccaggggcggagtgccagtcgtgctcaaggacaaaagccgcgtatcgcggtcgggagtcatgttggaaaactactatcgcgagctggtgtgtttcctcaacgccaagctgggcaacctgcaggtggccgaagatgtggtgcatgacgcttacgtgcgggtgctggagcgttccagcgacacgccgatcgagcaaccgcgggccttcctctaccgcacggcgctgaacctggtgatcgacggccaccggcgcaatgccttgcgccaggtcgaatccctggatgtgctcgacaacgaagagcgcttcttcagcccctcgccacacaccagcatcgaccacggccagcgcctggacatgctgcagcgggcgctggcggagctgccggcgctgtgccgggaaagtttcctgctgcgcaagctcgaaggcctgtcccaccccgagatcgccgagcgcctggggatttcccgcagcctggtggagaagcacatcgtcaatgcgatgaaacattgtcgggtgcgggtccggcagtgggatgcccattgatccttctttgttaaattttttttcactgtcctcgttcctactcaacagacgacctgctgcctcgccatgggccgatcaggtcaccgtcgatttctccccgcgttgagggatttatccagaggacactggaaatgacacaggcaattgcatcgaccatcgttcacgacctgatcggtatcggtttcggcccctcgaacctggcgctggctatcgcgctggaagaacgtggccagattcagggtccgctggacgcgctgtttctcgacaagcaggccgactaccgctggcacggcaacacgctggtggcccagagcgacctgcagatttcctttctcaaggacctggtgaccctgcgcaacccgaccagcccgtactccttcgtcaactacctcaagcaccacggccgcctggtggacttcatcaacctgggcaccttctatccatgccgcatggagttcaacgattacctgcgctgggtcgccgggcacttccaggaacagagccgctacggtgaagaagtgctggccatcgagccggtgctgcataaccagcaggtcgaggcgctgcgggtgatttcccgcgacagccagggccaggaattcgtccgtaccagccgttcggtggtggtcagccctggcggcacgccactgatcccggacaccttcaaggcgctcaaggacgacggccgggtgttccaccacgcgcactacctggaacgcatggccagccagccgtgcgccagcggccagccgatgaacgtggcgatcatcggtggcgggcagagcgccgccgaggcctttatcgacctcaacgacagcttcccttcggtgcaggtggacatgctggtccgcggttcggcgctgaagccggcggacgacagcccgttcgtcaacgaagtgttctcgccggccttcaccgacctggtgttccaacagccgagcggcgagcgcgaacgcctggtccatgagtaccagaacaccaactactcggtggtggatgtcgacctgatcgaacgcatctacgggattctctaccgccagaaagtctccggcatcgcgcgccatgccttccgcaccctgaccaccgtggagaaagccaccgccaccgcccagggcgtcgaactggtgctgcgcaacacctccaccggcgagctgagcacccgccactacgacgccgtgatcctagccaccggctacgaacgccagactcaccgtgcgttgctggcgccgctggaagcctacctgggcgacttcgaagtggaccgcaactaccgggtcatcaccgacgagcgctgcaaggccggcatctacacccagggcttcagccaggccagccatggcctgagcgacaccttgctgtcggtgctgccgattcgtgccgaggaaatcgccgcctcgctgtacgagcacgacaaaggccgccacagccgttcggtgcgcgacctgctgctggccaccgccagctgattgcccgggtaacgttgtaggagcgagcgtgctcgcgaaacaatggcatggccggtctttgtcgtgggttgaccggacgcctcgcgagcaagctcgctcctacaggatcgccttatcgttgtaggcgcgagcttgcccacgacagggggcagacgtccccgcatttcctgcctttggggcctgtccgtagccccttcctgaaccttcgctgaagaacttttcgattcccccgtccgggcctttgccgccgatttactccgcaaaaaccgcggcgtaagcttcgcgcgttttccatcaagcggagacccacagtgggtacttgttcgagtgacagtagtcggccggtttcgctaaccggcgccttcccggcaagataacgcgcccgcttttttgtgccgttgtctcgccatgaccgcgagcgacggcttcccgagcgtggccttcagggcccgttcccgatgtctctctcatcgacactgcaacagtgggtgatgcctggcgcatcgccgcgctacggctgcgcctgtttgcgcggtcggcgaaccagacctggctgtgagtctcccggcgccgaccgttaggggacacaccatgaacctcaccctgctcaaagagttttttgccggcttcctgcggacccggcacttcgcccggcactttcgccgcctggccttgctggagagcttcagcgacgccagcgtcagccgcgacctgccgccgagcctcgcgcaaaccctggtggccgcggccaacgacgatgccgcgagcctgctgcaacgcctcggcagccacaccgatggcttgagcgaggccgaggcccaggccctgcgcgaacggcatggtctcaacgaggtcgagcacgagcagccgctgccctggtggacgcacctgtggcattgctacaagaaccccttcaacctgctgctgaccctgctggcggtgatctcctggctgaccgaagacatgaaggcggccacggtgattttttccatggtggtgctctccacgctgctgcgcttctggcaggaggccaagtcgaacaaggccgccgatgccctcaaggcaatggtcagcaacaccgctacggtgctgcggcgcaacgtggtcgacgccgcgccgtcggtgttcgcccggctgcatggcgtggcggtggccagccagggccagcaacgcctggaactgccgatccggcaactggtgccgggcgatctgatccagctctcggccggcgacatgatccccgccgattgccgggtgctcagcgccaaggacctgttcgtcagccaggcggcgatgaccggcgaatcgatgccggtggagaaattcccacgccagcaggacgccgccaccctcaatccgctggagctggacaacatcctgttcatgggcaccaacgtggtgtccggtgcggccaccgcgctggtcctgagcactggcaacgccacctatttcggcgccctggcgcagcgggtcggggccaccgaccgggcgccgacttcgttccagaacggggtgaacaaggtcagctggctgctgattcgcttcatgttcgtcatggcgccgctggtgctgttcatcaacggtttcaccaagggcgactggatggaggcgctgctgttcgcgctgtcgatcgccgtgggcctgaccccggaaatgctgccgatgatcgtcacctcgaccctggccaagggcgcggtgttcctgtcgcgcaagaaagtcatcgtcaagcgcctggacgcgatccagaacttcggcgccatggacgtgctgtgcaccgacaagaccggcaccctgacccaggacaagatcttcctcgcccggcatgtggatgtctggggcgaggagtccgacgacgtgctggaaatggcctacctgaacagctattaccagaccggcctgaagaacctgctggacgtggcggtgctggagcacgtcgaagtgcaccgcgagctgagggtcggcacggcgttccagaaagtcgacgagattcccttcgacttcaaccggcggcgcatgtcggtggtggtggccgagaaggagcgggcgcacctgttgatctgcaagggcgcggtggaggaggtgctggcggtgtacacccgggtgcgccatggcgccgccgaggaaatgctcagcgacgagctgctggcgcggattcgccaggtcaccgcccaattcaatggcgaaggcctgcgggtggtggccgtggccgcccggccgatgccgcggggccgcgacagctacagcctggcggacgagcaggggctgaccctgatcggttacgtggccttcctcgacccgcccaaggaaagcaccgcgccggcccttgaggccctggccgcccatggcgtggcggtgaaggtgctgaccggcgacaacgagctggtgacggcgaagatctgccgcgaagtcggcctggaacaacagggcctattgctgggcaacgacatcgagcgcatgagcgacacccagctggccaaggccgtggaaaccaccaatgtcttcgcccggctcacgccctcgcacaaggaacgcatcgtccgcctgctcaagggcaacggccatgtggtcggctttatgggcgacggcatcaacgacgcgccggcgctgcgcaccgcggacatcggcatttcggtggacagcgccgtggacatcgccaaggaggcggcggacatcatcctcctggaaaaaagcctgatggtgctggaggagggcgtgctggaaggccggcggaccttcgccaacatgctcaagtacatcaagatgaccgccagctcgaacttcggcaacgtgttctcggtgctggtggccagtgccttcattccgttcctgccgatgctgccgatgcacctgctggtgcagaacctgctgtacgacatttcccagatcgccattccgttcgataacgtcgacgaggaaatgctggcccgtccgcagcgctggcagccggcggacgtcgggcgcttcatgctgtttttcgggccgatcagttcgatcttcgacatcagtacctttgccctgatgtggtacgtgttcgatgccaataccccggaccaccagacgctgttccagtccggctggttcgtggtcgggctgctgacccagaccctgatcgtgcacatgatccgcacgccgaagatccccttcctgcaaagccgcgcggccatgccgctgctggtgatgaccgggttgatcatggccatcggcatcttcctgcccatgggcccgctggcgcactacttcaagctgcaggcgctgccgtcgctgtacttcgtgttcctgccggtgatcctgctggcgtacatggcgctgacccaggcggtgaagggcttttatatccgccggtttggctggcaataagctgcggctcgcggccgacgctgcacaacatcctgtagccgctgccgaaggctgcgatggtccgggccacactggtcgcagggcctccggcgttgtcgggatcgccgcggccctgcgggccgatcgcagcctgcggcagcggctacagggttaaccggcaatcgccatctgctcgtaatgccagtcggtgcaagatacccggcaccctggccgacctcatctcggcctcgtcggatcgccgcccgctcgcaccggcaaagtgcacctatcctttaacggcagccgaccgccgcgtactcaaggactcccttcatgcaagcactccagaacatcaacctgacctccctggtggacactctggtcagcctcagcgcggcctttatcctcggtggcctgatcggcttcgagcgccagtaccggcaacgcaccgccggcctgcgcactaacgtgctggtggcggtgggcgcggcgattttcgtcgacatggccaaccgcctcggcggtgccgagggcgcggtgcgggtggtggcctatgtggtgtccggcatcggttttctcggcgccggggtgatcatgcgcgaggagggcaacgtgcgtggcctgaacaccgcggccactctctgggcttcggcggcggtgggcgcctgcgccggcgccgacctgattctcgaggcctttctcggcacgctgttcgtgctggcggccaacaccctgctgcgaccgatcgtcaacaacatcaaccgccagccgctggacgtgatctccgccgaggtcaccaacatcgtctatgtcatcgcccatcgctccaagcaaaaggccgtgttcgccctgctcgaagcggaactggaacgcagcaactacccggccagcgatatcgatgtccatgccttcggcaacgacgacgtggagatcgaagccaccctggccaccacctcggtggacggcgacgaactcgacgccctggtggcgcggctgtccacctcggccctggtggagcaggcgttctggagccccagcaccaccgaataaagcgcccgtgcgggggctttcctgggagaaacttctcgtgcgcagcaatttttgggaattgtcttaaagagttggccaggggccatcggatagtctgtcgggcctctgtgttcaaccgatagttgccacgccgatgcccaacaaacgcttgagaatactgattgccgatgcgtcccgggagcagtgtgggcgcatccagcgtttgttgaatgtcctggggtatttccgcatcgcggcggtggagtctttccgcgaactggtgaccctgactcactattcctgcgaccccttcgagaacttcgacctgttgctgctcagcggcgagctggcgttcgccgccggggtggacgccggcgcgttctgccagggcaacccgcagatccgccatgccatgatctatggcggtcgtaccgaacaggcattgccgatggtcctcggcgcctctgcgctacaggagattctctgggtgcagggcgccacgcagcagatcctccagcgcttcattgcccatatcaatcctcccgcctcctcgggcaaagaccgaaccttgtgaatactgaatagccccgccgttgatgggaacagggcttgcgtcatgctgctggaggtggaaaccgccacctggccagcggtttgctgatgaccgctgccggggccggacaggtcttttggctccatccggagcgggcaaaaaacaggggccaaggccgcccatcgatacccgatgtgtgccgccgatgcgggcggatatcccagggaaacgagcatttcgggctcgaaaagtaggggaaagccgcattttagtaatgtggagtagggcttttcagaaaacccttagagaaaactatcggctgctcccctagcctttattcataggcttggagcctgtcatctcagacttttttcatggtcgcgaaaaaatgccgaataaaacgttacgaatcctgatcgccgatgaacagcattttcatcgaatgaagatcgagcgggtgctgaaccaattgggctattaccggattgcaccgatgtatcgactcatcgaggtattgaacgtcgtggaatatggcagtgagccaatggacctgctgatcatcagcgcttcgctggggttgcaggcccggctcgatatcgtggcgttctgcatggataacccgcaggtccgtcatgtgctggtctatgactccgagcttctcggcgtgccttcgattccattcggtccgcagcgcaagatgtatatcagcagcctgtcgctgccggaccacgagaccctcagccgtttgatggcggccatcgacaccggccgccggagcaagaccctggcggctggaaagtttcccggcagttccaatgaggaagagatcgcgtccgacggcattcggttgaatgccgtggtgcgttaagacctcagtcccacgccggcgcaatgccggcggggctggtcagacgatgaccgcgctccaggccggcgatgcgttgcatctctgcctcgctcagggtcagggcacaggccttgaggttgctttccaggttcgcgcgcctggtcgaggagggaatcaccgcatgacccgattgcatggcccaggccagggtcacttgggccggcgtcgcccgatgctgctgggcgatctgctggatgaccgggtcctcgagtacctcaccgtaggccagcgtcatgtacgaggtgatgtgaatcccctggctttgtgcgaactccacgaccttgcggttctgcaggtaaggatgcaattcgatctggttagtggcgatgtgttcggcaccgaccgcggcgatggcctgccgcatcaggtcgatggtgaagttggaaacaccgatctgccgggtcaaccccagttgcctggcctccagcagcgtcgccatgaactcttcgaccggcacctggttgtccggtgacggccagtggatcagggtcaggtccaggtagtcggtccgcagcttgcgcaggctgtccttgagactggggatcagcttgtcgcgggcgaaattggcaacccagatcttgctggtgacgaacagctcgtcgcgggggatgccgctgtcggcgatggcctggccgacctcggcttcgttctcgtagatctgtgcggtgtcgatcacccggtagcccagctcgagcgcggtgctgaccgagtcgatgaccacctggccttgcaggcgaaaggtgccgaggccgaaagcaggtacagacatggatgactccagatggcagtggaaaggccacgagtatcccggtccgcatccttgagaaaaaccgccgggcaggcaaagcaatctttactgcgaatcacgaatgcgcgggcaggcacgatccctggtatgggcgagcttgctcgcgagacgtcctcccggccaccggtgagcgcaagccatagttttttcgcgaacgagctcgcttctatagacgcagaggcgggttcagccacgcgcttcaagaatcatgcaggtggtggagccggtggcgtacaggcggccatcgacgtcgtagatccgaccttcggccagggcggtggagcggcccaggtggacgatcttgccttcggcgcggatcggcccgctgctgccggtcagggcccgcacatagctgatgcgcaggtccagggtggtgtagccctggcccttgttcaggcgggtgtggatcgcgcagcccatgcaggagtccagcaaggtcgcggcataaccgccgtgcacgctgcccaacgggttgtaatggcgggcatccggggtgccctggaacacgaaatgtccggcggaccattcgatggggatgaagtccagcaacgtgccgatgggcggcgagggcaattcgccgttgccgatgccgtcgaagaactcggcgggggagagggcgctgacctcggccagggacaggctgcccggagcggccaggcgcgcgcgcatggcctgttcctgggcaatccactgggccagggtggcctcgcgggatgggctttgcatgggcgtttcctcattgggcggaacaagatgacgagcaaaatattatgttcgaaatattatttcggccagtgtcaaaaacgccacaggtcggaagattcggccaggcttcaccttgagcgcattctcaggtcatatcgctgcggctgaactcctcgccaagaaagtcgatcagcgtgcgcaccgacggcagcaggccacggcgcgacgggaagatcgcatggacgatcccgcacttgggcgcccagtccggtaccagctgcaccaggcgcccggcggccacatcgtcgcgcaccaccacgctgggcaggtggacgatgccgattcccgccagtgccgcctggcgcagggcaatcaggtcgtcggtgaccatccgtggcttgtggcgaatctgcgcgagcgtctcgtccgggccgaacagctcccactggtactcgcgttgcgccgcgccccaatgcaggctcggcaggccgctgaggtcggcgggcgaggcggggctcgacaggcgcgcgagaaagtccgggtggccgaccaggcactgggtgctgttgcccagcaccttcatcaccaggtcgctgctttccagcggtggaaagcgcacccgcagggcgatgtcgaaaccttcgtggatcaggtcgacccggcggttggtgctctcgatgaacagctccaccagcgggtacttgagcatgtagcgggtcagcatcggcccgacccaggagttgagcagcgcggtcgggcaactgatgcgcaccaggccctggggctcggaacggttgcgctcgatgacttccgcggcgctttccgcttccacgcgcatggccaggcaacgctggtaatactcatggccgatttcggtgagcgaacagtggcggctggtgcggtgaatcaggcgcacgccgaggcgttcctcgagctgggcaatacgtcggctgagcttggacttgggcatgtccagggcgcgtccggcggcggcgaaaccacggtgttcgacgacctgggtgaagtagtagagggtattgaggtcttccaccatcgttctccaaatagaacgctaagagcgatttttgcagtctagtgcatcaaaggtatgggttttaaggtgtatccaacgaaataactcagccatttcggaggcacccgcatgaaaaacatcatcggtatctacaccagcccacgggcccattgggtgggcgacggcttcccggtgcgcacgttgttttcctacgacaacctgggcaagcacatcagcccgttcctgctgctcgaccacgccggcccggctgaattcaccccgacccagggacggcgcggcgtgggccagcatccccatcgcggcttcgaaaccgtgaccatcgtctacaagggcgaggtggagcaccgcgactccaccggcagcggcggcaagatcggccctggcgatgtgcaatggatgaccgcggcctcggggattctccatgaggagtttcactccgcagcgttcgccaagtccggcggcaccctggacatggtccagctgtgggtcaacctgccggcgcgggacaagatggccgcacctggttatcagacgattctcgatggcgacattccggccatcgccctgaaggacaaggccggcaccctgcggttgatcgccggcgagtacgacggcgtcaagggcccggcccgcaccttcacgcccattgacgtctgggacatccgcctgaatgccggcaagcccctgaccctcgacctgcacgaggggcgcaacaccgccctggtgctgctgcgcggcacgctccaggtcaacggccaggaactggtgcgcgaaggccaactggtgctgttcgagcgcgacggcgaccagctcagcctggaagccaacaacgacgcggtggtgctgctgctcagcggcgaaccgatcgacgagcccatcgtcggccatggcccgttcgtgatgaacagcgaggccgagatccaccaggccttcgtcgacttccagtccggtcgtttcggccagatgcctggctgacccccgcttaccgacttgcacaggacgtgtcggccggttcagggccagggatggctgttgccttcaataaatgccctagacgaaagaggaactgcacatgaacaacttcaatgctgccaacttcaatggcgccaagccgaccatcgaccccaacgacgcggcgatgctgctgatcgaccaccagagcgggctgttccagatcgtcaaggatatggatgtgcctcaactgcgggccaatgccatcgccctggcgaaagccgcgactttgctgaagatgccggtgatcaccaccgcctcggtgccccagggccccaacggcccgctgatcccggaaatccaccaggaggcgccccatgcccagtacgtggcgcgcaaaggcgagatcaacgcctgggacaatcccgagttccgggcggcggtcgaggccaccggcaagaaaaccctggtgatcgccggcaccctgaccagcgtctgcctggcgttcccgtcgatcgccgcggtgcatgaaggctacaaggtgttcgcggtggtcgatgcctcgggcaaccattcgcggctggccactgacctgaccatcgcccgcctggcccaggccggggtggtgccgatcgacatcatggccacgctttccgagctgcagggttcgtggaaccgcccggacgccgagcagtgggccgcggtctacgcccaggccatgccgcattaccagttgctgatcgagagctacctcaaggcccagcaagtggcgaacgagcacgaagtgctggactcccagcgctgaagctgcacccccccacgccgacgtccagtcggtatcgacaagaagcgaggactaccccatgactactgcctacaagcgtctcgacaaagacaacgccgccgtgctgctggtggatcaccaggccggcctgctgtccctggtgcgcgacatcgacccggacaagttcaagaacaacgtgctggccctggccgacctggccaagtacttcaagctgccgaccatcctcaccaccagcttcgaaaccggtcccaacggcccgctggtgcccgagctcaaggcgctgttcccggacgcgccgtacattgcccggcccggccagatcaacgcctgggacaacgaagacttcgtcaaggcgatcaaggccaccggcaagaagcagttgatcatcgccggcgtggtgaccgaggtttgcgtggccttcccggcgctgtcggccctggaagaaggcttcgaggtattcgtggtcaccgatgcctccggcaccttcaatgagctgacccgcgattcggcgtggaaccgcatgtccaccgccggcgcgcaattgatgacctggttcggcctggcctgcgagctgcaccgcgactggcgcaacgacatcgagggcctgggcaccttgttctccaaccacatcccggactatcgcaacctgatcaccagctacaccaccctgacccagggcaagtgacctgccagcggcggctacacaaacgaccgggctataggaggtgtcgccattccctgtagccgctgccgcaggctgcgataggaccgaaggtcctccagcggtttcaagacccctgcgcctgctgcgcagtcgatcgcagcctcgcaagctcggcagcggctacagggttagcgccgatcggtaggtcacaacccctgtagccgctgccgcaggctgcgatagggccgaaggtcctccagcggtttcaagaccctgcgcctgctgcgcagtcgatcgcagcctcgcgggctcggcagcggctacggagtgagcaacatagttgcaggcaggggcctcccatgaggcccctgtttttgtttctccggctatacctgcaaggtcgcttgtgtgagattgtcgcgcctctgaccgtgctggagttgcttgatgccgaacctgttcgccgaccacccgctgttcgccgcgctggtcctgatcctgctggacatgctgctgtggcgcctgatcggcgcgcggggcggttactggaagctgctggtgcgggtgctgatcttcaccctgtacagcgtgctgctgttcaaccagggcctgaacccgatgcaggcggcgccctggccggaggacgtgccgctgcacctggccgccaccgggttgcagatcggttggtggctgttcggcgcgcggaccctgacggtgctgctcggcaccctgatgatgcaacgggtcgggcataccgggcggctgttgcaggacctgatgggcgcggtgattttcctgatcgccatcatcgccgccatggcctatgtgctggaactgccggtcaagggcgtgctggccacctccggcgcggtggcgatcattgtcggcctggcgctgcaaagcaccctcagcgacgtgttctccggcatcgtgctgaacaccaccaagccgtatcagctcgatgactggatctccatcgacggcaccgaaggccgggtcaccgacatcgactggcgcgccacccggctgcagacctcccagggcagcatggcggtgatccccaattccctggcggccaaggccaagatcatcaacttcagccgtcccgccgatatgcacgggctttccatcagcctccaggtcagcccccatgcgcggccgcaaacggtgatcgaggcgctggagcgggccatgctcggttgccgtttcctgctccccaagccggcccccagcgtggccctgaaaagctcgggcaatgccggggtggaatacgagatcagcggtttcgtggcctccatggggcagaagcgcgaagtgcgcaaccagttgttcgacctggccttccggcacttgcaggcgtccggcgtcagcctgctgtccagcggtgaaagcagcatggcggcccagctgtcgcgcccgcgggcgctgctggacagctcgagcatcttctccaccctgcgccaggaagagaaggaaaccttcagccagaacatgaccctgcagaccttccgcgccggcgagaccatcctgccggcgggcgaggtcagcgatcacctgctgatcatcgagtcgggggtggtctcggtcagcctgatccgcgatggcaagcctttcgaggccgggcgcatggggccgggcgaagtgataggcgaggcgggggttgccgatcaggcgaccgcggcggacttctcggccaagaccttctgcaccctgtaccgcatcgaaaacgaatacctcaagccgtgcctggatgcgcggcgcgacatcagcgacgcgatgaaaaacctcctggatttccgccagcacatcgcccagaccctgacccaggaaaccccgcggccggcggtgaaaaaaggctttatgcagtggctgcgccggcgcgcctgagcgtccatgcacggcccctgcgggcgcgcagtttgcgcgcgatccgcgtagcggccaccggacgccagggcaatcgagcgtcgagcggccgctcccacagaagaccggaggcattggtcacctggtcttaagcgcaattggttattggtagggaccgggcccgggcttaacgtagcgccacattcactggacctggagccacaccatgcaaccgcgtatcgacttctacaccgcttcgccggacgccctcaaagccatgatcgcgctggaaaccgcggtctcgaaactgcccctggaaaagtcgctggtcgagctggtgaagctgcgcgcctcgcagatcaacggctgcgccttctgcgtcgacatgcacaccgccgacgcgcgcaagagcggggaaaccgagcgccgcctgtacgcagtctcggtctggcgcgaaacgccgttcttcaccgaccgcgaacgcgcggccctggcctggaccgagtcgctgacccgggtcagcgaaacccacgccccggatgccgactacgagctgctgagcagccagttcagccccagcgagcaggtcgacctgagcctggccatcgccaccatcaatagctggaaccgcctggcggtgggtttccgcaaaatgccccaggcctgactcacccgggctcaatggccgtcggctgacggcgccgacggcggggcgaccttgcgcatcaggggcaccatggccgtggcgatgatgaaacacaccatgatcatcaggaacgcgtcgccgtaggtttgcgtctgcgcttcgcggtaggtcagttgccagagctggcgcaggctggcgctgacgccttcgtcaccggtctggcccagcgccgcgaagttgccgccgacccgggccagccattggttgagcgcttcgttgctgctgttgaggtgttcggccaggcgggtgaagtgcaggttggtgcggtcgttgagaatggtggcgcaggcggcgatgccgatggcgccgccgaggttgcgcatcaggttgaacagccccgaggcatgcttgagccgcgccggcgccagcccgcccagggtcagggtcaccgccggtggcaccgccagctgctgggcgatgccgcgcaaggcttgcggcagcagcagttccctggccccccagtcatgggtgatggggctgaagtcccacatcgacaaggcgaacaaccccaggcccgccatcatgatccagcgcaggtcgacgcggttggcgagaaacgcatacagcgggatcgccagcacctggaacaccccggtggaaaacaccgccatgccgatatccagcgcgctgtagccacgcacccgaccgagaaacagcggcgtcaggtagatggtggcgaacaggccgatgccggtgacgaaggagaagaaacagccgagggcgaaattgcgctccttcagggcgcgcaggtcgacgatcgggttggccacgcgcagggtgcggccgataaaggccagcccggccaatccgcaaatccaggcggtggtgaggatggtgctgtcgctgaaccagttccagcgcgggccttcttccagggtgtactccaggcagccgagaaacagcgcgagcagcagcatgctcaggtagtcggcgcccttgagcagcgccagttccggctggtcgatccgcaccagcatgggcaccgccacggcgacgaaaatccccggcagcaggttgatgtagaacaaccagtgccagctcgacacttcggtgatccagccgccgatcaccgggcccagggtcggcgccagggacgccaccgcgccgatggtcgccgcggcgatcacccgctgcttgccggtgaagaaaaagaacgcggtggtgaacaccagggggatcatcgagccgccgagaaacccttgcagggcgcggaacacgatcatgctctggatgttccaggccacgccgcacagcaggctggccagggtgaagccgaccgccgaggcgcagaacagccagcgtgtggagaacacccgcgacagccagcccgacagcgggatgacgatgatttcggcgatcaggtagctggtctgcacccaggcggtttcatcggtgccggccgacagcccgccgccgatatcgcgcaacgaggccgagacgatctggatatccagcagggcgatgaacatgcccatgcacatagtggcgaaggcgaagaccttggtcgtcgtggccatgttggccggattcaggggctgggccggggcggcgagggcgcggctcatggcgcgctggccacggcgggttcaggcgccgccggttcgctgcgggtgttgaccgcggccgtcaccgacaggccggggcgcaactggccgagcaccgcgtcctgcgggtcgaggatcacccgcaccggcacccgctggacgatcttggtgaagttgccggtggcgttctccggtggcagcacgctgaactgcgcgccggtggccggggccaggctgtcgaggtggccgtggaattcccggccgggcagcacgtcggcgcggatcaccacgcgctggcccgggctcatgtgttgcagctggtcttccttgaagttggcgtccacccacaggccgctggccggcaccagcgacagcagttgcgcgccggcctgggtgtaggcgccattgcgcgcccgacggttgccgatcaccccgtccatgggcgcgcggatttccgtgtagcccaggttcagttgcgccaggtcgcgctcggcgcgggcctggagcaaggctgccttggcttgcagtttctgggtggcgatcacttgcagctggcgctgggtcgccagcagttcagcctgggcccgggtgttgagggcctgggcggtcttgaagccggcctcggcccgttgcgcgctttccaccgacaccgccgagctgcccaccaggcgtttgtagcgggcattgtcgtcgcgcgagcgggtcatttccgcggcggtggcgtcgatcccggcgcgagcctggctgattaccgcgtgctgcaactgttcggtggcgtccaggttggccagcagcgcttcctcggcggccaccgcgccttcggccttggccaggctggcgcggtaatcccgcgagtcgaggcggatcagcaggtcgccggccttgacccgctggttgtcgctgaccagcacctgctcgatgtagccggacaccttgggtccgatcactgtcacgtcgccgcctatataagcgtcgtcggtctgttcgataaaacgcccgctggtccaccaatgcaggctgtagaacaccagcgccgccagggccaccagcgccagggtggcaagtagcaggcgcttgagcaaaggaggcctgaccggggccgggtgggtggcgacagaggcagggtcgatggcgggcaggctggtcatgacaagttcctggagggggaatattatggttgaaatatgatatttgtaatattttattgcaactcaatctttgtaccgatcgtcaggtgcgacctgggagttggcggatgacgcgggtgattggcgaggcggggtagggcccaagcggaagcagttggcgcaagccgtggcgaagactattgttggcaatctgaataactgcccgaagagagcgatgcgatgaacaccagtgatttgcttgaacagttgctgcgcgccggccaggcctcgatgacgcagcagggtggcggggcctcggcaccgcagggcgggctgggaggcctgggtggcttgctcggcggcctgttgggcggtaacagcggcggcggtgcgccagccggtggcttgggcgctggcggcctgggtggtctgctgggcggcttgttgggtggttccggcttgggcggcgcgatccctggcggcgcgacttccggtggagcccctcagggccgctccggcggtggcatgaactacgcggcgctggcctccctggggatgatggcgttccaggcttaccaggcctggcaacaacagcaacaatcggcggcgccgcaacaggcgttgcgtaccgtcgaccagctggccggcccggaagccgaagaacacagccatgccatcctccgcgcgctgatcgccgcggccaaggccgatggccgcattgacgagcaggaaaaacaactgatcagcgccgagatcggccgtcataccgatgacccgcaattgcagcaatggctcgacgacgaagtcgcgcgtcccctggacgccgccgacgtggcccagtcggccgcgggcgagccgggcatggcggcggaaatgtacctggccagcgtgatgctggtggacgatcagcaggacgccgagcgcgcttacctggacgagctggcggcggcgctgcggatcgaccccgagctgcagctgcacctggagcaacaggccaagggccaggtggcctgagccacgaggaccggctccgccaggggccggtccatttgtccgcgtcgggcgtgccattcgacgcccggcaggctcgatccgcatccctcccaatttctgcttggcttcgacggcgtgcccccgtggccgaggtggattgtcgcagcgcggatttattcgccatctccgggtgtgggcagggtgataatgccggcctgtccatcatgcgagcgcaccgtcgccatgttcgagatccagccgcagaaccccgagctttttcgccagcagacccgccgcagtaccttgttcattgccctgattttcctgtccctggccatgctgttgtctagcgccgcggtgctgctgttcggcgcgccgggcggcgataacttcaagctcaatgtcgccggcgtgctggccgggctggtgctgagcatggtgctgatgcgcgtgcgtttctggtcgcagccgtggatggccgcggcggtctacggctggcagctcaagcgcagcctgatgagcgtgaccaacgtcatgcaccacgtcaccgcgggcgtcgaggcccaggacccgacagcgatgaaactgctgcgcttctaccacctgggcctgacccagatgcaccagctggatgccaactccagcgcgttgagccaggtggtgcatgagatcgaccggcacaaggaacggatggaaacgttgggcatggacaccgagcagaatcgcttgaatccggactggatcgcagcggtgaagcggattccggtaaaaaaatgagctgaacagggcgcggcttccaaggttttccccggccgcttccgcacccatttcgccatgtgactgctgcatgaaatccaagggttatatgcgctgaatacatggcaaaaaggcaaagagttataacgttagattttatttatataaatggacataagcattagcgctatgctgccgccagttttttacctggccgcggttgatgcgtagggcttattgatggatgtgggtaattttggttttgtaatcgcgggcctgttggtgggtttcatcgtagggatgacgggggtgggaggcggttcgctgatgaccccgatcctgttgtggtttggtatcaacccggcgaccgctgtcggcaccgacctgctgtacgccgccatcaccaagtccggtggtgtgctggtccatcagaaaaaccgcaacatcgactggaagatcaccggttggctgaccctgggcagcgtgcccgcggtgctggccaccctgtggttcctcaagagcctgcacaccgacccgcaagcgctgaacagcgtgatcaagcaggccttgggttttgtgctgctgctcaccgccctggcgatcctgttcaagaaaaagctcctggcttttgcccagaagcacgccggcgatcactaccacctgaaggattccagcctcaacggcctgacggtggtcaccggcgtggtcctcggcaccatggtcgccctgacctccatcggcgccggcgccctgggcaccgtggcgctgttcatcctgtaccccttcctggccaccaagcgcctggttggcactgaaatcgcccacgccgtgccgctgaccctggtcgccggcctggggcacgcgagcatgggcaacatggactggcaactgctgggctttctgctgatgggctcgctgccggggatctggctcggcagccacatgaccggccgcgtctcggacgaactgctgcggccgttcctggcgctcatgctgttttccatcggctacaagctggcgttctgaccccgcgctggtgggccgagccaagagcctcctgcgggaggcttttgtgtttttgcggtttgagcgcgcacgcttggggcgggccgtgatggacccgccccaggcctctctcagcgttgcgccaaccagtaatcgtgcagcccacgggctgcctgttcgacgctggccacggtctggcgatgttgagccagatcgaggtcggccggcagttcgaagttgtcctgttcggcgcaggtgatgatggcttgcagctggacggcctgggcagcgggtagctcgggccagttgctcacggccatggcgcggatgtagccgaaacaccattcttccgccagcgtcagcggctggtcctgatgctcggtctgttcgaaacgcggctgaaagctcgccgagtcgctcgccagcgccgtggcgagggcgttcagatggcgcacgctcagttcgatgaagcgcttgcactcctcggggtcctgccagtccgggttctgcccgccccagatggccgggaaccattcggcgatgtccacctgggccgggccggacaccagggcggtgcaaaaaccgtccagctcggccaggttgagcacggagtggtcgtcgccatacttgagcagggtgtcttcgatgaattcgaactcggcggggctgagcggcgggttgtgcatggagggtttccttggaaaaacgtgcgccccagggggctgcgcggaaaaaagacgcggaggatggcgcgttccgcggcttttatccagcgccgatcatcgtcacggagcgcgttgtcatagctgcgacgcgctcctggtcgttccagcgaccggtccgttaaccgattcggtcgctgttgttctcagggttgcgcgtcatccagtgccttgagcagggcatgggcgaccttcacccgttcggcgttggggtagttcttgttcgccagcaacaccaggccgatgtccttgccgggcacgaacagcacataggcgccgaaaccgccggtggaaccggtcttgttcagcagggtatcggcccgtggtgcctggggcggagtgagccagcgggtcgggtgcggttcgaaggccatctgcgacgagttgccagccagcagggcgtccaggctgagcgggtaagggtagagttcccagcccaggccctgggtcatgccctcgacctggtaatagccggtgtgggtgagggcgatggcctgcggccagggttgcgccagcgactcgggcttgaggttggcctggacgaaacgcagcaggtcggcggcgctggtcttgaccccgtaggcctcggcatccagggcgccggggccgacccgtaccggcttgccgtccttgccgtagccctgggcgtaattgtccatctgtgacttcggtacctggacatagctgtgctgcaggcccaactgcgggaacagtcgctgctccatcagttgctcgaagggctgccccaggctttgcgcggccaggtagccgaacaggccgatgctcgggttcgagtacaggcgctgggcgccgggcgcaaaggccggtttccagccctggtagtagccgagcatcttgtcctggctgtcccattgttccgggaactgcaacggcaggccgccggcgctgtaggtccccagttgcaacaggctgatgtgctcgaaggcgctgcctttcaacgccggcaggtagcggctggccgggtcgttcagggacagtttgccgctggcctgggcataggcccccagggtcgcggtgaagagcttgctcaccgagccgacctcgaacagcgtgtcggcgtcgacggctttctgctcttctttggaggccaggccgtagttaaagtaatggggctggcccttgatggtgatggccaccgccatcccggcgatgtcctgttgttgcatcaaagggcggatcgccgcgtcgaccaggggcttgagcgcgctgtccggcgggctggcggctaggcaggcgctggcaccggacagcagcagggaaagggtgagaaatccagatagggctaggtttttgttgtgcatgatgggcaggcattccatgattttgcagagtgatggccgctgcactccgagcggcttttgccggcgcctgcccttgcagtcagggagcagcgcgctgcgagccggctcaatgtaggcggccggcgaaggatcggcaaacgacgatatttcgcaggagccattagaaaaactagggagtggtcatgatccgaccccatttgccgctgaatgccctgcgcgccttcgaggcctcggcgcggcacttgagttttacccgcgcggccatcgagctgtgcgtgacccaggcggcggtcagtcaccaggtgaaaagcctggaggcccagctcaatgtgaccctgttcaaacgcctgccccgcgggctgatgctgaccagcgagggcgaaaccctgctgccggtgctgtgcgaatgtttcgaccgcatcgccgaaaccctcggccgcttcgagggcgggcactaccgcgaaatgctcagcgttggcgcggttggcacctttgccgtcggctggttgttgccgcgcctggaggacttccaggctcgccatccgtttatcgacctgcgcctgtcgacccacaacaaccgggtcgacgtcgccgccgaaggcctggactacgccatccgtttcggcaacggcgcctggcacggcaccgatgctgtccagttattggaagcgccgctgtcagtgctttgcgtgccggaactggcacggcagctgcgcagccccgccgatctgctcggccagaccttgctgcgctcctaccgtaccgacgaatggccggaatggttcagcgccgccggcctgccggccagcaccctgcctgcgcgcagcatcgtcttcgactcgtccctgggcatgatggaagccgcgcagcagggcataggcgtggccctggcgccgccgctgatgttcgcccggcaattgcacgccggcagcatcgtccagccgttcgcggtgggcattaccactggcagctactggctgacccgcttgcagtcccgggcgcagagcccggcgatgctggcgttcaaggaatggttgttggggaccgtgcagaagggctgaaggcgatctgaagagctggtgtttccctgggccaagagcgtgcggacagggagagcgccaatgcgaatcgccagaaccgcctggcgccgttctggcgagtgtttttcgcgcgacgcagccttgcagcgcggtcatcagcacctgcacccgtcgaccgccttgtgagcctggatcctgatcttcgaccggcctctttacactgtgtctggtgtgttgcatcggccgactgaatccacaatcgattccggccattcacgcctggccgcaacccataaaaaagcagccccaggcggcgaaccctgccgagacgcaatggtcaaccgatcaagggcctccgggctgcttcacaccggccggcgacccttgataaacggattcactcccatcctgctggcttgcagtgctcgtggtgattctgccggtagtgcatgcagcacacttcaggggggagccggagaacttcaagccggttcgggtcctgcctggtgcgggcgctgaccgttgatcgcatccgctcctcccgcataggagtacgaaaatgactcaatcaatgcggttcttcctatcgatcgtcctggcggcggtgtcactgacatcagcgagcctgttgaacactgcaggtgcggccaccgccgaggacttgaatgccgattcccggcaagccttgcaaatcctctataaggccactccgtccgccgaaagcctttcgcacaaagccaaagccgtgctcatctttccgaaaatcgtcaaggcaggcctggtgtttggtggcagctatggcgaaggcgtgctgatgaaaggccagaaagtggagaattactacaattccgtcaccgggtcatgggggctgcaggcaggcgcccaatcgtacggttatgcggtgttcctgatgaccgaaaaagcgctgaactatgtgcgcaagaccaagggctgggaggtcggcgtggggccaaccgttgtcgtggttgacgaagggatagcgaagaatctgtcgacctcgacgctgaaggacgatgcctacgcgttcatcttcgaccagcaagggttgatggccggggtcagcattgaaggaacgaagatttccctgatcaaacgctgaaaaaaacctggcaagggttttgatcttttcaagcgtttcgcgtcaaggcggtctaaccggcggctccttcacccaggcgccttgcatggcaagcaaggcgcctgggtggaggaacctgtgccaagcccttttgggcacaggatgcacgacgacatctgcggattattgagcgctatcaccgtcctcgccaagagggggtccaatgaaccttccaaatccatgtaagggtgcaagtaatcttctggcgctgtgcgtggttgtgctcctggcatttatgatctcctgcagcacattgcccaggatagtgcccgacatggctcgcgcaccctctacgccagtgcagctcgacggggcccatggacctctgtctgccgagcgcagcaaagccattctcgaccggctcaagtcctccggcgcagagaccgacatcttcgacgtgcacctcgcaatcgaagaggccatcgccggcagcccgctgacggaaggcaacaaggtcgacttgctgcaagacggccccagcacctaccagtcgatgatcaaagccatggaggcagcccgcgaccacatcaacatggagacctacatctttgacgatgacgaagtcggtcagcgcttcgccgacgcattgatcgcccggcaacagcaaggcgtacaggtcaacctgatccgcgacagtgtcggcaccctgggaacatcggcagagtttttctctcgattgagcgaagcgggcgtcaaggtgctggagtacaaccctgtcaatccggtgacggccaaagcgggttgggatgtgaaccagcgtgaccaccggaaactgttgatagtggacggtcgcattgcctttcttggtgggatcaacatcagcagcgtctattcggggggctcgctcagctcttactcgaagacccggcccggtggcgatttaccctggcgtgacactgacctgcgtatcgaggggcccgtggtggcggaactgcagaaactgttcatcgaaacctggactgcccagaaaggcgaaccactcgcggccaggcggtactttccaccccctgaacgcaagggcagcgaggtggtgcgcgccattggcagttcgccagatgaaccgttcagcctgatctacgccacgctgatttcggcgctgcgcagcgcacagaccgagatatggctgaccaacgcctactttgtgcccgacccgcagttgctagcggtcctcaaggaggcggcagcccgtggagtcgacgtcaagctggtgctacccagcagtaccgattcgtggctggtgctccatgccggacgcgcttactacagcgagctgctgaaagccaacgtcaaactttacgaacgccgtgacgcgctactccacgtcaagactgcggtaatcgatggtgtgtggtcgagtgtcggctccaccaacctcgactggcgcagcttcttgcataacgatgaagtcaacgtcgtggtgctgggcaccgggtttgcaaaaaagatgcaggcggcattcatggctgacctggccaagtcgaacgaaatcaagctggaacagtggcagcgccgttcgctgggtatgagagccaaggagcagatagcgcgactttgggagtactggttatgaacccagtgcgcgttgccgggatgcgctgttctgcgtcttgaggggatggcgcgagcccgggttcgagccctggcgagatcgaccgcgggcaatgtttgcgggcgatgattttgagcacgccggattgccctggctcgccgttggcaggcgggattgccaatcccgccgcttacgtttacccgctgtttacttacctgccaccaacgcgggtgtgcgcggcgggatcaggcgtttgctgccggtggactcgtaggccgccgccaggcgcagcaggttcgaatcgtcgtaggcgcggccggcgaaggtcagcccgacaggcatgccgatgtccggcatgacgcccatcggcacggtgactgtgggcacgcccaggtggcggatggcgaggttgccgttggccacccagacgccattgctccaggcgatgtccgcggacgccgggtcgacatcggcattggccgggccgacgtcggccacggtggggaagatcaccgcatcaaggccgagacggtccatccagtcctcgaggtcgagcttgcgggttttctccaggccgcgcaggccgtcgggcacggtggggatctgatcccagggggtgatgccgcgctcggccatcttcacgtactcgtccatgccggcggccaggtcgccttcgcggttgggcagggtgcccgggtcgtgagggaatatcagcgggccgtcgacatccaccaggcgattgagctgcgggtcgccgttggcttgcaggaagtcatcgaaggcccaggcggtcaggtcccacaactcatggtgcaggaactccttggacaccaggccgcggttgaacaccgtcggcgcgccggggcgatcgccctcgcaattggacaccagggggaagtccacttcgagcacctcggcgccggcggcttcgagcgcctggcgcgcctgctgccagaggccgatcaccgaagggcgggtgttgatgcgttgtccggtcgggccaccgatccccggcgcctcgctggtgcccgcctcagggtcggcgttgatgtacatgcgcggcacgccgaagcgcttgccggccagggcgctgctgctggcggccagttcctgataggaagccgggcgcaccgaggccacgctgggaatcggcacccagggttgcaggcgccacagatcgccacgggtgtccgggtcctcggcgaccaccacgtcgagtacttcgagcaggtcggccatggtccgggcgtagggcaccaccacgtccatggtcggggtcaggggccagttgccgcgcaccgagatcaccccgcgcgacggggtgtaggcacacaagccgttgttcgaggcaggtccccggccgctggaccaggtttcctccgccaggccaaaggcggcgaagctggcggcggtggcggtacccgcgccgttcgacgagcccgaggcgaagggcgcggtgaggtagtcggcgttgtacgggctttccgcgcggccatagaccccgcgctgcatgccgccgttggccatgggcggcatattggtcttgcccaggcagatcgccccggcggcgcgcagccgttcgatggtgaacgcatcgcgataggcgatcagcctggcgaaggccgggctgccggaggccgcggtgaggcccttgaccaggtagctgtccttggcggtgtaagggatgccatcgagcggacccagggtttcgcccctggcccggcgggcatcggcggcctgggcttccttgagcgcgtcggggttgcgcaccactaccgcattgagggcggtaggcgtgtcggggccgtcgtaggcatcgatcctggcgagataggcctggaccagttcgaccgcggtggtctggcctgattcgagcgcggcgcgcagttgggcaatggaaacctcggtgacttcgatcatgctgttaccgccggctgctgaggggtgatgtagtgaaagttgccatcacactggcgctggggttggggcggcttgggcacatcgcttatctcacaatgggtgttcatatcggttctcgttgcgcggcacgacgcgactggggctgggctacaacctgagcggggtattttgcaccaagttgccggcggggaatcgttaaaggtttcgccgtcgttgttggcggctgatcggcgactggcgcccgccgtatagcggttgccgggcatcggcggtttttacctcactcaggccccaaaaagtaagtagctgttttaaaaacaaatttatgcatctttgacttcacaggcgacgaaaaagttgataaatttccgcgcgttcttgcagaggcccccacggggcttgcagtgaaagcaagcaacagcagagataggggcgtcgccaagcggtaaggcagcaggttttgatcctgccatgcgttggttcgaatccagccgcccctgccatctctcatccctccctctatttatcaaacgctccccccaaggcacggcctcggctccatccggatgctcaagcggcccgtttttgtgtgcccgggatattcccatcacctcagctctggtccggcgctagcgaaagcgcggcgcgatggcctcggcaaacgggtaatggacaaagtagggccgggcttcgtcgatgacccgctggaacgaggggcgctgtatcagccgctcgaaataggcgcgcaaatggcgatggtcatcggcaaaggccaccagcgtgctggcatagaacagggccggggcggcggcgcaatcggccaggctgaagtccgggctggccacccagattctcgaggccaggcgctgttcgagcatgttgtatgcgctcagcagggctgcgcgttcccggctcaggtcgccattggtgccatacaggcgatcggcgactatccgctgcatcggcccctggacatggcaatcgaaaaaacggtcccacagccggacttccagcgcgctgtcccaatcatccggaatcaatggctgccggccccgataaaaccggtccaggtactcgatgatcacactcgattccggtacatcgcgctgccgggcgtgatcgcggatgaccgggaacttgcccagcggccacaggctttgcagctcggcccggtcggcgtcgttggccaggtcgatgatgcgtttttcaaaggcgctgccgtgttcgtagagggcgatcagcaccttgtggcagaacgacgacaggggatggaaatacagggtcagcggcatgttccggttcctcggtgaagggtggggcgcacgacgtgccagcagggaaacccacacattatcggccgaccctggcggccacgcgctggcaggcgacgagccgggctatagcccccctgaatatttcaccgccgccgcggcccgcgacggcacgttgaggatgcgcagcagcgacgacacatggatgcgcacggtgaagggcgagatctccagttcgcgggcgatttccttgttggtcttgccctgggcgatcaggcgcagcacctcgtgctggcgcgcggtcagggtggcgccggtgcccagcggcagcaggccggaaggggcgaacttgaccagcacttcgccttggcgaatggccaggaccgcctggccgatctcgtcgggggcgatgttcttaccgataaaaccgtcgacgccggcggccatgacctcgccgatcagcgcctggtcatcgaccatcgacaccacgatcagggtggtgcgcggcaattgcttgcgcagttcggccagctggctgacgcaggtcaggcctggaaaacgcaggtcgaggatcagcgtgtccggctcgtcgccggcccgggtcagggcgagtaccctgtccaggtcgccggcctgttcgatcagcgcatccggcagcaggcgctggaccgtgcgcaacatgccctcgcgaaacagcgggtgatcgtcggctatgataatccggcatgccatggggtgactctccttgggtcgagctttccttgaggcagctactttagcagcgggccaggcaactgcctgtggttcgtgtcgagtacgacgactggcgcacaaggatgttcaccatgaaattcgagaaaaacaccgagctcgaccaggccaacctgcgcattattgtcggttcctgcgccgtggcctatatcggcgtgctgggtttcctgcccgggcagcgggtcgatacctacctgccgatcgtgatctatatcgtcctgttcctgctgctgtcgatcgtcctgcgccaggccatcgtgcactggcccgggcattatccggcgcgacggatcctgagcatggtccacgactacaccggcacctcgttcggcctggtggtcggcggggaggcggcactgccgctgtacgcggtgatggtctgggtcaacctgggcaacggcatgcgctatggctcgcgctacctggcgattgccacggccctggcgctaatggcgctgttggtggtctatcgcttgacgccgctgtggcaggcgcaacccttcatggtgctgatgctgctgatcaccagcacggtgatcccggcctacgcccatatcttgctggagcgcacgcgcaaggcttcggaggaggcgattgccgccaacctggaaaagtcgcgttttctcgcccaggccagccacgacctgcgccagccgatccactccatcggcctgttcaccgcctgcctgcgcgaggcgcgcctgggcgacgaagagcggcgcctggtggacaacatcgaccgctcgctgctcaacgtctcgcaattgttccgctcgattctcgacctctacaccctcgacaacgggcgggtgcaacccagtttccagactctgcacctgggcgaattcctcgccgaccagctgcggcagaacgccgaagccgcgcgctgggccggggtcgagctgcgcctgcgcccctgttcgcactgggtccgggcggacccgacgctgctcgccaccatggtccagaacgtgctgtccaactgcttcaagtacgcggcgcggcgaccggtgctgattggcgtgcgccagcgcggcgcggggctggccatcgtcatctatgaccagggccgggggattgccgaggaacacctgccgaacctgttcgaggagttctatcgggtgcgcgagctacgggacaaggacgtcgaaggcgtgggcctgggcctgtccatcgtcaagcgcctggggcagttgatggggctcgaggtggcgatccgttcgcggctgggccacggcaccgcggtgagcctgttcgggttgcccctggcgccaccgcagctgcaagccgccagcttcgacgaggcgcgtcaggcggggctgctgaccggcttgaaagtgtgcctggtggaggatgaccgcaacgtgctgctggccacctcggccttgctcgagcgctggggctgcgtggtccaggccgagctttgcggccgggacctggtcagcgactgcgatgtcatcgtcgccgactatgacctgggcaaccacgccacgggcatcgagtgcatcgacagcctgcgtcggcagcgcggctgggcggtgccggcgctgatcctcaccgggcatgaggtggagaagatccaggccgcgttgcacgaccgcaatatcgccatcctgtccaagccggtgcgcccggccgaactgcgcggcagcttgcgggcgctgcgccagcagtctgcgccggcggtcatgcccgagatgtgatgacgcggttcggcgagccctggccgcttgcttcgcgccgccaaaccgtggcgctggggagggtggtcgattagcgcaaatgtgccagggcggtgattcgcgaaccactgtgaaaggcaccgcgaatcagggctcggccccgtgccgggctttgcgtgtctcaggtgcattgctgaacatgaagatttctactcgagacgggtcgctgtacccgacctcaagtgccacctgctcagtgattcgcaggtattcaaggtattgagagggcgttggaacgtatcggtaagtggccattttctctgtcagggacgcatattcctgcggccttgtccgagtgaggtacttatgtattctcgagtcgtatatctgtgccctatggccttcgctggtcgtgataccgccaaagtgcagcaacttggtggtgatgccgttcttgacgttgggcagtgagttgacttgctcgtatagctcgttgttcaaggtggcgcctgggccaatccgctcgaggatgaacgggagagcgttcagtgcgtgttgcagcgttctgccgcccggcagcccgccacgcgggaagccccaggcgatagcgctcagggcccctagatggggatcctgctggaatgcactgaacacatccgccctgctcagggtgattgccttggcaccatcgaataccggttggaaggccgcgccataacgttcgaagctcgaccacttcatgccgatggactgtcgcagggggtcgatagtccgggtgccgcggagcaagtcgaccaggctgacaggagtggcagccgtcgtggctattttcttgttcacaagagtcattccagtggtagtgaaatcgttgaagcgctttttaccgcgagctttcctgcacgcccatggtgagcatggcgcaaagcgctcgatgacggccttggatcatccgtccctgtgttttttacctcactttccacacacctcccgcacacagtcgcgcaaccagcgatgcgccgggtcgctgttcatgcgtggatgccagagcatggacacggtgatttccggcgtggccagcggcagggcgaagctgtgcaggccgctgcgcaggttgtgggtgtggcgctcggggacggcggcgatcaggtccgaagcgcggaccagggccagggcggcggagaaaccgccaacgacggtggcgatatcgcgcgtcaggcccgccgcctgcaacgcatcgtctaccagtccgcgatcaaggccctggcgcgataccagcacatgctcgccggcggcgtaacgggcggcgctgatcggcccgcggctcagcggatggccgttgcgtaccacgccgataaaacgatcgcggaacagcgcgcgggtgtggatttccgggctggcgttggcgtccaccacgccggtatcgaggtcgaccgtgccgtcgcgcaggggcgtgctgtccttgctggttttctgcatgaaatgcaggcgcaccccaggggcttcggcgcgcaggcgggcgaccagggccgggccgaagttctcgacgaaaccgtcgctgctgcgcagggtgaaggtgcgcaccaggcgctgcaggtcgacgccgttcgacggggcgcaacatcggcttcggcgtcctgcaccaggtggccgacccgctcgcgcagttccagggcgcgcggggtcggcaccaggccgcggccggcgcgcaccagcagcgggtcgccggtggtttcgcgcaggcgcgccagggcccggctcatcgccgacgggcttagccgcaggcgctgggcggcgcgcgccacactgccttcggcgagcagcacgtcgagggtgatcagcagattgagatcgggtgtggacatggcggcggtcccgtctggcacaaaagtgagatggcgtcagacgcaccaataacctgcaagggttgcgtcttccaccatgttagaccgcgggctagattggcgacagcgccatttcgcgcgggtcagagaaggagtgcaacgtgaagccagtcaatgccggagcagaaccggaagcggtatcagtcggctgggcattagccagcctgtcgctgtcgatgttgctggcgtcgctgggcaccagcatcgccaatgtgggcttgccgaccctggtgcaggcgttcggggcgagcttccagcaggtgcagtgggtggtccttgcctacctgctggcgatgaccgcgctgatcgtcagtgtcggccggctcggcgatttgctgggacggcggcgcctgctgctgattgggatcctgctgttcaccctggcctcgatactctgcgccgccgccccgacgctggggatgctgatcggtgcccgggcactgcagggcgtcggcgcggcaatcatgatggcgctgaccctggccctggttggcgagacggtcagcaaggcccgcaccggcagcgccatgggcctgctgggcacgatgtcggcgatcggcaccgccctcggcccgtccctgggcggggtattgatcgccgggttcggctggcaggcgttgttcctggcctgcgtgccgttgggcgggctgacctgggtgctggcttatcggtatctgccggctgctggtcaggtgcgcgcccttgaacgaggcgcgttcgatccgctgggcaccttgctgctggccctcacgctgctggcctacgggctggccatgaccctgggccgcggccatttcggcctgctcaacgccgggctgctgttggtggcgctgatggcggccggcctgtttgtctgggtggaagcgcgggtggccgcgccgctgatacgcctggcgctgtttcgcgacggggccttgagcggcagcctggccatgagtgcgctggtctcgacggtgatgatggcgacgctggtggtcgggcctttttacctggcccacgggctcgggctggaaacctttgcggtgggcctggcgatgtcgctcggtccctgtgtcaccgcgctgagcggcgtgccggccgggcgcatagccgatcgttttggcgtgcggccgatgatcctcgccggcctcggcgccatggtcctcggttgcctgatgctggcgttgctgcccgcgagcctgggcattggcggctacctggcgcccatcgttgtcatcaccctgggctatgcgacgtttcagaccgccaacaacaccgcggtgatgagtgaagtgggcgccgagcagcgcggggtaatttccggcctgctcaacctgtcgcgcaacctcgggctgattaccggcgcctcgctgatgggcgcgctgttcgcggcggcgacaggggagctgagcacggcgagcgccgaggccgtcggcagcggcatgggcttcacctttgccctggccgcggggctggtactcatggcgatactggtggcgctgctcagtcagcagcgccgatggcgggcgctggattcagtggcttagtacaaagccactcccagctcgcggcagcaaaccagcctctgtaggagcgaggcttgcccgcgatgacctaaccccattcgacgcaggaggccgagccctgtcgcgagccattgaccgaccgctacagataggccgttcaagcctgagcgccttcccccatcagcaacgcactgtaggcccgcagccgctgcacgaactcactcaccgaaccctgggaaacataggcctgcttgaggaagaacgcggcatactcggccatccctggttcggccgccgtcagcagatgggcatgctcctccagggtggtcggccagccgcgttcctgctcgccgcgcagcaggttggccgagcgcagcgccttgcgcgccgcggcccgttgcaggcgttgctgctgcaacggttcgcggctttgttccagctgctgagcgtagccttccagcacctgggggaagtcgccattcagcgccagggcgatggtccggctcgggcggaaaggctcgaagcgcagccccaggtcattgccccaaatgcagcggcactgatgcttgagccagaaaccccagcggtagcgattgtcgggcgccagcacctcgctgagcacgccgatatcgaaatcgatcttcgacacttccgggtgttgcgcttccagcgcctgccgagtctgctccagccgctggcgctcctcggggctcggtgcccaggccaggaccagggtcacatccaggtcggaggtgcccggccgcgcgtcgccacgggccacgctgccgtagaggtacaggccatcgagcagcgccggaaaacgccgcgagagcatcgcgcgcaactcatccaccaggtggctgaacgccggttgcaacggcaggtcgggcagggactggataaaaccttcggcgtcgacgcctgggtattgcgacatggtgatctcggtggggcaatggcgatgaaaaccgcccgggccaggcgggcggttggcagacagtctggctgacttcacgaatcgcgcaagctggcgcggttcaacgccacgccgtcacgggtcgaggcttgccagatcgttaccgaggggcgtcggcgactcgccgctgatcgcgcacagcagagccgtgatggcttccccctcgaccatgccgcgctcttgcagcaggtccgccaccgcgccgaccgccggccagtagcgatgcaccaggcagctggcgcgggccatggcccgggattcggcgtcgagcagcttgcgtggcggcagcaggctgatcagctcatggccgcggctcaggtcgccgcggccgctgccttttatcagcctgtcggatcggccatggcgatagatcgcttcggccaccgggccggcaaagcaatgcagcaggtcgcgctcgatggactcgaccatcgacggcaggtattcggcgatccccggggcgtcgaaggccgggcgcgggaccaggtaatcggcttccaccaacccctctacatagcgcgggttgccgcgcagatcgagcatcggacccgcgtcggcttcggccctggtgcgcacggtaatgcgggcgatcggctgaccgttccaccagaaggccagggcgtggccggcttcgtggatggccgtgcaacgaggacgctggttcatggtcttctcccgtgctctgtacgcgtcgggcggacgaaaaaggcggggcatcagtcgcaaaagccgtcagagcccccgcgggcgctgtccctatcattggcttcggccttgggccctgggtaaaagcttgtccctatcaacaaccaatagtccggctattagcgatccgccacagaggggctagccttaattcagcgctggcgcgagccggccggatgagacctgatcgagagataacgaaaaacgagtcagaagcgtaccgggcttaccgtgggccaccgtcctggcaactcgcttgccgctctgcagcatgccctgtggccacacccatcagttgagcgaactgtgagccccgcaacctatgtcattgctttcgcctgtcgctatttcgcgcccatccgggccggatagctggatgaatacgaccaaaggtagctcctcatggcaaacgaatcgaaatgcccgttcaaccatgccgccggcggtggcacgaccaaccgcgactggtggccgaaccaactgaacctgaagatcctgcaccagcactcgtccctgtccgaccccatgggcgaggacttcaactatgccgaagccttcaaaagcctggatttccaggccctgaaacaagacctgcgtgcgctgatgaccgactcccaggactggtggcccgccgacttcggccactatgggccgctgtttatccgcatggcctggcacagcgccgggacctaccgcgtcggtgacggccgtggcggcgccggttccggccagcagcgcttcgcgccgctcaacagctggccggacaacgtcagcctcgacaaggcgcgccggctgctgtggccgatcaagcagaagtacggccgcaacatctcctgggccgacctgatcgtgctcaccggcaacgtcgccctggaatccatgggcttcaagaccttcggtttttccggcggtcgcccggatgcctgggagccggacgaagacgtctactggggctcggaaaacaaatggctgggcggcgacacccgctacggcaaaccggataaagccgccatgcaagaacccggcgagggccagctggtggccgagcctggcaatgaagaaagtcgcaccgaccagggacgcaacctggaaaaccccctggccgcggtgcagatgggcctgatctatgtgaacccggaaggccccgagggcaacccggacccggtggccgccggcgtggatatccgtgaaaccttcggccgcatggcgatgaacgacgaagaaaccgtggccctgatcgccggcggccacgccttcggcaagacccacggcgccggccccgccgacaatgtcggcgccgaacccgaagccgccggcctggaactgcagggcctgggctggaagagcaccttcggcaccggcaagggcgccgacaccatcaccagcggcctggaagtgacctggaccaccacgcccacccgctggagcaacaactacctggaaaacctgttcggcttcgagtgggaactgaccaagagcccggcgggcgcgcaccagtggacgcccaagggtggcgccggcgccggcatcatccccgatgcccacgacccctccaagcggcgcaacccgaccatgctgaccaccgacctggcgctgcgcttcgacccgatctacgagccgatctcgcgacgcttcctggagaacccggaccagctggccgatgccttcgcccgcgcctggttcaagctgatccaccgcgacatgggcccgctctcgcgctacctgggcccggaactgccccacgaagaactgctgtggcaagacccgatccccgcggtggaccatgccctggtcaacgacagcgatatcgccgcactcaaggccaaattgctggcctcgggcctgtcggtgtcgcaactggtgtccaccgcctgggcggcggcgttcagcttccgtggctccgacaaacgcggcggcgccaacggcgggcgcctgcgcctggccccgcaaaaggactggccagtcaaccagcccgagcaactggccaaggtgctggcgaccctcgaaggggtccagaaggacttcaacagtgcgcaatccggtggcaagaaaatctccctggccgacctgatcgtgctcggcggcagcgccggcatcgaacaggccgcgaaaaacgccggcctcgacatcagcgtgccgttctccccagggcgcatggacgccagccaggagcagacggacgtcgagtcgttcggctacctcgaacccatcgccgatggctttcgcaactacctcaagacccgctacgcggtaccggccgaagcgctgctgatcgacaaggcgcaactgctgaccctcaccgccccccaaatgacggtgctgatcggcggcctgcgcgtgctcgacatcaacgtcggccacaccccccacggcgtcttcaccacacggccgggcgcgctgaccaacgacttcttcgtcaacctgctggacatgggcgtggaatggaaacctgtctccgacgcccaacaagagttcgaagcccgcgaccgcaagaccggccaggtcaaatggaccggcacccgcgtcgacctggtcttcggctccaacgcccagttgcgggccctggccgagttctatgccagcgcggatgggcaggagcagttcgtgaaggactttgtcgcggcctgggtcaaggtgatgaatctggatcggtttgatttgcggtgaggagggcgccttgaggtctggaaacagggctctcgacctgatggttcaggtcgggggcacccggccggaggtaggcgcgtcataaaccattcggtgtttttgaaagttgctaacgcctcccagtgtggaggcgtttttttttccggggggaaggcgcagtgactgttcgcggggtggcgattgcctgggctcattggcacaggacggggggatatccacctcttgataggtgtcgataacctgtcctttctctggctactcaagtgcatttgatctgatcaggatcaggttttccttacggcaattttggataattcctacccctataccttcgtctctttggggatggtggcaagcctgatttggacgcctgatgtggcggccacaggcccatcagatcaggcgtcgagaacatgcaagtggtgtgagtgcggagttgaccctcgtgcatttttacaaataggctgctgccctgatgtgctgcctgggcagatgagcagcgctggattgctcagtcatttccggggcggacccaggtatcagtccaggtagtgcaaggtgcggttgacgcttggtattggacgccaagttcatacaccgggcgcctcaatacgttgaccaaggatgagtcatatgcgtcaaagggatttgagattcaccttctccgtgctgtccgggcggatggagttcgaggtcgtagagttcaccctggaagaagccatttgcgagccttatcggctgacgctcgaactggccagcgacaaccccgccctcgattttgcccaggtcctcgatcagccggcgttgctgacaatctggcaaggcaccacggctgtccgtcatgtgcatggcatggtctcccgcttcacccagggcaaaaccgggttccgccgcacacgttaccgtgtcgtggtcgagccacagctcgcccgactggccctgagttctgactggcgtatcttccagcagaaaaacgtgcccgaaatactcaagtcggtattggccgagcacggcattctggattatcagcagagcactcataccgagcacctgcctcgcgaatattgcgtccaggccggggacaccgacctttattggttcgacaggctttccaccgaagaaggcctgttctactacttcaaatccgacgcgacctcccacacgctgatccagagcgacaaactctacgttcaggaacgcatccagggtgatccggtgctgtacagcgcacagccggctgcggatgccacgcgaccggtgctgtatgcgttcagctacacggaaaacgtccgcacggccgagcagacccagcgtgactacaccttcaagcgtccggctttcgatcagcaacagcgtctcgtcggcgacgagttgcagcaccaggcccggcactatgaacgctacgattatcccgggcgctacaaggccagcgcagccggcaaacccttcactgaaaaccgcctgcgtggccaccgtcgggacgcccagggcgccctggtcgaaggtgacgatccgcgtttgatcccgggtctttccttccagttgacgggtcacccccggcaagacttcaaccgctggtggcgttcggttcgcattacccaccgaggcgtgcagcacgccagccagcaggaagagtccgccgacgccgaaatgggcgtgagctacgacttcaccgccgagatcattcccgaagaaatggaatggcgcccggcgcccctgcccaagccccgtatcgacgggccgcagatcgccagcgtggtgggcccggaaggcgaggagatccacaccgacgagtttggccgggtcaaggtccagttcccatgggaccgggaaggccggagcaacgaattcagttcctgctgggtccgggtctcgcagaactgggccggcgccgactggggccatatggcgatcccgcgtatcggccaggaagtcatagtcgattatctcgatggcgactgcgaccagccgatcatcaccggccgcacctaccgtgcgagcaacatgccgccgtacccactgccgaatcacaagatcctcagcaccatcaagagcaaggaatacaaaggcagccgtgccaacgaactgcgcatcgatgacaccaccaagcaaatcagcgccgcgctgatgagcgatcacggcagcaccgcgctgcacctggggtacctgactcacccccgtcccgacggtggcgcaccacggggtgagggtttcgagctgcgtaccgacgagcatggtgcgttgcgcgcggccaaggggctgttgctcagcaccgaagaacagttgaatgccggcggtggccaccttgatcgtggcaccgtcgttcaagtgctggaggccgcgctgcaactggccaagggcttgggagactatgccgccgatcaccagggcatcgaccacgacaccgatcctcagaaagccctcagtgaagcggttcgcgatctggggcatggtgccaacgatgagtcgggcaaaaccaacggtggcacaccggccatcgccctgagcggccaggcgggtatcgctgccgcctctcccaacagcgtcacgctggcggccggggagcatatcgacagcgtggcccagcagaaccagcaactgacgtcaggccagaagtttgtggtcaacgccggcaccgacctcgggctgttcgcccagggcggggagatgcgtcatatcgctcaccaggggccaatgttgctgcaggcccagaagaacaccatccgcctggaggcggaccagagcgtagaggtcagtgcgagcaatcagcacgtgctgattgccgcgaaggagcacatcaccctgatgtgtggtggtgcctacctcaccctcaagggcggcaacatcgagctggggatgccgggcaacttcattgtcaaggcggccaagcacagtcacgtcggaccggcacacgcctcgaccaccttcaacacctgggactccacgccatttgatgacgcttttgtcctgcgtgacgaaaacaccttggagcccctggccaatacggcggtggaactgctgcgtggcgatggggcgcccctcaaactcaccaccgatgcccaggggcgcttgccgaggcaacaggacctggccatggatcgggttcaaatacgtgttttggccaagggagccagtatcaagggtgacagggagtccaccacatgagcagcgaagtgaatacccaggaagtgatagtgccgcgtgcgcgcgacaacctgggccgtcccgtctacaccagtcagctcacccgcactgaggatcagcgcgacaaggtgttactggtgaagcagcaggtcaccattccggtgattttcattcccggcatcatggggaccaacctgcgcaacaagaagaccttgaacagtgtctggagtccgcccaatgcgtcgttcagctttggcgatatcgcgggggccctgggagcattgtttgtctggggtttccgggggccgaaaagacgacaggagttgctcaaggtcgatgatgtcgaggtcgatgatcgtggaacggtcgatcccggcacatcggggctgagcgaggaggccgcgcggatgcgcggttggggcaaggtcatgcgtacctcctacaacccgatcatggcgctgctggaaaaccggctggaccatatcgtcaaacaacgcgagcttcagggatggtggaaagctgaaagcctgcgctcgcctgccgactatggcgaagagctgggcagtgccgctccccttagcagcgacgagctgagcgcggcgggcaagtatcagttcgatgtctggtgcgcaggctacaactggctgcaatccaaccgccaatccggccaggacgtgcgcgactatatcgagaacacggtattgcctttctatcgcgagaagggcggggtcgaccctgagcaactggcgcggaccaaggtcattgtggtcactcactcgatgggtggcctggtggcccgatcgctgactcaactgcatggctacaagcgggtgctgggtgtggtccatggcgtgctgcctgcccttggctcatcggccatctatcaccatgtgcgctgtggctacgaaggggtggcccaggtcgtcctcggcgccaacgccggtgaagtcacggcggtagtggccaactcgcccggcgcgttggaactgaccccctccgcggaataccgggaagggcgcccttggctgttcctgtgcgatgcacaggggcaggtcatgaaggacattgatggaacgtctcgtgcttatcctcagcagggcgacccttatgaggagatctataagagttcagcctggtatgggttggtgccggagcagaacgtcaagtatttggatatgtcgagcagcgaaactactaatggcagggtaaacctacgggcaagatttaataagcgaatcaatgacgtggccaagtttcatcgtgaacttgcagcagctgggtattaccccgaaacctacgctcattatggtgctgacgattcctctgacaggcacagttggcgggacatgatctggcaaggcgattcaacttccctggagtcatccggttttaccgtcaaggatgatgagaatggcagttacaacggctggttccgccgtggcctgcctgctgttgtcgaaggtccgttgcggtttgccgtgatgcaggaatcatccggcagcggtggggacgggaccgttccgaccgactctggcctggcccctggcaaagccggcatcaaggccagcttccgccagggcggtaagggcgtcgggcagtacaacaccgacaaaggctacgatcatcaacacagctacaacgacaaacgtgcccaatgggccactctctatggcgttatcaaaattgcccagcatgctgactgggcaggaggttcatgatgcgcctgcgtcagctcttcactgttcttggcatggtcgccttgaccagtatcaccagttgcacatcattctcctcttctcggaacccttccatggacaagaccggatggatcacccattgctttggcagattcctgattgatttgccgccccaggcggaagtcagagcggggtattacttgcgtgggcaggttattgagccactaaaggacgatctcgctgcattcacgtccaggatcgatcagcatgagcaggagcttaaacggcagcagcatgatacgaagggaagcatgtttgtgcgccggtatgatctgggcaaaggctcaaccgggatactgtcttgggcttccgatgccagcatcgagtcgtattacctgtacgcctatgctgtttcagaacctgtgtggcagccttattactggaggattgagatggagccagatcgcgagcctcgtggcattgaggtcgcgaagaacctggtacgcgatcttcgctctcgcgaacccagtgaaattcccaccgagccggggttttgcattgatcgtggctatatcgcaggcaatcacttccagagcgaacgtttcgatattggcgtgactttcccggatcatcccggtgctcatttcgaattcagttccagcaccggcgcagaagagaaccgcctgctggatcgtgtgggaggtttcctagcaggtgccgccagggctgttacgggtatcgagaccctgcgtaaaagggagcggggcggtccggttcccgctgacgaatacctgttggctggcaccgacaaggggcagcgcatctatacgttcgcctgggaagctcaaggcaaagacggctctatcaccgagccaaatatctcagctgcccttggcgtactcgagcgtagccctgacagcagcggcaaactacctgcgcccccattcaagtcagacaaagaagcgctggaattgtgggacaccatcattggctctatccgcttgcgcccggtgtcttctgcgccgcgtggcagtaacgcaggcagccccgctccaactgccccaacggggaatacgaaggccgtggatgacgattacgccatcgagagattcctggccgacctgaagccgaacaacaactggatggatgagttgtaggagctttgtcggcatcagtacgcgttggggcagagggtacttctctctctggatcatcactcttcacagccgacacttttccttcggcgggcataaagcctgccgaggcggaagtgtcgggtggtacagcggaaaaggactagacgtgaacatcattcgagatgataaggaccgcagggataacggccggtttcaccgagatttgccatcgattgtcgaagtcctccagcagttagaagattcatgatgcgtgcccatcagttcctcactgttcttggcatcgttgccctgaccgggataaccagttgcacattattttcttcttctcgggacccagtcatggacaagagcggatggatcacccattgctttggcagatacctgatcgatttgccgccccaagcggaagtcagagcgggttactacctgtggggtgacaatattgaggctctcgacgaaacgcctgcggccttggccaccaaaatcaatcagagtgagcaggaattaaaaagccaacaacatgactcgaagggcagtatgtttcttcgccggttggattttggtgcaggtgcatctggattgttatcttggtcttcggaagtcgcttctaaggtatatcttctagatacctacgttgtttctcacccaacatggcgtgcttatagatggaaaggaaatgtgtcggcagatagagagcctcgcgccatagagctttctacccttctagcccgtagtcttcgctcccgtgagcctaatgaagttccttccgagcccggattttgcattgatcgagcctatatcgcaggcagtaactttcagagcgaacgtttcgatatcggcgtgactttcccggatcatcctggcgcccacttcgaattcacctccagcaccggagccgaagaagatcgtctgctggatcgggtgagtggtttcctcgcaggtgccgccaggatggtgctggggatcgagaccctgcgcaaaagggcgcgtggtggaccggttccggccgacgaatacctgttggccagtactgataaggggcagcgtatctatacctttgcctgggaagcccagggcaaggatggctcgatcaccgaacccaatatctccgccgcgctcggcgtgcttcaacgtagccccgacagcaacggcaagctgccagcgccgccattcaaatcagacaaagaagcactggcgttgtgggacaccatcatcagctccgtccgcctgcgcccggtgtcttcgcgtgacggtaatacagcaggttcctgaatatttgtccttcgggggcgcaaggcccaggagggaggagtgtttgtgagtacaacggaaaaggagcagacatggacatcatccgactcggcgattccaccagtcacggtggaaccgtgatcgaagcgttcaaccagaccgacctgaacggcaaacccatggccggggtcgggcacaaggtcacctgccctctatgcaaaggtgtgttccctattgccgagggcagcgccttgctggatgtcggcggtgttcccgtggcgctccatggaatgaaaaccgcctgtggcgccagcctgatcgccagcgggcccaaaggcgacgccgggagttagtcaggtagagggtggggagttacacggacttgcccacccgtttgcattcgacctgccatgacatctcctcgttttgattcgttcttaactagcgaaagacaaccgctcctaccattgcgtcaaactcgacgatccgtgcttcaccgcgcctatctacgccaacctcttcgaaggcgacgacgcaaccggagaagggaatctgtgctctcaaaccagcatcgactgctgggcgaagatacccgccatcgcgccttgccatgatgccgtggtgaccgatgccatgagggggtttgccaggtcgccggcggcgtagatgccaggcatgttggtttcgcggcgctcgtcgaccttgagggcgatgcccaggggtgtatcgaccgtgtcgaggcccagcgattcatgcaggcgtgcggacggcttgttgcgcggatgggcgaacaggatgtcgatcgcgacagaggggccggcgtcgagcctgacggtggcgttatggctctcgtcatggtcgatttcggtgatccggccatcgacgacagggatgccgcggcgcgccagatcggcccggatgtcgggtggaatgtcgtgaccattggcgaagaccgtcaatgtgtcggtccagtcgtggtacagcctgacgtagttgtgcgacggcgggccggaccagacaaggccccaatgccggccggcaacttcaaagccgtcgcaataggggcagggcacgatggaggagccccagccttcggcaaagccgggaacttcaggcatctggtcggcgacgccatagctcaggatcaggcggcgcgccctgaggctttcgccatcgccagtgaggacggagaaatcgtcgatgacgccggagatgctctcggcccgcgcagtgatcagcctgaccgtgggataacgcgccagctgctgccgcgcctcggccaggatctccagcggtggcttgtggtcgtggccgagcaggccatgcgagtggtcggcgaagcgattgcgcggcaggccggtgtcgagaacggtgaccttgcgccgggcacggccgagctgcaaggcggcggcaagaccggcaaaactgccgccgatgatgatgacgtcattcatggtgatgggctccgcgctgtggatgaagggaatcggcttgcacacttaagatactttggagtaccctaattcaagaattagaatactgtcaagtactggaatttttatgagcgaaaacagccagagccggcgcggccggcccgccaacgaggcgcttggccaaacgatagccgacgccgcgtgcgaactttttgtggaattgggttttcaagcgacgaccatggataaggtcgctaagcgggcgaagatatccaagctaagcatctatcggcacttcgagaacaaggaggcgctgttcagcgcggccatcgcggcccactgccagcagtttgcacctcaggccctttttgaaggtgtcgacggttcggccgaagatcagctcatggcggtgggatcaaccctgcttcgcacgctgttgagcccggacgtgcgcagtgtcgaagccatgatcatggccgacaagaccaatcaaaagtcgttaagcaagcgccaatatgaagccggccccgcctatgtcatcgcccaaatcgaggccctgttgcgtcagttgcacgcgaaggcggttctgaacgtgcccgatcctctacggtcagctcgcttgtttgccgcgcttttcaaagggtccgatcttctgattatcgcgcgcttcgatgaggcgagagccgaggacgataacgaaatcgaatcctattgccggtcggccgtcgccatgttcatcgccgcgcacggtggcaacgaccatgcgggcggataagcatttgattgctccgggcagcttggcctgggcggtcgtccaggcgcttcgtcatattgggctggcgcgcgccaatatggcgacagtatcgaaacgttgctttggtggatcaatggcagccctcggaaaaccctaaactacgaaacgcccgctgaacgatttagccagtctgttgcatcgaccggttgaatccacagccagaagcgggcattcgttcgtgtcggccaacgacgaaatgaaagcgagtcagcacgcgttgtgcgacatccatctatctcctctacgactgagtctgcgattggctagataatgattcggtcatttgcgcgtgacacaccgccagaatctcatcggccagcgccgagtcgtcaggacaggcgcgcgacaagatgatcgccccgaccgcgcgcgccagcaggtcgatcattttcaccctcgcttcacccggcgccgcatccggcccggtcgggtatttttcgccgagcgtttgcaatgtgcgctcgatgccttcagcgaatgccgacttcaaattgtccgactgacgcgctgcgtcaccgcacaacgccgccatggtgcaacccgtggcgcgcccatcgcgatgatccctggacacatacacatcgatgaaatccttcacgctcaattcttcggcgctggcaagtgactgcgcaaggctgttagccgaggcttcggccatcaggtccgccttcgaaccgaagtgtttgtagaaaccgccatgggtgaaaccggcggcggccatcaagtcggccacgccgacaccgtcaaaaccgcgctcgcgaaacatgactgaggccgtttcgacgatgtgctcccgatttagctgggcctgagccttggacactcgcatgggaaatacctcgctaccgctggaaattcatcggctgatgatacatagatgttgaccataatcaaaatcgttgacagtttagatttcgatcatcatcctaatcgaaagcgacctgaccatttccccacgggcacggaacaaacacccatgagcgacctgaatctgtttaccccttacacgcttggcgcgctgacgctggcgaaccgcgtggttctcgcgccactgacgcgcaatcgcgcaggcaaaggctttgtaccgagtgagttcgcggctgcctattacagccagagggccagcgcgggcttgctgatttccgaagcctcgcagatctcgcagcaggggcagggctatcaggacaccccgggcatttacacgcagccgcagatagagggatggcgcaaggtgaccgatgccgtgcacgccaagggcgggagaattttcctgcagttgtggcatgtgggccgcgtatcccacgtggatctgcaacagcacggcgcggcgccggtagccccttccgcgcttcgtcctgcgaccaaggtgttcgtcaacaatcgcttcgaggacgtttccgagccgcgagcgctggagactgacgaactgccgggcatcgtcgacgatttccgccaagcggcggcaaacgccattgcggcaggcttcgacggcgtggaaatccatggtgcaaacggctatttgctggaccagttcatcaaggacggctccaacctgcgtacggatgcgtacggcggctcgatcgccaaccgtgcgcgcctgctgctggaagtgacggccgccgtggtcgccgagattggcgctgatcgcacgggcatccgcctttcgcctgtctcgccggccaatggcatatcgagcagtgacccacagtctcagttcgattacatcgtcgagcaactcaatgctctggacatcgtttatctgcacgtcgtcgaaggcgcgaccggtgggccacgcgatgtggcgccctttgatttcgatgccttgcgccggcgcttcaagaacacttacatcgccaacaacggctatgacctggacctggccacggcacgccttgcgcatgacaaggctgacctgatcgcctttggccgtccatttatcggcaaccctgatctggtggagcggctcaagaccggtgcgccactgtccgccttcgaccccaccacgctctacggcggcggtgcggcgggatacatcgactacccgacgcttgccgaatcaagcgctgccgcgaactaggcactggccgatcgagcctggttttactcgtgcatcaatcccaattcatgttcccgacaaagagctgacatcatgacgactcgccccaccgttctcatcactggcgcttccaccggcatcggcgcggtttacgccgagcgtttcgcccaacgcgggcatgctctggtgttggtcgcccgcgaccactcacgcctggagacgctcgccgcaacgttgcgtggcgaacacaaggtcgccattgaagtgcttccggctgacctgactcaactcagcgacctgcacatcgtcgaagcacgcctgcgggatgacgagcgcatcggcatcctcgtcaacaatgccggcgccgcacagtccggccacttcatcgagcaaagcaccgacagcgttgcacaactggtggccctcaacaccaccgcgctggtgcggctcgccagcgccatcgcgccacgcctggccaaggcaggtgaaggcgcgatcatcaacatcggttcggtggtggggctggcgccggagttcggcatgtcggtctacggggcgaccaaggcgtttgtgctattcctttcccaaggcctgagcctggagctgtcgccgcagggtgtttatgtgcaagccgtattgcccgccgccacccgcacggagatttgggatcgcgccggtatcgacatcaacaccttgagcgaaatcatggaggtgggtgacctggtcgatgccgcactggttggtttcgaccgtcgcgaaccggtgaccattcctccgttgcaagaaggcgagcgctgggatgccttgcaagccgcgcgccaggggcttttgtcgcagatcaggcaatccgccgtggcgcaacgctatttgactcaggtctgaaccatgtcaagcaggtcggcctcgccccgcaatcggagggaataaacatgacccccatggctacccgcaatcacccgggttcgcagccgtcatttatcaacgcggtgaaccagtcggttctgattggcgggatacctttcgcctatcgtgacctgggacccaagacggaggtcccgctggtcatgtttaaccattggggggccgtgctggataacttgttctttaccaccacggccaatggccaacgcgccgcgtcggagtatgtgcaacgtttgaaagagcgccaggaagatcgggacaaaggcccgacaccccgcgcgtttctacggcagttcaaagccattaccgcgtggggcaggcaggcctcgcaagatctcggccgcctgcggatgccgaccctgatcgccaacggggacaacgacatcatggtgcccaccgtgaactcgatcgagctggcgcagcgaatccccaacgcgcaactgatcatttatcaggacgccgggcacggcagcattttccagtaccacaccgatttcgtggccaaggccgtggcgttcctcgacgcctgacggcctgtgtctctaatcgcatcgaggttgccgtggccgcgcccattctcacttcaccgacaagagtatctgcaacatgaaggcattttttatcgaccgctacggcaagcagaacggaatgcttggcgaagtgcccgacccggcggtcggtgtgcatgacgttctgatccaggtgcatgcaacgagcgtgaacccgttggactcaaagatcagaacgggggagttcaagctgatcctgccctatacctttccattggtgttgggcaacgacctggccggagttgtcgttcgcgcgggatcggcggtgaaacgattcaagccaggagacgaagtctatgcccgtcctcccgaggcccggatcggcacctttgccgaactgatcgccgtgaacgaaagcgcgctcgcgctgaaaccctcgaatctcgatatggccgaagcggcttccattcccttggccgccttgacggcctggcaggcgctggttgagatcgcccaggtgaaaaaaggccagaaggtgttgattcatgccggatccggcggtgtcggcacgcttgccatccagctcgccaaacacctcggcgccttcgttgcgaccaccaccagcacggcgaatgtcgaatgggtgaaagcactcggggcggatgtggtcatcgattacaaacagcaggattttgcaaacgagttacgtgatttcgatgtggtgttgaacagcctcggcgccgatgtactggataaatcgctcaaggttctcaaggctggcggacagctcatttccctttcggggccgccgaccgcgcaatttgcccaagagcaaggcttgtcctgggtgctggggcaagtcatgcgcctgctgagcagcggtattcgcagaaaagcccgcaagcacggggtgaactacacctttttgtttatgcgcgccgacgggatgcaactgcagaaaatcacctcgcttatcgaggctggcgtcatcaagccggtcatcgatcgttccttcccttttgaatcgattgcagaggcgttgcggtacgtcgagcagggcaggtcaaaaggcaaagtcaccgtcacaatcaaatagcgcactacaaaaaatgtcggtagataacgtagacgccacccagtatcaggctcccgcgcctgaaccagagccgccgcccaacatgcccacacaggagccattgccaccgaaagtcgcgcctgcagaaaagccgacgatcatctggcgcagtttgctgctggagcagtaacgagaaatgcttcattgcaattgaaacgatgcttgctgcgtcaccggtttccagcgaatggcaagttcgccgaaaaccgccattcacgaaaggtccatcggacgaccagaacccccgcgcaccaagccccgccagccgccgaactataattaacaagcaccccatctgcccggcgagtaccgctgtgcccatcggttacccagcaagctcacccgcccggcagagggcagtccaaccaatgggacgggacgcccaactgatgacacgagagggacccgccatgaaacttcattccttccagcattactcccatggcctggaaatggccgttcacgatgcatgggtcaccaccaaggtgaggtcggccctgacctttgccgaatcgacccgtggtttgcctatccatgtcaaaacccatgccggcatggtgaccttgagcggtcggctcaacactcataagcagtgtgagcaggctgtcagcctgacccgtggggtacacggcgtcgccggcatcgatgccagcgacttgcagacccatatgttcacgccgggaagcctgcctgaagcgcccaatgctgaagagaccagcgaatacccttcgccgtcggcgacgaagagggacgacaaatgaccaaggcgaaggcttgagcgtcgcgccgggaggccagcgcgacgctgggttcgatagccctttcggcggggcctcaggaggatcgtcagcatgttgaaagccctgcccggtcgggtggggcttgctctcaactggcaaatgcacccagccaggccgtatctggcccgtgcaatgcgcaggcagtcccttcagcccagcgcggccagcatcaaatccagattctccactgccgcccccgccgcgcctttgcccaggttgtcgaacaccgccgccaacaacacctgaccctcaccctcgaacaccatcaagcgcatcgcgtcggtatcgttcagcacctgcgggtcaaggcccgtgagttcttgtgcctgccgaagcgacatcacctgcacacaaccgctgccggcgtagtgctgttccaggcaggcatgaatgcgcgtggcatccacgcccggagcaagtaggcgcagctgtagaggaatggtcagcacaatgccctggcgaaaggcaccgtaagcggggacgaacagcggccgttcgctcaggccactgtgttgctggatctccggcacatgcttgtggcccaggcccaggccgtagatctggaaaggggcggcttgggacgcattcggcccttcgtgggcttcgaccgcggcgcggccgccgccggagtagccggagatcgcgttgatgctgatcgggtagtccttcggcagcagtccggcttgcagcaaggggcgcagcaggccgatggcgccggtggggtagcagccggggttgctcacccgtttggaggtggcgatgcgctgtgcctgttgcgggtgcatctgcgcgaaaccgtaggtccaggtgggatgggtacggtgcgcggagctggcgtcgatgactcgcacggccgggttgcgaatactggcgaccgcatcgcgggcggcatcgtcgggcaggcagagcagggcgatgtcgcaggcattgatggcttcggcgcggcgttgcgggtctttgcgctggtcggcggcgagggtcagcaggtgcaggtcgctgcggccctgcaggcgctggtggatctgcaacccggtggtgccctggtcgccgtcgataaatacgaggggtgtgctcatgctgtgtgctcgcaagaaggaagagttgggcaaatcttccggccgcagctgaaatagagaaagttgaatttaataacgctaagcttcagtttttctgaatctggagcaggccatgcgtgagatcagcctcgaccggttgcgcaccctggtggcgattgtcgacctggggtcctttgccgaagcggcccgcgcgctgaacctggcgccgcccacggtcagcctgcatatcgccgacctggaggcgcgggtcggcggctcgctgttgtcgcgcacccgcggtcgggtgcagccgtcggccattggcgaaaccctggtggagcgggcgcggcgcttgttggccgatgccgaacaggcgctggaggatgtgcagcgtcaggtgctgggcctggccgggcgggtgcgcctcggggcatccaccggcgccatcgcccagttgctgccccaggccctggaaaccctcggccagcgccatcctggcatcgacctgcaggtggcggtgctgacctcccaggagagtttgaagaagctcgccgaaggttcgctggatatcggcctggtggccctgccgcaaaccccggtcaagggcttgcgcatcgagccctggcgcaaggacccggtcatggccttcctgccggcccgctggcaatgccccgacccggtgacgccgcaatggctggccgcccagccgctgattctcaacgaccacagcacccggttgtcgcgcctgacttcggagtggttcgccctgggcggccagcagcccacggcgcgcatccagctcaactacaacgacgccatcaagagcctggtggccgccggttatggcgccaccttactgccccacgaagccgccacgccgctgcccgacacccggatcgccatgcgtccgttgcagccgccgctgtggcgccagctgggcattgcccatcgggacggcgaggtggaacgctcaacccaacatgtgctggaggtgttgtggggcttgagcgccgattgacgacggggtgtgttaacccagcaggtgcttggaaatgtgcttcgagatttcgaccatcgaagtcttgccggtgaactcgaacttcacctggcccagcgatgaaaagtagatctccagctcggagtccaggtcgaaggtcccggaggtttccaccgagtaagcgacgatgtttttgtagggcagggaggtgaagtcctttttgctgccagtgatgccctgcacattgaccgcgatgatgcgcttgttggtaaacaccacgccgtcgcgcatggccttataggcgtcgatcacctgttcgccttccagcaacaggtcgctgacccgctcggcgtattcatcgttttgcttgagcttgaagaagcctttgttgttgaagtcgatcatggggggagtccttatttttgaagcgatattccaggttttttgctggctgttaaggcgtgtcggacccggctcaggctccatcggctcctatgcaaagcgtatggtctttgcggtgagtccgccgtttgggtattggtggtacagcgttataccaagaggttgctggtagcagatatcagttaaggcgatgtctctgatggtcttcggattatcctgatcgatttttagccggaattaataatttatgaggcggctgttactttggactgcacatgattttattttcatacggcatcactggttaagaccaactgttgggaactgaaaggatgaaacggattttagcggtattacttttgatcacgggcagtatgggagatgccgcccatgctggggtcgatgtcgcagcgccccggcagtcgttgaagaattatggtcttggctattgcatcgttaatcagtttaaaaatgagtccgatgtgaagagcgatattgagtcggctattggcgcctattccttcatgggaagtggtatgcataccattcttcagaatgaagacaccctggagacattgcataacccgtacgacgcaacgacggattttgtattttccatgtatgagaaaacccaggccagtagcaagtatagggataagaaagtcgtattttatgcctgcctcgatatctataactccaaggcgttcgacgattttatcaagacgcaggacccgtacatttccaagtgaaggggatcatcactgatccggttctctcagactgagcgagatatccaatatcgcgctcgtcaccctgacttaaaacaacttccagccataactcagcaacaaccggttctcattgatatcggtccgataattcgagtgcgccaccaccgcgagtcggctgcgcgcgaggggtcaggtgtcggagtgttcggcgcgcagttcgtcgatcatccgcaagcagtggctgagccccgccgacacatcgccgacccgccggctgatgatgatcggcgaggtggcgttggcttccagcagcgggctgaagccgatgtcgtcgcggtgcagcaattgcaccgaggccggcaccagggtgatgccgatgccggcgcccaccaggccgatggcggtctgcagttcgttggtccactgcacgacgcggatgttcaggccgtgggtgttgaacagcgcgatcacgtggtcggcgtagctcgggcgcgggttgccggggtagagcacgaaaggctcgtcggccagttgcgcgaggctcaccggctggccgatcagcggatggccggcgggcagggcggccaccaggcgatcctcggtctgcaccttctgcacgatggccggatcgtcgatgcggatccgcccgaagccgatatcgatgcgcccggccttgagcgcttccacctgctgcagggtggtcatttccgacagccccagttccagggccagggtttcgtggctgcgcaggcggcggatcagttccggcagcaggccgtacagggtcgagggggcaaagccgatgccgagccaggtcttttcgccgtggccgatgcgccgggtgttgtcgcagaccttggccaactgctccagcagaacgctggagtgctcatagaaaaagcgcccggcttcggtcaggcgcaacggccggccgcgctccagcaacaacaccccgagttcttcttccagttgctggatctgccggctcaggggcggctgggcgatgtgcaggcgctcggcggccttggtgaagttgagggtctggcccagcacctggaagtaacgcagatgacgcagttccataaggcctcctcgggcaaaggttggatacctttaaggtatcgagctagaccaattctatattggaaccccggaaaaagccgtacgagaatcggctccataacgtcaagaacctgatgggtatggaaatgctttcaagtgccattgaatcgatcgaaacgatcatcgtcgatctgccaaccatccgcccgcacaagctggcgatgcacaccatgcagaaccagaccctggtgctgatccgcctgcgctgcgccgacggcatcgaaggcctgggcgaagccaccaccatcggcggcctggcctatggcaatgaaagcccggacagcatcaagaccaatatcgaccgcttcttcacgccgctgctgctcggccaggatggcgccaatatcaatgccgccatgcaacgcctggagcgcagcatccgcggcaacaccttcgccaagtccggcatcgaaagcgccttgctcgacgcccagggcaagcgcctgaggctgccggtcagcgagctgctcggcggccgggtgcgcgacgccttgccagtggcctggaccctggccagcggcgacaccgccaaggacatcgccgaagcagaaaagatgctcgacctgcgtcgccaccgcatcttcaagctgaagattggcgctggcgaggtggaccgcgacctggcccacgtgatcgcgatcaagaaggccctgggcgaccgcgccagcgtgcgggtcgacgtcaaccaggcgtgggacgaagcggtggcgatgcgtgcctgccgggtgctgggcggcaacggtatcgacctgatcgaacagccgatctcgcgcaacaaccgcgccggcatggtgcgcctgaatgccatcagcccggcaccgatcatggccgacgaatccatcgagtgcgtggaggacgccttcaatctggcccgcgaaggcgcggcctcggtgttcgccctgaagatcgccaagaacggcggcccgcgcgcggtactgcgcaccgcggcgatcgccgaggcggcgggcatcggcctgtacggcggcaccatgctcgaaggcggcattggcaccctggcgtcggcccatgccttcctgaccctcaataccttgagctgggacaccgaactgttcggtccgctgctgctgaccgaggacatcctcgccgagccgccgctgtaccgcgatttccaattgcacgtatcccgggcgccgggcctcggcctgagcctggacgaggagcgcctggcgttcttccgccgcgaccaagcctgaactgccattcatcacgtcttaaggagagcaccatgctgttccacgtcaaaatgaccgtgaacctgccggtcgacatgaaccccgagcgcgccgcccagctcaaggccgacgaaaaggccctggcccagcgcctgcaggagcagggcaagtggcggcacctgtggcgcatcgccggcctgtatgccaactacagcgtgttcgacgtcgacagcgtgcaggaactgcacgacctgctgatgcaactgccgctgtacccgtacatggctatcgaagtgaacgcgctgtgcaggcatccttcgtccattcatgcggacgaccgctgagcccgcgccacactctaataaatacaagatgaggaataaccatgaacgtccgaatttcccacactgccagcgcccagaaatttctcgaagaagtcagcggccagctcaacgaccagggcaacccacgcaccaaggccctggtgtaccgcatcctgcgtgacacggtgaacatcatcgaagacctcgacgtgaccccggaagagttctggaaggcggtcaactacctcaacgtgctcggcgcgcgccaggaggccgggctgctggcggccggcctgggcctggagcactacctggacctgctgatggacgccgccgacgaacaggccggcaagaccggcggtaccccgcgcaccatcgaaggcccgctgtacgtggccggcgcgccgctgagccagggtgaagcgcgcctcgacgatggcgtcgatccgggcgtggtgctgttcatgcagggccaggtgcgcaacaccgccggcgaaccgctggccggggccatagtcgacgtctggcacgccaacaccggcggcacctattcctacttcgacacctcccagtcggagttcaacctgcgtcgacgcatcgtcaccgatgccgaaggtcgctaccgtttccgcagcatcgtgccttcgggctacggctgcccaccggacggtccgacccagcagttgctcgaccagctgggccgccacggccagcgtccggcgcatatccacttcttcgtctcggccgatgaccaccgtcacctgaccacccagatcaacctcgatggcgacgaatacctgcacgacgatttcgcctacgccacccgcgacgaactgatcgccaagatcaccttcagcgacgatcagcagcgtgcggcgcaatacggggtcagcgggcgtttcgccgagatcgacttcgacttcaccctgcagtcgtcggcccagcccgaggagcagcaacgcctggaacgggtgcgagctctggaggactgacagcgcggcagatcccgattcggggccacgggataacgtgagtgatcccgtggtttttgccgttgtgagccgtggtcgatgtcttgcgtgacgtgtcagcggtggcgaacgatcaccgcccggcaataacagtcccattaataagaaccccaataacaaaaacggggagtgacccgcttatggaaacgcgtctgttgagtgagcgcagccgggtatttgcccaggccgatccctacgccgtgtccggctatgtcaatcagcacgtgggcagccactgcatccgattacccaaggccggcagcccccaggccagcctcaatcatcggcagttcgccagcctcgacctgtgctcgatcagctacggcggcagcgtgcgcgtcacctcgccggcgctggaaaccatctaccacctgcaagtgctgctgcgtggccactgtctgtggcgcggccatcgccaggagcattacttcgcccccggcgagctgctgctgatcaaccccgacgatccggtggacctgacctattccgacgattgcgagaaattcatcatcaaggtgcccacccgcctgctggaatcggtgtgcgaggagcagcgctggctgtatccggggcagggcgtgcgcttcgtgggcaaccgctaccagctggatgagctggaaggctttatcaacctgctgggcgtggtctgccgcgaagccgaagccgccgaatgcatcccccgggtgcaggagcattacgcgcagatcgtcgcgagcaagatgctcagcctgatgaagaccaatatccggcgggtgggcctgggttcgtcgtcggcgaccttcgaggccatcgccgattacatccagcgcaacctcaagcaggacatcggctgcgaagagctggcgcaacaggcgcagatgagcctgcgttcgctgtatgcgctgttcgagcgcaacgcccgcaccacgcccatgcgctacatccgccagaagaaactcgagcggatccacgcctgcctgcgcgaccccgcctgcaacgtgcgcaacatcaccgaactggccatggacttcggtttcctgcacctgggacgcttctcggaaagctaccgcaaacagttcggcgaactgccgtccgacaccctcaggcgccggcattgatccgcccatgcctctgcaggagcggccgtgtccgccgcgtcattcctgattcctcatgtagccgctgccgagctcgcgaggctgcgatcgactgcgcagcagtcgcaaaacctaaaaccacgatcgtcctggataaaccggcgaggcctgaatggcggccgctacatcggaatgccgcccaacccggtcgcagcctcgcgggctcggcagcggctacggctgtaggacttgccctacaaaactctgcagaaaacggatagtggtctgcacgcaacggatattgcccgcgcgtaccccgccctagcatgagccttgcctgaataaaaacaatggaggcggcggccatgaccctgcgacccgaataccttcactccctgcttgaagaagaccgtgaccggggcgtctaccgctgcaagcgggagatgttcaccgacccccggctgttcgacctggaaatgcagcacatcttcgagggcaactggctgtacctcgcccacgagagccagatccccaacaacaacgactactacaccaccaccatgggccggcagtcggtgttcatcgcgcgcaacaaggacggcgaactcaatgccttcctcaatgcctgcagccaccgcggcgccatgctctgccggcacaagaccggcaacaagtcgtcctacacctgcccgtttcacggctggaccttcaacaactccggcaagctgctcaaggtcaaggacccggccgccgcgggctacccgccgagcttcaactgcgaaggctcccacgacctgaccagggtcgcgcgcttcgagtcctatcgcggcttcctgttcggcagcctcaaccccgacgtgctgcccctcgtggagcacctgggcgagtcggcgaagatcatcgacatgatcgtcgaccagtccgccgacggcctggaagtgctgcgcggttcctcgagctacatctacgaaggcaactggaagctcaccgcggaaaacggcgccgacggctaccacgtaagttcggtgcactggaattacgcggccacccagagccagcgcaagcagcgcgaagccggggaagagatcaagaccatgagcgctggcagttgggccaagcagggcggcggtttctattccttcgacaagggccacatgctgctctggacccgctggtccaaccccgaggaccgcccgctctacgagcgtcgcgatgagctggcccgcgacttcggccaggcccgcgccgactggatgatcgagaactcgcgcaacctgtgcctgtaccccaacgtctacctgatggatcagttcagctcgcagatccgcattgcccggccgatttcggtggaccgcaccgagatcaccatctactgcatcgcgcccaggggcgaaagcgacgaagcccgcgccatgcgcatccgccagtacgaggacttcttcaacgtcagcggcatggccaccccggacgacctggaggaattccgttcctgccagatgggctatcagggctgcaacagcgcctggaacgacatgtcccgcggcgccgaacactgggtcgagggcgcggacgacgcggcccgggaaatcgacctgcaaccgatcctcagcggcgtgcgcaccgaagacgaaggcctgttcgtgatgcagcacaagtactggcagcaaaccatgctcgaggcggtggccgccgaagccgcgcgagccattgccgtggaggctgtgtgatgagcatttcccatgacaccgtgcgcgactttctctaccgcgaagcgcgctacctggacgacaaggactgggacagctggctggagctctacgccgccgacgcgaccttctggatgccgtcctgggacgacaacgacgaactcacagaagacccgcagcgggaaatctcgctgatctggtacggcagccgctgcggcctggaagaccgggtgttccggatcaagaccgagcgctccagcgcgagcattcccgacacccgcacctcacacaacctgagcaacatcgagctgctggagcaggccgacggcctgtgcaaggtgcgctgcaactggcacaccctgagctttcgctacaagaccgtcgacagctacttcggcaccagcttctacaccctcgatgtgcgcggcgagaccccgcggatcctggccaagaaagtcatcctgaagaacgattacgttcgtcaggtcgtcgatgtctaccacctctgaggcgaccgccatgactcatcacatcgcactcaatttcgaagacggggtgacccgcttcgtcaccgccaacgccggcgaaaccgtggccgatgccgcctaccgccagggcatcaacatccccctggactgccgcgacggcgcctgcggcacctgcaagtgtttcgccgaagccgggcgctacgacctcggcgaggaatacatcgacgacgcgctgacagcggctgaagccgagcaaggcttcgtgctgacctgccagatgcgcgccttgagcgactgcgtggtgcgggtgccggcttcgtcgcaggtttgccgcacggcccaggccaccttcgacgccaccatcagcgcggtgcgccagctgtccgacagcaccatcgccctgtcgatcaagggcgaggccctgagcaagctggcgtttctgccggggcaatacgtcaacctcggcgtgcccggcagcgagcagacccgggcctattccttcagctcgctgcagcgcgacggcgaggtcagcttcctgatccgcaacgtgccgggcggcctgatgagcagcttcctcaccggcctggcgaaagccggcgaccccatgagcctggccgggcccctgggcagcttctacctgcgggacattcgccggccgctgttgctgctggccggtggcaccgggctggcgccgttcaccgcgatgctggagaagatcgccgagcagggcagcgagcatccgctgcacctgatctacggggtgaccaacgatttcgacctggtggaaatggatcgcctggaagccttcgccgcgcgcatccccaacttcagtttcagcgcctgcgtggccaaccccgagagtcgccacccgctcaagggctacgtgacccagcatatcgagcccaggcacctgaacgacggcgatgtggacgtgtacctgtgcggcccgccgccgatggtcgaggcggtcagccaattcatccgcgaccagggcatcgccccggccaatttctactacgaaaaatttgccgccagcgcggcctgatttccaccctgactctgtgcccgcgatagcgatagtgcgtgcacagccgagctttcagcctggcggctgatcgcgagcaagctcgctcctacagatggcgtatcgggtttattggcatgaggttttgagatgagcagattcgaggaaaaagtcgccctggtcaccggggcggcgcagggcattggccggcgggtcgccgagcgcctggccgaggagggcgcgcggctggtgctggtggatcgctccgagctggtgttcgcgttgcaggccgagctggcccccaggttcgaggtgctggcgctgaccgccgaccttgaacagtacgccgaatgcagccgggcgatggccgcggccgtcgagcgtttcgggcgcctcgacgtgctggtcaacaatgtcggcggcaccatctgggccaagccgttcgagcactatgcagagcagcagatcgaagccgaagtgcgccgctcgctgttccccgccttgtggtgctgccacgcggcgctgccgtacatgctggagcagggcagcggcgccatcgtcaacgtgtcgtccatcgccacccgcagcatcaaccgcgtgccctatggcgcggccaagggcggagtgaatgccctgaccgcctgcctggcgttcgagaccgccgggcgcggggtgcgggtcaatgccaccgcacctggcggcaccgaagcgccgccacggcgcattccgcgcaacagcgccgagcagagcgccgaggaacaggtctggtaccggcagatcgtcgaccagaccgtcgacagcaccctgatgaaacgctacggcaccctcgacgagcaggccgcggcgatcctgttcctggcctccgacgaggcctcctacatcaccggcctggtcatgccggtaggcggtggcgaccagggctgaatcgcccatgacccgacgacccggcgacccgacgatccgacgaactgtcgggctgtgcactctcaaaaaaacaacaagagtcagatgccatgcgaaacatagacagcaatcaattgatcgacggggcacgcttcaatgcctttcactggcgcgtgctgttctggtgcgcgctgatcatcatcttcgacggctacgacctggtgatctacggcgtggtgctgccggtgctgatgcaggagtggggcctgagcccgctgcaggccggggcgctgggcagttatgcgctgttcggcatgatgttcggcgcgctgtttttcggcacgctgtcggagcgcatcggctgcaagaaagtcatcgccatctgcgtggtgctgttcagcggtttcaccctgcttaacgggttcaccaccacgcccacccagttcggtatctgccgctttatcgccggcctcggcatcggcggggtgatgcccaacgtggtggcgctgatgaacgaatacgcgccgaagaaaatccgcagcaccctggtggcgatcatgctcagcggctactcggtgggcggcacgctgtccgccggcctgggcatcgtgctgctgccgaatttcggctggcaggcggtgttctatgtggcggcgattccgttgctgctgctgccgctgattctcaggttcctgcccgaatccctgggcttcctgctgagccagggccgggatgacgaagcgcgccaggtgctgcaatgggtcgagccgggcttcgtcgcgcaacccggcgactcgttcgtcaaggccaacctcaagaccaccggcgcgccggtggtgcagctgttccgcgaaggccgggcgctgagcaccctgatgctctgggtggtgttcttctgctgcctgctgatggtctacgcgctcaactcctggctgcccaagctgatggccagcgccggttacagcctgggctcgagcctgatgttcctgctggtgctgaacctcggggcgattttcggcgccgtgggcggcggctggatcggcgatcgcctgcaactgcaaaaggtcctggtggcgttttttatcgtggccgcgctgtccatcagcctgcttggcttcaagagcccgcacgggttgctgtacgccctgatcgcgattgccggggccaccaccatcggcacgcagatcctggccttcgcctgcgtcgcccagttctatccggtgacgatccgctccaccggcattggctgggcctcgggcatcggccgcggcggggccattgtcgggccgctgctgggcggtgccctggtgagcatcgagctgccgctgcactataacttcatggcctttgccattccgggggcggtggcggcgctggcgatgtgtttcgtctacccgcggcccgccaaggcgctgccggtcagccaggccagcgcgccgtcggtgtagcagggcccgtgaccgatgcgggcgcccaggtgccggcaccggtggttcagtcatggcaatcaccgctgaccgcggctgagccgaatccatagatacctggtttgccggcgatgtggacgctgcacggtggctggcaggccgccatcatgagcaagctcgttcctgcagtgactggtggttgcagatagcgtgcagacgccgcggcaccgcgagcgagcggctggtcggatacgctgtcgcgaaccctttcttgagcctggggcgcaaaccccagcacctatactcaatccaggcatggtcgtgtggtatccggttgaagcctgccccgtcgtgagcgggtggccgtggtcgacgctgtgcgagggttgccatcttgtacctgcgtgcgctgatcgtcgtgatgctgctggtgctggccggatgcgccgcgacccagcgtgtccgcgaggcggtggcgccggtggtggtgccggccagcacctggcgccaggtggaccgggaaatcgccgaggcttcgcagcaggcggtgatccaggtcaaggtgtttgcccgcggctccatggagcactggcgggtgcgggtctatgccgtcaccgaggaaaccttcatcccctggttcagcagttactggacccaggaatggatggccatgaaagtcagttggtacagcctcaccgccggcgacgagcaggacgcggcggcgacgcggctggcggagtacctcaaggaacagtatcaggaacaggtgctggcaccggtggcggtggagatcgacccggatgcgattctcaaccaggccacggagttctatatcgagctgctggacaagcaggtgcaggttatcgcccagcgttatcggttgccggccaggcagctcgatcaacggctcaatggtatccaggcgattcgcctggggccgccgccggcgcgcgatgcttcgttgtaccagatgctgcacgccaagcctttgactacgctgccggcctactcggcgctgtaccagcagatccatagtgcgccggcgggcaccggcgaggtgtcgtccgaggccgggattgtctcggtggccaggcaggccagcgaaaaattcgaagcgcagatggccggccgtggcattgccggcgccgcgtcggcggtggccggcaaggtcgcgggggcggtgatctccctgggcgccgcggggtttcgcgcgatagcccatgagagcgaccgggccgagaccgaggcgcagattcgccagagcctgggcaaggcgttcgaccaggcctggttcaagctgttgaacaacaccggcaacggggtgatggccggggtgtattacctggccgggcatatcgagggcgaactgggccaaagcgcggtaccggagcccccgctggagacggtaccgggcactgtgcatccgcctgccatgccgggcctgagcgccccgcaaaccggttggcagccggagccatgacgcccggcggtcggtcgattcaggttttttcgcgccggcttgtcgattgtcggcgatgcggatcgaccaactcccagagtgaccgacagcaaggtcgggatccgatgttcaaccccaatcagcaggagcaggatcatgtcttatgtcgatggttgtgtactggcggtacccaccgccaaccgtgaggccttcaagcagcatgcagagaccgcggcgaaagtgttcaaggagttcggcgccctgagcgtggtcgattgctggggcgacgacgtgcccgagggcaagctgacctcgttccccatggcggtcaagctcaaggcggacgagacggtggtgttcagttggatcatctggccgtcccgcgaaatccgcgacgcgggcatgcaaaaagccatggaagacccgcggctcaagcccgacgtctgcccgatgccgttcgatggccagcgcatgatttatggcgggttcaagatgctggtgaatacctgaggcatcaccagcgaaacatcggcagcggccgcagcggcgtacgcagcaactgccgggccgaagcgcgcgccagcatccagtgaaaaccctggtcggggtagcgtgcctgcacctcgcggataaacgggcggggcaggccgaagttgagcaagcccagggagacgtcgattgtgtcggcctgccggaacgcttcgacgctcgcggcgtgggcctggcgataggggcgcagtttgtgatgctgctcgatcagcgcgctgacttgctcagccagctgtgactcgccgcgctcggccagaaaggcccgggccagttggatcgacggcgccaggtagtcgagggtgccgtgggtccagatacccaggtcatgaaaggccgcggcgatctgcaccgcgcaggacagcggccggtcctgcggattgagcgcggtgtagaagctcagcacgcgatatatatgattgcgatagccgggcagatccttgccgatcaccgtggcgaaagaggcaaggatctgttcggtgagcgggcattcgagaacgacgtccatgtggtctgctccgggtctggaagggcgacagtataaggctcggcgcagggcctgaggatgcaggcgtcgcggcgtatcgacaggtcgcggatcgattcgacgccaggaacaagggcgggcccgatgctggtccgccctttgttcattgcgccgttcgctggcggtattcggtggtggtcatgccggcgtagccccagttatcggtgtcgacttcctcgatgacgatgtgggtcagttccggggccttgttcagcacccgttgcagggtttcggtgatctcgcggatcacctgggctttctgttcgcgggtcacgccgtcacgggtgatgcggacgttgacgaaaggcatggcattactcctaaggaaaagatgggggttgcaagggacgggaggcacgcgggcctcccgccggatttaccatttgccgctgctcatgccgccgtccaccggcagcaccacgccggtggtgaagccggcgccggacaggtagagcaccgcgtcggcgatttcctcgatgcgtccgacccgtccggccggttgcaggccgtcgaggaaggcacggtgcgccgggtcgtgcatcggcgtgtcgatgatccccggggccaccgcgttgacctggatgttgaacggcgacagctccagggccagggcgcgggtcatctggttcacgccgcccttgatcagcaccggcaacgccgccgggaccgccaggttcggttgcagcgcgacgctggcgctgatgttgatgatgtggccccggcgccgctcgatcatgtgccgcgcggcggcctgggaggcgtagaccacgcccttgaggttggtctccagcaggctgtccagctcctcggggctgtagtcgataaacgccttgggcaggaaaaaaccggcgttgttgaccagcacatcgacctggccgaagcggtcgatggcgcgttcgaccagttgcgtggcggtggccgggtcggcgatgtcgccttcgaccccgagaaaacgctcgctgtggcccagggtctcggccgccgcggccagccgctgtgccgagcgggcattgccgaccacgttgtagccgcgggccaggtaggcctgggccaggccgaggccgatgccgctggaggcgccggtgatgatgacggtgctggtgtggttcagggtgtggctcatggggatagtcctgttctgcggtgagagtggttccagcgctgttgggcagaactatatttgtgtgccgaatgctgataaatagcgcttcaggtacttcacttgatacatggtgtaatcaatgagtcggcaattcgacgatgtgctgctgggcagcatcgagctgttctgcatggcggcggagatcggcagctttaccggcgcggcgctggcggccggggtcacgccggcggcggtcagccgctcggtgtcgcgcctggaagagcggctcggcgtccgcctgttcgtgcgcaccacccgcagcatccgcctgaccgacggcgggcgcgactatcaccagcaatgccgcagcgcgctgaaccagatgctcgaagccgagcgccagttgaccgggcaacagctggcgccttccggcaccttgcgtatcagcctgccgaccacctacggccatctgcggatcctgccgctgctgccggagtttcgccggcgctacccgcagatgcgggtggaggtcaacctgagcaaccgcaatatcgacttcgtcgaagggggctacgacatggcgatccgggtgcgcgcgcagccggattccgggctggtcgcgcggctgctggaggacgccgagctggtggtgttcgccgccccggattacctgacgcgggccggtactccgcagcggctcgacgacctggcgcaacacgagtgcatccagttcgagttgcccagcagcggccggcgcatcgcctggctgttcaacggtgccgacggcccctgcgaagtgctcgccgagggggcctacgtgtgctccgaggacctgcaggggggcgtgaccttggccaggcacggcgccggcctgttccagacctaccgtttcatggtcgagcgcgagctggccgagggttccctggtggaggtgctgcagccttacggcggccgttcgcggcccttcagcctgctgtatccccacagccggcatgtgccgttgcgcctgcgcgcctttatcgatttcctgctggagaaacggcagggctggaagacctgaagcggggatgggcagcccgggatggattggttagtatggcgaccgggcttcctgggcgcccacctcgcgaaagcgcaagcaccttcaattcccgcaagcactacgcttgcataccccctccgggccaatagcgagcaggccgattctcttggagttggtatgcctatcaacaaatccgttccccgttcacccgccagtcaggccgccagcctggtactgcgcgaagccaagcgcctgcatcgcactgcaaccagcggttcgctggccagcgccttgccgatcctgcggcgcttgctggcgagcaacagtttgcctggcctgtcgttgcccgagctgtatcgacagcgagtcaaggtgcagcgcaaacacctgttgcgcaccctggccagcgaggctggttttgccagttgggagacctaccgccaggtcctcgatgaactggcgcccgagcagttgcagcattttgaactggtctaccgccaggcgggtcatctcaactgctggttctcgtcgccggacgaggcccgggagtacgtggcccatcacggcggccggctgttgtgcgtagggcaacaggcggtggtgctggtggatctgccggcggcgtaaggcgctatccatagcggtacacaagcacggcacccggggtttcccgggtgccgttttgcgttttcagggcactacgcagagatgatcctgttactttcacgatcctcctttatttacgtgcctcgagaatcaggttgaacggcgtctctgcggcccggcggaactggctgaagccggcttcgctgaagacctggcgcaggcgcgcttcgccggcctgggccccgaggccgaggccgacttcctgggacagcgagttgggcgtgcagataaaggtcgaggcggcatagaacagccggccgaccggggtgatgttctggtccagtttatcgttggcgaacggctcgaccagcagcacgctgccgtcgtctttcagcgcctggaaggcatgttgcgcggcgcccaccgggtcgcccatgtcgtgcaggcagtcgaagaagcagatcaggtcgtagtcgttgccggggtaggtcttggcgctggcctgggagaactgcacgcgggcggtcaccccggcttcctcggcgcgttgcgtcgcggtggcgatggagggctggtggtagtcgaagccgaaaaactgcgaggcgggataggcctgggccatgatcaccgtcgatgcgccatgcccgcagccgacatccgccaccttggccccggcctgcagtttttccaccacgccgtccagggccggcagccactcggccaccaggtgcgcccgatagccggggcggaagaagcgctcggtgccgctgaacatgcacggatggtggtcgccccaggccagggcgccgtcgccgcgcatcgccgccagtagtttgtccttgtcgtgaaacagcgcggagaccaccacggcgcctccggccacgtacaccggcgaatcctcgatggccagcgcctgggcctgttcttccggcaggcggaactggccgccctggtgttccatgtagccggacgcggcatgggcgctcagccattcgcgcagcagccgtgcgttgcagccggtcttggcggccagcgcctcggggctgatcaagcgactgtcggccatggcccggtacaggcccagttcttcgccgagaatcatattggcgagcatcgccgcgccgcccatgtctgacaccagtttgcccatgaaatcgttgagcttggcttcgtccatggccttgtcctccgctgtgagggtcactgtcgccgacggcccggcagtggccggatggaaatacgtggcgtgcgtggggaggccatgtcccggcgctgccgaatgagtgggcctggcagggccggcccgtgttctgaagagctgatgcacgcacacctcccgggtgggacggggtgcgtgcctaccgttcaggcaggtgaggctggccatcgggcctgggcgtcgaacccgtggcggcaggcgaggctgcgcgcgggttccggggacgcccggagcaagcgattgctggtcggtagatgagtcagtttagttccccggcgggggcgtcgcggggttggccgataagggggcggggcgccgccgacggcgccctggggcaagctcggtcaggccgtcaaggcgtgccgaacatcgcggtccagtagatgccggcatcgcttttcggatcgaccgcataggacgcgcccagctcgcgatactgtgggttcatcaggttggcgcaatggcccgggctggccagccagccatcgaccaccttgcgcacgctgtcctggccggcggcgatgttctcgccgatctgctggccggcataacccgccagttcggcgcggtcgccgggggtgcgaccgtcgcggtccttgtgatcgaagaagttgtgattggccatgtcccgggtatggtcctgggccgcgctggccagggtggcgttccaggccagcggggtggcggcggcgaagatctggttgccgcactggcgcggctgcgcgcgggcgctgttgaggctttccaggagcttctggccctccgcctgccagtcgctgaggcgcgcggtgagcagcggccgggcgaggacgatgcgccattcctggccggtgcggctgacaccgatatcgacgaactgcgggtccagcaccacctggcagaaactttcctgcaccgccttcatggccgcctgggcattgcgcggtccggacaggctgatggcctgcacattgaccatcgggtaggcgctgctggccagggcctgctgcaggttgccgatgctgttggccggcagcaccaggcgcgggtcggcggccagcggcggcagttcctgggacacctggccggcgcagcgctggacctggctgcggtagctgttgatcgatgtcaccagttgcgtctcgtcgctcgccacggcggcggtggcgaaggccatgctcagcgacagcagggtcagcggcagaacggaggataggcagcgcatggagatctcccttgagcgaattgcgcccatgatgcgcgattttgccccgctcggcgcaaggtctttttgccgaaaaccggcgccgttatccgtccttgccgttgccggcgcggcgccggttacgggcggacggcggcgaactacactcaagtccagtcgccgcagccggcaggctggtggcggctttcccgtgcccggatcgggcttttggcgaaggtgcgagcatgcgtccgacagcgattgccggcggttttctgatcctcctgtgcggggggctggcgatggccgcgggtgaaacagcgaaccccgaagtggcgcaggacaaggcccaggtcctggaacagaaagccgcggaccagcagccggcgccacgcagcgaaaccattacctctcccgaggctcaggcggtggacccggcgggcgccgcgtcgctggacgatgccatcacctgcctggcgcggtccatctactgggaagccaagggcggggccgccgccgacatggaagccgtggccagcgtggtgctcaaccggctcggccatgaggggtttcccgatacggtgtgcgcggtggtcaagcagggttcggagcaacgtgcctgtcagttttcctggtggtgcgacgggcgtgcggatcaggtgaaggaagatgagccctacatcgcggccaaggaaatcgcgcgcaaggcgctcaaccagcaacttccggaccgcacccacggcgccctgtatttccatgaccggcgcgtgcggcccggttgggccaggcaataccgcaagaccgccgagaccggcaagttcctgttctacaagccgcgaggcgacagcgcccgttagcccggtttgcccaggccatctgtaggagcgagcttgctcgcgatagcgtccgtgctgacacaccgcatagcgagcaagctcgcgcctacagggactgcgtcaaatacgcgggcggagtatcatgccggcccgccgccgacgcctgctgtcccaggcgtgccgcaacctttggagcccaccgcgcaatgcccatcatcagccacttccagaccccgtgcccggaagccgtcaacagccagatcctgcaaatggtggtcgactacctgaccgacatcagcgccgtggcgatcccgcccagcaacctgctgtacaacatctaccagtacgccatcggctttgaggtgcatctgtatctgcaggccctggacggctcccggggcatcgccgtggaactgctggtggccactgacgaggacgacccgcagcaggtgctgggttttgtgctgtacctgccggtcaaggacgatcccgaggcgtgcggcgtggcctatatggcggtacgtgccagccatcgccggcaggggatcgcccgttcgctgctggcacggatgcgcgagcgctacccccatgccgaactgacctgcgcggcgggcaaggtggcctggttcgaagcactgggcttccaggtgctgggcgtgcgcggcccgcaggtgctgatgaacacccgcgatcacgccaccgacggcttgatgggcctgctggacacggcgccgatctatcgttcgctggaggtgcggcagattcacagctacctgctgcaaaagcatggcaagcgggcgatgctcgatgccgaaaaacagcgtgaccgccacctcgaccagatgacccgcaacgcccaggccctggtccgcgagcgcctggggcagggctgaggccggcttaaccctcggatcagcccagcttgtgctggtcggcggccatgatcgagggggccagggaaatgcccgccatctggcagatgtccgccagcgtcgcctgctgtttgtggaaggccttggccaggtccagggcggcctcctggacgttaaggccgaactccttgatcatctcgctctgatcgaacaggaaaccataggccaacagttccggggttcgcgattcgtccttgggcacgatgacgattttccagaagcgggtcgggtaatgcaccgggcccttgccgaagtcctgctcgacgcaggagtcccccagcaccgggccggcgaagatgatggcctggccgcccccggcttcgatctgttcggccagctcgccctcgaagtaaccccagatgcctttgcgattgcggtacagggcgccgtcgggcgattcctggttgaacagttcgtgctgcggtgtgcagttggtccagtggtaggtgtcggcgttggcgtactcggtgtcgacccctggctggccccagcagctgtcttcgcggcgcacgatatggccgcgatcgaagttgccggccggcgcgtagatgtcgctgttggtcaactggtagcggctcggcacccggcggtcgaggcgccagctttcgccgccgaagccgcggcggccccgcgcatcgccacggacctcgggccggtagtcggcattggaggccgtccacatcggcatgcggtactgcttgttcatcaccagcgaatagcggtgatagggcagttccagcggggcatcgtcgtccaggtgggagagcctcatggccggcacattgcgcgccacggctgcatgttcgcggtagtcgccgacgcggtagagctgggccaacaggtcgccctcgacgaagggcggcggcaccggcaccccgagaaagtccgggtcgtagccgggacgggcctcgtagtcgaggtcgaaggtcagagtcttttccagggcctcgaccgttggagccggttcggccggcaccggctcggcaggtgccgcgccgagggtggacgcgatgttcgttgggctgtccgcggcgtgactgaggatgttgatggtggtggggccggagatatgaaagatgttctgcgacctctcgggcaggcctgggcggggcggcgtaacaggcagcgcttcgttgacgctgagcgtggccagcgggtcggcggtctgctccatgagctgggccagcagctcggccggcctgccactcagttgcagggccttgagcgcgccgacgatgctgctgacccgggtgccctcgttggccacccagtccaccgtgctttcctcgtccccttcggcgttccagaggctgcggtcggtcttgaggatgttgccggcttcgtcggtcctggggatgccgcagtgatgcagggcgatcagctcccagttgtcgctgaacaccggggagccggaagcgccttcggcggtatcggtttcgtagtgcaaaaaaccctggtcgagaatgtccagcaaccggttgtgggtggtggcgtactggcgcgggccgccatcggggtgctggatgatgttcatcggccggccacgcagggtcttgccggtggcttcgatcaggcggatgcagccgtagtccgacagcgcctcgccgcgtgagccctgcgtggagatggccaccaggcagaagtccagcgcctcgtcggcgaagtagaactgatccggctgcaggttgaagtaggtgccttcgttgatgccgcgctcctgcctttcgtagagaaagttggcggcgcagtccacggcatccacatacctagggaacacatgctggttggtcagcaacaggctgggcgagaccaggaaaccggtggcgaaaccctcgaccaccgtgcccgggcgtggcgcattgaccagccgcgccaccggccttgccgcctggcgggcggtctcgctgggggcgtagaaggtcgggtcccaggtgccgatccggcgttccagcccggcccgggtcaacagggcgcgggcgttctcgcgggcgatccacttggccaattgctgcggtgaatcgccagcgcccgggcccagttcgcggatgcgcgactgcgattcgctgcgtgccccggcctgctggttccagcgttgcagggctttggccatgttgcttcggcgggcagtggcaacggcatctggcgtcttgctcatgggcacctcctggcgagtacgggattcctttcgggctagccatttgagcgtagacaaccagcgcgctggcagacggctggcggcatgccagctcgtcggatcctccggcctttacgcgcctttgccggcgcgtgcctgcaagcgttccagcaacaccttggccacgccctgggccgagcccgggttctgcccggtcaccagctcgcggtcgatcaccacgttctcgctccatggcgagcggttgctgcggtacaggccgccggcctgttccagggcggtttgcgggtagaagcgcatggcgccgccacccagcaggcccttggccaattcctcttcctggttgctgatcaccgtgaattggtagccggcgtagatccagcccggggcgctggccttgccgccgctggccagttggcgggtgaagtcctgcgcctggggcagggtcgacagcagggcgatcgggccgtggcagaccagggcggtggtcttgttgttctggtggaaattgctcagcagccggcccagctcggggctgtgcagcaggtcctgcatcggcgcgtggccgccgggcacgtacagcgcatcgaaatgctcgtagccgatctgctcgacccgggccaggctgatcaccggcgattcgccgggggaggtgattttcaactggtcgagcagcgcctggtgcgcctgcagcgcggcgacatcgttgttgaaatacatcttgtcggtggaggagcggtccagggttggcgccttgccctgcggggtggcgaaggtcaccgagtggccggcgtcgagcagttgtttgaccggctgcatcagttcgttgaggtagaagccggtggaaaacaccttgccgtccttgaggtcgaggtggtcggagtccgagagcaccaccaggacgtttgcggcctgggcgttgaaggtggcggcggtgatgctcatggcaagagcgagggtgctgagtgggcgcatggcggtttccaaagtgtgaggtcagggagtcggcggtggccgacgggtgattcactgtattcatgcctccgcgagcgataaactcgcgccactggaaatcacttgttccctggagataaaggtgagccgtcgattcgattatctggctgacgtcgaggtgttcgtcagcgtggtggaaaagggctcgttgagcgccggcgcggtggccttgggcaccacgccttcagtggtcagccgggcgatttcccggctggaggcgcgcctgggcgtgcagttgctacggcgtaccaccagacgcctgagcctgaccgaagccggcctgttgtacctggagcaatcgcgggcggcgttcgagttgatcgacggcgcggagcgcagcatccagggccaggacggcgagctgaacgggcgggtgcgcctgagcgtgccgaccacctatggccattaccggttgccggcgctgctcggcggctttgcccggcactacccgcaggtgcgcatcgagctgagcatcagcaaccgcaatgtcgacctggtggccgaaggttacgacctggcgatccgcctcgggccactgcccgacagcggcctggtcgggcgcaagctggaggacgcgccgctgtgcctggtggcgtctcccgactacctgcgccgcgccggcacaccgcggcagttggaggacctggcggcccatgcctgcctgccgttcatcatgcccagcagcggccgggtcggtgcctggctgctgcgtgagcaggggcgggacctggagtggacgccccaggcgaatattcaggtggccgacgatgtgctgggcattgtgtccctggccgaacacggcatgggcatttgccagacctacgaattcatcgtccgcgagcggatcgccagcggccgcctggtggaagtgctgccgcaggcgggcggccgttcgcggcctttctcggtgatctacccgccgcaccgccagctgtcggcggcggcgcgggccctgatcgatcacctgacccaggccgtggcgcagtgacaggtcgaccggccatcagtcccgccattgctcgggagaaggattaaaaaagcgccaactgccgtggggaaggggatttactgagaatcgggcgctgattacaatgataatcattgctattcatgtccttcccttccttgagtgcacaccttgaagtcatcctgtccgcgtgcccgccgtaaaaccctgatcaaacgcctgttgccgacactgtcctgctgtctggtcgccagcccgctgtgggcgcaggaggcggtcgaactgccggccaccgatatccaggccgatcggctcagccaggacaccggctacaccacctcgcaagccagcaccgcgagcaaaagcaatgtgccgatcaaggaggaggcgcagtcgatcaatgtggtgacccagcagaccctggccgactatcaggtgcactcgctgagcgacgccatgaagttcgtcagcggcgtcagccagggcaacaccctgggcggttcccgggactcgctggtcaagcgcggtttcggcaccaacgacgacggctcgatcctgcgcgatggcgtgcgttccaacctggggcagaacttcagcgccaccaccgagcgggtcgaagtgctcaagggcccggcgtcgatgctctacggcgccctggaacccggcggcctggtgaacatcatcagcaagcagccgcagtattcccagagcactaccctcagcggctcggcctacagcgagggcggcggcagcatggccctggacaccaccgggccgctgggcgataccggcctggcctaccgcctgatcgccgagcgtggccatgaggactactggcgcaattacggagtcaacgagcacaccctggtggcgccgtcgctgacctggaccggcgagcgcgccagcctgaccctgaactacgaatacaacgactactccagccccttcgaccgcggcaccgtgttcaccaacggacacccggcggacatcgactatgacaagcgcctggacgaacgctgggcgaaaagcgtgggcatccgcgaagtggccagcgcgcgcttcgagtaccagctgagcgacgcctggaaaacccgcgtcacctacggctggaacaacgaccgctacagcctgtcgatcgcccagcccaacagcctgaccggcaacaccctgcgccgggccgccaacggcgcccactacgacgacgaaacccgctacgccagctgggatttcatcggccagcaggagctgttcggccagcgccacgacctgctggtgggcgtcgacagcgagcactccgaccagtaccgcggcaagacctaccgcaacaccgcccagggtggtttcaatatcaccgcgccggtctacggcaacctggccgagccgagcctggtcagcgccacccagagcaacctgcgcaaccagctgacctcgagctcgctgtacttcaaggacaactggcacctggacgaccagtggatcctggtgttcggtggccgccagcagcattacgaccagtacagcgaccagggcctgggcaagagctacaaggtcaaccgcgacagcaacggcgataccttcgtgccgttcctcggcctggtgttcaaggccaccgacagcctgtcgctgtacggcaactacagccgttcgttcaagcccaacaccgacgtcgatgacgccggcaacaccttcgatccggaagagggccgcagctatgaggtgggggccaagtacgatccgctgccgggcctgaacatcaacctggcgctgtacgacatcgagaagaagaacgtggtgaccaccaccacggtcaatggcgtgagcctctcggaagccgccggcaaggtcggctcccagggcgtggagctggacgtcaccgggcgcatcgccgagcgttgggacctgatcggcacctacgcctataaccgcacggaaatcctcgacgacccgagcaacgaaggtcaccgcctggccaacgcgcccaagcacaccgccagcctgtacctgagccatcacctgaacgtacctgcggaatttggtgcctggcacgcgggcggcggcgcccgttatgtcggcgagcgcgcggccaacaacgccaacgatttctggctcagcagctacaccgtggccgatgccttcgtgcgctgggagtcgccgctgttcggctacaagacccgtttgcagttcaacgtcgacaacctgttcgacaagcagtactacccgtcgtccaccggcagccagctgcaggtcaacgtcggcgaaccacgcaccgcgcgcctgagcgccagcgtgaccttctgacaacacgcggaccgctgcgcgtcgccctgcggggtggcgcgtcggcgggccccgttttgccgctgcctcttattcccccgcacatttcactcttcatggcattcccgccaatctcccgactttgccctcccgcggcccgactccccgcggcccggcgtcaagaaagccttggcccggtcgatagttgaaaggcgaattgggctatttgccactatcgttgttgactgaaccgctcgccgaaggcggtcatcccgttttgccctctgccgtttttcttcccgccccgtacatggagtaagagtgcatggctttccccccacgttttctcgagcattaccgcaaagccgaccgcatcatgatgggcctgatctggctgatgttcgcctatgcgctgggcctggcgttctggcacgacaccttcacccaggcgctgctggtgggcggtggcaccaccctggtcctgagcctgctgtaccgcgccatcagcggcacgcgtctgatgcgctgctgcatcgccatcggcttcatgctcatggcggcgctgcacatcaaccaggccaagggtttgatcgaagcgcacttcggtatttttgtgctgctggcggtgctgaccttctatcgcgactggctgccgatcctgctggcggcggtgaccatcgccctgcatcacgtgctgttccatgtgctgcagcaccagggctttcctgtctacgtcatggcccatcacggcggtttcggcatggtggcggtgcacgccttctatgtggtggtggagacggtgatcctgctgtacctggcggtgcacagccatgccgacgcggtggagagccaggacatgctggacaagatgctcgccgccacgtcccagctgaccgtcgaggttcatcagggcgaaagcgccaaggcgcatgtgtcgctggcccagcgtttcgaccacttcatgcagcagatcaccgccctggtggatggcgtggtgcgcgacacccatggcctgcgcgaactgggccaggacctggcgaaaaccagccagaccctggagcagggcgcccagcaccagttgacggaaatcacccagatgaccggctccatgcagcgcatgggcgatgccatgggcgacatcgccgtgcacgtcgagcaggcggtcgagcgcgcggggcaggccagcgcgcaaatcagccgcggccagcaaagcgtcgatcgcgcccaggcggaaatcacccagttggcgtcacgcatcaacggcaccaacgaaaccgtgcaacgcctggcggggcaggcgcagcagatcggcaacgtgctggaggtgatcggcagcatcgccgcccagaccaacctgctggccctcaacgccgccatcgaggccgcccgcgcaggcgagcagggccgtggttttgccgtggtcgccgatgaggtgcgcaacctggcccagcgcaccgcgctgtccacccaggaaatcaagaccatcatcgaagccctgcaacagggcagccgcgaggccgccgaagccatgcacgacagccacgaaggcgcccagcgctgcgtcgaagacagccgccaggcctccgcgatgttccaggccgtcggcgccgatatttcgcatatcgaccaactcaacggccgcatcgtcagcaccacccgcgaacaatccagcgccagcctcgacatagtcggccgcctgcactcggtccaggccatcgcccagaacaccgccgacgacatgggcagcctggccctgagcagccagcgcctgccaccgatcgcgattcggttggaggcgttggggcagacgtttcacaagtaacgggggagggacgcctgtttgccgataggcagcgggcgccatcactgctgctggttcgcaggccctgactggaatccggactacaggtcattcagaccggtcaacgtcaatctcagagttctccaagtttccaagggcgagccgtttcgccaacttgagatatcgacaacctgagtgtcgttacaccgaaacatcacatcgacattcacagaaatggatgacgtttatcaatgaagaacaacatcactgactttaccgaagacgaatttgtcagctatctgaaagaactgctcgccgctaacaagaccgcaaccgacgatgtgcttgacgaccttctagagaagttctgcgagattactggtcatccagacggcaccgatttgatttactacccggaggacggttcaaagggaaccgctgaagacatcacgcgcgttgtgaaggcgtggcgggcggtgaatgggctaccgggattcaaacagtgatgctcaaaggagagggcgagcttctgacatcacactcatcaaaagtgagaactccagagatctcgctcaaggttagccgctatgtctttagataagacccggatcgagcactacacagagtgtgagttcctgcagttcatcaatgagttcttcagtgaaaccaacgaccttgaaggggctcagctcgaaaagtatttgagtacgctggccagtcattttgagacggtcacgggacatccggcgggttatggactcatttactaccctgatcaaaacggcatcgaggacagtcctgaggcagtgttgaacgaggtgaaagcatggcgtgccgcgcatggtttgccgggcttcaaggcgtgatgtcttatctggttgagcaccaaacagaaacgataaaaaagccccgcttatgcggggctttttcatggccgggagcaggtcaaccgggaggcaggctggcgcgtatgtggctgacgcgttgtttcacgtctttccagggcgcctggcccgccagatcctggcgcaggaagcgcagcaggtcggcgatctgctggtcgtcgaggctgtggcggaaggcgggcatgtagcccagtgccgggttggccggttgggcgatgccttcgaggatcacgcggatcgcgttgtcggggctgtcggcgtagaggttgctgttgagggccagggaagggcgcacgccggtcagggtcgggcctttttcctgggcgtggcaggccatgcaggcccccgagaacagccgggcgccgggggagcctaggggctcggtgcgttgctcggcctggtggttcagggtggcggcgctggcttgcggggtgctggccggctgcaggctggacaggtaatgggcgatggcccgcaggtcggtgtctggcagttgcgccaggccttcgtggatcaccggcgccatcgggccggcggcgacgccatggcgcgggctgtagccgtggcgcaggaagtccagcaggtcctgttcggtccaggccagcggggcattgccgccgaccagggcatgggcgctccagtcttcggcaacgccgccgctcaggtggcgccggccgccgcgttcgccaaacagcgggtcgcggggcgagtggcaggcgctgcaatgtcccaggccctcgctcaggtaggcgccacggttccactgggcgctgcgtccgggatcgtcggccatggcgccgggcctgaggtagagccagttccaggcgaggatgcccgggcgaatattgaaggggaaatgcaggtcggtttgcggtggctggtggcggaccggcggctggctcatcaggtaggcgtagagcgccttgaggtcttcgtcgcgggtcttggtgaaggcggtgtaggggaatgccgggtacaggtaacgcccgctgcggtcgatgccgtggcgcatggcgcgctcgaaggccggataggaccagctgccgatccccgtctcgggatcgggggtgatgttggtgctgtacagggtgccgaacgggatgcgcatggccaggccgcccgcgttgcgtgccccgcccggcgcggtatggcagaccgcgcaatcgcccacggccgccagttgctcgcccctggcgacttgctcatggctgaagtactgggtgtcgtgattgtccagcggtgcgatggccggctgccagctgagaaaggcgcctgcggtggcggccaggctcagggtgatcaggctccagccggcgatgctcttgaatttgctcatgggcgagcctcctggccagggcggtcagtgccgggggctcgctgcaaggcttgcaacacccgctccggggtaaagggtacttgccgcaggcgcacgccgaccgcgtcgaaaatcgcgttggcgatggccgccgcgctgggtaccgaggccgattcgccggcgcccatggacggttcttccgggcggtccagcagttgcacatccacctcgggcagttcgtcgaagcgcaggatcggatagccgccccattccagggaggtgctgccggagcggtcgaagctgacgtattccttgagcacccggctgcacgactggacgatattgccgtgcacctggtgacgcacgccggccgggttgaccatgcgcccgcagtcgtggctgacgaagatcttgtccaggcgaatctgcccggtgcgccggttgacgctcaggtcgcagacccacgcggcccaggcggcgccgaagccggggaacttgctgtggaaataccgggcataggcaaaaccccggcccttgacccattcctgcgacggtggcgctgggtggcggtgggcgctgccgtcctgccagtcggcctgttttttcagcgccgcgatcagcgccagggcgcgcgggtcgtccaggtagcgcaggcggaaggcgatcgggtcctgctgggcgatataggccagttcgtcgatccaggattcgtgggcgaagacattgggcagcgcggaaaccccgcgcatccacgaggcgcggacgatgggcgcggcgtcctggcagacgatgcgcatctgtgggaagcggtattgcgggatcgccgtgcggtcgcccatctgctggatgtcgggacggttggcgacggtaccggtgagcaacagcgccagggtgcgggcgttgttcgaggggtagcaggttttcaactcgtaggcggccacttcgcgtttgccgtcgaggccaccgcggacctgcatcagttgcgcggtgcccttgggttcccagccggcttcctgttcgcgcatcagttgcacccgcaccgggcgcccgaccgcctgggagagcagggcggcatcggcggccacgtcgtcggcgcagttgcgtccgtagcaacccgaggcctccatgcggttgatctgtacctgttgcggcgcgcgtcccagcaacagggcgatgtccttgcgcaggtcatgggggttctggctgccggtccagacctcggcgcgctcggcgtcgatcatcgccaccgcgcaggaggggccgatggaggcatgcaggtgatagggccagacatagtcgacattgagcgggctgttgagcgtgcccaggctgctgtcgatgccgggatcgtcgcgcagcacgcgatcctgcttggggtgggccaggagcgtttcccgcaggatgtccggccgaaggtcgggcagcgagtcccagggtttccactggaccttgagctggcgcatggcgtcgatggcctgctcctcgcgctcggtgacgatgccgataaagtcaccaatcaccaccagtttgacgatgcccggcaagtgcgcgatggacgccgtgtccaccgcgatcagcgcgtggcccaatggcgcgctggcgtcggcgccggggtagggcgggcgtaccacgcggccgtggagcatgccgtccaggcgcaggtcgtggacataggtcagctggccggtgaccttggccgggatgtccacgcgcggggtggactggccgacataacgaccggcgccaaccgccttgagttcgacgcgtgggtccaggggtaggtgcaggtcctgcccgcgggccagttcggcgtagctcaggcgtcgtgtagggcgagcgctgacgtagatctgtccgcgctcgacccgcaacccggcaatcggctggtcgaggatttccgccgcgccttccagcaaccactggcgcaactgggcggcagcctggcgcaggggcagggcgctgacctggagggtcgcgctggcgatggtcgggccctggtccggggttctggcggtgtcgccgaggatcatccgcacttgctcgaagtcgacatccagttcgtcggcgacgatctgtgccagcgcggtgcgtaccccggtgccgagatcgacatgaccgcagaacgcggtgacgtggccgtcggcgtccagggcgataaagctgtcgacgtggtccggcgtcgggtccgctggcaatgcgctcgagttaagaatctcggctgtggccaacaagggtttgggcagcagggtgctgatcatgatcaggccgccggcctggagcaggcggcgacgggtcaacggcaggtcgttcatggccgcccccgctctgccagcagttggcgggctcgtgccgcggcctgcaggatttcgaagtgcgcgccgcagcggcagaggttgtaggccagttcgttcttgattcgttgctcgtcggcctcgggttcgcgctcgaacagcgccaccagggtcatgatcatgccattgctgcagtagccgcattgcgcggcctgctcatcgatgaacgcctgttgcaccgggtgcgggcgctcttcctgcgccaggccttccagggtggtgacgtgtttgccttgcacgctggacagcggcagggtgcaggagcgggcggcgatgccgtccaccagcaccgtgcaggcgccgcattggcccaggccgcagccgtacttggggccattgaggccgaagtcgttgcgcagggcatacagcaatggggtgttcggcggcagctgatccagtaaaaggtggcggccgttgagggtaaaagtcatggcagctggggtcctgtgggtgagtggcgtggcgcgcgacatgcgcgacagcggtcagggcaggtttgagccggcaacgggcttattgtcaggggctggacaacaaggtggcgctcaggtgctgtgcagattggcgggggcgaagcatgcggggtttatggtgggtcgataaataagacgattctggttttttgtaggcctaagccagggagtaattcggttttatctgagcagattcctgagaaagtgatggctagtagccataattgttgcttgtgacagcccaggtcacggcgtaggatgcgcgccctgatcagcctggctgaaccgttttacccgaatgcgacatggattgttatgactctctccccccgttttttctcgccgttgctcatcctggcaatggcgacgatgccggctttcgccgatcccggtgcccagcgcgccgagctgctgcaggtttaccgccaggccgtcgagcatgacgcccagctgtccgcggcccgccacgagtaccaggcccagcgcgaaagcgtccctcaggcccgggccggtttgctccccacactcaatgccggcagcaccgtggaatcggtgcgcctggagcgcgatgagcctggcctgacccgcacgcgcagcaccacggtattccaggccaatctcaaccagccgctgtttcgtgccgatcgctggtttcaactggaggccgcccatgccagcaccgcccaggccgagcttgaattgggtgcgaaggagcaggggctggtgctgaccacggcccaggcctatttcgaaaccttgcgtgccctggacctgctcgccgcctccaaggccgaggaagcggcactcaagcgtcagcagcaacaggcccaggcccgcctggagaatggcgcttcgagcatcaccgatgtgctcgacgcccaggccgcccatgacaacgccggggccaatcgcaaactcgccgagcgcaaggtcgacgatgccttcgaggccttgtcccgcctgacccgccaggactattcgacgatcgagggcattcaacatcagctgccggtggagctgccggtgcccaacgatgccaacgaatgggtcagccgcgcggtgcgccagaacctggcgttgcaggccagcagctacgcggtgctcgccgccgaacaaaccaaccgccagcgcaaggccggttatgcgccgaccgtcgatgcggtggcatcctggcgcaaaggtgaaaacgacagcttcggctacagcaaccccaccgatttcgggcgcgatggctatcggggcaatgtcacgcagagcagcatcggcctggagctgaatattccgttgtactccggcggcatgacccgctcgcaggtgcgcgaggcgaccgagcggctggcccagagtgaagacgagcgcgaggaccgtcgccgtgaagtggtgcagaacacgcgcaatttctaccgcgcggtgaattccgatatcgagcaggtcattgcccggcggcagacgattcgttccggccaggcctcggtcaaggccaaccaggtagggcgggacctgggctcgcgtaacaccgcggatgtgctcaatgcccagcgtcagctgtacaacgcggtgcgtgagtacaacaacgcgcgctacgactacatcatcgacaccctcaagctcaagcaggcggcgggcaccctgagcccgaaggacctgagcgatctggcgatgtacctgaccaaggactacgacgccgatcgggatttcctgccaccgcaggagcgcaaggcgctctgacgggcgactcatacagccgagtgaaataaatctcaatcaatgatgtcgtattgatactaattgtttcatgtttgatataacatcttgaaatattaggactttacggccgcaacgcggcatgcatggaagcttatgagcgaacaaggaaggggcgccgagtcgcccacgccagacaccggcctggtctgtctggtgatgctggcccggtttcattcggtggcggcatccgccgagcaactggcccatgaattcgctccagagaaccaaccgttcacccaacgcgaactgctgctcgccgcccgcaagctggggctcagggccaagtcggtcagcacctccatcgcgcgcctggagcgcacgccattgccggcgatcgcggccgatggcgacggcaggtttttcatcattgccaagctggaccagggccaggcgctgatccaggacccgcgtgcggatcggcctgaggtgatctccttcgaggccctggccgcgcgctggactggcgagctggtgctgctgcgttccgaagccgggttgccgggggaaacctcgcggttcgatttcacctggttcattcccgccatcgtcaaataccgcaagttgctgggcgaggtgctgctggtgtcctttgccctgcagctgtttgccctggtgacgccgttgtttttccaggtggtgatggacaaggtgctggtgcaccacgggctgaccaccctggatgtcatcgccgccgggttgctcggcatcatgctgttcgagtcggccttgagcggcttgcgcagctacgtattcgcccataccgccagccgtatcgatgtggagctgggctcgcgcttgttccgccatctgatcaacctgccgctggcgtatttccaggcgcgccgggtcggcgattcggtggccagggtgcgtgagctggagaacatccgcagcttcctgaccggcaacgccattaccttgttgctggacgtgctgttctcgctggtgttcatcctggtgatgttctactacagcggctggctgaccctggtggtgctgttgtcgctaccgctgtacgtgctggtctcgctgtttgtcaccccgctgctgcgcgcccgcttgcaggacagcttcacccgcggcgcggagaaccaggcgttcctggtggagacggtgaacggcatcgatacggtgaaatccatggccgtcgagccccaggcgattcgcaagtgggacaaccagatgtcggcttatgtcgcggccgggttcaagacccagaccttgtccaccatcgccaacgagagcgtgtcgctgatcggcaagctggtcacggtggcgaccctctggctgggcgcgcggctggtgatcgacggacagctttcggtgggcgaactgatcgccttcaacatgctggccggccgggtcagcggcccgatcatgcgcctggcgcagttgtggaccagcttccagcagactggcgtttcggtgcagcgcctgggcgatatcctcaacacccgcaccgagctttcccaggccacccgcagcgccttgccgcccctcagggggcagatcgaattcgaccaggtgcatttccgttatcgcgccgacggctcggagatcctgcgtgggatcaacctgcagatcgccgccggcgaggtgattggcgtggtggggcgttccggctcgggcaaaagcacgctgacccgcctgctccagcgcctgtacgtgcccgagcgtggacgggtgctggtggatggcatggacctggcgctggcggacgtgtcctcgctgcgccggcagatcggcgtggtgttgcaggacaacatgctgttcaaccgcagcatccgcgaaaacatcgccctgagcgatccgggcgcgccgctggaaacggtgatgcatgccgccagcatggccggggcccacgaattcatcctggagttgcccgaaggctacgacaccatggtcggggagcatggcacctcgctgtccggcggccagcggcaacgcatcgccatcgcccgggccttgatcggcaacccgcggatcctgattttcgacgaggccaccagcgcgctggactacgagtccgaacggatcatccagcagaacatgcaaagcatctgcgccgggcgcacggtgatcatcatcgctcaccggttgtcggcggtacgcgacgccaatcgcatcctggtggtcgaccgcgggcagatcgtcgagcagggcaaccatgccgaattgctggcgcaccaggccggccactattcgcgcctgcaccgcatgcagcagggctgaacaccgcccgattcacaggttatttgttcggccgccgccctcgccgcaggggcggggctggatgccatccggattcaaggaccgattgcccatgagcgccactccttcgttattgcagcgctaccgcgacgcctggcagcacgcctggcgccagcgcaaaagcatggacagcgtgcagcgcttgccccatgaggcgcagttcctacccgccgccctggagttgcaggacacccccgtgcacccggcgccgcggatctttatctggagcatcctcggctttgccgtgctggccttgctgtgggcctttatcggcaagatcgaagtggtggcggtggcgccgggcaagatcgtgcccaatggcaagaccaagctgattcagtccagcgaaaccgcggtggtcagggcgatccacgtcagtgacggccaggcggtgaaagtcggcgaactgctggtggagctcgacccgacggcggcggatgccgacgtcaggcggattcagagcgagctgctggcggcccgcgtcgacagcgcccgtggcgcggccatgctcgatgcgatcaaccagcaacagccgccggcgtcgctgctcggcccgcttgccaacgccggcgccaacgccaacccggagcaggtgcagagcgcccagcgctggttgcaggggcagtaccaggagtaccgcagcaacctggagctggtggacgcggaaatcctccagcgcagcgccgaaatccagtcggcccaggcccaggtggccagcctgcggcaaacggtgccgatcgccacgcaattggccgaggactaccggcggttgctggagcaacagtacgtggcgcgccacgagtacctggaaaaggaacaggcgcgcctcgacctgctgcgccagctgagcgtgcagcaggccagtgtgttgcagtccagcgccgcccaggccgaggcgcggcgccggcgcgaaggcgtggtcgcgcagaaccgccgggccatgctcgacctgcaacaggaagccaatcagaaagccgcgagcctggtccaggaactggccaaggcccgttaccaggaaaccctgaccagcctcaaggccccggtggacggcaccgtgcaacaactggcgatccacaccgtcggcggcgtggtcaccccggcccagccgctgatggtcatagtgcccgccgaccaaccggtcgaagtcgaagcgatgctggaaaacaaggacgtgggcttcgtccgtgccgaccagccggtcacagtgaaagtggaaaccttcaccttcaccaaatacggcaccgtcgacggcgaggtgctgaatgtctcgaacgacgccatcgaagatgagaaacgcgggccgatctacagcagccgcattcgcctgaagtccgatcacctgatggtcaatggccaacgcgtggcactgtcgccgggcatgtcgatcaccgcggaagtgaagaccgaccagcgccgggtgatcgactacttcctgagtcccttgcaacagcatgtggatgagagcctgcgcgagcgctaggacggttgaagtgaagttcccggcgtatcgccaggcatcaatgatcttttcagtgtgtggggagtaaccggtatggccagatccgtaagccgaagtctgtattggctgggtgcgggagcggcagtcgtgctgcttctgtactccttgctgccaaccgcgcaaggcagcccctatatgaaacttcattcaacgggggagggcagtgtttttaccgggtgtgagttttcatccatccagcacgacgtgcctgcctttcgattctccatgagcccgcaggcctgtcgcctggtgcgttatgacggcagcagcggcatcgaattcacccttgagtatccaacggcagaggtggtcagcgacgacgccaagggcagccgttacccgatagccttgtttatccaacgtatctccatggaaggcttcgatgccgataggcacctgcgcggcaagcatcccgtggcgctgtcggacggggtcgagggttatgaggtcggtggttttcaggagcgcaagttcacagggaaagacggtgtctcggtgtatgtctcggactacgtggcgacggtccgggcgaaccgcctgtatggcagcggattatgggttttctaccaatatccaaaggaacttacggatgtaagggccgtggacgattttgttctcggtgccctcggtaatgtattggctggataaagaggtggtgtgtggaattgatcgcatttaatgacgaccagctacaagggccttcgcgttttttggataaaaaatattattcggttggcaaggttcttaatgttgcttcaaggatcgaggtctggcgcaagttcttgatttttttcagttgtatctggctggcggcatgctccgcaccggtatgggtggtcaaacccattgatatttcacaggccgaacaaagagtcacagcagactttgtagtcagcaagtcggctgactatagattcgctttgctgtttattcagggaaacaccttggctgaaataatcagccgggaagaaatctggggcaccagccacaaggaaggtgtcgcgattcctgtgcatcttcgggtcttgaaagatggaacaccggtgtttgacgaggacatagtgaccacagggatttactgggggcagacgtttgattatcaggggcagcgaatcaacacgacggtgcgtttgatcaagacattggaattgtcgcctgggagatattcggtcgaagtcggcactcttggggaagtacaggcatttcgcagtattgagagctacgtagagtttagttattacaatcccaagcattgaatcgttgtaaaagtttgcggtgtctgggtggtatagaaaggtggagtttattatgcgaaaagtgattgttggtcttctttgttttttgctggctgcctgttcagcacctgtatcgatagtgaagcccctggatgtctctcgggctaaccagttcgccagtgcgcagtttgtggttaacaaagccggcgactacagattcgctttgttatttacgaagggacatggtttagcggagataaataagcaaattgaaatatggggtgatcttgatcatgaaggtgtagctattcccatccatcttcgggtcttgaaagatgagcaggttttctttgatgaggagttagtgacaacaggcgtgcagtgggggcaggggattgattatgaaggacggaatattaatgtggcagttaggttgattgaaattctggagttggcgcctggaagttattcggttgaagtcagtacccttgaagagttggaggcttttcgaggtatcgaggggtttgtgaagttttcttattacaatccaaagcattgaagcaatcttagattgaagagggagcgttaaagtggaaaagaaatacagtgttacctataaggttgcaagggcgggggcggaatacgaatatcagaaagataaaggtgagcacaaagagggcgatattcattcgtcgtctggtggacatatgtggtactccttgagtgatggtgcaggctataagcaaagttatggttttgagtccgttcacgaccagatgcgtggtgaggggcaggtaggtggttatgatgatgcaggttacaagcagacagtatatgaagtaagtgtggtgttgactgaggatcagtttaataagttaaaaggtttttcgcaggatcctacgtcgctcggatttgataatacgcgttataggcttctaactaatagctgcgtggatttcgtatatgcttcgcttaaatccattggttttaatggcaagggtttcgaaggcgctctttttccagcagataatataaatccgctcaacaatcttctgcatacgtatggcgcccagatcattcgtgacgacttgacccgtcacggcgaatattatgaagcgaaagacggtcagcaatgtttatggcttggcgtgggtgatgtctctactgcccctcagacacccggcctgatcaacatcgacatcaacccttccccccaaccccaacaacacatccagggtgaaagcaaagcccagcaggacgtcgccaacggcttcattcaaaactcggcgacaaacagcatttttgccgtcggcggcattctcaacaaaaccgacttcacctcgacccagatggccagcctggcctcgggcggtattcgtcccggtgagatgcagctcgaccccaatgcccggcccaacacctacctgtcgaatttctaccaggccccggacagcaccaagccggacttcagcctgcgcaatgccgtgaccctgaacggtctgtcggccatgaccaccttcaacacctacgtcgatccgctgctgctggacctgaccggcaacggcgtgcacatgaccgacatccgcgacggtgtgctgttcgacaccgaccacagcggcacgctcaagcgcagcggctgggccgatcgcagcaccggcatgctggtgatcgacgatggcagcggccagatcaaggacgtcagccagatgttctccgagtactacggcggcaaggccggggtgaacggcgcggcgggcgagacgaaattcaaggacggtttcgccgccctggcgagcgaggacgcgaacaaggatggcgtgatcgatcagcgcgatccgatctggagcaagctgcgggtctgggtcgacggcacccatgacgcgaaagtcgatgccggcgaactaaagaccctggccgagctgggcatcacccagatcaacgtgcgtgcggcggcgtccactcaaaccgaagtgcgggacggcaaccgcgtactcgccaccggttccttcaccatcaatggcaagagccaggaagcgctggcggtggatttcctcggtgacccggtcagcaacaccttgagcgcccagggcgcgggcaccaaggtgacctcgaccagcaatggcatcaccaccaccgcctatgccagtcagagcaccacgggcgaaaccctggacgcggcgcagctgggcgtgggcaacctgtacggcggcagcggcaacgacacgctgattgccgcgccggccggcggctggctggtgggtggcggcggcagcaacacctatgtcggcggcaagggcgacgacgtgtttgtggtcagcgcctcggacgacatgaagaacctccacggcaacggcggccacgatacggcgatcgtcgtcggcgacaaaggcgtggtgttgaacatggcccaggccggcctgaccattgcccagggcggcagcggcgacgacaccctgatcagcggcggcaacggcggcgccttcatcaagggcggctccggcaattcgaccctggtgggcggtggcggcagcgacgtgctggtcggtggcagcggccacaacaccatcatcggcggcagcggcaaggcggtgatctacgccgggccccagggcgacgtgatctacgccgccgaaggcggcagcatcattcacgccggtggcggcgccgaccggattttcggcggcgcgggcaatgacgtgatcgaagtcggccacggcaacgcaaccatcgacggcgatggcgggatcaacctggtgaccctgcacggcaaccatggcgactaccgcatcacccgcaccgccagcggctatgaggtggccgacaaggtcgccgggcgcgacggtacggtgaccctgaaaaacatccagaagctgaatttctcggatatctcggcggtcgatctgcagacccccaacgccatgccggtggccgacgtgctgagcctcgataaggacggcaaggccttcaaccggacccagcctcacctgattgccgcgcagagcctgctggctaacgatcaacacctcaacagccagggcgcgctgcgcatcgccaacgtcggcgacgcggttggcggctctgtcagcctcacggcccagggcgatgtgctcttcactccggatgcccgctacaccggcctgctcagcttcaagtacggcgtggtcgatgccgccggcaacctgtcggcttcggtggtggacctgagcagcgggcagaccgcgccgatgcgcgccggggtgaccttgctgacgccggaagtgccgctggacccgttggcggcccaggagtggtacctgagcgataccaacgtgctgccggtctggcaggactacaccggcaagggcgtgcgcatcggccagttcgagccgggcggccagttcgccaccgcgcccgagatcttcgacatcgtccacccggacctggccgccaacgtcgaccaggcctggctgcagacccagcagagcaacggcagcttgccgggcctggtgtccaaccacgccaccatggtggcgggggtgatggtcgcggccaagaatggtacgggcggagtaggggtggcctacggcgcgacgctgggcggctactacctggccaacagcggcgccgacctcgccgggctggggcacatggtcagcttcgacattgccaacaacagctggggcttcaccaacgatttcgccctcagcagcttccaggacggcttcgtcaacaccgccacggcgctgagcatgaatgcccagtacgccgcgagtaacggtcgcggtggcctgggcacgatcattgtcgcggctggcggcaacagccgcgcgaccggcggcaatgcccagggctccttgaccaacaacaaccgcttctcggtggaagtcggcgcgatcaacgcccagggcgacttgtcgaccctgcagatcggctcctcgccgttctccaacccgggcgccagcctgctggtgtcggcgccgggcagcaacgtggtgtccaccagccatatgctggaaaccgaccgtggttcgaccttcggcaacgactacaccagcatgcagggcaccagctttgccgcgccgatcgtctccggcatcgtcgcgctgatgctcgaggccaacccgaacctgggctaccgcgacgtgcagcagatcctcgcgctctcggcgcgccagatcaacgacccgtccacgcagtggagcgacaacgccgcccacaactggaacggcggcggcatgcataccagcaacgactacggcttcggcgaagtcgacgcgcgggccgcggtgcgcttggccgaagcctggatgacccagagcaccggcgccaacgagtatgtctacagcgcctccagtggcgccctgggcaagaacttggcggcggggggcacgctgagctcgtccatcgccatgaatgccggcctcaatgtggaacacgtcgagattgatttcgacgcccaggtgggccgccttggcgacctgacgctcaagctgatctcgcccgacggcacccagagcatcctgctcaaccgccagggcaaggtgccggacggcatgccgggggcgagcgccacggaccttggcagcacgcagtcgggatcgttcaaatacaccttcatgacgacccatgacttcggcgagcgctcggcgggcaactggaccttgcaggtgagcgattcggcttccggcctgccggtcacgctcaatgcctggtcgctgcgtttgtacggcagcaagagcaccccggacgacacctatttctacaccgacgaatacctcaagtcggtggtcgggcatgtcaaccgtggcgtcctggacgacgcggtcaacggtgtcgcgggcgggcgcaataccctcaacgcggcggccgtttcgggggatagctcggtcaacctgctgaccggtgtcgccagcctcggcggcgcggcgttgacggtgaaaaatccggcgagcattcagaacatcgtcaccggcgacggcaacgatgtgctggtggctggcaatgccgatgccttgctcgacggcggccgtggcaacaacagcctgacagggggcgcgggcaaggacttcttcgtggtccatcgccgcgatggcggcagcgatgtcatcagccacttcgaggccgcccgtggcgagatcatcgacctggtgggttttgccgggaagaagttcaccgacctggtgctcagccagcaaggcgcggacgtcaagattgacctggccaagggccagagcattgtcctgaagaaccagtcgctggccgggatcggcgcggcgaacttcaagttccaggacacctttgtcgccccgacggcctacgtcaacagcgacgcctcggcggtcaagccgcaggaaggcctgggcaccgtgctgctcaacggcggcggcaagggcgtgatgtacagcagcgacgcccagggcaagatggtcgcttcgctgagcggcaccatctacagccatgacagcgcgacttcggatgtgttcgtggtggcggcccagtcgggcgtcaaggactacaacaacgccttgcgcggcttccgtcatggcatcgacaagatcgacctgcgccagaccggggtgaccgatttcagccagctgaccctcgagcacaagaatcgcgcgaccctcaacggcctgacacagattcacggggtgtatgtgacccgtaacggcgcccagggcgccgactcgaatgtcaacctgctgtacctggatgcgctggatgtggcgcaggtcagcgcctcggacttcatcttcgccgagcatgcgccgcaggtggtggcgccagtcggcccggtggtggctccggtggaacagccgacggtgactgtaccgggtacgctgacgccgattgtcgagcgtcctggtgtcgacaagcctgtcgtggtgccgccgctgccgcctgtcgatctgcatccgaccgtcagcgttccagtggtcgatccggtgctgcaaccttcggtgacgatcccggacatcaccctgccggaacacaagacgatcgagcagatcctcgccgaacggggtatcgacctgaacccgaaagtgccggaacacaagaccgtcgagcagatcctggccgagcgtggcggcaaccaggggccgacggttcccgagcacaagaccatcgagcagattctcgccgagcgtggcgtcggttcgttgcagccttcaaagctgccggatatcggcccggtcggacgcgatcaagggggacgcacgccggtggatgtgccgagcccgcggccgatcgtgattcccgatatcccggtggtcgataccagccaccgcgacctggatattccgagtcgtccgcgggtcaccgtgcccgatatcccgacggcgtcgaacccgtggctcaagttcgatgacccggtgccatcggtgactgacaccgaggatttctcgtacgcttcgatccgcgacagaatccgttcgcgtccaacgcccaccaccgtggatccggtgaccagctcgtcgcgcgacccgctcacactgagcccgttgccgggcgtcgatcctgcgcccgtggccagcgatcccaacaccatgacggtcaagggcttcttcgccaacgtcagcctgggcgacgaaagcaagaccatcaatgtcgaggcgtcgagcgccaagctggtggccggcaacggtgataacaaggtcaacgtgacgggcagccgcgccgagatcaccctgggcaacggcaacaacgtgatcgccggcgacatcaacaagctcacggtcggccatggcaacaacagcatcaccgacagcggctccttcgccacggtgaagctgggcgatggcaacaacaaggtgctggtcagcggcagcatgcccaccgtggaagtcgggcacggggtcaacgacctcgagttcagcggcagcatgggccagctggtgttcggccaggacatcagccccgagcgcctgtggttccagcatgaagggcaggacctgcagatctcggtgatcggcagccagcaggaggtcacgctgcacaactggtacgccgcgacccccgagcgtccacgggacatcatggccggcgaccgtcaccgcttgctgggcaacgatgtggaaaacctggtccaggccatggcggcgttcgcgccggcagcaccggcgaccatgaccttcggcgcggccgagcaacaggccttgcaacctgtgctggcggccaactggacatgaccgggtaacttgactcgctaacagggcccgcgatggagatcgcgggcccttttttgtttttggttgggaatgggcgggtaggtaagccgtcgttaatccccggatacaaacaggcgctgctttcaggttgcacggcaaagggcgcgacgttaaccctcgcccgtcgctgcaaaataagcgaccgggtttggcagctcgatgttgtcactgtgcgcaaggcgccaccttcagcgaggcgcttttttttcggcctacgctttccagggtggccgtgcgtagggcgcattcgtgcgcgccgggttcctggtgcaccggtctaccaacctgcgtacggccaccaccctttcgtttggtagcgagggtgacggctcctgaaggatgcactgggagtcaatttcatgaagaaaatcgttcctgatccacccgtcatggcagacagcttctctagcgccaaaatggaccctgccaaattcgaaagcgcagccaacaaggccatcaaccactacctgttccctaccgccaacgatatccccgttcctcacacccgcccgggaaagctgttccgtgtggaccccaacctgagtaccgaagaagccctgagcaacgcttgcgaaatcctcgagtccgcagcaaagcgccacctatcaatccaccgaagacatgcctgcgaccagccgcaaggtggtattggcaggcgtgcggttgatcgagatggcacaggtgctggtggaggcggtgttggagagggaggaggggagaagttgtaggtagtcgtgaaagagccccgcggatgcggggctctttatagggagagctaaggtattcgagtagcagcttcttagctgatagtcatatgtctggaaactcgagcttgtctgttctcggccagaagcagtcgttggttgttgatcaaacttactcctcttgtttcagccaggattttctagcaaagccggggcgatatatacctagtcagacctccctcacaagaactcgcaatctgagcctgcgctttaaagcgcaggcccgtacaactaaacataactttacatacctgcgagctgattcttttgcaattcagaattcaaacagcgactcacgccgtccttatcgctatagaggctatcttgatctttcgaaaccgttatgctttcaattcttgatcctttgccctctgttagttcgctgggtttgtagagtcgatcaacagcaacataaacataataaggttttgagtttatgatctgaacaaaggcagcctcattgtacgtcatagatgtatggcaaagtggcattgatgagttcagtgctatgtattcagacacagtggacgcgccaagctcccgactcttatcagtgaattttgtgccagccatgagaaccttatcttcacggccattaaaaaggcttctaaggaagaaggtgtcgtactcacttagctgctcgacaagttcgtcggctaaaattttaaatgtcaaatctttggtaggagatgccattgaccgctctaagcatgcctcagccatccctagggttaagaagcttctgtgatttgttaagagatacgactcaagaagcctctgcttatcatgctggttgagattttctccatatgtgttgctcagaagcttacactctcttgtaatcgcagataggctacccgccttgaaggctccaccctcagtagctcttcgctcgtcaagtactttatttggggacttgccgccactaatagtcttgcccatgatatggccatatcctaagttgtccaagacagaatctttggtgaggctctggaaggaaagtaatgtccaaggggctttgtcaccaattgcccctttcagaattgccttgcttttgtggttttgaacgccgggaatatcaaagtcaaccacataatcaaggcctgatctggttgcttgctcgtatgcactaactaagaacggcaacacagcgtcagtaatgggcgcactgagaagatttgcttcacttccaagaattgtctttgcggtgctgattaaattattaatgctctcaattttttcttctgacacatagataagactcagttggtggtccggcttggctgctccagccagcaattggccatttaaacttttttcgcggaattcatagagtgtacatttactggtcttgtcgtcatagctcatgtttagcactgggattttatccaaagtgactaaaagtgaggctttcttgcttcgaccaatcaagctgcgcgccaccgagttcttaaagctatctacgcagaatgcttgcatggcatatgtatttattgctattacctgatacttatcttcccctactggctccggagctgaaagatcgaagcttatatttatcgactcctttccccaagcgaatacgggctgggccaccatcagaaatatcagactaaaacaaattgatgaatattttttcatactacctccttgttatgcctttcatggcaaatagccataaggctatagaccattccttttcttcatgcaacatcggtcttgagagcagccatgctgcatagagtgtcgtgcgataaggaagtattgaactggttatttcaggctcaggcctggcactattgttaaagctgctctagtgatcaagcgttggctagaatgagcggccgctaattggccgaaagcagccatcattcttgtttaaatccacccctcatccgaaccaattgctgcctttaataagaagcattactattcacgcctccccaccctcagcacgccgcaatgacccccaagccgcctcgccgaccaggctttttcgagcactacgaagagttgatcggcacctggacgcgtcggctgaagaaccgttcgcaggcggaagacctggcccatgacacctttgtccgggtgctggagtcggatgcggcggcggtgcagcagccgcgggcgtatctgcaccagacggcgcgcaatatcgcggtggatgcctatcgtcgcgaggaccggcgcggcgccatggagcgggaggcggtgtatccagttgcgtcgcccagtggcgacccggagcatttcatgcatgcgatccagctggctgactccatcgaacgggcccttggcgagttgccgttgaactgccgcaaggtgtttgtctggcagaagctcgaagggctgacccaggccgagattgccgagcgcctggggctgtcaaaaaacatggtggaaaagtatatgatccgcaccctgcggcatctgcgcgagcgcgtggacgggccgcggtgatgaatgccatgacgttttcacccccagcccaacaggatgttccatgacgcagactcgtgagtgcgcgtgcgggcaggcgacggttcgcgatgaggcggcgctgtggtttgtgcgcctgcaagaaccggcgatcgatgccgaggagcgccagcgtttcgacgcctggctggcgcagcacgaggcgcatcgggatgaattccagctgctgcacaccctgtgggcggccacggatctggtgcccaaggcgcgtttgcaggcgctgtgcgcaaccccgagcccgagcatcaggcgccgcccgctgttgcgttatgcggtggcggccagtgtgctggcggtggccgtgggcctggggttgttcagcggtttgaacccgcctgcgctgtacagcgccgagttcgccacggccccgggcgagcgccgccatgtggccttgcccgatggttcccaggtcgacctgaacagccgcagccgcttgtgggtgcgttatgaaaaaggcctgcgcagcgtcgagttgagcgaaggcgaggcaatgttcagtgtcgagcacgacagcagccggcccttcgtggtggcggccgggcccggcaaggtcacggtcaccggcacgcgcttcgatgtgcgccgcgacgccagccagacccgggtggcggtggagcagggcacggtgcgggtgcaggggcgcgatgccgccgacagcgacttcgtcaacctgaccgcgggcctgggcaccgcggtcgatgcccggggccaagtggctgcggcctacgcggtggatccccaggcgctgaccgcctggcgcagtggcaagctggtgttcaacaacgccagcctcagcgaggtggccgccgaggtgtcgcgttatcgcgaccagccgctgcgggtcggcagcgaggcggtgggcaggttgcgcctgaccagcgtgttcaagtccgacgacaccgacgcgctgctcaaggccttgccgagcatcctcccggtggcggtgaagacccacgccgacggtagccaggaaataattgcgcgatagattcaggtttttttcgagttcttcgtcttcttgtccaactgcaactggtttgcattaacagacgcatcttcttgcgatcaacaggactgctcgaacttgaaacgcctcgacctgaataacaacaatccttgctcgccttccacccgctggctgccgctggccctggccctggcggtcagtgccgcgctgcctcaggcccatgccgaacaggcgccgagcgctatccacatccaggcccagccgttgggccaggccctgagccagctggggctgcaaacctcgttgcaggtgtttttcagccctgagctggtgggccggcaagcaggccccggcggtggacggcaagctgtcgccggagcaggcgctgcgccagttgctgcaaggcagcggcctgcaataccagatcgacggcggctcggtgaccctcagcccggcgccgtcggcggcgggtggcggccctctggagctgggcgccaccagcatcagcgtggtgggtgactggctgggcgacgccaacgcggcggtggtgcagaaccaccccggcgcgcgtacggtgatccgccgtgaggccatggtcgagcagggcgcgatgaacgttggcgacgtgctgcgtcgggtcccgggcgtgcaggtgcaggacgccaacggcaccggcggcagcgatatttccctcaacgttggcgtgcgcggcctgacgtcgcgcctgtcgccgcgctccacggtgttgatcgacggcgtgccggcggccttcgcgccttatggccagccccagttgtcgatggcgccgatctcctcgggcaacctcgacagcatcgatgtggtgcgcggcgccggttccgtgcgttatgggccgcagaacgtcggcggggtgatcaacttcgtgacccgggccatcccggaaaaagccaccggggaaatcggcagcaccctggaaacctcccagcgcggcggctggaagcacatcgacacggcctttctcggcggcaccgcggacaacggcatcggcgccgcgctgctgtactccggggtcaacggcaacggttatcgcgccagcaacaacggcaacgacatcgatgacgtgatcctcaagacccattgggcacccaccgaccaggacgatttcagcctcaatttccactactacgacgccaaggccgacatgcccggcggcctgacgcagaagcagtacgacgccgacccgtaccagtcggaccgcgactgggacaacttcagcggccgccgcaaggatgtgtcgttcaagtacctgcgccagatcgacgatcgcacccagttcgaagtgctgacctactactccgacagcttccgtggcagcaccatcgccgcccgcgaccagaagaccctggtgtcctatccgcgcacctactacaccttcggcatcgagccgcgggtgtcccatgtgttcgacctcggcccgaccacccaggaagccagcgtcggcatgcgctacctgaaagaaggcatgcacgaagaggccagccgcctggccctggtcaacaaccagccggtggtgcgcccgggctccgacggccatgtgtaccaggaccgcaccggcggcaccgaggccaccgccttctacatcgacgacaagatcgacgtcggcaactggaccatcaccccggggatccgcttcgaaaacatccgcaccgaatggcacgaccgcccggtggctggcaccaatggtgtgccggtgcaggagaagcgccgcgagatcaacagcaacgagccgctgccggcgctgagcctgatgtaccacctctccgatgcgtggaaactgtttgccaactacgagacctcgttcggcagcctgcagtacttccagctgggccagggcggggtgggcgaccagaccgccaacggcctgaacccggagaaggccaagacctacgagatcggtacgcgctacaacgatgaggtgtggggcggtgagctgacggcgttctacatcgacttttcggacgagctgcaatacatcagcaacgatgtcggctggaccaacctcggcgcgaccaagcaccaggggatcgaggcgtcggtgcactacgacctggccgcgctggacccgcgcctcgacggcctgaccgccaatgccggtttcacctacacccgcgcgacctatgaaggtggcagctcggcgttcaaggatcgcgacctgccgttctactcgcgccaggtggcgacgctcggcctgcgttacgacatcaaccgctggacctacaacatcgatgccttcgcccagtccaagcagcgctcaccgggcagcatggtcaacgccgacggcagcttcaacgacaactacatcaccgaaggcagcgccgacggccagtacggcgatatgccgggctacgtcacctggaatgtgcgtggcggttatgacttcggttcgcagctgtcgaacctcaagctcggcgccggggtgaagaacctcttcgacaagcagtacttcacccgctccagcgacaacaactccggcctctatgtcggcgcgccacggaccttcttcgtccaggccagcgtcggcttctgaccgaccgcgtcgcgcccatcgcgggcaagcagaagcgaggcttacccgcgatttttatgcccggcgcaaacccctgtagccgctgccgcaggctgcgatcgagcggcacgctcgtggggatcttgcgggtgctggagaccctgcgggtctatcgcagcctcgcgggctcggcagcggctacagggatggggggcaccctcgatattccggtcgggcccgatgtttgtgtagccgctgccgcaggctgcgatcgagcggcacgctcgcggggatcttgcgggcgctggagaccctgcgggtctatcgcagcctcgcgggctcggcagcggctacgggagcggtgacgccctcgatattccggtcagccccgatgtttgtgtagccgctgccgcaggctgcgatcgagcggcacgctcgtggggatcttgcgggcgctggagaccctgcgggtctgtcgcagcctcgcgggctcggcagcggctacagggatgggggatatccttatattccggtcgggccccgatgtttgtgtagccgctgccgcaggctgcgatcgagcggcacgctcgtggggatcttgcgggcgctggagaccctgcgggtctgtcgcagcctcgcgggctcggcagcggctacagggagcggtgacgccctcgatattccggtcagccccgatgcttgtgtagccgctgccgcaggctgcgcaaaggcccgcagggccttcctgcgatctcgaaaacacaatggacgctcgatggcccgcgaaagggctcagaccttcaacactttgccgctggccgccacgccaatcagcatcaccgcgatcaggccgaaggcgatgctcaggctgctgccgtgggcgataaagccgatcagcgccgggccggcgaggatgccggcataacccagggtggtgatggccggcacggcgatggcttcgggcatgacggtctgtttgcccaccgcggtgtacagcaccggcacgatgttcgagcagccgacgcccaccagcgcgtaacccaccagcgccgcttcccaggccggtgccagggtcgccagcagcaggccggcggcggccaccgagccgcccatgacgatcacccgcgtggcccccagcttgtgcacgatggcgtcgccagtcaggcggccgacggtcatggtcagggcgaaggccgcgtaacccaggccggcataggcggcatccacctggcgttcggcgctgaggaacaccgcgctccagtccagcaccgcgccttcggcgaggaacaccacgaagcacaggcagccgataaacaacaccacgccatggggcacggcaaaggccgggcccgaactccggctgccgtacggcaacatgtgcggcgccgccttgagcagggcgacgaccagcaaggccaccaccaccagggtcgcgcccagcggcgacaggccgaggccgagcatggcgctgaccccggccgcgccgacgatgccgccgaggctgaacaggccatggaagcccgacatcatcggccggccgctggcccgttcgacgatcaccgcctgcaggttcaccgtggaatccaccgtgcccagcccggcgccgaacaggaacagcccggcgatcagcagcggcaccgtgctcaccgtggccagcagcggcagggccaggcagatcagcaggctgccggcggccatcacccggcggcaaccgaagcgcccggccaggattccggcgatcggcatcgccaggatcgaacccacgcccaggcacagcagcaacaggcccagggtgccttcatcgagcccggcccgggccttggcgtagggcaccagcggcgcccaggcggcgatgccgaaaccggcgatgaaaaaggcgatgcgcgtggccatctgttccaggcggccggggctgatctgttgctctgaggtgtgggtgttgagggctgtcataaaaatccttggcggtcaccccgggcgcctgtcaggcaatggacgcttggcgccattgctgctgccgctggaggaccgagtctgccgtttcaccgaccagttgttgatacaccgccggcgacgtggcgccttcggtgttgataagcaggacgcccgagtgggcgtcgaggtgcgcgacggtgcgccgcgcgccatccttgcacatcaggctcagtcccgcgaggcccgcggcggcggattcgccggccagcaggggaatatcccgggcgctgccggtggccagttggcgcatggcgccggcggcgagcgtgtcggggagtgtgaccggacaatcgatcgaaggttgcaggaaacgccaggccgggccagccatcgacgagtccagcgcgccactggccaggccccggctcgcagccctggaaataatattgcgtggctggcgaatttgtttcgcataatcgccagcctttgcacaatttcattccattgattgcccaccactgattgcctgcccatggattgcccgcatgaccaccagcctggatgcctacgacctgaaactgctcgccgaactgcaacgcgatgcgcgcaccccgcaaagcgagttggggttgcgggtgaacctgtccaccgcggcggtcaaccggcgcctcaagcgcctgagcgatgaaggggtgatcgaacgctacagcgcggtcatcgcccccgaggccctgggctatgagctgagcatcattgtcgaggtggaggtggagagcgaacgcatcgatcagctcgatgcgctcaagcgcagcttccaggcctgcccgcaggtgcagcagtgctactacgtggcgggcgagtgcgatttcgtgctgatcttcgccgtgcgcaacatggcccagtacaacgaactgactcgtgagctgttcttcgagaacaacaacgtcaagcgcttcaagaccctggtggccatgagccgggtcaaggtcgggctggatgtgccgaccaccccttgaaacaccttaattccctgtaggagcgagcttgctcgcgatcagccgccaggctgaaagacatggcggtgcatgcgggatttttatcgcgagcaagctcgcttgtatgtcttaaggtgggcaagggggctcttgtcacgaaacaaaacgacaacgcggcgcctttgggcgccgcgttgtggtgggggaggccgatcagccctggcggcgggcatccaggctgaagcggccggcgccgaaggccaccacttgcagcaggccgccggccatggcgatgttcttgaagaagtggatgaactggttctggtcgcccaggttgttgtggaaggccagggcggtggccacgctgaacacagccaggcccagggctaccaggcgggtgcggtagccggcgatcagcagcaggccgccacccagttccacggcgatggcgatgcccagggccagttgcgggaagggcaggccgaccgattggatgtagccgaccatggcggccggcgcggcgattttcgagaagccggaaaggatgaagatggcgctgagcaggacgcgcccgatcaggctgatgctggcgttgctgttggaggtagtggacaggctgttggtcagtgtggacatgctggattctctcagtgggttcggcctcaccaccttggtgcgccgcgatggagagaagtttgccactggcgttatgaacgtaatagccgaataatttcgagtgtcagattcgattttttagaacgtagcctttgcgagaacagccccatgtccagcaaccccggtacgcccaccctcgatcaattgcgcatcttcctcaccatcgtcgaggtcggcagctttgccggcgcagcgcgcaagctgcatcgcgccacctcggtgatcagctattccatggccaacctggagctgcaactgggggtcagcctgttcgaccgcaagaccacccgcaaaccccagctcaccgaggccgggcgcacggtgctggccgaggcgcggagcatctacaacggcatcgacggcctgcgggccaaggtcaaggggctgctgcaaggcctggaagcagaggttcacctggtgatcgacgtgatgttcccggccgcgcgcatcgtcgatgcgctgaaaaacttccgccgcgagttccccacggtgcagctgcacctgcacatggaggccctgggcgcggtggccgagatggtgctggcggggcgcgccgcggtgggcgtcagcggcatggtgcaccgcgatctggccggtatcgagcgggtgcaggtggggttcgtccagctgatcccggtcgccgccccggagcatccgttggcgcaagcatcggtcaacctgccgggggctggtcgcgagcatgtgcagctggtgctgtcggaccgttccgagctgacgcgcaaccaggatttcggcgtggtcggcacccacagctggcgcctggcggacctgggctccaagcatatgctgctcagggaaggcatcggctggggcaacatgccggcgccgatggtcgaggaggacctggccagcgggcgcctggtgcaactcgatctgccgggcagccagagcctgccttatggcttcgacgccatctaccgtctcgacacgccaccggggccggcggcgtcctggctgatcgattggctggcggcccaggttcagtccgccggctcgggcgcggcctgatcggcctcctggagtgggccgagggcctgggccaggaagtcgacgaagaagcggattttctgcgacacatggcgattgctggcatacaccgcgtagatggtccggcgcggcatggaatagcagggcaggacccgctgcaactggccgctgtcgagcaacggctgggcgatgaacgagggcagggcgccaatgcccagcccggcctggagcatgtcgctgagcatcaggctgttgtccacggcaaaacgcaccggcagttccaggcggcggctgccttgcgggccttccagctgccagtggccggggtgctcggccaggcgataggccaggcagctgtgctcgcgcagttcatcgaccgtctgtgggctgcccttggcctgcaggtaggccggggcggcgcagatcacctgttcgatttcccccaggcgccgggcgatcagcgacgagtcggttagttgtcggcgaatccgcagcgatacgtcgaagccttcgcccaccacatccagcaggcggtcgtcgagggtcaggtcgatacgaaattgcgggtagcgccgcatgaagtcggcgaggatcggcgacagcaccttgaggccgaacgacagcggcgcgttgacccgcaagcggccgccgggctcgcgggtgccggcgcgggtcgcgcattccagggccgtcagttcgtcgagcaggtggcagcactcgctgaagtaggcctggccggcgtccgacaggctcatgcggcgtgtagtgcgcagcagcaacaggctgcccaggtgttcctccagctggcgcacctgcttgctgaccgcggcggtggattgccccaggtcgttggcggcgaggctgaagctggcgcgctccaccacgcggcgaaaggtgcgcatggctgccagcacatccatattgtttctcctgggttgaatatgtcttaacgaaacggctgattatcgccgaattgttaatccataccatggacacttcatttcacaggagtgtcgtcatggctgtttcccgtttgttgcgtgtcattccaggcctcgccgccttgtcgctgttcagtgcgctgtgcggcgccgcgccccaggccgaagtcggcgtcagcccctgggggccgaaggatgagatcggccgcctgaacctgatcaccgagcagtcgcgggcggcgatcatggcccgggtcagcggcagccaggcctacgacctggcggtcgagtatttcgtcggcatgcccagctggcaggcggcgggcgatccgccgtaccagatgtggatgacccacaccccgcacggcaatgtgatcgccgacccgatgcaggtcggcgagccgatgaaccggcatgtcagctacaccggctcggcggtgtcgatgtatgcccacatgggcacccatatcgatgcgctcaaccacttcggcctcgacggcaagatctggaacggctttcgcgccgaccagcacctgggcgaccgtggctggaacgtcaccggcgcggaaaaactgccgccgattgttgcccgcggggtgctgatcgatgtcgccgcggccaagggcgtggacatgctggcggacaattaccgggtgacccgcgccgacctgcaacaggcgctgaaggtgcagaaggtcagcctggaaaagggcgacgtggtgctgatccgcaccgggcgcatgcgcgactacgaaaaggcccaggcctatatggccaacccgccgggcatgagcctggacgcggcgaagttcctggtggaggagggcggtgccatggtggtgggtgccgataacctgagcttcgagaccttcccgtcggaggtggaaggcaactacctgccgctgcacacttacctgctggcgatgcagggcgcgccgatcctggagctggtcaacctcgaaggcctgtcgcgggaccgggtgtaccagttcgcctttatcggcgcgtcgttgaagttgcgcggtgccgatgccgcgccgattcggccgattgccttgccgattcgctaaacgccagccgtccggtcagccccgatgtttgtgtagccgctgccgcaggctgcgatcgagcggcacgctcgcggggatcttgcaggcgctggagaccctgcgggtctatcgcagcctcgcgggctcggcagcggctacagggatgggggataccctcgatattccggtcgggcccggtgcttgtgtagccgctgccgcaggctgcgatcgagcggcacgctcgtggggatcttgcgggcgctggagaccctgcgggtctgtcgcagcctcgcaggctcggcagcggctacagggagcggtgacgctctcgatattccggtcagccccgatgtttatgtagccgctgccgcaggctgcgatcgagcggcacgctcgcgggggatcttgcgggcgctggagaccctgcgggtctgtcgcagcctcgcgggctcggcagcggctacagggagcggtgacgccctcgatattccggtcgggcccgatgcttgtgtagccgctgccgcaggctgcgatcgagcggcacgctcgcggggatctggcgggcgctggagcccctgcgggtctgtcgcagcctcgcgggctcggcagcggctacagggagcggtgacgcctcgatattccggtcgggcccgatgtttgtgtagccgctgccgcaggctgcgatcgagcggcacgctcgcggggatcttgcaggcgctggagaccctgcgggtctatcgcagcctcgcgggctcggcagcggctacagggggggcgttagtgggggcacagggttagtcctgttcgcacaatgcccgcagggccgggtcgcgcacttgcatcagctcgaacagccccagggccctgagcgctggcagggctgcccgcagatcctcctcggctatgcgccgctgctgcgccgaggtgcccgggtcgctccacagccgggcattgatcagaaaggcccccaccgtccccttgcgtacccgggtgccgttgaagttgccatggttgagttgatcgggtaacaggtcttcggcgcgcatggatcgatcctcgtgtgaatgagcgctcagtctgcggcctggggattggctaaactgcctggttcttgccgttgaataacgtgaaacagccaatgtcccaacctttggtttcccccttgctcgctcaagccgagggcggcccgctgctggtcgcggcgtggcaacacagcccgatcgaacggcagaccgctgcccacagccacgctcgcggccaactgctcggcgcacggtgcggcctgttgtcggtgacggcggccgacagccagtgggtggtgccggcgacccatgcggtgtgggtgccgccgcgctgcgaacacgccttgcgttcccatggcccgttcgacggctggagcatctatgtcgagcccgaggcctgccacgaactgccggcgcaaccacggatcattgccacctccgggctgttgagggaggcggtgatgcgtgcggcgagctggccacaaggcgcgctggatgagccgcagttgcgcatcgcccgggtgatcctcgatgaactgggcagcctgccggtggaaccctttggcctgccattgcctgtggacccgcggttgcggcggatctgccaggcgctggccggcgacctggcggacagccgcggcctggaggcctgggcgcaatgggcggggatctcgccacgaaccctggcccggcgttttgtcgccgagaccggctttgccttcagccagtggcggcagcgcgcgcggttgctgcgggccctggagcgcctggcggcgggcgatgcagtgacccgggtggcgctggacctgggctacgacaatgtcagcgcctttatcgccatgttccgccgtcagttcggggtgacgccggggcgctatttcgcccggcacggaacaggctgagcgtcgctaccccggtagaagcgggcgcatgccttcaccccgcggaaaaccgctcccggctgttgctcaggtgggtccacatcgccgcccgcgcggcatccgggtcctggcggcggatggcggcgtagagggtttcgtgttcctggttggccagggtcgccagttgcgccaggtcgacatcgccgcgctcggcgtcgcgcacccgggtccgggggatcagggcgttgcccagcgattgcaggatctgcacgaaataagggttgccggtggcttcggcgatcagcaggtggaaacgctggtcggcctccacacaactgtcgttgttggccagcagttgctggtagtcgtccagcgcctggcgcatctgcgccagttgctcggcgctgcgccggcgggcggcgagagccaccgcctgggtttccaggcccaggcgcaattcgaggatgtcgcgcacgctcagggcggtatcgacgttcaagcgcaggccgtgggtgtcctggcgctccaggacaaaactgccgacgccatggtgggtttccacccagccggcggcctgtagcttggagatggcttcgcgcaccacggtacggctgacgccatgggcgcggacgatggtgctttccgacggcagcttgtcaccgggcttgagcaggccgcgcatgatctgccgggtcaggtcgctgaccaggtcatgggccaggttggtggaagggcgacggcggcccggggcgatatcggattcggtgctcatggcaaggtcgcgcagggaaagcaaaaagcttatcaccgaagtggccgggcagggctcaacttgtctgacatgtatgacaagttatcggataagtcactccagggttcagtgcaggttctcagcgcgagtgcagccggaaaaatatttctgtgcatgtggtttttgtttatatgaattaaatcaatttgttgggtttatttctcaacattctcttcgatcaacaaagccttgcgagccgacttctgcgacgagtctgcgcttgtgacgctatttttctacttgtatgatgactgtcaactggggcgctcgcccagtcacccgcacacaacaacaaacaagtgggagaggcatcgtgaataccaccctcaatccggccggcgacgattcgctgctggccatcgccgtggcgaaggtcaagcgccatgtgctgccgctgttcgtcatcatgttcatcgtcaactacatcgaccgggtcaacatcggcttcgtccgcactcacctggaacatgacctgggcatcggtgccgcggcctacggttttggcgccgggctgttcttcatcggttacgcgctgttcgaggtgccgtccaacatgctgttgcagcgggtcggcgcgcggatctggctgacccgcatcatgttcacctgggggctggtggccacggccatggccttcgtgcagaacgaaacccagttctatgtgctgcgcttcctgctgggggtggccgaggccgggttcttccccggggtgatctactacttcacccgctggctgcccggggtggagcggggcaaggcgatcgccattttcctgagcggttcggccgtggcttcgctggtctccggcccgctgtccggagcgctgctgcagatcgagggcctgggctggcacggctggcagtggatgttcatcgtcgagggcatggcctcggtgctgctctgcggttttgtctggttctggctcgactccacgccccgcgacgccaagtggctgagccccgccgagcaagaggcgctggtgcgggcgatcgacagcgaacagcgcgagcgcgaagcggcgatgccggtcaagccgtcgctctggaccctgctcaaggaccggcagatcctgctgttctgcctgatctacttctgcatccagctgaccatctacgccgcgaccttctggctgccgagcatcatcaagaagatgggcgacctcagcgacctgcaggtgggcttcttcaactccattccctggctgatctcgatcatcgccatgtatgccttcgccgcggcgtccggcaaatggaagttccagcaggcctgggtcgccagcgccttgctggtggcggccgcggggatgttcctgtccaccaccggcgggccggtgttcgccttcgtcgccgtgtgcttcgccgctatcggcttcaagtcggcatccgcgctgttctggccgattccccaggcctacctggatgcgcgcatcgccgccgcggtgatcgccctgatcaactccatcggcaacctcggtggcttcgtcgccccggccaccttcggcctgctggagcagcgcaccgggtcgatccagggtggcctgtacggcctggcggcgacctcgatcatcgccgcgatcatcgtgtttttcgcccgcacccggcccaaggcccatgtcatgccgacgcccttggacgatgcccgcccgctgctggacaaaacccactgacttttgccgacaggaaccgacccatgacttttgaatccacccatcatcaccctggccagacaccactcatcacccgactgcaagtggtgccggtggccgggcatgacagcatgctgctcaacctcagcggtgcccacggcccgtttttcacccgcaatatcgtgatccttaccgacagcgccggtaactccggggtcggtgaagtgccggggggcgagcggattcgcgcgaccctcgaggaggcccgcgaactgctggtcggccagtccatcggtcattaccagaagctgctcaatcaggtgcgccaacgttttgccgagcgcgatgccggcgggcggggccagcagactttcgacctgcgcatcgccatccatgcggtgaccgcgctggaagcggcgctgctcgacctgctcggccagttcctcggggtaccggtggcggcgttgctcggcgaaggccagcagcgcgaatcggtgaagatgctcggctacctgttctacatcggcgaccgacgccggaccgacctggcctaccgcgacgaagccgaggccgacgatgcctggctgcgcctgcgccacgagccggcgctgaacgccgagagcatcgtgcgcctggccgaggcggccagggcgcggtatggcttcaacgacttcaagctcaagggcggcgtgctgcgcggcgaagaggaaatggaggcggtcaccgccctggccgaatgctttcccaaggcgcgcatcaccctcgaccccaacggtgcctggtcgctgaaacaggcgatcgccctgtgccgcgatcaacaccgggtgctggcctatgccgaagacccctgcggcgcggaaaacggttactccgggcgcgaggtgatggccgaattccgccgcgccaccgggctgcccaccgcgaccaacatgatcgccaccgactggcgggaaatgggccacgcgatccagttgcaagcggtggacatccccctggccgatccgcatttctggacgatgcagggttcggtgcgggtggcgcagatgtgccatgaatggggcctgacctggggctcgcattccaacaaccacttcgacatttccctggccatgttcacccatgtggcggccgcggcgccgggcgagatcaccgccatcgacacccactggatctggcaggacggccagcacctgacccgcaatccgctgcagatcgtcgagggctgtgtggcggtgccgcagacgccggggctgggcgtcgaactggacctggacgcgctggcccgcgcccacgagctgtacaacagccggggcctgggggcgcgggacgacagcgtggccatgcagtgcctgatcccgggctggcgcttcgacaacaagcagccgtgcctggtgcgctgagccaggtagaagaggcttggccgggccgctgcattcacagtaatgtcagcggcccgtctgcttttggagccctgcaatgactgctttctacgatgcccgcggcaatctttacggcgtggtggcgcccgaggcggtacgccggttggggatcgccttgccggccagcgcggccgaggcggcgctggccaggaccaattggagcgagcaggccatcgaagccctgtgcagttggccctccggtatccggccggaaggggccaaggcccatcgcagcgacggtttgctggtcgggccgttccaggacgcgccgccgttcgacctgctgatcgtcaacaccgacggcaccctggccgagcgcagcggcaacggcctgaccatcttttcccaggccttgaccgagcaagggctgctgccggcccaggggcctgcgcagctgcgggtgcatcacgacaagccggacggggtgtcgccgctggcgaccctggtcgagccggcacaggtcgccggggtgtccggcttctggctggacctcgggcagccggcgttcggcccacacgccgtgggtgcgcaacacggggtcgaaaatgacggttcgagctgtgtcgagctgagccgggtgcgcgggctggcgcggttgcacccgcaatggtgccgtagccagttcgtgcgtattggcaacccccattgcgtgaccctggtcagtgacgccagcgccttgccgggcaaccggcagatgagcgaagcgcccctggccgaggccctgacccgcattgcctacgccctgcccagcggcagcggcgaaccctgcccggccggggtaaacctgcaatgggcgtggctggaaggcccgcagcgcgtcgccgcgcgggtgttcgaacgcggcgagggccccaccgcatcctccggcaccagcgccagcgcggtggccagcgcggcgtggcggctcggttgggtcacggccggcgaagtggcggtggtgatgcccggcggcaccgcgccgctgcgcctggaggagcggggtggggagttggtgcgggtgagcctgttcggtaccgcccgcgccctgtagccgctgccgcaggctgcgtaaagatccgcaggatcttccgacgtccttgagatcgctgcgaccgtgccggtcgatcgcagcctgcggcagcggctacaggggaggtgatgaggtcagtggccgttacacaaaacccgcatcgtccggcagctcgacctgggccatctgccgtttcatcagcaccttgccgtcgcggatcgagtacagcgccaagccctggctgcggatcatttcgtagtcgctgtcggccgacaggatcagcaggttggccggccggccttcttccaggccgtagcgctcgcccagggccagggccttggcgctgttgtcggtgaccaggtcgagggcgctctgcaggttgcggtagccgagcatgtggcagatgtgcaggccggcttccagcacccgcaggatgttgccgttacccaacgggtaccaggggtcgacgatcgagtcctggccgaaacacacgttcattccggcttccagcagctcgttgacccgggtcacgccgcggcgtttcgggaagctgtcgaagcgcccctgcaggtggatgctttcggtggggcaggaaacgaagctgatgcccgagtggccgagcaggcggaacagcttggcgcagtaggcgttgtcgtaggaacccatggcggtggtgtggctggcggtcacccgcgagcccatgccgcggctgcgggcctcttcggccagcacttcgagaaaacgcgagtgtgggtcgtcggtctcgtcgcaatgcacgtccaccaggcaaccggtgcgttcggccaggtccatgaggaacttcaccgagctgacgccctggtcgcgggtgtactcgaagtgcgggataccgcccaccacatcggcgcccaggcggatcgcctcttccatcagttcgcgaccgttgcggtagctttcgatgccttcctgggggaaggcgacgatctgcatgtcgaccagatgcgcgctttgctcgcgcacttcgagcatggccttgagcgcggtcagctccgggtcggtgacgtcgacatgggtgcgcacgtgctggatgccgtgggcggcgagggcgcgcagggttttccgggcgcgggccttggtgtcttcctgggtgatggtgaccttgcgctcgccccagcattcgatgccttcgaacagggtgccgctcatgttccagcgcggctcgccggcggtgagggtggcgtccaggtgaatgtgcggctcgacgaagggcggcaccaccaggttgccgccggcgtcgaggtcgtcggggcccagggttggggcttcggtctgccgggcaatgctggcgatgcgaccgttctccaggtgcagttcgtgcaggccttcgcggttgcgcaggcgggcgttgatgatgagcatcggagcgattcctttttcaatccaggcggtcagggtacggcgctcgggccggcggccgcaacgtcgcgtggcccgggctcatgcctggatgtccgcggcggtcgtggcgcgtgcgccgagcaggctgctcagcagcatgtagctcagggcggcggccgcgatgcctaccagcggcgcgacccagggcgagccgaaggccgccacggtgccgatggcataggcgcccaggccggcccagttgaacgccggcagcttactgtcggccaggcgcgggtactggccgcgatagcgatagaagaagtcggccatgatcaccccgccaatcggcgggatcaccgtgcccagcagaatcaggtagggcaccagcatgtcgtacatgcccagcagcgccagcagggtgccgatcaccgcgccggccagggtcacggtcttgcgtcggccggtgcgcagcaggttgcagccggcgacggcgaagttgtagatggtgttgtcctgggtgctccagatattcagcaggagcatggccatggcggccatggcgaagccctgcaacagcagcacttcgaccacgtccggctgctggtagacgatggcgccataggccccgatcagcaccatcaggccgttgccgacgaagaagccgatcaggctggccagcactgcgaccctggccgagcgcgaaaagcgcgtccagttggtggcctgggtggcgccgctgacgaaggtgccgaacaccagggtgatggccgtggacaggtcgaggctggcgctcggcaccacggccagcaacccatcgaggccgccgaccttgaccgtggccacccacatcgacagcaacagcagcagggccatggccggcaccgcgatccaggagaggatttccagcccgcgataaccgacgtaggcggtggcgcagaacaccaggccgaacagcaccatcagccccagcacggtgccctggcccagctcgaaatacttgcccagcaccaccgcggcggtggcggtgccccaggcgtaccagccgatctgggtgaagccgaggatcaggtcgctgagcttgctgcccacctcgccgaaacagaagcgccccatcagcaccgagttcaggccgctcttgaaggcgatatagcccaggcccgccgcgtacaggcccagcagcaggttgccgaggacgatcaccccgagcatctggccaaagctgaaggccacgccgagcttgccgccggcgaacatggtggcggtgaaaaaggtgaagcccagcagcaccatggccgtggaggccaggcccttgcgcgcatgcatcggcacttcgctgagcgggtagtcgttgcctggatcgttctgcgtcatctgccttcccctgattggcccaggcgtggcctggtgcgtaagcgacgcaggtgtctgctgcagtcgccgtgccaacgccccgagggtcaggggtgcccggccggcgctgtgcaacctgcaggagatttatagacaagcaggggatttttgctttccggcgcggccgattggccggttttggagcgaaagcggtgcgccagtgagacaaattggatcactggccgctcagtcctcgggggcctcgaaaatgctctcgatgggcaggccgaaggccttcgcgatcttgaaggccaggggcaggctggggtcgtagcgaccggtctcgatggcgttcacggtctgccgtgaaacctccaggcgcgcggccagctccgcctgggaccagccttgcgcggcgcgcagctcacgcaggcggttgttcactggtagcgcctgttgccgaggagcgtggccaccagccaaaccccgcccatgatcggccagaccatgaacatcgacagtcgcggcaggcccgctatttccaggaaaccgtagctgaaggtgatcagcgcggtgcagacaaaggcgatgcccagggcgttgagctggatgcgctggctgagttcatccaggcgccgcagttggcggatgaccaccagcgccatggcgatcatcgggatcacgggaatcagcgacaccgcgatgcgcccggcgctgctgtccatgcccggcagcaggtaagtgctgagcaccacggcgacaaggtacgccagcagggcgagggtgaattccacgaggtaacgtttgccgcacatggccggctcctgaagtaaagggtgctttacattaggcaggcgatcccgcggtgtcaaggacgctttacattggctcagtcgaacagggtcaggcgggtttcgccgcggtggaaggcaaaggcggcttcgatatcgctttccacggtgcggccgcgggacagttcgggcagggcgtcgagggcgaagaacccggcgtcgctgacttcagagccggccaccggggcactgcgttcgtcgcgctcgcagagaaaatacagcttgtagaagtcccgggtgtcgggggtgaaggggcccttggccttgtgtcggacgctgtagagggcgtgggccgagacgctgagcccggcttcttcgtggatctccttgacgatattttcggcggccgacaggccgatatcggcataaccgccgggcatggcccagcggccgtcggtccgctcgcggaccaggaggatgcgctggtcttcgatcagggcgccgcgcacatccaccaggggtgtcgagtagcgtttggcgaagtccgacaccaggccggcgatgcgttccaggggcacgtcggccagttgcgcgagcatgctgtgggcgatgtcggcgacttcctggtaacgctcgcgatcgaacgggtccttgcagaaatgcagcccggtggaggccagggcctgcaagcgtttggcgtgggtgagccaggtgttttccatggggcgtgtcctcaggtaatcgctggggccaaatctgtcactgtcggagcgagcttgctcgcgatgaggcccttgagtattgcatcggccttgaagacttatcgcgagcaagctcgctcctacagggggcggggcggtggttgctgggcgaggtaggcggccaggcgcggcagggcttcttcggcgttgcggctgtggccggcccaggtgcaggccagcatcaggttgcgtggcaggtggaagtcctccaccagaaaaccttcgtcgcggccgtcggcgtcatggggcacttgttcgcgcagggtcgcgggcgcctcgaaccaggcccacaccggtttgcccagggcgatggccatgcccacttcgaaggccgtgccggagtccggctccaggccgcgaaagtcgttgaggttggccagcaccgcgtcgcagtcgcggatcatctgcatgttctgctggcagatcagttgcgcggtctgctccggtgtcggctgggccggcacctgctggtcgaaggggtagaggccttgcaggccttgggcctggcacaggcgcttgaggtattcgccacgggcgatggcatcgcggcgaaacaggtcgaagccggcgaggtagatgcgtgggttcatgcctggctcccggcctggggtagaaagcgcagcagcgcggcgatgatggcttccggggcgtcttcctgcagcaggtggccggcgttgggcaccgcccggaaccgtgagccggggatcagccggtgcaactggcgcccgcgttcgatggggatccactgatcgtcctcgccccagagaatctgggtcgggcagcgaatgctcggatagagcccggctacctccgcggtatagcgctcgtccatctgcgcgatctgccggtagaacgcggcctggccgctggcgccgagccagggctggacgtagggcgccagttcccggtcggggatctcgcgctggatcgccccacgaatgtaggccggcactatggcgcgctggatgtagtccggcacgccgctgaaggcctgttcatgctggcgcacgtgttgcacgaacggcgagccccagggcgacagcgccaccgggtcgagcagggtcaggctgcggtagtccttgccgttgagcaggtgggcgcgcagggcggtggcgccgccgaagtcgtgggccaccatgtccgggcgctccaggccccagtgctccagcagttcggccagcagccggttctgcacgccgagggacacatcctggccggcggcctgttccgattggccgtagcccagcaggtcgaaatagtgcacccggtggctggcgctgaagtgcggggcgatgcggtgccagacgtaggaagaaaacggcgtgccatgcacgaacaccagcggcggcccgtcaccctgaatggcgtagcgcaccttttgtccgttgaagctgtaggttcgatccagcggccagtcactcatgttgtggtcctctgcgggtgatcggtccggcgccttgctcatgcaaggcccggcgcagcccatgctcctcggcgcgatgagtctcggtgtaagcgcggcgcgagcacaggcgatgttttcgctcatggctgggttggtgtaaagccggatgtggctatgacccgaggaccgagcgggcaagcataggcataaaaaaactaccgcgggcggtggttttttttcaggcgggcgacggtttattcgccgcgatagatgcagccgctggtgcaggtctcgtgaatgcggatcgcactcagctccggcagcaggggtttgagctcgttccagatccacttggccagcacttcgctggtggggttttccaggccggggatgtcgttcaggtagttgtggtccaggcgctcgtagagcggcttgaagatctccttgatctcggagaagtcgcgaatccagccggtatgcggatcgaggtcgccgctcaggtggatggccaccttgaacgagtggccgtgcaggcgcccgcacttgtggcctgcgggcacgtggggcaggcggtgggcggattcgaaggtaaattctttgaagatttccacagtgtcggtcagctcggtcaggtggctatcgccgcgggcgatgtaaggcaggcggcgagtttaccagcttggttatacggttgcgggaaaacactgactaaagggtcagcaggcgctcgccgagacgaccgctaccggccagctcgaggaactcgtcgcccaggcgccggctttcgtccatcgcgctgcgccagtatttctgacggctggcgtcgtcgcccatgaagcgcttgaagtcattgcggtccggcagtttgccgtagggcaggcgcgccaggtattccttcgacggtgccagcagcaagacgtcctgcaggcggcccgggttgccgcggcgccagggcagggtcttgtcgaaccagccgggaatcacccggtcggtgaagtgcgggtagagcacgatatcctcgccgctgtagggcaggtcgaggtggtagtccagcaggccgccgtcgcggaaggtgccggccccggccccgggcaggtcgcgcacgccttgcatgaccatcgggatcgaacccgaggccagcagggcctggcgcaggttgccggtgtccagcggcacgaagcgcgaggggaagtcgtcgagggcatgcagcggcggcgccaggcgcgggtcatgcagcaccaggcgttcgaagtgccgcgccaggcgcgcgcggccacgcaggttgtcggcgatcaccgaggacagccccaggcccagccgaccgcgatggtcgtcggcgagcaggccgtggcttttcaccaccatgatgttcagccggtagtgcgggttgtcgagaatgctcgcgtcgcggccgtcgagcagctcgtgcagcatgcgctgcgaactctggctgatctgcgccatggtcacgcccttggcaaaactctgggcgttgtacagctggcccaggcgccggatgccttcggcggcgtccggcaggcaggcgctggcgaagcgccaggaacccaccgaggcaccgatcagcgaacgttcccgtggcgccgctggcagccattcgccgaacagcgccaggtccagcccctggatgcccagggctttcggcccgccggcggcgccgggcagggtgccgacctcggccgcgctcaggccgttggcgcgaatgcgcgccagggcgcgtgggccggccttgagggtcagggcagggaacttgatgtggatagcggtcataccggcctcaatctcgagcgacagcggagtataaaagctcgggccagcggcgccgaatgaaacctgcgcggcgccgatgatggccattcagtttcaattaagttcgaccggctatcgtgagccccgtagcaacacataacgagaaattcggagacaccccatgaaaaccctgactgccctgttcaccgcgaccctcatcggcatgaccgccagcctggcccatgcccgcgacctggggcccgacgaggccctgagactgcgcgacgctggtaccattgtgtcctttgaaaaactcaatgccacggcattggccaagcacccgggcgcgaccatcaccgaaaccgagctggaagaggagtacggcaagtacatctaccagatcgagatgcgcgaccctcaagggattgagtgggacctggaattggacgcagtgagcggccaggtgctcaaggatcatcaggatacgtaatgaaggtgaatctacgcgccggcagcagggtggccctggcgcttctggctttttgctcggtggcgctggcccgcgacctggaccaggacgaagccctgcgcctgcgccagcaaggggtgatcctgccgctggagcaattgctgcagcaggccctggaccgttaccctggggccaagttgctggaagccgagctggaagaaaaacacgacgtctatatctacgaagtcgagctgctgaccaccgagggcgtggtccgcgagctggacctggaggccaccaccggccgcttactgaaagacaaggaagatgactgatgcgcctgctcctggtggaagaccacgtctccctggccgacgaactgctggccgggctcaaccgccagggctacgccgtggactggctggccgatggccgtgacgcgctgtaccagggcgccagcgagccctacgacctgatcgtgctcgacctcggcctgcccggggtgccgggcctggaagtgctggccaagtggcgcgccggcggcctggcgaccccggtgctgatcctcaccgcccgcgggtcctgggccgagcgcatcgaaggcctgaaggccggtgccgacgactacctgaccaaacccttccacccggaagaattgcacctgcgcatccaggcgctgctgcgccgttcccacggccaggccaaccagccgacattgcaggccgccgggctgcacctcgacgaaggccgccagtgcgtggtgcgcgacggcgtggacatccagctgaccgccgccgaattccgcctgttgcgctacttcatgctgcacccggagcagatcctttcgaaaagccatttggccgaacacctctacgacggtgagaccgagcgcgattccaacgtgctggaagtccacgtcaatcacctgcggcgcaagcttgggcgcagcgtgatcgaaacccgccgcggccagggctacctgttcggcgggaacgcccagtgaggtcgatccagcgccgcctgagcctgggcctgatcagcgtgatggtgattgtcggcctggtgctggcgcagaccagcctgtggctgttcgagatgggcttgcaacgctacctggaagccggcctgcgcaacgacagcgaaagcctgctggtggcgctggtccggggcccgcagggtttgcagctggacgagcggcggttgtcgccggcttatcagcggccgttttccgggcattacttccgcattgacttcgatgacgtgcactggcgctcccgctcgctgtgggaccaggacctgcctgcactggcacagaccggcctgcacagcaacctgcaactggggccggaaggccagcgcctgctggtgctgcgcaccgactaccggcgcctcgggcagtcgatttccatcagcgtggcccaggactacaccccggtgcgtgagagcttcctgcgcatgcaacaggtgggcctgggcctgggcctggccggcctgctgctgatcctgatcctgcagcgggtcaccgtgcgccgtgccttgcgcccgctggagcaggcccgcgagcagatcgcccaattgcaacgcggccagcgttcgcaactggacgaacaggtgccgctggaactggaaccgctggtggcgcagatcaaccatttgctggcccataccgaagacagcctgaagcgttcgcgtaatgccctgggcaacctcgggcacgcgctgaagaccccgctggcggtgctgctgagcctggcctcaaccccaagctgcaggcgcacccggaactgcgccagttgctcgaggagcagctggagcaggtgcagcagcggctcaaccgcgagttgaaccgcgcgcgcctggccggcgatgcgttgcccggcgcgctgttcgattgcgacgccgagctgccgggtctgctggcgaccctgagcatgatccatggcgagcacctggacctgagctatcaggcggcccccggcctgcaactgccctgggaccgggaagacctgctggaactgctgggcaacctgctggacaacgcctgcaagtgggccgatgccgaagtggcgctgagtgtgtggcagaccgccgagggttatggcctggcggtggacgacgacgggccggggattcccgaggagcagcgcagccaggtgttcagccgtggcgcgcgcctggacgaacagaccgacggccatggcctgggcctgggcatcgtgcgcgacatcgtcgagagctggggcggggtgctgcgcttgctggaaagcccgcagggcggcctgcgggtgttgatcgagttgcctgggcgctgatattgccgatgctgaatccctgaatccctgaatccctgtagccgctgccgaggcacgaggctgcgatcgggttgggcggcattccgacgaagcgcccgccaaccctatgcccgcggtgtatctgatcgaccgagtcgccgggtctacgactgctgcgcagccgatcgcagcctcgtgcctcggcagcggctacaccgggcgtttttgaaaggggaggtcagacccggaactgatccatcaggctctgctgctggttggccaggctgttcagcgactggctgacccgcgccgattcgttggcctgttccgacagcgattcggtgacgtcgcggatggtcgccacgttgttgttgatctcctcggccaccgcgctttgctcctcggcggcgctggcgatctgcaggttcatgtcgctgatcaccgtcaccgcgtcgccgatctgccgcagggcggtgaccgcctggccgacctgctcgacgctgccctgggcctggcgatggctgttgcccatcgaaccgaccacttcctgggtgccgctttgcagctgctcgatgacctggcgggtttcctccaccgactcctgggtgcgccgggcgaggttgcgcacttcgtcggcgaccaccgcgaaaccgcgcccggcctcgccggcgcgagcggcctcgatggcggcgttgagggccagcaggttggtctgctcggcgatggcacgaatcacttccagcaccgaaccaatcttttcactgttggcggcgaggccttcgacctgggtcatggcggtgctcatatcggccgccaggtgatcgatgctcgcggtggtgcggtcgatcacgctcaggccctggcgcgtggcctggtcggcatcgcgggcggcctgcgcggcctgggccgcgctgcgggcgacgtcctgggcggtggcgctcatctcgtgggacgcggtggccacctggtcgacctggcgatactgctgctccatgccggcgctggtctgggtggcgatggccgaggactggtcggcggtgccgcgggcgtcctgcaccgagcgtttcacctcggcgatgatcggctgcagcttgtcgaggaagcggttgaaccagccggccagctggcccagttcgtctttcttgtcgtaggccaggcgccgggtcaggtcgccttcgccgctggcgatgtcttccagcatgtgcgccacgccgaggatcggccgggtcacgctgcgcgccatcagccacaccagcagcaggccgagcaccgcggccagcaggcccaggcccagttcgaccagggtgccggcctgattgctctggtccagctggtttttcagggcttcggccgggcccaccaggacccgctccggcacttgcagcagcacgccccagggcttgccgccgggaatcggggtgaagggcgcgagcactttcagggcgttgtcgttgtgcaggctctgggtctgggtgctggccgacaacaggcggatcagttcgccaccgttggttttgtccagttggtccaggcgctggctgagcttgctggcgtcggcgctgtagccggcgagcaggccgaccgggctgatgatgctgaccgtggtctggccgtcgtagagtgccttgctcgcttgctggctgaccgattgcaggctgttgaggttgatgtccaccgacagcgaggcgatgactttgccgttcaccagcagcgggaacacgatgctggtcatcagcacattctggccgtcgatcacatagaagtaaggctcgatcacacaaggcttgagggtattgcgcgggcaggtgaaccaggcattggccggctggccgctggggccggtggtggtgtcgctcatgtcgctttccggcagcgccatggaggtcagcttgcccggggtcggctgcgaccagtacagggcgaagcggcccttgtcgttgctgcccagttcgctctggccgctgaagagttcgtccttgccgtccagcgcgttggcttcgaacaccagcgacaggccgagcaggtcggggttggcctgcagcgccgacttcacctggcgggtcaggtcctcgcgcaggtcgaaggcatcgaggaagcgcttctcggcctgctcgcgcaggaacagcacctggcgcgagaagccgtggccgtattgataggcgtccatgaattgctggcggatacccagcgcctggacctcgccctgggcctcgatgcgggcctgggcggcttcgttgagcatctccatgctcgaggctttcaccagtgcggagctgtgctccatgcggtacagcgaaagccccaccagcagggtcactacagcggccaggcagaggccggcgagcagggtgattttccactggatggaaagttgtctgagcgacatggagacgtccttattcgatatttatttgagactttgcaacgtatcggccgaagaacagccttctttaaacgcttgttcgaatgccgctccctgtagccactgccgcaggctgcgatcgagtgcgcagcactcgcaaaggcacgcaatgcgactggcctggaagactcgatcctcagacccggcgtccgctgcgcggccgatcgcaggctgcgccagcggctacaagtgacggcggagctgccggcgcaggcggtagtcggtcgggcagcgagtgcccgccggttttgacaagcgttgcccgctgctgcaaagtgcgcgccctctaataagaccctcctttttcaatccggcgtcggcaatggttgccctctggccggactcattccttttgcggcgttttcccgccgcagtgccatgaggtaacgatgattaatgcagtaattgccgcggttggcgtcatgctggtcctcagcttgtcccgcgtgcatgtggtgatcgcgctgatcgtaggcgcgctggtgggagggctgaccggtggcctgggcatcgaggcgaccctcaaggccttcaacaatggcctcggcggcggggcgacggtggccctgtcctacgccttgctcggcgccttcgcggtggcgatcgccaagtccggcctggcccacgccctggcggacaagatcctgctgctggtggaccgtcaggacgccaatggcggcggcaacgtcaaatggctgctgatcggcctgttgtgggtggtggcgatcgcctcgcagaacatcctgccgatccatatcgccttcatcccgctgctggtgccgccgctgttgtatgtgctgagcaaactgcagctggaccgacggctgatcgcctgcgtcatcaccttcggcctgatcaccccgtacatgttcctgccggtggggttcggcaacatcttcctcaacgagatcctgctggccaacgtcgcccgcagtggcgtggacatcagcaacatcaatgtcacccacgccatgggcattccggccctgggcatggtcttcggcctgctgctggcctttgtcagctaccgcaagaagcgcgtgtatgacctggagctgatcgagaaagtcgagcaggtgacggtgcaatacaacccgcgcacgctgctggtggcgggcctggcgattgtcgcggcctttgtcatccagctgttgctggactcgatgattatcggcgcgctgtccggcttcctgatcttctcggtgtcgggcatcgtgcgctggcgcgagaccgacgacctgttcaccgaaggcatgaagatgatggcgatgatcggcttcatcatgatcgccgccgccggtttcgccgaagtgatgaaggccaccggcgaggtgaagagcctggtggagtcctcggccagctggatcggccacagcaagggcgtgggtgccttgctgatgctgctggtggggttgctggtgaccatgggcatcggctcgtcgttctccaccgtgccgatcctggcgaccatcttcgtgccgctgtgcgtgcagttgggcttcagcccgctggccatcgtctgcatcgtcggcaccgccggcgcattgggcgacgccggctcgccggcctcggactcgaccctgggcccgacctccggcctgaacatcgacggccagcaccaccacatctgggacaccgtggtcccgaccttcctgcactacaacctgccattgctggcgttcggctgggtggccgccatggtgctctgagcccgccgggttccagtcgcaccgcggtgttcctatcgcgagcaagcttcgctcctacagaagcgtgaagcttgctcgcgaaagatctccaggacgctgcgtatccgcagattccgctcttcatcctgcggggctcaacttttgtggcggcgtgccgttaaggctgtatcacgccaacaacatcaagagtgaacctcctatgcgcttaagtctgaagggcaaagtcctgtccctcgcggtcctcccggtcctgttgtttgcgctggtgatcagcctgaccacggtcgtcatgctcaaggagcaggcgcagaacgaggtggacgagacccggcagcgcctgctcggcgaggccaagaccacgctgcaaagctatgtggaggtggccctgagcaccgtcaagccgctctacgacgcggcggcgcccggcgatgccgcggcccgtgcacaggtggtgaagttgctgtcgaacatcacctacggcaaggacggttacttcttcggctacgactccgagacggtgcgcctgttcaagggcaacagcccggacggcgtcggcaagagcttcaaggacaaccgcgatcccaacggcgtgtacgtcaaccgcgaactggtcaaggtcggcaaggatggcacgcattatgtgcagtacagctcgacccagccgggcagcgacgtgctggtaccgaagctgggctacaccgaatacctgcccaagtgggacctgattgtcggctcctcggtgaacctggacggcatcgacgcccaggtggccgaggtcgaggccagcgtcaaccagcgcatgcggggcatggtcctgagcatcatcggcatcgccgtggtggtgctgctggtgatcgccgccatcggcctgctggtggccaacaccatcctgcggccgctgaatctgatgaagctcaacctcgacgatatcgccgccggcgaaggtgacctgacccgccgcctggccatcaccagccaggacgagctgggcgacctggccagttctttcaaccgtttcgtcgacaagatccacggcctggtgcggcagatcaccgagatgaccggccaactgaccggcctggtgacccaggtgtccgaacaggcccagcgttccgagcaggccatggagcgccagcgtcacgagaccgatcaggtggccacggcgatcaaccaaatgtcgtcggcggcccaggaagtggcgcgcagtgcccagggcgcggccgtggcggcgcagcagaccgacgaggaaggccaggcggccaagcgcgtggtggatggcagcatccagcagattcacgcgctggtcagcgatatccgcagcagcggcacctccctggacagcctgcagaaggacgtggcgtcgattgtcagcgtgctcgacgtgatccgttccattgccgaacagaccaacctgctggccctcaacgccgccatcgaagcggcgcgggccggtgaggccgggcgtggcttcgcggtggtggccgatgaggtcagggccctggccagccgcacccagcagagcacccaggaaatccagggcatgatcgaccgcctgcaacagggcacgcgcaccgccgtggaggccatgcgccgctccagcgatgccggcgacggcacctcgcaccaggccaacgaggccggggcgtcgctggatgccatggcgcaactgatcggcaccatcaactcgatgaacgcgcagatcgccagcgccgcggaagaacagaccgcggtggccgaggagatcaaccgcagcgtgcaccagatcgcggtggcggtggacagcgtcgccgacgaaacccagctcggcgcccagacctcacgcagcctggccgacctcggccagcgcctggggcgattggtggggcaattccgcatctgaggcgcgcggtgccggtggccggtgtctgatggctggtgtagccgctgccgagcttgcgaggctgcgaaaaggcccgaagggtcttgcttggcggcccaccagttacatcagggtgttacctacacggcatcaggcgctgatatcgcgcattagcaggccaaagcgcaggtccacctgatcggggatcggcaggtacaccgtatgcccgtcccctggcgcgacctcgatcggctcgccgcgcacgttctgcaactggtgcaggtcgaagtggaagttgcccttgggcgtcatcagctccatatggtcgcccagggcaaagcggttcttcaccttcacttccgccaggcggtcgcggcgttcgccggtgagttcgccgacgaactgctggcgttccgacaccgagctgccgttctggtagttctggtactcgtcgtgcacatggcggcgcaggaagccttcggtgtagccacgctgggccagggactccaggtcgttcatcaggctgcggtcgaactcgcggccggccaccgcgtcgtcgatagcccggcgatagacctgggtggtgcgggcgcaatagaagtgcgacttggtgcggccctcgatcttcaatgagtgcacgcccatgcgcgtcaggcgctcgacatgctgcaccgcgcgcagatccttggcgttcatgatgtaggtgccgtgctcgtcctcgaaggctggcatcgcttcgtccgggcgattggcctcgcgcagcaggaacacctggtcggtcggcgcgcccaggcccagggtcggttcgggctggaacggctggacgatctcgccgacgatattctgcgtagcctcctgggcctggtatttccagcggcaggcattggtgcaggtgccctggttggcatcgcgcttgttcatgtaccccgacaacaggcagcgcccggaataggccatgcacagcgcgccgtggacgaatacctcgagctccatggccggcacttgctggcggatttcctcgatctcttccagggacagctcgcgggacaggatgatccggctcaggccctgttgctgccagaactcgacgctggcccagttcaccgtattggcctgcaccgacaggtggatcggcatctgcgggaagtgccggcgcaccagcatgatcagccccgggtcggacatgatcagcgcgtccggggccatggcgatcaccggctccaggtccttgaggaaggtcttgagcttggcgttgtgcggggcgatgttgaccactacgtagaagcgcttgccctgggcctgggcctcgcgaatgccgagggccaggttggcgtggtcgaattcgttgttgcgcacccgcaggctgtagcgcggctggccggcgtacaccgcgtcggcgccataggcgaaggcgtagcgcatgtttttcagggtgccggcgggggcgagcagttcgggacgggtcaggggcgtcatggcgattgtcgatggcaaaaggtcgcgagggtaaggccagggccagccggctgcattgatctgagtctatgctcgacgaataaaacagggcacttggccgaacgctggcggactaacgctttaggagcgctttgcggcgtcctggaccttattgacggggagcggacatgaaccagcacctcatgcaacacaaaagcctgttgcttctgctgaccctggtgaccgtcgccttcatctggcttctgctgcccttttacggcccggtgttctgggcggtgattctcggcatcctgttcaacccgctgcaacggcgcctgcaactcaagttcggttggccacgcaccctgaccgccctgtgcaccctgagcatctgcctggtgatcgccattctgccggtgattgtcatcggcaccttgctggtgcaggagggcgccaacctctaccagaacattgaaagcggcaagctggacattaccggtcatctggatcagctcaagcacagcctgccgccgtacttccagcaactgctggaccgtttcggcctgggtgagctggagagcgtgcgcgagaagatcgtcaagggtgcgctgcaaggcagccagttcttcgccacccaggcattcagcgtcggccagggcactttcaagttcgtggtgagctttttcgtgatgctgtacctgttgttcttctttctgcgcgatggccccgaactggtacgcaaagtgcgcatcgcggtgccgttggccgagcaccagaaacgccggctgcagctcaagttcaatcgggtggtgcgggccacggtgaagggcaacgtgctggtggcgatcagccaggggctgctgggcgggttgattttctggtttctggagattcccagcccgctgctgtgggcggtgctgatggccctgttgtcgttgttgccggcggtgggcgcggcgatcgtctggggcccggtggccctgtacttcctgttcagcggggcgatctggcaaggggtggtgctgggcttgtacggggtgttcgtgattggtctggtggacaacgtgctgcgcccgatcctggtgggcaaggacaccaggatgccggattacctgattctgatttcgaccctgggaggcctggcgatctttggcttgaacggctttgtcatcgggccattgatcgccgcgctgttcatctccagctggggcctgttcgtcgatacccggccgcggccacaactgccgttgccttaggcatgcaggacgcgctgctcgatcttttgcgacagggcctgggcggcggtcagagaagtgagcgggccactgaccggctcaccgtcgcgcaccaggtaccaacacgccagcaaccccacttccctgagcgaggtgggaacggcgctaccgataacggacatgatctgaaccttgggcataagtacctccatcaatctgtggagttaccttacggaccggcaagtgctacgaaaaatcaccgcgctcgatagtggacatcgataccggcgaaaaaagcgccagcccgatcagtcgacgacctgatcgagcatgtagaccacttccgggtcgtgcagcaggcccttgcgcaccaggtgttcggccagcaaggccaggaacttggcgctgcggtgaccttccaggtgcttgagttcggtcagggcgctgtacaccttgctcgcggtacccagggtaggggagtgatgagggttctgtgttggcatgggagtcgtccttgttgttatggggctgttttgtggacagatccgatcttgcggacctggcatgacataaatatgacagtcgtgggctcgcctacacgggctgccgctgggcaacaaacactattgctggattgaatcgcaaaaactgttccagcagcgacctttgcaagatttattcagacgtttggcaaaacgcaacaggccccgctggcgaaggcggggcctgtaggtgtgtggtcgcctggcttaccagcggccagggccatagtagtaatggcggggcgggccgtagtagccacgaggtgggccgtagtacaccggggccgggcggtaatagaccggcgggccttccacgtacaccggctgtggctggtagtagaccggtggcggcgcggcatagaccggctgcggctggacgtagactggctgttgcacgtagaccgggcggctgtggctggcgatcaccgaacccactaccgcggcgccgaccaccgcaccgactaccgccgggccaccccaaccaccgccaccgtgggcggacgcttgaccggcgacagcaagtgcaccaatgagcaaggctatcttggggattttacgcatcatggctattcctcggttccgaccccggcgctcggtctgccatagacgcgaggactgtcgcggggatacttctaagaccgcttttttctgaaaaactgcacagccgccgggtaaattttgtgtaaggtctgtaccggtttattgaccctcgtccgtgggcggcaggcccgtctttcaggcacgtcgatatgatcgggcagaacccgatgactggctaatcccgtctatccgaaagtgcgttccaaggagatcaacatgcagatgaaccccaacaaagacacccagttgtgtatgtcgctgtcagggcgtccggggaatttcggcttgcgctttcacaatcacttgtatgaacagctgggcttgaacttctactacaaggccttcagcagccaggacctgccaggcgccgtcgccgggatccgcgccctgggcattcgcggctgtggcgtgtccatgccgttcaaggaggcctgcattgccctggtggacgaactggacgcctcggccagcgcgatccagtcgatcaacaccatcgtcaacaccaacggccacctcaaggcctacaacaccgactacatcgccgttgcccaattgctcgaacgtcaccggattcccaaggacacccgctttgccctgcgcggcagcggcggcatggccaaggcggtggccagtgccttgcgcgatggtggctaccgcgatggcgtgatagttgcccgcaatgcccaggccgggcaggcccttgccgactccctgggttatgcctggcagtcggagctgggcgaattgcgcccgcagatgctgatcaatgtcaccccgatcggcatgagcggcggccccgaggccgaccagctggcgttcccggtcgaggcgatccaggccgcgcgcacggtgttcgacgtggtggcggtgccggcggaaaccccgctgatcctgcgcgcccgggccgaaggcaagcaagtgatcaccggcctggaagtgatcgccatccaggcgctggagcagttcgtgctgtacaccggcgtgcgccccagcgccgagcagttccagcaggcggtggccttcgcccgggcctgatcggtgggtggaacggggcaggtcggaggggcgtaaggccctgcctatactggtcgccagcaagccaagacttgcccctgttccacgtcaccgtgatcgaggaccgttatgccacctgccattctcaatctggatcaggcggaccttcagccgctgcctgaagccctgagccccaccggcgacactgccggccgttatgtccagcgcatcgcccgcatcggccagcaactgggcgcccggaagctcggctaccggctgattgccctgggcccggggatgcgtgccagccccttccataaccatcgcgtcaatgaagagatgttctacatagtcgccggcgagggcgagatccgcctcggcgccgagcgttttgccatccgcgccggcgatgtgatcgcctgcccgccgggcgatatggacagcgcgcaccagatcatcaacaccagccagggcgagttgcgctacctggtggtcagcacccaggaagcgccggacatctgcgaatacccggactccggcaaatatgtggtgatgaaggacttcaagatcgacgatgagggcaacgcctcgggattcgtcgcggtggcacggcatgcggacggggtggattactgggacggggagtagcgggaagtgttctgaggctttaccccgactgcgtcggcgatcgcagcctgcggcagcggctacaaggcgctgccgcaggggcggggatcagccttcgagtttcgccaggcgttcttcgagggcggcgatgcgcgcttccagctcctcgatgcgctccgccgatacgccgctgcccgcgctgcgctccaccgggttctgccgggcggcgaggatcgcctcgatatccgccgggtcgcccagggcatgcatgtagcgatcttcgcgctggccggcctggcgcgggatcagcaacgccaggccacgagcgatcaggcgttccagttggtgcaccacctgttcactgtcttcgaaatcgtgcatgcgcccgctgcgggtcagcagttcgttgacggtctgcgggccgcgcaaaaacagcaggccggccagtgccacctgcgccggcaccagttccagcgccttgtccaggcgatgctcccagcgatcggcgcggctgcccatcaccaggcgggcgaagccgcggttttccagggcgcgcaggctctggccgacctggccctgggtgaggttcatcaccggttcgcggctggttttctggttgcaggcgatgaccagggcattgagggtcagcggataggtttccgggctggttgcctgcttctcgatcagcgacccgagaatgcgcagttcggtgctggtcagttgcaattgctcgctggagatttcttgctcgatgctcatcgcgctttccctatgctgtcgaaggcgactagcctaatccttgctggataaaagacaagccgccggcgaggctcaagcaggtctataatcgcgccacgttcgatttccgcgattctttccctccacccttgtcgagactgtcatgaccatttccctgtacgccgcctccgttcctgtcttcaagcaaatgctcaacgccctgagcgatgtcctgaataaggccgaagcccacgccacgacgaagaacatcgacccgaatgccttcctgcaggcgcgcctgtatccggacatgttcccgctgatccgccaggtgcagattgccgtcgatttcgccaagggcgtttcggcccgcctggccgaagtcgaagtgccgaagtacgacgacaccgaaaccacctttgccgagctgcaggcgctgctggccaaggtcctggcctttatcgacggcatccagccggcgcagatcgatggcaaggaaggcatcgagatcgtcacccgtccgggcaccccgaaagagaagcgcttcagcggccagtcgtacctgctgacctacggcctgccgcagttctttttccacgtcaccaccacctacgcgatcctgcgccataacggcgtggaaatcggcaagcgcgactacatgggcgctttctgatgtagttgagggacaagtccataaaaagcccggcaaggtgcgagccttgccgggcttttttagtgcgcgctattcgtgcaggatcaggcggtctggcggactttctcttcctgggccatgcacgcggcggcggtgaagagcacatcggtggaagagttcaacgcggtttccgccgagtcctgcagcacgccgatgatgaagccgacggcaaccacctgcatggcgatttcgctcgggatgccgaacaggctgcaggccagtggaatcaacagcagcgaaccgccagcgacgccggaggcaccgcaggcacagatggcggcgactacgctgagcagcacggcggtgggcaggtcgacggcaatgcccagggtatgcacggcggccagggtcaagacggtgatggtgatggcggcgccggccatgttgatggtggcccccagcgggatcgacaccgaataggtgtcttcatgcaggcccaggcgcttgctcagttccaggttgaccggaatgttggccgccgagctgcgggtgaagaacgcggtgatgccgctttcgcgcaggcacatgagcaccagcgggaacggattgcgacggatcttccagaatacgatcagcgggttcatcaccagcgcgacgaacagcatgcagccgatcagcaccgccagcagatgcatataaccgagcagggcgccgaagcccgaggtagccagggtcgaggccaccaggccgaagatgcccagtggggcgaagcggatcactacccggacgatcagggtcacgccgtcggacaggtcgtccagcatggtgcgggtggtgttgccggcgtggcggatggccacgcccatgccgatggcccaggccaggatgccgatgaagttggcgttcatcagcgcgctgaccgggttgtccaccacgctcagcagcaggctttgcaggacttcgctgatgccgccgggggcggagatggcgacatcatgggtgctcagcaccagggaggaggggaacaggctgctggcgatcaccgccaccaccgccgcggcgaaagtgcccagcaggtagagccagaggatcgggcggatatgggtttcctggccgtgcttgtggttggcgatggaggccatgaccagcacgaataccaggatcggcgcgacggctttcagtgccgagacaaagaccttaccgataaaggcggtggatttcgccagttcgggggccagcagcgccagggcgataccggcgatcaggccaatgacgatctgcgtgaccaggctggtgcgtttgagtttttccaggagcgacgggggcgaagcagtcatagcggtatctctgatttttttaatatgccgtgcgtcgacgtgggacgccgtgctgatgagttgctgaaagtacggggtgttgcggcagggggcggactttatcacacggggttcgcccacggatgtgacgatctgccacctgagctttccagagtagcctgcggttttttcgccgctaccccagacatgcgcggacacattctgttaggattcgccatcctcttctcatctccagtcagcgggccaccaggccatcgctgatgtcgtcgtttccggagtttccatgctgttgcccattctgctgttgtcagccgccggttttaccgtgctgacgacggagttcatcattgtcggcctgctgccttcgattgcccgggaccttgcggtcagcgtgccccaggccggcctgctggtgactttgttcgccttcaccgtggcggcgttcgggccgttcctgacggcctatttcgcccgtttccagcgcaagcgcctgttcatttcggtgctggtgatgttcggcctggccaataccctggcggcgctggcaccgaatatctgggtgatggcggtggcgcggctgatcccggcgctgggcttgccggtgttctgggctttggccagcgaaaccgcggtggacatcgtcggccccgactacgccgggcgggccatcgccaagatcggcttcggcattgtctgcgccacggtgttcggcattccggtgggtacgctgatttccgatgccttcggctggcgcgccgcgttcggcatcctggcgctggtggcctttgccaaggcgttgctgctgtatgtctacctgccgcagacccgcgtgcacaacgagcaggccagcctgcgctcgcagttcggcatcctgcgcagccccttgatgcagggacatgtgctgctgtcgatcctggtgttcagcggcatgttcaccgcctacacctacctggcggatatcctcgagcgcctggccggtttcaacggcacgctggtgggttggtgcctgatgggtttcggcgcggtgggactgatcggcaactcgctgggcggccgcgcggtggatcgccatccgttgctggcttccatgggcttctgcgccttgatgatcggcggcatggtggcgctggtgccgagcatccactcgccgctgggcctggccgcggccatgggcatctggggtgtgacccaggcggcgctgttcctggtcagccatgtccgcctgatcaaggccgcgcctcaggcgccggcgtttgccgcttcgctgaacatcgccggagccaacctgggcatcggcctgggcgccatggtcggcggccgggtgatcgacaccctggggctgggcagcctggggttcgccgccgccggttttatcctggtgtcgatcctgctggccctgctgttgatgaccctcaagccccaggccagctgcgcctgactctcctcaagcgcccatggcggtgaacagctcgcggcgggcgccttcggtgatcgccacgatgccggggtgcttgaccttgcgttcgaccgaaatggcgtagaacgactcgctgaccgcatcggtctggccgatcagttgcacgccgtattggcgccgcacttcgtcggcgatcacgctggggctgataaagattccgctgcctgattggccgaatgcctgcatcaaggcactgtcgtcgaactcgccgatgatcctgggttgtatctgctgctcggccagccagcgcagcagccggctgcgcaccacggtttcctgcccgggaatcagcagcggagcgccatgcaggctatggggaaagttcgttccatagcgctcggccagttcttcggtggcgaaaaaactgataccgcattcgccgagtttctggctgtagcccttgatgtccaggtgcgaaggcatggggctgtcggaaatcaccaggtccaggcgctggatggccaggtcggccagcaggcgttcgagtttgtcctcgcggcaggtgatgcggatcggttcgttcagctccatggtcggggcgatcaggcggtagacgatcgatttgggcaccacatcggccacgccgacccgaaacaggatctgctgttcgttgggctgggcctggagcatggcttccagttcgccgccgagctggaacatctgctcggcgtagggcagggtctggcgcccggcttcggtcaactccaattgccggccgacccggcgaaacaactcgatgccgtaggtttgttcgagcagggtgatctggccgctgatggtttgcggggtcaggttcagttgctcgcaagcccggacgatgctgccggtcttggcgacgacccagaagtagtgcagttggcgatagttgagcatggccggttttaattcgtaaaaatcgaagtatagctgttaaaaatacgaattttcctgaagtgttcgcctccatagaatgcctcgctattgacgggccatcatctcggcccggtccgttctaacgaggaaagcgcaatgacctataaatccatcgccgcatcgttgctggcgttgtcgttgatcacccttgccggttgcgagcaggcggaaaaaagcgcgcagcagctgttgggcaaggccgcggaaaacgccaagcaggcgatcgacgacacgcacaaggccgccgaacaggcgatcagcgacgcgacccaaggcttgatcagcaagcaggaaaaaccggctgacgaggccaaagaagccacctcgtcgtcccaggaaatctgattcccccataccccgactcaggactgagccatggaataccttttacaactcgccgccagccccaccgcctgggtcgccctggcaaccctggtggtcatggaaatcgtgctcggcatcgataacctgatctttatttcgatcctgaccaacaagctgcccgagcagcaccgggccaaggcccggcggatcggtatcggcatggccctgatcctgcgtctggcactgctcagcaccatcgctttcatcgtgcaactgaccgaaccggtgatcgatgtcttcggccaggtcttctcctggaaggacatgatcctgattgccggcggcctgttcctgctgtggaaggccaccacggagatccatcacagcatggatccggaaccgcaggacagcaaaagcgagaccgcgggcgtgtccttgggttttgccgcggcgatcggccagatcctgatgctggacatggtgttctccatcgacagcatcattaccgcggtcggcatgaccgaacacttgccgatcatgatcattgcggtggtggtgtcggtactggtgatgttgttggcggccgagcctctggccaagttcatcaatgacaacccgacggtggtcatgctggccctgggcttcctgatcatgatcggcatgaccctgatcgccgaaggtttcggtgcccatgtgccaaaaggttatgtgtacgcggccatggccttctcggcggccatcgaggggctgaacatgctggctcgtcgtgcccgacagaagcgggtggcggcggaggcggaagtcgaagcctgattcgcggcaacaaccgacggcggcctgtgttcaaggacacaggccgccgttttttattgggcagaagaaagtgccagtcagtgcgcggtggcgtgatgccgggccggttttgcggttttcgcggcgggagtcggcaaacgcggatgatggtgtcggcgaacgatccgcaagacaccccagagcatggcagcggcaacggccagccagccgccgatcagcatcaggattgtcgttgtcaggctcatgcatgcctccttgttgccctgtccagggcacacactcttcgcaatggacagtctagtcgcggatgtgtttcaagccattgaccaatagtcgagtgtcatcgaccgctttgctctatgggacgcaaattaccgcggcttaacgctatacccctgtgtcgcggcgccctatgatcagcgtttcggccggggctcctggcttggcgtctgcacaagagagtcatgatggaacggatgtttctgcgatttcgaacactgttgttggcgggcgcttgcgccctgacgctggccggttgcgccagtagcgtgcagccggagattcagcgcctgcccgagcgggtggagctcaacggcgtgccgtttttccgcggcgaaacctatcagagcggcccgggcaccctggccagcatgctgtcccagcaaggcatcgcgatcaccccgggtctgctggacaagccgctgcacctgcctggcgccgaggcgaagttgcagcagaacatgctgaccctggcgcgtgagtacgggatggtggtctatccgctggacgacaatttatcggcgctgctgacccaggttgccgcgggatacccggtgatggtgcgttacaccgaaggttcggcgttctgggccgagcctcgttatgctgtgctggcgggctataaccgacacaagcagacagtattgctgcgcgcgggaatgaatcgtcgtctgttgatggactttgccaagttcgagtcggcctggagcaatgcgggacactgggcggtgttgattcaggggccgacccaggtgccagcccaggtcgatcgccagcgttggttgaaggcagccgatgagttggcccaggccgggcaggagaacgcggcggcacgggcgaccaaggcgttgagcgccaactgaggttgcagaaacgctgacggcgcccaggggcgccgtctttgaaagggccgcgatcgacagatccgcggccttttttgtgtctgccagcttctattcggccgtctgggcgacgccgctctgacggcttttcaggtttttgccggccttgtagctcaaggcagcattcggtaccgagccgcttttacctgtttccagccactggcggatacggctggcatcggcgaagtgcgtgtatttgccaaaggcgtcgagaatcaccagggcgaccgggcgattgctcatgctggtcaccagtaccaggcagtggcctgcttcatcggtaaagccggtcttggtcaacttgatgtcccagttggccctgttgaccaggtgatcggtgttgcgaaagcccagggtgtagttgggtttgcggaacgccacggtcttttccttggtggtgctcagctcgctcagcagcgggtatttgcgcgccgccagcaacagtttgctcaggtcgcgggcggtggacacgttatggaccgacaggccggtcggctcgacatagtgcgtgctggtcatgcccagtgccttggccttggcgttcatggcggcaataaaggctgcgtacccgcccgggtagtggtgggcgaggctggcggcggcacggttttccgacgacatcagggcgatcagcagcatctccttgcgcggcagctcgctcttgagcttgacccgggaaaacacgcctttcatttccggggtgttgctgatgtccacggaaatgtactcatccagtggttgtttggcgtcgagtacgatcagaccggtcatcagcttggttactgacgcgatgggcacgaccacgtcgggattgctggaatagatgaccttgttggtctgcaggtccagcagcatggcgctgccggaggcaatgtgcagttgggaagggtcgcgcggcgcttcggtggtttcgcgagcgacggcgctctgcgtgataaaggtgcctgtaaatgcaaaaaataggctcaggatagaaagacggattttcacgcgggcggactcatgaagtggatatgccgttctgcaacgggctgctttcagaaaaacgttacattttatgagtatgtgccaggaaagagctacacgcccgtaggtaaagggcttcaggtaaattaaatttcatcctgtatcagttttgtatcagtttggttccctcctttctggtgagttgatcgtcactgcaagcgggggctactcgtttcaggttttcggcgagcagaaacaaagaaccccgccagtggcggggttcttttatccgggctatttccctgcgtcagtcgtgcagcgtttctgccgcatacaacgtgttttccagcaggcaggcgcgagtcatcgggccaacaccgcccggtaccggggtgatccagccggcgcggggcagggcggtctcgtagaccacgtcgcccaccagcttgccgtcttcctggcggttgatgcccacgtcgatgacgatggcgccttccttgatccactcacccttgaccaggcccggcttgccggcggccacgaccaccaggtcggcacgtccgacgtggccggccaggtccttggtgaagcggtgggtaacggtaacggtgcagccggcgagcagcagctccatcgccatcgggcgcccgacgatgttggaagcaccgaccactaccgcatccatgccgtacagatcggcaccggtgctttccagcagggtcatgatgcctttcggcgtgcatgggcgtagcagagggatacgttgggccaggcgaccgacgttataaggatggaaaccatccacgtctttatccgggcggatgcgctccagcagcttggaggcatcgaggtgttcgggcagtggcagttgcagcaggacgccatcgatgttcgggtcatcgttgaggcggtcgatcaggccggccagtgcttcttgagtggtgtcagaaggtaagtcataggcttgtgaaagaaagccgacctcttcgcagtctttacgcttgtgcgagacataaacctgagaggccgggtcgctgccgaccaggatcaccgcgagacctggagtacgcaggccttgctggcgacgctcggcgacacgtttggcgatctgctggcgcaggctagcggcgatcgctttgccgtcgattagttgtgcagtcatgacgcgtgattaaccatcgagagggagagaaaaagagaacgcattctcgcatgccaggacgtgagggcaaaggcgcttggtctgcaaattcccctaactcctttaattaaatgaatttttttcaaaaaagagttgacgacctaacggctcgtctataacattcgtcgcacttgtcgggcacagcctagcactggttaagaaggtcgggcagagttgatgtttaactcgtaacgactgaaagcacttagtttgtaatcattaaagaatacagattaataaggcgcccgtagctcagctggatagagcatccgccttctaagcggatggtcgcaggttcgagtcctgccgggtgcgccattgggcagctttggcacaagtaacgcaacaacgcaatatggtgggcgtagctcagttggtagagcacaggattgtgactcctgttgtcgtgggttcgatccccatcgtccaccccatattccgaaaggcgccagattaatagtctggcgcctttgctttaaaagcttgatacgcggacgtggtggaattggtagacacactggatttaggttccagcgccgcaaggtgtaagagttcgagtctcttcgtccgcaccaattaagtagctatttatatagcagaaaacggcgcagcacctgaaaagggctgcgccgttttcgtttcagaagtctgtatttccagcgggttgcaggtagtgggccggggaggcgacgaaatactcgtccttttgtcgctggaatgctgaaggtttaccggtcgggctgtggtttgctccgatcatcaggggtgtgacgcgccattccttctatatatagaagcatgggtgcagaggccctggtttgattcgctgtatttgctctcagggcgcggctcaaccgttggtccccgcctttaaatcgccagctgtttttttacccgttttcagtagggtgacttcttgagtttgacccactagaatgcatgcccttgattctggggtcggaaacggccggctaacgtctgtgcaacgaggaatatccatgcaagtttctgttgaaaatacttctgctcttgagcgccgcatgagcatcaccgtgccggctgagcgcatcgagacacaggtcaacaagcgtctgcagcagactgcccaaaaggccaagattccaggcttccgtcctggcaaagtcccaatgagcgtgatccgtcagcgttatgaagctgatgcgcgtcaagaagctgtgggcgatgtgatccaggcttccttctacgaagctgttgtcgagcagaagctgaacccggctggcgctccttcggttgagccaaaggttctggagaagggcaaggatctggaatacgttgcaacgttcgaagtgttccctgagttcaccgttgccggtttcgagtccatcgccgttgagcgcctgagcgctgacgtggctgatgccgatctggacaacatgctggaaatcctgcgcaagcagaacattcgcttcgaagtggccgaccgcgccgctcagaacgaagaccaactgaacatcgatttcgtcggcaaggtcgacggtgaagtgttcgctggcggttccgccaagggcactcagctggtgctgggtaccggtcgcatgatcccaggcttcgaagaaggcctggtcggcgccaaagcgggtgaagagcgtgttctgaacctgactttcccagagaactaccagaacctggacctggctaacaaagccgccgagttcactgtcaccgtcaacaccgtttccgagcctaagctgccagaactgaccgaagagttcttcgctcaatttggtatcaaagaagccggtctggaaggtttccgcgccgaagttcgcaagaacatggagcgcgaactgcgtcaggccatcaagtccaaggtcaagaaccaggtaatggacggcctgctggctgccaacccgatcgaagtgcctaaggctctgctggacaatgaagtgaaccgtctgcgcgttcaggccgttcaacagttcggtggcaacatcaagcctgatcaactgccggccgagctgttcgaagaacaggccaagcgtcgcgttgtactgggcctgatcgtggccgaagtggtcaagcagttcgacctcaagcctgacgaagcccgcgtgcgtgagctgattcaggaaatggcttctgcttaccaagagccagagcaggtcgtgtcctggtactacaagaacgagcagcaactgaacgaagtccgttcggttgtgctggaagaacaagttgtggatactgttctgcagaaagctagcgtgaccgacaaatcggtctcttacgaagaagcggtcaagccggtagaagcaccacaagccgactgattttttactcgttcgaaaatacacaccataagccagccttcgcgctggcttatgcgtattcaagacatgactatttgggagtgactgcaggacatgtcccgcaattcttattatcagcagagctctgacatccaggccgcaggcggcctggtcccgatggttatcgagcagtccgcccgtggcgaacgcgcctatgacatctactcgcgcctcctcaaggagcgggtgatcttcctgattggcccggtagaagactacatggccaacctggtcgcggcacaattgctcttccttgaagcggaaaacccggacaaggacatccatctctacatcaactcgccaggcggttcggtgactgcaggcatgtcgatctacgacaccatgcaattcatcaagccggacgtttccaccatctgcatcggccaggcctgcagcatgggggccttcctgctcgccggtggcgcagcgggcaagcgtcattgcctgcctaactcgcggatgatgattcaccagccattgggcggtttccagggccaggcgtcggatatcgacatccatgccaaggaaatcctgcacatccgttcgcgtctgaactcgctgctggctcatcacaccggtcagagcctcgagaccatcgagcgcgacaccgagcgcgacaacttcatgagcgcagagcgtgcggctgaatacggcctgattgactctgtgatcaccaagcgtcaaatgcctgcctaagcaactcaaatgtaggtggttggtttaaccggccacctgtgggcttgaaaaagcccgcaattgccttcatcttgtgttgcaagcctatcggatttggatcgatcgaatgactgacacccgcaacggcgaggacaacggcaaactgctttattgctccttctgtggcaaaagccagcatgaagtacgcaaattgattgccggcccctcggtctttatctgcgacgagtgcgtcgacctgtgcaatgacatcatccgtgaggaggtgcaggaagcacaggccgaaagcagcgcgcataaattgccttcgcctaaagaaatcagcggcatccttgatcagtatgtgattggtcaggaacgtgcgaaaaaggttctggcagtagcggtatacaaccactacaagcgcctcaaccagcgtgacaagaagaatgacgaggtcgaactgggcaagagcaacatcttgctgatcggccctacaggttcgggcaagactctgctggcagagaccctggcgcgcctgttgaatgtaccgttcaccattgccgacgccaccaccctgaccgaagccggttatgtgggtgaggacgtcgagaacatcattcagaaactgctgcagaagtgcgattacgatgtagagaaagctcaaatgggcatcgtctatatcgatgaaatcgacaagatttcccgcaagtctgacaacccttcgattacccgtgacgtttcgggtgaaggcgttcagcaggccctgttgaaactgatcgaaggtactgtggcttccgttccacctcaaggtggtcgcaagcatccgcagcaagagttcctgcaggtcgatacgcgcaacatcctgttcatttgcggtggtgcgttctcggggctggaaaaggttattcagaaccgttcgactcgcggcggcatcggcttcaatgccgaagtacgcagcaaggaagagggcaagaaggtcggcgaatccctgcgtgaagtcgaaccggacgatctggtcaagttcggcctgattccggagttcgtgggtcgtctgccggttctggcaacgctggacgagttggatgaagcagcgctgatccagatcctcaccgagccgaagaacgccttgaccaagcagtatgccaagctgttcgagatggaaggcgtcgatctggagttccgtaccgatgccctcaagtcggtcgccaagcgtgcgcttgagcgcaagaccggtgctcgcggattgcgttcgattctcgaaggcgtgttgctcgacactatgtatgagatcccctcgcagtccgaggtgagtaaagtagtgatcgacgaaagcgttatagaaggtaagtccaagccactgtatatctatgaaaacagtgagccgactgccaaggcagccccggacgcctaagcgccggactgctggtttgacagaaggggccttcgggcccctttgcttttactgcctttaaagtactgtctttgagcttgttttttttcgaggcagcccccatcttggtttcaagcttacttccatctgtttacggccttatggccgccgtagaggcgaaatcatgaagacaaccatcgaattgcctctcctgccattgcgtgatgtcgtggtttatccgcacatggttatcccgctgttcgtggggcgcgagaagtctatcgaagccctcgaggctgcgatgacgggcgacaagcagattcttctgttggctcagaaaaatcctgctgatgatgatcccggtgaagatgcactctatcgcgtaggtaccattgccactgttctgcaattgctcaagttgcccgacggcaccgtcaaagtactggtcgagggcgagcagcggggcgctgtggagcgtttcagcgaagtggacggccattgccgtgccgaagtctccctgattgacgaggtggacgctcctgagcgcgagtcggaagtctttgtccgcagtctgctgtcccagttcgagcaatatgtacagctgggtaagaaagtccccgccgaagtgctgtcgtccctcaacagcatcgatgagccgagccgcctggtagacaccatggccgcccacatggcgctgaaaatcgagcagaagcaggaaattctcgaaatcatcgacctgtcggcgcgtgtcgagcacgtgctggcgttgctggatgcggaaatcgatctgttgcaggtcgagaagcgcattcgcggtcgcgtgaagaagcaaatggaacgcagccagcgcgagtactacctgaatgagcagatgaaggccattcagaaagagctgggcgacggtgatgaaggtcacaacgaagtcgaagaactgaaaaagcgcatcgacgccgccggcttgccaaaggatgccctggccaaggcccaggccgagctgaacaagctcaagcagatgtcgccgatgtcggctgaagccacagtggtgcgttcgtacatcgactggctggttcaggtgccgtggaaggcccaaagcaaggttcgtctggacctggcgcgtgccgaagatatcctcgatgccgatcactatggcctggaagaagtcaaagagcggattctcgaatacctcgccgtgcaaaagcgtgtgaagaagattcgtggtccggtactgtgcctggttgggcctccaggggtcggtaaaacctccctggcagagtcgattgctcacgccactaaccgtaaattcgtacgcatggctcttggcggcgtgcgcgatgaagcggaaattcgcggccatcgtcgtacctatattggttcgatgccgggaagattgattcaaaagatgacaaaggtgggcgttcgcaacccgctgttcctgctcgatgaaatcgacaagatgggcagcgacatgcgcggcgatccggcttcggcattgctcgaagtgctcgatcccgagcagaaccacaacttcaacgaccactatctggaagtcgattacgacctctccgacgtgatgttcctttgcacctccaactcgatgaatattccgccagcgttgctggaccggatggaggtgattcgtctgccgggttacaccgaggacgagaagatcaacattgcggtcaaatacctgtcgccgaagcagatccaggccaacggcctgaagaaaggcgagctggaattcgacgaagaagccattcgcgacatcatccgctattacacccgcgaagccggtgtacgtgggctggaacgccagatcgccaaggtttgccgcaaggcggtgaaggagcatgcgctggaaaaacgcttctcggtgaaggtcacttccgacctgctggagcacttcctcggcgtgcgcaaattccgctacggcctggccgagcaacaggatcagatcggtcaggtaacgggcctggcctggacccaggtcggtggtgagctactgaccatcgaagccgccgtggtacctggcaaaggtcagttgatcaagaccggttcgctgggcgacgtgatggtcgaatcgatcaccgcggcactgacggtggtgcgcagccgtgcgaagagcctgggaatccccctggacttccacgagaagcgcgacacccatatccatatgccggaaggggcgactccgaaagacggccctagcgctggcgtaggcatgtgcacggccctggtttctgcactgaccggtattccggtgcgggctgatgtggccatgaccggggaaatcaccctgcgtggtcaggtgttggctatcggtggtttgaaagagaaacttcttgcagcacatcgtggtggaatcaagaccgtcatcattccagaagagaatgtgcgcgatttgaaggaaattcctgacaatatcaagcaggatctgcaaattaagccagttaaatggattgacgaagtcctccaaattgcgctgcaatacgcgccggagcccttgccggatgtggctcccgagatagttgcaaaggatgaaaaacgcgagtctgactctaaggaaagaattagcacgcattagtacgcattagcttggggggcttccttgacagctttttagagcccttgttataaagcggctcttaagtgtctgtaggccattcagcactggtttttgctttcaccaaaaaacttagaatcatactcaaatagatatataaggggacttagagtgaacaagtcggaactgattgatgctatcgctgcatctgctgatatcccgaaagctgctgctggccgtgcgctggatgcagtaatcgaatccgtcactggcgctcttaaggctggcgactccgttgtactggttggtttcggtactttctctgttaccgatcgtcctgctcgcattggtcgtaacccacagaccggtaagacgctggaaatcgctgcagccaaaaaaccaggtttcaaagccggtaaagcactgaaagaagccgttaactaagcgtccttcaagcctttgcctacccgggtcggggtctttcccgacctggcagcggagcggtagggcagccggttagaaatccggtttgtcacatcggggatcgaaggttcgaacccctgtccgctccgccagttacgagaaaggcgcatcctcggatgcgcctttcttctatccggactctacccacgctccacggttgcttaatttgaagtacaaccgtttctgggggacgcatgctgcagaatatcagggacaattcacaaggctggattgccaagaccattatcggggtcatcgtcgcactgatggcgctgaccggtttcgatgccatttttcaagccacttccaccagtcaggacgcggccaaggtcaatggcgaagaaatcacccagaatgagttgagccaagcggttgatatgcaacgccgtcagctcatgcaacaactgggcaaggatttcgacgcttccttgctcgacgagaagctgctgcgtgaagccgctctcaaaggtctgatcgaccgcaagctgctgctgcaaggcgcggaaaactccaagttcgcgttctctgacgccgctctggatcaggtgatcctgcaaacgccggaattcctggtggacggcaagttcagccctgagcgtttcgaccaggtgatccgtcagctgggttatagccggatgcagttccgtcagatgctggctcaggaaatgctgatcggccaggtacgcgctggtctggctggcagcggtttcgtgaccgatgcacaggtgctggcattcgctcgtctggaaaagcagacccgcgattacgcttccctgaccatcaaggccgaccccgcggcagtcaagctgaccgacgatgaggtcaaggcttactacgacgaacacgccaaggaattcatgtcgccggaccaggtggttatcgactatctggagttgaagaaggcatccttcttcgatcaggtcagcgtcaaggacgaagacctgcaggcgctgtatcagaaagaaaccgccaacctgtccgagcagcgtcgtgccgcgcacatcctgatcgaagtgaacgacaaggtgaacgaagcgcaggccaaggccaagatcgaagagatccaggcgcgtctggccaagggcgaaagcttcgaggcgctggccaaggagttctcccaggacccgggttcggcgaacaacggtggtgacctcggttatgccggccctggcgtctatgacccggccttcgaggaagcgctgtacgccttgaacaaggaccaggtatcggcaccggtacgcaccggtttcggtttccacctgatcaagctgctgggcgtcgaggcacctgaagtgccaagtttcgccagcctgaaagacaagctgacccgcgagctgaaaacccagcaggtcgagcaacgttttgtcgaggcgaccaagcagctggaagactcctcgttcgaagcctcggacctggcccagccggctcaagagctgaaactgaccgtgcacacttccgcaccgttcgggcgtgaagggggcgagggcatcgccgccaaccgcgccgtgattcaggctgctttcagtcctgaagtgctggatgagggtgccaacagcaccgctatcgagctggacccggaaactgtagtggtcttgcgcgccaaagagcaccgcaagccagagcagctgccgttggaaagcgtcgccagcagcatccgcgcgcaattggccaaggagcacgccagtgctgctgccaaggccaaggccgatgccttgatcgccagcctgcgtgaaggcaagactgcgctgaaggcgcctgtcgatggccagaactggaaggtttccgaagcggtgacccgcggtcaggaaggtgttgagccgatcgtgctgcagaccctgttccgcatggccaagccagcggccaaggacaagccgaccttcagcagcgtgacgctgccgaacggcagcctggtggtcttgcaactgagtggtgtgaacgaagccgcagctccaaccgatgaagagaaggctcagtaccgtcgcttcctcgcgtcgcgtgtgggtcagcaagacttcgccgcgtaccgcaaacagttggaaaaccaggctgacatcaagcgcttctgatgcccgactgaaataacaaacagggaccccggccaacgcgccggggtttttgttttcagcgtatggcgggaaacccatggcgtcgggcgttcacggccaccagcaggcaagccagcaacaggccgatgatcacccagggaaacgacaatacgcccgggccttccagcagcacgccacccaccagcccgcccccggcgatcgccaggttccaggcggtcacgagcatcgactgcgcggcatcggcagcgttcccggcagctttggccagcgcggtttgcagcaacgtggccaggcctccgaacgacaatccccagagggctatcgaggcatagaccgccatcggcgtatcggcctggaacgccagcaacagcgccgaaagagcgaacaggacgcaactgacgagtaccagttgacgcaaccagcgatcgatcagaaggccgacgatccagatgctcagcagtgcggtcaggccgaacgtcagcagtacccggtcaatttgcccgccgatgccggccggctccagaaacggtgcgatataggtgtacaggatgttgtggcccaggacataagcgaaggtcacgaacagcaccggcttgactccgggcaaggcgaacacgcccgagagcggcaagcgtttgtcggcgcgctggccgggaaagtccggcacctgccagcgcacccagccgagcaacaacagcgtcagcagagtcatcagcgcaaagctcacccgccagcccaccagcgtgccgagcagtgtgcccgcggggatccccagggacagtgccagtggtgcgccaagcatggccacggcgatggcccgcccctgcaggtgcggtgcgaccatgcggcttgcgtagccggccagcagggcccagagcagcccggcaaataccccggcgaacaagcgggcgaccagggtcaggctgtagttggtggagatcgcggtgacactgttgaccagggcaaagccgccgatcgcgatcatcagcaaggggcggcggcgccagccctgggtgaggatcaccaacgggatcgccgccagcagtgagccaatggcgtacagggtgaccagttggccgaccagcgccggggacaccgccaggtcctggctcatctgcggcagcaggcccgcgggcatggcctcggtaagaatggtgatgaagccggcggtcgccagcgccagcaggccacccagtggaagtcggtcgcgacgcctggactcgatgtccagcaggtcggcggtggcaagaggtttggtcatggtgtcaggctcgctacaggtttcaggaagtagggaggctgagggtagggcgctgtggtaaagagaaaaataggctaaggttccgaacttatcggacatctgtgtccgtaatggtgaggtcggcgatggactggttgagcaatatctcggtcttcctgcatgtggcgaaaacccgcagtttcaccgaggcggggcggttgttgggggtatcctcgtcggctgtcggcaagagcatcgcccggctcgaggagcgcctggagacccggctgttccatcgcagtacccgcagcatcaccctgaccgccgaaggcgcgagttttctcgagcgctgccgcagaattgtcgccgaggccgaggcggccgaattcgatctgtgcaagttttccaatgccccgcggggcaagttgcgagtcagcctgccgcaggttcacggcctggtgatgccggtattggtggagttcatgcagcgttatccgcagatcgaactggatatcgagctgacggaccgcatagtggatgtcgtggaggagggcttcgatgccgtgatacggaccggcagccccggcgactcgcggctggtggcccggtcgctgggccagttccgcctggtgctggtgggcacgcctgggtactttcgcgagcggggcgttccgcaggcccccgcggacctggctaaccacgggtgcttgcggcataccttccataacaccggcaaattcgagcattggccgctgcgacgagcggtcgatgccccggagccgctgttgccgacgcgttttgtcagtacctctatcgaagcggtggaccacgccgtgcgcagtgggctggggatcgcctgcctgcccgatttcatggtgcgtgaggcggttgcacggggcgagttgcagcaggtgctcgatgagcatctggaacacagcggcaccttctggctgctctggcctgcgagccggcacaccgccgccaagctgcgggtgttcatcgatcatctgtgcgcgcgactttttccggcaaaccgtggtcagtaaccttgtattaatttttaagacactaatccgcgcgccctgtgccctcgaactgttgcacaatacgccccggaccgttttcctcaggattttcgatgcatagatcatttcacctgcgtgctgccgggttgacgctgctgctggcggccgtcgccggttgttcgtcgcagaagaccgccatttacgagcatgaaaacttcgatgactccggcactttttcgcgcaattacccggtgaatgagacggcgtcctgcgaggccgcccgtcgcgccttgctcagccagggctacatcatcaccagcagcgatccgaagctggtcagtggtcacaagagcttccagcagaccggcgaaacccacatggagatcagcttcagcgtggtgtgtgcccaggatggcaacaccggccaccgttccacggtgttcgccaacgccctgcaagaccgttatgcgctgaagaaggtcaacaactcggcaagcctgggggtgggtgtgctgggctcggtatcgatgccgatcggctcgaccgacgactcgatggtcaaggtcgccagcgagacggtttcctcggcgaagttctacgagcgttatttcgccctggtggagctgttcctgccgcaggaagcgaaaaaggccgcgcacatcatcgagaaacccaagaccgatctgggcgtgcccgaacccaagcccgccgagcctgccgcggcgccagtgacgccccaaccggcgcctgttgcaccggccgccgagccggccccggccattccgtccgtagcgccagccgaatcgaacctctcgcaaccgctggcaccaccggcggaagcggcgcccattgcgccgggcgcacctgccgagccgacgccgcccaccgagatcgttaccccgcctcccgccagcaccttgccggccccgacagagccgattccggcgctgccacagtaagcatctgcggatagctgcgagatcgacccaggtgtcgatcccgcggttgccgagcctctctgaaaatttctttgccagctcgcgggtaaatccgttgccagctgctacgttccatttgagggacgcagattgcgcacggtattttttctgtcataccggcactttatgctgacggctaagtcagtaagaagactactcagcgagcagattacctacaccccacacacaaggagtccgccatggacgattaccaagaagaactgctggaattccaggctttcgaactggacccgctggaacccgcagaagacgccaccgagctgtaacgccggtggcgttttttttcaggcggactgccggtggctgcgacgaaattcacccggtgtctggccgctccagcgcttgaaggcgcgttgaaaggcctcggctgaggcaaaccccaacagataggcaatttccccgaaggccagttcggtatcgcgaatgtaggtcatggctaggtcgcggcgggtgtcgttgagaatggcgcgaaactgcgtgccttcctcggccagtttgcggcgcaaggtccaggttggcagcttcaggcgtgccgccacttcttccaggtcgggttcccggccaccattgagcaaaggccccagcaattgagtgatgcgttcacgcaggctgcgggtgcgggtcagttgctccagttcccgttcacacagttgcagcagatggcgccaggtgctggggcagtgctcgacattgcgctgggccagggtggcctggctcaggcgcagctgattgtgctcggcgccgaactggatcgggcaatcccccaggctgttgtagcggtcgcggtaatcggtctgggcaaactcgatctcgatgcgttcggccttgaccggtaagccgaggctgcccagttgctggagccagccggccaggatcgaatccaccacaaagcggttgtaggcgttataggggctgatggagtagaagcgcagccaggcgccgtcggcgtcttcgtggaagctcgactggccgcgatagttcgagccatacagggcctcgaagcgggtcaggcagcgcgcagcttcacgcacggtcggcgcctgggcggcggtgacgcccgccagcccggcctggctcaggcggctgagctggcccatgcgcagccccagcgccggatcgccggtcagttgaatcgccgcatggcccaggcgcatgtaacggggaatcgacagccgcgcaccggcctcggccaggcgtgcggtatccagcccgtattgttccagcagcggctgcgggtcgaggccatggctgcgcaccgcgtcggccaggctatggacgaagcccaccgacaggtctccgaggcgcatcggctggggcttcatggatttacaaccagatattcagcaaacgcgcgccacgggcatcgccatcggcgaagtgctcgccgttgctgttgatgaagctttgtccggcgctgccctgatcccagaactggccgcgcagaaacacgctgacaccggcgctggccaggctgctgggcgcccggctggtcagggtcaggcggcgccaggcttcgccttcgctgacttcttccggcttgaggctgacctcgctcggggtcgagaggttcttgtagccgcgccacggccggttccaggcgccacggcccatgacgaaggctgggaccgccaccagttgcgcgccctgggcgttgagcttgcggtagttgtccgggtaccagctgtcgctgccgatcagcacgcccaggcggccggccggggtgtcgaccacctggacagcctggtcggcgctggcctggataaaaccgcgttcgtcgaaggtcgggtacagctggcgttgcggctggccgatcggcaggccgtcgctgccgaagaccagggtggtgttgtacagcgcgccgctgccgatgcgcaggttgctgccttcgatcaccggctcgggcaggacaatggagccggccaccagggtgatgccaaattccttggccaggccgccgaacagccgctggtattgatcggccatgctcctggccttcatccgcaggtgcgcgtcgtccaggcgattgtcacccttggcggtgatcagcgcgcgcaggaagggcagcgggttgctcaccgccagccagttcatcgcctctttcaggctggcggcctggtacagctcgtttttctcgccgctgaccatcagccaggtgccgatgtgctccggcagcaccaccacggtcttttcattcagcagcccctggtcccgggcctgctgcaggtaggccgcgagcttgcggtgcaggcgctcggggctctggtagtcggtggggaacagttcgggctggatgcccagcagattgccgtgatcggcgggggtgccctggtccaccgcgagctggatacgcagatcggacaggtaatggccgatcggtcgctcgcgggtccacagtgtgtaactggtcagagcggcaatcagggccagggtgaaggtgaaataaagaagtttgcgcatgggaagacagtcggcagccgtgtgcgggattcgctgactagggtagggcccatgcccgcgattgccaaggccgggctgcgcatttggatcaataagttgtcagttacggtcattgagcgcctcgggggctgctcttagtctgtcgaacatgaccgacggaggccgcagagcttccgcattttttccgtgatcgttcgatgtggagttaccgatggccgccgctcactacccgcatttgctggccccgctggacctgggctttaccaccctgcgcaaccgtaccctgatgggctcgatgcacaccggcctggaagaaaagcccggtggcttcgagcgcatggccgcctacttcgccgagcgcgctcgcggtggtgttggcctgatggtgactggcggcatcggccccaacgacgaaggtggcgtgtactccggcgcggccaagctgaccagcgaagaagaagcgctcaagcaccgcgtcgtcacccgcgcggtccacgaggcgggcggcaagatctgcatgcagatcctccacgccggtcgttatgcctacagcccgaaacaggtggcaccgagcgcgatccaggcaccgatcaacccattcaagcccaaggagctggacgaagagggcatcgagaaacagatccgcgacttcgtcacctgctccagcctggcgcagcaggccgagtacgacggcgtcgagatcatgggttccgagggctacttcattaaccagttcctcgccgcgcacaccaaccaccggaccgaccgctggggcggcagctacgaaaaccgcatgcgcctgccggtggaaatcgtccgccgcgtgcgcgaagcggtaggcccgaacttcatcatcatcttccgcctgtcgatgctcgacctggtggaaggcggcagtacctgggaagaaatcgtgcaactggcccaggccatcgagcaggccggcgcgaccctcatcaacaccgggatcggttggcacgaagcgcggatcccgaccatcgccaccaaggtgccacgtgccgccttcagcaaggtcacggccaagctgcgcggttcggtatcgatcccgctgatcaccaccaaccgcatcaacaccccggaagtggccgaacagatcctcgccgaaggcgatgccgacatggtctccatggcgcggccgttcctcgctgacccggagttcgtcaacaaggcggccgcggggcgtggcgacgaaatcaatacctgcatcggctgcaaccaggcctgcctggaccacaccttcggtggcaagctcaccagctgcctggtcaacccgcgggcctgtcacgagaccgagctcaactatttgccggtgcagcagatcaagaagatcgccgtggtcggcgccggccccgccgggctgtccgccgcgaccgtggcggccgagcgtggtcatcaggtgacgctgttcgattcggccagcgaaatcggcggccagttcaatgtcgccaagcgcgtgccgggcaaggaagagttcttcgaaaccctgcgctacttcaagcgcaaactgcagaccacccacgtcgagctgtgcctgaaccgccgggtcgatgtcgagcaactggtggccggcggctatgacgaaatcatcctggccaccggtatcgccccgcgcacaccggcgatcccgggcgtcgaccacgccaaggtcctgagctacctggacgtgctcttgcagcgcaagccggtgggccagaaggtggcggtgatcggggccggcggcatcggtttcgacgtctccgaattcctcgtgcatcagggcgtggccaccagccaggaccgtgaagcgttctggaaggagtggggcatcgacacgcacctggaggcccgtggcggcgtcgccggcatcaagcccgagcgtcatgcctcggcgcgccaggtgttcctgttgcagcgcaagacctccaaggtcggcgacggcctgggcaagaccaccggctggatccaccgtaccggcctgaagaacaagcaggtgcagatgctcaacagcgtcgaatacctgaagatcgacgacgccggcttgcacatccgcatcggcgagagcggcgaaccgcaggtgttgccggtggacaacattgtgatctgcgccggccaggacccgctgcgcgaactgcacgaaggcctggtggccgccgggcagaacgtgcacctgatcggtggcgccgacgtggccgccgagctggacgccaagcgcgcgatcaaccagggctcgcgcctggccgccgaactctgatccagcggtaatcaaggccactgcgattccggatcgcggtggccttgttgcgtccgctgcgcggccgatcgcagcctgcggcagcggctacgaagtaggggtgtagccgctggcgaagcctgcgatcggggtcgcaggacccactatcggggactccgcggttttgctgatagactccccgcctcactccttccaaacctccccatccatggcgtttcctgcttctttcgactggctgcccaacgcacccttgcaacccctggacctcgactggctgaccgaggctggggtcgaggtggcggtcttgcgcctggaccagatcgacccgctgatctccggcaacaagtggttcaagttcgccccgcatctggcggcggcgagccaagccggcgctgagggcatcatcagcctgggcggcgcgcactccaatcacctgcatgcgctggcggccgccggcaagcgttttggtttcgccaccgtggggctgctgcgcggccatccgcaggacacgcccaccgtgctcgacctgcaaggctttggcatgcagctgcactggctcggttacgccggctaccgggcgcggcatgagccaggtttctggcaaccctggcaggcgcagtaccccaggctgttcccggtggcggagggcggcggtggcttgcttggggcaaccggctgcatgccgctggtgaagcaactgcacagccagctggatgccctgggttgggacgactatcacggctggtggctggccgcaggcaccggtaccaccctggccgggctggtgctgggggaagccggtgcccacccggtgtatggcgccctggcggtgccggacgaccatggcgtcgcgcaacaggtggcggcgattgtgcgggaggcggggctgcaggctgcgggctatgaactgctcgacagcagtcgtggcggtttcgccaaggtcgatccgctgctgctggcgtttatcgaggagagcgaacggcacagcggcatccccctggagccgctgtacaccggcaaggccttgctggccctcaagcaacaggtcgaggccgggcggtttgccgccggcagccgcctggtcttcatgcataccggcggcctgcagggccgccggggtttcgccgctccggcgcagccttagccgcgcttgggcagcatgcgttgcagggtgttgtcgcgcataaagtagtggtgatagagcccggccaccgcatgcaggccgatcagccagtagccgacggtgcccagcagtacgtgccagccctcgacctgcttggcgaactgtttgtcttcagccaccagcagcggcaggtcgatgccgtagaacatcacctgatggccttcggcgctggtgatcagccagccgaggatcggcatggcgatcatgaacaggtacagggcccagtgcatcagcttggccaggaccgtctgccagctcggcggggtcggcaggatcttcggcgccacccccaggctgcgggccagcaggcgcagccagaccagcacgaacacggtcaggccgagcatgaaatgcgcttccttgatcagcgtccggccaccgctgcccttggggaaaatgccgcgcagttcgatgcaggcgtacaccgcgatcaacaacaccagcatcagccaatgcaatgcaatcgacaccgtactgtaacggctgtcggagttcttccagggcatagatccttcctcgttcatcaggtcagttgtctccgttcttaacgacggagtgcggtaactgtaatcctgtttccgaggctctgcccggggcaaatgcgcggtttgagcgggtagcggaaaaaaaacggcagccgcggatcggggctgccgttgggggagacaagtggccgatcagctgctttgcggcatctcgccgttggccaggcgctggttgatgtcggcgatcacctgcggcaggtcgctgatggtatcgatcatgtagtgcgggcgcgaaccttcgaacaacgcgtggatgcgctggcgctcgccggccagggtgtcgctgcccagggcgcgataaccttcgtaggtcagccccagggcgttgccggagcagatcagggccacggtccacatgccggcgcgccgtccttcgagaatgcccggcacggtgtcgtcgatcttcacgcaggcggcgacatcgtcgatccccagggcgatcacgttggccagggcctgggccggccatgggcggccgttcggcacttcatcggtggccaccacatggtcggtgacgtagccatgggttgcggccagttccaccaccttgtccatgacctgcttcgggtagccggagcaggagccgatctttatgccttgccggcgcagggtggcgatggtctccagggcgccgggaatcagcgccgaatgttcggcgatcttttcgatctgcagcggcatgaagcgctggtagatggcggtgacatcctcatcggtcggggtgcggccgaacacctggcgataacgctcggcaacctgcggcaggtcgcacagggtgcggatatggtcccacttgcccatgcccatcgggccgcgggcttcttcgatggagacctgtacatcgaactcggcgaaggcttcgacgaagatctgggtcggcgcgaaggagccaaaatcgaccacggtgccggcccagtcgaggatggcggcttgcagctggttggggttgttgtaatgcatgtctggaaaacccgtgtaggagcgagcttgctcgcgaaaaaaattgggggccgcgccgtctgtatcgcgagcaagctcgctcctacaggccgtggggtggttgtagtaatcagatatccagcacttgcatttcccgcagcacgtcggcgatggcctggaccgcggtgcgcatcccggccgggtcgacatggccgatgcagccgacacggaaggtttcgacctgggtcagcttgccgggatagaggatgaaacccttggccttgacccgttcgtagaactccttgaactggtagcgcggacctttcggcgcgtggaaggtgacgatgatcggcgcctggatcgccgtcggcaggaagctgcgcaggcccaggcgcgccatgccgtcgagcagcgcctggcagttggcggcataacgctggtggcgcgccggcaggccgccttcttcgtggtattgcagcagcgcttcgtgcagcgccgcgaccacatgggtcggcggcgtgaagcgccattgcccggtcttgaccatgtagccgtgctggtcgtgcaggtccatggccagcgagtgcgagttgccggcggccgcggccagggcttccttgcgggcgaagacgaagcccatgccggggacgccttccaggcatttgccggacgcggcgatcagcgcgtcgaacggcacgtgccgggcatcgatcggcagggcgccgaaggagctcatggcgtcgatgatcaggcgcttgccgtgaccggccacgacctgggcgatctccggcagcgggttgaggatgccggtgctggtttcgcagtggatcagcgccacatgggtgatggcggcatcggctcgcagcaggtgatcgacatcggcggcgctggtgggctggtcctcggcggtttcgaaggtgctgaagtcgcgccccagcacttcgcagatcttcgccaggcgcttgccgtaggcaccgttgatcaacaccagcaccttgccgccccgtggcaccagggtgccgatggcagcttccacggcgaaggtgccgctgccttgcagcggtacgcagtggtggctggcggcgccgttgacgatggccagcagctgttggcagaggctggcggtcagctggttgaaacgctcatcccaggaaccccagtccaccagcatcgcctggcgggtgcgggccgaggtggtcagggggccgggggtgagcaggatgggcgcggcagtactcaattcgggtgtcctcgcagaagcgctgtgggatgcgcttgggataaaaactacggggcctaaattgcagtttggctcgttatcaatcaaattgtttgtcgttatgccagccataagtgaggccgatagatatgaacctgttccaactgcgcgcattcgatgccgtggcccgtgaaggcagcttcacccgggccgcggcgcggctgttcatcagccagccggcggtcaccgggcatatcaaggcgctggaggagcactaccagatcaccctgctgcggcgtaccgcgcgccgggtcgaactgacggaagagggcatcaggctggcagcgatcacccgcgccatgttcggcctggccgaagaggcccaggccatgctcgaagccaaccggcaattgctcaccgggcgcctggaagtggcggcggacggcccgcacctggtgatgccgatgctcgccagcctgcgcgagcgctatccggggattaccgtcaacctgcgcctgggcaatgcccaggaaaccctggcggcgttgctttcggagcacgccgatgtggcggtgctgaccgaggtcgaaccgcgcaagggcctgcacctgcagagccttggcgagtcgcggatctgcgcgctggtgccgcagggccatccatggctagccgagcccgagggcgtgcggctggagcgcctggaccaggtgatcatggtcctgcgcgagcccggctcgattacccgccgcaccttcgaccaggcctgcgcccaggccggggtcaaccccaaggtgctgctggagctggacagccgcgaggcggtgaccgaggcggtggcggcgcagctgggggtgggcgtggtgtcgtcgctggaactgagccccgacccacgggtgcgggcggtgccgatcatcggcgaggggctgttgaaccggcacatgctcggctgcatggagcggcgccgggagttgcgcttgatccaggccttcctgcagctggcaccgccgaactgacgcgcggattgccctgaacctgtcgccgctgccgcaggctgcgatcgatctgggcggcattccgacaacgcgggcgcacgatcttgagatcgctgaaggccttcggccttatcgcagcctgcggcagcggctacaggggcatcctgctttcgcgaccactattcaggaaaggtcgccacgggatccgatgcgggacaggtggtcgcggatctgactttttggtcgattggtgccttcaggccgtataaacttgcccatcgcgtcggccacatccaactcgacgccacagatcaaagagagtgagtaatgggcgcacagtggaaggttaaacacaaagaagcagcagccaacgccaagggcaagatcttcggcaagctggtcaaagagatcaccattgctgcccgcaacggcgctgacgtcgccaccaacgcacacctgcgtctggtggtggagcaggcgaaaaaggcctcgatgccccgcgagaccctggagcgtgcgatcaagaaaggttcgggccagctcggcgagaccgtgcagtaccaccgcgtgacctacgaaggtttcgcgccgcaccaggtgccgctgatcgtcgaatgcgtgacggacaacatcaaccgcaccgtggcggaaatccgtgtggccttccgcaagggccagctgggcgcttccggttcggtgtcctgggacttcaaccatgtcggcatgatcgaagccgcgccggacagcccggacgccgatccggaactggcggccatcgaagccggggcccaggatttcgagcctggggacgagggcgcgaccctgttcctgaccgagcctgccgacctcgacgcggtgcagaaagccctgcccgagcaaggcttcaccgtgctctcggccaagctcggctaccagccgaagaacccggtcagcggcctgtccgacgagcagatggcggaagtcgaagccttcctcgaaggcctggacaaccatgacgacgtgcaggacatgttcgtcggcctggcgggttgagcccagcctggtgaatcgcgctacctgagcgattcttgcgccagccggcaagctccagcaggagcgagttggctggcgatgctcttcaaatcccccgcaacacctccccgacttcggcaaatcccggccgcgccagcacctgcggctgacagcagtcgttgaccagcgtcgccaggcgttcatgctgccgcgggctcaggcccgactcgatccttgccagcaactcttccagcagaatgccgaaggcccgtacttcgatgcgttgcagggcccgggtttcctcggtgtcggccagcgcatggaaggatgccgcgccaaaatcccccagcaggcactcgccctgcgggttccacagaatgttatggccgtacaggtcgccgtgggtgatgccctggcggtgcaggtgcgcgccgaccgaagcgatgccgcgggccatgcgcaaggccgcgtcggcgctgaagcggatgctctcgtcgtagatgtcccgggtacaggaggccaggctcggcaaggccgccaggttgcggtagctcggctcgatcaactgcatcaccaggccgttctgcccttcgggatgatcgctgatccggccttcgacccggatcaggttcgggtgtcggccggcgctgatgcaggcgttcatttcatgcagcggcgagccgtcgctggtcatgctgcccttgtacaacttgaccgccacctcgcttggcgcttgcccggggggctgccagcgggcctggtgaatcactccggacgcgccttcgcccaggcgctgctgcacttccagctcggcccagggaatgcgtgccaccgattccagcgccgccgcgtcggcctcggattccagcgggttgccagcataggccagccaggtcaggcgcggcaggccaagcaggaaggccggcagtgcactgagccggttggcggcgatgcggatcagctccaactgctggcattggccgaggctctggggcaaccgggtcaggcggttgccggagagcatcagcttttgcaggtgcgggcgctggcccagctcgtccggcagttcctcgatgcggttgtcggtgaggatcagccagcgcaacagcggcggcagggcggcggcgggcacccgcgcgatgcggttggccttgaagccgaccatgctcagttgcgcgcactggccgacacaggccggcatctcggtgaagaggttatcggagcagaacagcacccgcaggcgggtcaggcggtgcaagtcgtccggcaggctgctcagggcattgccgctgaggttgaggacttccagcgagtccgccaggtcgaagatttcccgggggaattcgctcagcccgcaagacaggtccagacgcttgagcccggtcaattggccggctcgcagttgggcaagggtatccatgaacaggttcgacactcaggcaggaggagggcgcgtggccctggaaatggccgccatgatagcggcgtggagcggtgggtggcgaccgtcggttcagcccggcggcgtatccgcgctgatttcctgcagctggcccaggcggctgcgggtgcgcgccaggtcgatggcgttaccgcccaggctttcgcgcagggagcgttcgccgatcagggtcaggtgcttgtcctggtcgtacagcacgtcgatcaggttgataaagcgttgctgcacggcaatcgggcattcgcccagctcgggcagttcgtcgatgatccagtggtcgaaacgccggctcagctccaggtagtccatgaccgcggtcggctgttcgcacaggtcactgaaggcaaaacccacgctgtgttgttcgcacaaccgtacctggagctgacgcgcgccgaccatcagcgccgaggtcgggccgttgcgccgcggcaggcccaggctcaggcgctgctgctcgctgccgggccacaggtaacggccttgggtgaacacctgctgcgaatggctgcggggctggctgcggtagtcgtgggggccgccgacctccatcacctgcatgcggctggcgatcaggtcgatcaccggcttgaagcgtgcgtggtagagcggattgggcagcaagccctggggcgcatagttggaggtcaccagcagcaggatgccgcgctggaacagggccttgaacagccgcgtgatcagcatcgcgtcgccgatgtcgtggacatggaactcgtcgaagcacaatacgcggcagtggctgagcagttcgtcgagggtggcctcaagggcgtcgggctgttcgcgatggcggaacatgccctggtgcagttgggcgaagaaatcgtggaagtgcaggcgctgtttttccgccagagggatggcgtggaagaaaccgtccagcagccagctcttgccccgtcccaccgcgccataaaggtacaggctacagctggcgtttggcttggcgtctggctggagcagggcgttggcctgctgggccatgtagtcgatcacccgctgctggctgtggctgagggtgtagccctggtcgtgggctttgtgccggaaatattcgtgaatcactcggccgtggctggtgctggcggccggccgggcgaaggccttgccgaagaacgcgcgcagcctgggccagcgcgatgggcgtagcgagcggtttggcggtaaagcggccaatggtgtcaccccgatggttccaggccagctcccccctggaaccggcgcggtaatttaaccaatccccggcccggcatccagcgctgtctgaaggcgctgattggttctacgaaaagttctggtcggtacagttttttgcccgtgtcactgtgttcgacccaggtgcatcgggcggccagggggctgttttattggcgggcggcttgcccccggcgctggcgatttccccggcgcttgcagaacgttgcgccggcccgctgaggccatctaccgctgcgggcagacaagggtgcggggctgtccggcgatcggcgattcaggctgaccggtagcggcagtcactgctggccatggaagaaaggtgtccatcgatgggcgtaacgcttcaatgaacctcggcgcggctcgtcgtttctggcgcccggggtgggcggtgagcgggctgtgttgctgggtgttcgcctccggcagcctgggtggcgaactgccgccgccgcccagcggcatggaagcgatcagcgatgcccagctgtttctggaactggtggtcaatcagatgaataccgggcgagtgatcgccgtcgagcaacgtgccggacgcctgttcgtgccggcccaggccctgcgggaaagcgggatgaaattgcccgacgggctcgacgcccaggtcgccctcgacagcctgcaagggctgcacagcgactacgacagccagggccagcggctgttgctggaggtgccgccggactggctgccggagcaattgatcggcagccgccaggcctatccacgaaccccggcgctgagcagtttcggcgccttgctcaattacgatctgtacctcaacgacgccgacgatgccggcacctacctggcggcctggaacgaggtgcggctgttcgacggctggggcaccctgtccaacaccggccagtaccggcggaccttttccggcctgggcgagggcacgctgaacaacggctaccggcgctatgacaccacctggcgttactccgacgacgagcgtttgctgacctacgaggccggcgacctggtcagcggcgccttgccctggagcaactcggtgcgcctgggcggcgtgcaactgtcgcgcgattttgccgtgcgcccggacctggtgacctatcccttgccgcagttcgccggggaggcggcggtgccgtcctcggtggacctgtttatcaacggctacaagtccagcagcgccgacctgcaaccggggccctacaccctgaccaatatcccgttcatcaacggtgccggcgaagccgtggtggtgaccaccgatgccctggggcgacaggtgtccaccaccgtgccgttctatgtcaccagcagcctgctgcaaaagggcctgagcgatttctcggtggccgccgggaccctgcgccgtgactacacgctgcgggatttcagctacggccccggcgtcacttccggcagcctgcgctacggcctgagcgacaacctgaccctggaaggccacgccgaggcggcgcagtccctgaccctcggcggtttcggtggcaacctgcgcctgggcaacttcggcgtgctcaacagcgccatcagccagagccgcttcgatggccagggcgggcagcaggtcagcctcggttatcagtacagcagccagcgctacagcctgtcctaccagcgcatgcagcgccgcgacggctacgccgacctgacggtagtggacagcccctacgccagcctcagccagcgcagcgaacagctgaccctgagcctcaacctcgagcgctacggcagcctcggcgccggctatttcgatgtacgcgccgcggacgactcgcgcacccgcctgctcaacctgacctggagcaagccgctgtggcgcagcagcagtttctacctgtcggccaaccgcgagatcggcgacagcaactgggcggtccaggcccaactggtgattccgttcgacctccacggcagcctgagcctgagcagcgagcgcagcaaggacgggcaggaccgacagcgggtcaactacagccgggcggtgcccagcgaagggggcgtcggcttcaatctcggttatgcccagggcgatgcgccggcctaccgccaggccgacctgacttggcgtttgcagtcggtgcaattgcaggccggggtctatggttccagcgaggccgaaacccgctgggccgatgccagcggttcgctggtgtggatggaccgccaggtgttcgccgccaaccgcatcgacgacgccttcgtggtggtcagcaccgacggctaccgggatattccggtgcgctatgaaaaccagctggtgggacgcaccgataagaacggccatctgctggtgccctggagcagcgcctattaccgcggcaaatacgagatcgacccgctgaacctgccggccaacgtgcagagcccgctggtcgaacagcgggtcgcggtgcgtcgcggcagtggctatctggtggcgttccccttgacccgcatcgtcgccgccagcctggtcctggtggacgcgcggcaccaggagctgcccctgggcagcctggtgactcacgagcagagcggcgcccaggcagtggtgggctgggatggcctggtgtacctggaaaacctggcgccgaacaacagcctgcgggtcagcctggccgacggcagcagttgccaggtgagctttaccctggagccggagcaggaacaggtgccgttgatcgggcctttggtgtgtcagtgaggattcatgaacggaatcgggaggcggtgaacatggacaggttgcgtggctattggggccaggggctgttgctgatggcgctgctgtcgccgggggcggtccaggccctgtgctcggtggtcagtacctcgccagcgagtttcggcaccctcagctcgatcctggtgcgcaccacctcgcagtccgcttccagcaccaacgccggcctggcctgtaccggctcgctggcgaccctgatggccagcaacgaccatttctacgccaccatcacctcctcgcagagcgggctgctgggccccaccggcgatgtcatcggctatacgatctacggcgacaacagcaccaactaccccatcaaccgcggcgtgcagttcgacttcgcgcgcaactccatcgtcgatgccctggggctgctgggcagcccgaccgtggccaaggccattccggtctacctgggtagcatcaccggcagcaacgtcgccgccggcatctacaccgagactttgagcatcgcctggagttggaactattgcgcggggatcggtgccctgggcgtctgcctggggcgcgatattggcagcggcgtcgccagcctgacggtcaacctgacggtggccaacgattgcgtgatcaccgcgcccaatatcagtttcggcagtgcgccggtgatcagcgccttcgccaccgtcagcgggcagaccatcaacctcgcctgtaccaagggcagtacctacaccgtgggcctggacgatggccagcatgccgtcagcgtcggcgggcggcggcggatgatctcggggagcaactacctggcctacgacatcttcaagagtgccggcaccacccgctggggcagcgtgggcgcggcgcggcgggccagttccgatgccgaggtgaatccgggcaacggcctgggcaccggcagccaggtgttcaactacaacgcccggatctacaccgaccaggccacgccgccggcggggacctatatcgacaatgtggtgctggatgtggggttctaggcggggagagcggttgctggcgctgggtgccggtacgagcgatgggggcggaggattaccgtccatatcgtgccggtctcaggcccgcggcgacctggatatcctgcggccgctgcgctgccgatcgcaggctgcgccagcggctacaggagggggagcggctctcgggagaggtgtagccgctgccgcaggctgcgataggtccgaaggacctttggcggtttcaaggctggcccacgggggcgggcgctgtggctcagaacttctgggtgtcctgcagccgctgcgccaccgccgaaccactggggctgaccatggcgtagttgtagccgctgtcggaccagtagtcggcctgcagttcgccatcgttgcggctgccccggggcagcaggtagttctttggtcccggtgggcggatatagaagctgatcctgtgcccgccctggtcctcgtacagcaccatcgccgccggcccttgatcggtgctcagcaggcgcccgctgactgcctggaagccggactcgcgcaggtccggcaggcgctcggcctgggtgaagtagcggtcgagccaggcctgcatggcgccgttgccctggaccttgaggtcggccgggaggacgccttgctgggcaaacaggcggtaggcctgcagggcgtcggtcatcggcagcggggcgctggccagggtcatttcccgggcctgccagccactcaggccgccgatgccgagggcgatcaacagcagcgcggcgctggccaggtggcggcgcgactggcgcttgagacgctggcgaatcagcgccgggtcgaggtcggggttggccggttgttgcagggcgccgccgagggccgcgcgcaactgctgggcgtcctgctgccaggcctggacctgggcggcgagctgcgggtggctgctcaggtaggtttccagcaggcgccggtcgctctcgttgagccgatgatcgacataggcatgcaggtcgcgttcgctggggggcaggctgatcatttgagtatccgcaaagaagggctgctgatttcgccgtcgctgagctggcgcagggcctggcgcgcccgggacaggcgagacatcacggtgccggtgggtacgtcgaggatggtggcgacttccttgtagctcaggccttccaccgagacccagagcagcagcgcgcgctgttcggcgggcaggcggtcgaaggcttccagggtcgattgcgcgaccacgctgcgttccaccgaaggctgggcgtcgtcacgcccggtgaagaattccagcatgcgtgcataacgccgggagcggcggtgcgcgtcgagaaactgccggtagagaatggcgaacagccaggcccgcagatcgccctcggggcgtttttcgccccagctcgacagcgcccgttccaggctcgcctgcaccaggtcgtcggcgctgctgggctgacggctcagggacagggcgaagcgccgcaaccgggggatgatttcacgcagctgttcgtcgatatcgttcatgggttcctgcggatcgttggccagtcgctacgcttgcaacagcacacttgcgccagacgcccggcaacgcaggttattcccgtgccggaaaaataaatagcgggccagggaataaccgctgccggggctcgtctgacctgtcctttccacctgtggccgcggccctggagatattcatggtagatcgtccatcaccccctgatcgtccgcccttgagcgcggccagcctgagcctgcgtctgggcgggatcgccctggtggtcgcggccctggccggcgccatggcttatgtaaacggcactttcgatccgcagcgcctgacccccaaggccctggtggatgtgctggagaaaaacaacggcgtgcatccgggctttcgccgcaaccatgccaagggcgtgtgcgtggccggttatttcgagagcagtggcgaggcccgcagctattccagcgcccaggtgttcaacgaagcgcggaccccggtggtcgggcgtttcgccttgccccccggcaatccctatgcgcctgacagcagcgtgccgatccgcagcctggccctgcgttttacccaggccaacggccagcagtggcgcaccgggatgaacagcatgccggtgttcccggtgggcacccccgaggcgttttaccagttgcagcaagccagtgcgccagacccggcgaccggcaagccgaacccggccagcgtgccggcgtttttcgccgcccaccccgaagccatgccgttcctgcaatggatcaagggcgccaagccctcggccagctatgccaccgaaacctacaacggcatcaacgcgttttacctggtgagcgccagcgggcaacgccaggccgtgcgctggggcgtggtgccgctgacccaggacgcacccggcgcggtggtgccgcaaggcaacgacttcctggaaaaagacctggtgcagcgcctggccgcggggccgttgcgctggcgcttgaacatcaccctggccaacccgggcgacccgaccgacgacgccagcaaggcctggcccagcgagcgcaaggtgctgaatgccgggaccctggtgctggagcgcagccaaccgcagaacgatggcgaatgccgcgacatcaactacgacccgctggtgttgccgagcggcattgccgcctccgacgacccgctgctggcggcccgttcggcggcctacgccagttcttatctgcgccgtaccagtgaagtcgaccaattgccccgcgctgcccaggagccccgcccatgagtgcccaaccgaaccacttcgcgccattggcgcgcctgctgcactggctgatggcgctgatgatcattgccatgctgtttatcggcgccggcatggtggcctcggtgtccgagcgtcaccaatggctgatccacctgcacaagccgctgggcattgccattctgctgctggtgatcgtgcgtctggtcgtgcgcttttccacccggcaaccgccgttaccggcggacctgccgggctggcaggcgttggcggccaaggcctcccatgtgctgctgtacgcgctgatgctggtcctgccgctgctgggctgggcgatgatttcggcggcgggcgacccgatgatgctcggcagttcgctgcagttgccggcgatcctgccggccaatgcccagctgttcgcttttttgcgcaaggctcacggctttctcgcctacctgctgtttttgacggtgctgctgcatctggcggcggcgctgttccatggctgggtgcgccgcgacggggtgctggaaagcatgctgcgcggcaaggaatgaggtaacggagtcatcgaggtttatcgcgagcgagctcgctcctacagggggcgcagcccttgctcgcgcattcaaccggcacacaccagggctttgcgcgggttcaggctccacagccagtacagcagcgccacaccattgatcgcggcgcccagcaggcacaccccgctccagcccgcccaggcgtacatggccgtggcgccgatcgagccgctggcgctgccgatcgaataaaacagcatgtagcccgcggccaggcggctctgggcctcggggcgggtgctgtagatcaggctctggctggtgacatgcaccgcctgcaaacccatgtcgaagacgatcacccccagcaacagggcccagagcgacgactgggtataggcgatgggcaaccaggcggccagcatcaggctcagcgccaggccgctggtccattggcccaggccacggtcggccaggcgtccggcgcgcgccgcgcccagggccccggccgccccggcgaggccgaacaggccgatctcggtgtgcgacagcgacagtggcggggcgctcaggggcagcaccagcggggtccacaacacggtgccggcgccgaagatcagcatcgccagcaccgcccggtcgcgcaggatcttttcttcgcgaaacaggccgaacagcgagcggatcagctggccgtagctgtgcagcgccgccggttgctcgaccttgggcagcacccgccacaacaacagcgccatgaccagggtcagcccggccgacagcaggtacaccgaacgccagccggccaggtcggccatggtgcccgacaccgtgcgcgccagcaggatcccgagcacgatgccgctggtcacgctgcccaccacccggccacgttcgcccggcgcggccaggttggcggcataggccaccagcacctgggtcaccaccgcgagcagcccggtcagggccatgcccagcaacagccaggtgctgtccgcggccaatgccaccatcaacagggccgcgaccgacaagctcgtctggccgacgatcagccgccgccggttcagcaggtcgcccagcggcaccaggaacagcaggccgaggccgtagccaacctgggtcagggtaatgaccaggccgatggtcgccgacggcatgcccaggctgtgggccatggcgtcgagcaggggttgggcgtaatagacattgcccaccgccagcccgcaggcaatggcaaagagcagcaccaccgacgccggaatggtggcggatggcagaggggcgatggcggcggtcatgctcggctccgtgagttctagttgcgttatgaaaccagttgtacagtagagaggctggttttatattgcaaccactttcctgtcgcgagtctgcatcatggtcaaacgcacaagcctggagggcgccgaatgcccggtggcccgttcgctggacgctatcggcgactggtggtcgctgctgatcattcgcgatgccttcgacggcatccgccgcttcagcgagttccagcgcaacctggggatggccaagaacatcctcgccgcccgcctgcgcaccctggtggcccatggcatcttcgaggtgttaccggcgtcggatggcagtgcctatcaggagtacgtgctgacagagaagggcaacggcctgttcaacctgatcatcggtttgcggcagtggggcgaggcgtatttctatgagccgggggaggcgcattcgctgatggtcgaccgcgagcaggggcagccgctgcgaccgctggaattgcgctcggcggacgggcgcctgcttgggcccgaggattgccggcgggtgccggtgcaataggcgctggccgcgggtcgagccgcggccagcgcagcaggatcagcgcaggatgccgaccatgtcggccacggtgctgaggacgtccttgcccagttgcatcgagcgtttgcccgaccagccggtgagcgggttggggttgtcgtcatggtccttgaacggcatttccagggtcagcgacaggcagtcgaacttctcgccgacgctgttgcaggccagggtcatgttggcttcgccgggtttgtccctggtgtagccgtgggtggtctggaagtcccgggtcttgtgtttcaggtggctgcggaaatgctcctcgagcttggccaggcgcggcgtgtagcccgggttgccttcgcagccggcggtgaacacatgggggatttcttcgtcgccgtgcacgtcgaggaacaggtcgacaccgtactgctccatctgctgctggacgaacagcacttccgggctgagctcctggctggcgctctgccaggcgcggttcaggtcctggcccatggcgttggtgcgcaaatgaccgtggaaagcgccgtcggggttcatgttcggcaccaggtacagatcggcgctggccagcagcctgttcagctcggcatcgtcacggtgctgcaggcgttcgatcacgccctccatgaaccattcggccatgtgctcgccagggtgctgctgggcgatgatccagaccttgcgccggccttcgccgccattgcctttgcgcagcagctggatgtcacggccctcgacgcttttgccggtggccagcagttcggcgccggccttggtcagtgcctgatcgatcagccagtcgtgccgaccgcggctgtagggttcgaagtaggcgaaccaggcgtgggtctgggtggcttccaggcagaagcgcagggtgtcgccttcaaaaatcgtcggcacgcggaaccagttgacgtgatcgtaggaggtcaccgcctggtagccgctccaggccttgttgtatgaggatttgctggcattgctcaggcggaaccagtgttcctggccgacatgcaggccgctggccttgaagtggaaccactggaaatgcgcgctgcgggtgtcgggcttgatggccagcaggacttgcgaggggttgctggcatccagtacttcgatattgccgctgtcgaaattggcagagatttgaaacgagctttgggccacggtcatgattcctgagcaggatttttatggccgttactttagcaaggcggggggagttgcaggggggcaatttcggcgggagaggggggcgtcgtccttgacgcgaaagcagcttagaagctatgcgattgattctcaagcgctgtttttgcatttgcgagccgttgcggcgggcgtcggcttgcaatgaggcattcttttgctatcatcgccgccaatttagcggtacccagtcttcattagcctgaagccaagccagaaaaactggcagaaaaaaaagacccggcaaaaaaccgggtcaaaaaccgtgattagcctgatgaggagataatccaggagtccgacctaaggtctcttgggttatcgactgatctcgcgaccagttgcttgcaataataatcattatcatttgcaagtcaaatgtttttccccgccttttagaaaataatttcctgtccctgttgccagccctgttcatcggccggatcggctgtgggcgaattctgccgtggcgctcattccgggcgatggctgtccagcgagcgatccaccagcgccttggccatgtcgatcatgtgcaccacggaaaacgccaggtcccgccgggtaccccgcaggtggtcggcagcctcgtaggcactggccgccgcgcaaacgcagcaggtcggaagcgtggatcatcgcttcctcgctgctgatgctgtgtttgacctcgaagaacttctcgtcgatcgacgattctgcaatagccggtttcaagtagtagtccatggcccggcgggcggcctcgctgtccttgagggcgttgaagccgacatcggtttccagttccggtgcatctttgctggttgtgctcatgagcggttccatcctttgacgtggaataagagggtctgaggaatggtaatacttaatgtatttgtgactaggtttcaaatactacaacttgtgtgttgagggccgaaatacacaacgtattgttccgctccatggacaaatggatcgagttggttaaatccaacatgaaggaccgcaaggtcacgcaagaaaagctcgcggagcgcctgggcatgtcccagggcggcatcggccactggctgagcaaacggcgccaaccgaagatcgaagacatgaaccgggtgctggaagaaatcggcctgggttttctcgaagtcgcgctggtgatccgcgaaaaaccacaggtggatgacgagggccaactgctgctggaagggccgtcgttggtgcagaagtacaacccgtacttccgctatccggtcagcgactggcggggcgttggcgaggtgcgcgaggctggtggcgcgggctacgccagcgagcgttacgagctctccgactaccaggccgaaggctcggctttctggctggtcgtggtgggcgacgcgatgattgcccccagtggcctgagcatcgcccaggacatgttgatcctggtggacccggcggtggaggcggttcccggcaagctggtgatcgtgcaatgcccgggcagcaccgaagcgattttccgcaagctggtggaggagggtgggcagcgttatctggtgccgctgaatccgacttacccgaaggcgctttacagcgatgactgtcggattattggtgtcgtggtgcaggctaccgctaaattctgacgtaaaaatacgatcgttcccgcaaggctgcgggaacgatcttctgcctcaggagcttattccagctccaccagggcacttccctcactgaccatttcgccttcctggcaatacagcgccttgaccaccccggcttgcggtgcgcggatgctgtgttccatcttcatcgcttccaggaccaccagttgcgcgccggcttcgacgctctgcccggcttgcaccagaacccgcacgatgctgccgttcatgggcgcggtcaggccgccatgatggccgtggctggcctccaccgcggcgatcgggtcataggccgtgacccggtgcatctcgccctgccactgcagatacaggctgtcgccctggcgaatcgcccggtgctgctggcgcagccccttgtgttcgatcgacagctgctcgccgtgcaaggccatggccgcgttgtggggggccagcttgatcgcccggtcctggccctcgcagtcgaggtgcagcacggtttcccgcggcaggccgatgcgcaggccgctggccttggcccagggggaatggcggtcgtcggcgcgcgtctggtccggctggctctgggcgaacgcctgggcggcggcctgccagaactcgtcgctcaaggcggtggccggtggcagcaactgatcctgatagcgcgggataaagccggtatccagctcggcggcggcgaaggccggatgggcgatgatgcgccgcaggaacgccaggttggtcttcagcccaccgatggcgaactcgtcgagcatggccagcaggcgcaaacgcgcctgctcgcggttttcgccccaggcaatcagcttgccgagcatcgggtcgtagaacggcgacacgctgtcgccttgctcgacgccgctgtccacccgccgtccaggacccgccgccgattcgcggtacagcgccaggcgcccggtggccgggaggaagtcgttgcccgggtcctcggcgtacagccgcacttcgattgcatgcccgatcagcggcacctgatcctgggtgattggcagcgcttcgccctgggccacgcggatttgccaggccaccaggtccagcccggtaatggcttcggtgaccgggtgctccacttgcaggcgggtgttcatttccatgaagaaaaattcgccgcgcgaatccagcaggaactccacggtgccggcgccgacgtaaccgatggcctgcgccgcacgcaccgcggcttcgcccattgccttgcgctgctcgatgctcaggccgggggccggggcttcttcgacgactttctgatggcgccgctggatcgagcagtcgcgctcgttgaggtacaggcagttgccgtgctggtcggcgaatacctggatctctacatggcgcggcttgagcacgtacttttccaccagcatccgcgaatcgccgaaggacgactgcgcctcacgctgggccgaggccagggcttcggccagttggctgacgtcctccaccactttcatgcccttgccgccaccgccggcggtggccttgagcagcactgggtagccgatgcgttcggcggcgacgcggaaggtttccaggtcctgggcttcgccgtggtaaccggggaccaggggcacgccggcggtttccatcagtgccttggccgccgatttgctgcccatggcgtcgatggccgacgccggcgggccgaggaagatcaggccggcggcttcgatggcgcgggcgaagccggcgttctccgagagaaaaccgtagccggggtgaatcgcctgggcgccgctggccttggcggcggcgatcagtttgtcgatctgcaggtagctgtcggcggccttgctgccgcccaggtcgatgcgcaggtcggcttcgcggctgtggcgggcgtcacggtcggtggcgctgtgcacggccacggtggtcaggcccagggccttggcggtgcgcatcacgcggcaggcgatctcgccgcggttggccaccagcagggtggtcaggacaggggcgctcattaacgcgactccttggtgatcttgtcgggctgccagctgggcgagcgcttttgcagaaaggcgcgcaggccttcctggccttcggggctgacgcggatgcgggcaatggcgttttcgcagtagcggcgcagggccggggtcagggcgccgttgccgacttcgcgcagcaggtccttgctggcgcgcatggcgcacgggctgttgagcagcaggttgtcgatccacgacgccacttgttgttccagctcggtcgccgggtagctttccgccagcaggccgatttcccgggcccgctggccgctgaaacgctcggcggtcagggcgtagcggcgcgccgcgcgttcgccgatggcttgcaccacgaatgggctgatcactgccggggccaggccgatgcgtacttccgagaggcagaactgcgcatcgtcggcaccgatggccatgtcgcagcaactgatcaggcccagggcgccgccaaaggccgcgccttgcaccacggccagggtcgggatcttcagcttggccaggttgtacatcagctcggccagctcgcgggcgtcgtcgaggttggtgtggtagtcgagttcggccgactgctgcatccaggccaggtcggcgccggcgctgaaatgcttgccgcggccgcgtaccagcaggaaacgcagggccggatcgctttgcacctgatccagggcgaggatcagctcgcggatcatttcggcgttgaaggcgttgttcttttcctcgcggctgagccacagggtggcgaaaccacgcgggtccttcagcagttccagggtgttgaagtcgttcatgtcggtttcgctccgggtcacatgcggaacacgccgaagcggctctgttcgataggggcgttgagggacgcggacaaggccagcgccaggacgtcgcgggtctgcgccgggtcgatgacgccgtcgtcccacagccgggcgctggagtaatacggatggccctggtgttcgtactggtcgaggatcggctgcttgatctcggcttcctgggcggcgctgaatggctgcccgccgcgttcggcctgctcgcgcttgacctgcaccagcaccccggcggcctgctcggcgcccattacgccgatccgcgcgttgggccacatccacaggaaacgtgggtcgtaggcgcggccgcacatgccgtagttaccggcgccgaagctgccgccgatgatcaccgtgaacttcggcaccttggcgcaggccaccgcggtcaccagtttggcgccgtgcttggcgatgccgccggcttcgtatttctgcccgaccatgaagccggtgatgttctgcaggaacagcagcgggataccgcgctggcaggccagttcgatgaagtgcgcgcctttctgcgcggcctcggcgaagaggatgccgttgttggcgaggatggcgatcgggtagccgtgcaggtgggcgaagccacacaccagggtggtgccgaacagcgccttgaactcatcgaagagcgaagcgtccaccagccgcgcgatgacttcgcgcacatcgaagggctgcttggcgtccgccgggatcactccgtacagctcgtcgctggcatacagcggggcgatcggcgtgcgttgctgcaactcgccctgcttgcgccagttgaggttggcaatgctgcgccgggccagggccagggcgtgttcgtcgctgtcggcgtaatggtcggcgacgccggagatcttgcagtgcacatcggcgccgccaaggtcttcggcgctgaccacttcaccggtggcggctttcaccagcggcgggccggcgaggaagatggtggcctgttcgcggaccatgatcgcttcgtcggccatggccggcacataggcgccaccggcggtgcaggagcccatgaccacagcgatctgcgggatgccctgggcgctcatgttggcctggttgaagaagatccgcccgaagtgttcgcggtcggggaacacctcgtcctggcgcggcaggttggcgccgccggaatccaccaggtagatgcagggcaggcggttctgctgggcgatggtctgggtgcgcaggtgttttttcacggtcagcgggtaataggagccacctttcaccgtggcgtcgttggccacgatcatgcattcgacgccttcgacccggccgatgccggcaatcaccccggcggccggcacgtcttcgccatacacctgatacgccgccagctggctgacttcgaggaagggcgagcccgggtcgagcaggcggttgatgcgctcgcgcggcagcagtttgccacgcgaggtgtgccgttcctgggccttggcgccgccgccttgctggacctgggcgagcagggtgtgcagggcgtcgacctgtttgagcatcgcttcgctgttggcgacgaactccgccgaacgggggttgagctgggtatgcaggatagccatggacagctccgttagcgggtttcgttgaacagttcgcgaccgatcagcatgcggcggatttcgctggtgccggcgccgatttcatacagcttggcgtcgcgcagcaggcggccggcggggaactcgttgatgtagccgttgccgccaaggatctggatcgcgtccagggccatctgggtggcgcgttcggcgctgtagaggatcaccccggcggcgtccttgcgcgtggtctcgccgcgctcgcaggcctgggccacggcatacaggtaggcgcggctggcgttgagctgggtgtacatgtcggcgaccttgccctggatcagctggaactcgccgatgctctggccgaactgcttgcggtcgtggatgtagggcaccaccaggtccatgcaggcctgcatgatcccggtcgggccgccggagagcaccacgcgctcgtagtccaggccgctcatcagtaccttaacgccgccattgagcacgccgaggatgttctcttccggcacttccacatcgtcgaagaacagctcgcaggtgttggagccgcgcatgcccagcttgtcgaacttgttgctgcggctgaagcctttccagtcgcgctcgacgatgaacgcggtgatgccgtgcgggcccttttccaggtcggtcttggcgtagatcacataggtgttggcgtcggggccgttggtgatccaggtcttgctgccgttgagcacgtagtggtcgccgcgcttgtcggcgcgcagtttcatcgagaccacgtcggagccggcgttgggttcgctcatggccagggcgccgatgtgttcgccgctgatcagcttgggcaggtagtggcttttctgttggtggttgccgttgcggttgatctggttgacgcagaggttggagtgggcgccgtaggagagggcgaccgaggccgagccgcggctgatttcttccatggccaccacgtgggccaggtagcccaggccggcgccgccgtattcttccggcacggtgatgcccagcaggcccatgtcgccgaacttgcgccacatgtcggcggggaacaggttgtcgatgtcgatctgtgccgcccgtggcgccagctcggccttgacgaaggcctgcacctggtcgcggagcatgtcgatggtttcgccgagggcaaagttcagggtcggatagctcatgggggcaccttcaagcttgtttttatgtcagggagtcgggctgtggagagcggctgatttagctctcacctttacgttaacgtaagcctgcggcgggtggctgtcaatcaccctttacgtaaacgtcaacttgcgccagagtaggggcgttttcgctgggggccaggctccttcgctacatgcctggctcatgcttacccactaataaagacaataggggtcatcatggatcaacccgcatccgcgccggggcgcagttacactcgcggcacgcaggacaaggccttgctggcactgaccatcggccaggcgttcgatcgcacggtggcgtcataccctcgaggcgaagccctggtggtgcgtcatcagcagctgcgctacagctggcagcaactggccgaaaccgtcgatctgcatgcccgggcgctgctggccctggggctcaagaccggcgaccggctgggcatctgggctcccaactgtgcccagtggtgcatcagccagttcgccagcgccaagatcggcgcgatcctggtgaacatcaatccagcctatcgcagctccgaactggaatacgtgctcaagcagtccggctgccagtggctggtgtgcgccggcgcgttcaagacctccgactaccacgccatgctccagggcctggcgcccgagctggcgcagcagtccatcggccagctgcaaagcgagcgcctgccggatttgcgcggcgtgatcagcctcgatgcccagccgccgtcgggctttctgccctggtcgcaactggccgacctgggggccggcgtcagcgtcgaagcgctgcgcgaacgccaggacagcctggaccccgaccaggcggtgaatatccagtacacctccggcaccaccggtttccccaagggcgcgaccctcagccactacaacatcctcaacaacggttacatggtcggcgagagcctgggcctgggccacgaggaccgcctggtgatcccggtgccgctgtaccactgcttcggcatggtcatgggcaacctgggctgcgtgacccacggcacgaccatgatctaccccaacgatgccttcgatccgctgctgaccctgggcgctgtggccgaggaaaaggccaccgggctgtacggcgtgccgaccatgttcatcgccatgctcgaccagccaaggcgggccgagttcgacctgtcgagcctgcgcaccgggatcatggccggggccacctgtccgatcgaggtgatgcgccgggtcatcagcgagatgcacatgagcgaagtgcagatcgcctacggcatgaccgaaaccagcccggtgtcgttgcagaccggcccggcggacgacctcgagttgcgcgtgaccacggtcggtcgcacccagccgcagctggaaagcaagatcatcgacgaggcgggcaatatcgtgccacgcggcaccatcggcgagctctgcacccgcggttacagcgtgatgctgggctactggaacaacccccagggcacggccgaagccatcgaccaggccggctggatgcacaccggcgacctggcgaccatgaacgagcagggttacgtgtgcatcgccgggcgtaacaaggacatgatcatccgcggcggcgagaacatttatccgcgtgagctggaggagtttttcttcacccatccggcggtggccgacgtgcaagtgatcggtatcccgtgctcgaaatatggcgaggagatcgtcgcctggatcaagttccaccccggccacagcgccagcgaggaggagctgcaggcctggtgcaaggcacgtatcgctcacttcaagacgccgcgttacttcaagttcgtcgaggaattcccgatgaccgtgactggcaagatccagaagttcaggatgcgcgagatcagcatcgaggagttgcgcgggcgttcctgagccattcgagcaggctcccgcgaatatgtgcgggagcggctcgcgagccgttttggggcgcgcagccgaggcaggagaggcgagggaaacaggaaggccggaaagcacaaaggggagctgaagctcccctttaatttttgtcgttgcgtgctctttttttattattgaggggcggtctgttgttgtttttggcaaccgttaccctttaccgctgtttttggcgatccccatccgggatcaagagcaaacgtatttttttgagcgctgatctattttctcgcttgagcgaccaaccagttcgggagctaccttggggtagttttattgttctctgcccggttgcgggtggctcttattgttaaagacaccctggaaaacacatcctctccaaaaaaatctgttagctgcgtctctgccgtgttgtttttgttatgtcagagtcgtttcgtcttatttttattagctttgctgctttttattcttgttatgccagagatatagcagaagccatgccaactttttaaaatcctttaaaatcaatggcttgataaaaacggtctttcatctgtaccgctagaaaatcgacaaactgtttccgtgttacccgtttcgagcgtgcgccagagcggtcggtaacaccctgaaacaggcgtgcccctcaacctgggtaacgggccttggcgacacgcgagccggtgggccgccccagcacggagcagatctgctggccggcgaggatcaggtgctccatgtcgataccggtttcgatgcccagcccgttgagcaggtacagcacgtcctcgctggcgacgttaccgcttgcgcccttggcataggggcagccgccgagcccggcgatcgagctgtcgaacaccgcgatgccctccagcaggctggcgtagatattggccagggcctggccataagtgtcgtggaagtgcccggcgagcttgtcccgcggaacgtgggcggccaccacctcgaacatgcggcgggtagcgccggcggtgccggtgccgatggtgtcgcccagggacacttcgtagcagcccatgctgtacagctcgcgggcgaccacggcgacctgttccggcgccacctcgccttcatacgggcaacccagcacgcaggacacgtaaccgcgcacggtaacgccttgctgtttcgctgcctccatgatcggcacgaagcgttccaggctctcgctgatggagcagttgatgttgcgctgggaaaacgcctcggaggcggcggcgaacaccgcgacttccttgaccccggcggccagggcgtcttcgaaaccgcgcaggttcggggcgagggcgccgtaggtcacccccggcttgcgctggatctgcgcgaacacctcggcggacccggccatctgcggcacccatttgggcgagacgaaactgccgacttctatatagccgagcccggccgcgctcagggcatccaccagttgcaccttgtcggcgacgctgatgggctgggcttcgttctgcaatccgtcgcgaggaccgacttcgaccaggcggacatgggtgggaagggacatgagagctttacctatattaagtgggcactaatgtagccgctgccgcaggctgcgttcggcgacgaagtcgacgcaaaaccaggcgctacggtctgtctggcagattgtctgtgttgctggcgcggccgctttgcgagcgatcgcctggggcggttactgcacggcgcttttctgattctggatggtctgctccagcgcctgggtgcagcgctcttccgcggtgtccagctccagcttcatctgttcgatgtccagcaactgttgctccagctgctcacggcgctcggcgattttcgccagcatgctgtgcagctgtttcagattgccgctgctggggtcgtagagttcgatcagttcgcggcattcggccagggagaagccgatgcgcttgccgcgcaggatcagcttcaggctgaccttgtcccgtggcgagtagatgcgttcctggccacggcgttcgggggcgagcaggccttgttcttcatagaaacggatggcccgggtggtgatgtcgagctcgcgggcaaggtcggaaatgctgtaggtctggctgctcatgggggcactcgaaaaaggtcttggcgttaagctaattcgaggttgacgtatacgtcaagcaggatgccgccctatctgtagaagcgaggcttgcccgcgatgggtacgctgaggtttccctgaaccaccacgttctcccttatcgcgggcaagcgttgcgcctgcacatcacttttcgagttttttctcgtgggccgtcacctgctggcacagctcgatcatctgctcgcgcatccagcggttggccgggtcctggtcggtgctttcgtgccagtagaggtgggtttccagcggcggcacgtcgttgaccggcaggttgaacgcctgcaggtcatggcgccgggcgaagcgctcgggcacggtcatgaccatgtcggtctgctgcagcacttgcgaggccatcaggtaatgctgggaacgcagggcgatcttgcgctggatgcccatcttgcccagggccaggtcgacgtaacccaggccgctgcgacggctggaaatatggatgtgggtcagcgacaggtagtcgtcgaggctgagtttttccttgttcgccagcgggtggctcttgcgcatggcgcacacatagcggtcttccatcagcttgacgtggcggacctgcgggtcggtgttgagcggggcatcgacggcgaaatccaggcggccggcggccagttccttggtggtttcccggcgtttggacaggaaactctcgatgatcaccgtgggcgccaggcgccgcaggcgctggaacagcggcggcaggatcaccgcctcggtcaggtcggtcatgctgatgcggtaggtcttgaccgcctgcaagggattgaagatgcggctttcctgcaccgacacccgcagcagcgaaagggcgttgcgcaccgggccgatgatgttctgcgccatgggcgtgggcaccatgccctgggcggtccgcacgaacagcgggtcgttgaaggtctcgcgcaggcgggccagggcgttggagacagcgggctgagtgatgccgacgatctgcccggcgcgggtcaggttggcttcggtgtagatcgcgtcgaagacgatgaaaaggttgaggtcgaccttgctcagattcattgcgctgcactcttattgttagggtcgggagggatgggttgatgacctgcctgatcggtcaatcatatatcggtgatgaatgttaatacacgccgagaataggctaggtaaattttcgtaagctgttctagcatcggttccatgccctcaaccacctcgccaagaaggtagctgcccatggatttcgcctattcacccaaggttcaggaactgcgtgagcgcgtgaccgcgttcatggacacttatgtctatccggctgaagcggtgttcgagcgccaggtcgccgaaggcgatcgctggcagccgacggcgatcatggaagagctcaaactcaaggccaaggccgagggcctgtggaacctgttcctgcccgagtcggaactcggcgccggcctgaccaacctcgaatacgcgccgctggcggaaatcatgggccgctccctgctggggccggaaccgttcaactgttcggcaccggacaccggcaacatggaagtgctggtgcgttacgccaatgaagagcagaagcaacgctggctggagccgctgctgcgcggcgagatccgctccgccttcgccatgaccgagccggacgtggcgtcgtccgacgccaccaacatggcggcccgcgccgtgcgcgatggcgacgaatgggtgatcaacggcaagaagtggtggacttcgggggcctgcgacccgcgctgcaagatcctgatcttcatgggcctgagcaacccggacgcgccgcgccaccagcagcattcgatgatcctggtgccggtcgacacccccggggtgaagattgtccggccgctgccggtgttcggttacgacgacgcaccccacggccatgccgaagtgctgttcgacaatgtgcgggtgccgtacgagaacgtgctgctgggtgaaggccgtggtttcgagatcgcccagggccgccttggcccgggccggattcaccactgcatgcgttcgatcggcatggccgagcgcgcgctggaactgatgtgcaagcgtgcggtgagccgtaccgctttcggcaagccgctggcgcgcctgggcggcaatatcgacaagatcgccgactcgcggatggagatcgacatggcacgcctgctgaccctgaaggcggcatacatgatggacaccgtcggcaacaaggtggcgaaaagcgagattgcccagatcaaggtggtggcgccgaacgtggccttgaaggtgatcgaccgggccatccagatccatggcggggccggggtctccaacgatttcccgctggcctacatgtatgccatgcagcgcaccttgcgcctggccgacggcccggacgaagtacaccgcgcggccatcggcaagttcgaaatcggcaagtacgtgcccaaggaaatgctgcgcagcgggcattaaaagcgatcgcgggcaagcctcgctcctacggaagaatctgtaggagcgaggcttgcccgcgaaacgtcctcgattacaccgcgggtttctctctcaatacacccagacttccacccgccgattcttgatccgcccctcgtccgcggtattggccgcgaccggcatctgcgcgccaaaaccgcggatctcgcgcaacaccacaccgtttctcaccagctcccggcgcacggtcatggctctgagcttggacagcagcgccgcgcgggccggatcgttcttggcatcgccgaagccaaccagggtcacgcgcttggccagcttgtcgtgccgcttgagaaagtccaggacccgtggcaggtcctggcgcgccttgttgtcgagggtggcgctgccttcctcgaagcgaaaattcacggtcaggcgctgcgcctgccgggcgatggcctggtaaccctcgggcatctgcggggcgggggcgacactcatggccagcaccgtctgggcgataaaaccgttggccgcgactatggcctggcccctggcgctctgggcgaaacgcaccagggccctggaccaggggttttgctcatcgggcggcaggtagaagtacaggcgccgtgacaatgggtagtcctcggtggcgatcaggctgtcgaggggcagcatcggttgcgagccgccgtcgacgatcgccacggccttggcctggcgcacataaggcaggccgatgaaaccgatgccctggggatcgcggctgaccgcgtcggagagttgttcgctggactcgaagcgtttcgccgtggggctcaggttcttgtcgcggcgggccagtaccagttctttgaacgtgtcgtaggtgccggagcggtcatcgcgggcgtacaggtgaatggcgccgccgacgccgcccagttcttcccaggttttcacctcgccgttgaacacccgcgccagttgttcggtgtccagtcgcgtcagcgggttgtgcgggtggaggatgatggccaggccgtcgatggcgatcacctgttcggcgtcggggtctttcaggtcgccgagggcttccagctccaccagttcgctgtccttgatcggccgcgacgcggcggcgaggtcggcgctggcgttcttcaacgcggcaaagccggtactggagccatgcgcggcgatctcgacgacaacgcgccggccctgggcactctggccggtcacccgacgctcgttgtctttgcccgtcgcctcaatccgtatgtcgagcaaaccctgttcttgcatcaggcccttgaccagggccgggcccagcgcggcaccgatggtattggaaccctggatgcgcagcaccggctggttgttgccagccaggggcagggcggcgaacaccgaccagggcagggcggagcagacgaagccgaccagcagcaggcagagggttcggcaccagaggtccggttcactgacggtggagacgcgtgacatgcggcaatggccttctatggcgggagcgagtgcggcgagattaagtcagggaggtgacggggatgtgacagttgatgggggtaataggagcgttccccaggcttttcagaatgctcttaaagacccggcacggcgggctcagtagagttgaaaactttgtctggaggggaattggcgcacgccgactctcgtcatcaccaggcgtcgatgcagccctggctgcaatttgcttgtgtcaaaggagtatgaaatgagtggctggttcgagctgaagcaatatggcagcggtggtttcaggttcttgctgaagtccaaggacgcgcagaccatgcttcaaagcgaccgttacccttgtcgtgagagtgtcgaggcagccattgcgctgctccgcaagcactgcacgtccccgggtagttacgaaaagaagatcgcccccggtggcaaaccttacttcaatctcaaggccggcaaggaggtgatcctggtcagccacttgtatgactcggagccgacccgtgagtccgccatcgaggccatcatgcaggccggcaccagcacccgggtcgagctgtgttgagacgctgaagcaataaaaaagcccatctcaggatgggcttttttgtgccgggcgatcagctcagctcgagccagatcggtgcgtggtcggaaggtttctccatgccgcgcaggtcgtagtcgaccccggcatccttgatccgtggcagcaggccgcgagaggccatgatcaggtcgatgcgcaggccgcgcttgggctcgtcctcgaaaccgcggctgcggtagtcgaaccagctgaagcgatcggccacctcgggattgaggtgacggaaactgtccaccaggccccagttcttcaggcgggccatccactcgcgctcttccggcaggaagctgcacttgccggttttcagccagcgtttcatgttgtccgggccgatgccgatgtcgcagtcttccggggaaatgttcacgtcgcccatgaccagcagcggctgctcgttgctgaagcgggtttccagcaggtgctgcaggtcgctgtagaagcgctgcttggccgggaacttggtggggtggtcgcggctttcgccctgggggaagtagccgttcatgatggtcaccggggtgccatcggcatcggcgaaggtgccccagataaaacgtcgctgggcatcttcatcgtcgccatcgaagcctttgtacaggtccagcggcgccaggcgcgagagcagggcgacgccgtagtggcctttctgcccgtggtaatgcacgtgataacccagcgcctggacttcggccagggggaactggtcgtccgacaccttggtttcctgcaggccgatgacgtccggttgatgcttttcgatcagcgccgccaactgatgggggcgggcgcgcagcccgttgatgttgaacgagacgatcttcatggtcggcagtcctggcaaaactgcgatgctagccgacaagtcgcgcggcggccagcgtggcggcagggcagatgcgctgctaaggtcgatgggcggtggaacgatcacgagcctgaaaggttcgtagctataacaaccgcgcagaagaacgccgccacccagcgcggtcacttcaagccgggcccaggggagaccaatcgccatgcctgaaacctcgactgccatcgccgacattcacatgctcgacagcggctacgcccgcgaagcccgttccctgctgtaccaggcttatcgccatgagccgaccttcgcttatctgttcgagtccgaacgcccgggttacgaacaacgggtgcgggccacggtgcgggagctggtcaaacagcacttcattcaggacctgccggccatcggcctgctggtcaatgaccggctgatcggcatcgccctgatcgcgccgccccagcgtcgcctgggtattaccgagagttgggcctggcgcctgcgcatggtgctcagtaccggtttccgttgcacccggcgttacctggactatcacgccgcggtgctgggttgcctgcccagcgattcggtgcacgtcctgcccttgctggggattcatccgcaattccagggcaagcacttcggcgagcagttgctgcaggcggtgcacaactggtgcgcggtggacgaacactcccagggggtggtgctggacaccggcaacccgcgttacctggcgttctatgagcgccagggttatgaagagattggcgagatcgccgtcggtccggtccgcgagcacgttttctttcacgccaacccgcaagttctgcaaagcgcgaccggctgagcagaactttcctcacatttgtgcgctctatcgggctcccagctcgtgatagcattcgcgcctatgaagttttcaggaagattcaccagcggcttgttgctgctgttcacaagctgtgcggcactggcgcaaagcgaattggacgtcagggtcaaaccctccaacgatgaactcaaggccaatgtggaaggctacattggcggggttggcgatcgcgacgaggaagccctgttgcgtttcagccgtggcgccgaggagcaggcccgcaaggccgcccaggccctgggctactaccagccgcagatcagcagcgaagtcaaaggcggcgaaaagccgcgtttggtgctgaacatcgatcctggcgagccggtgcacctgcgcaacgtcaccatccgggtcgacggcccggcggcttccctcaagggctttcgtgtgcccaggagcgaccagctgaaaagcggcgcggtcctcaatcacggtcattacgaagacgccaagcggctgatccagaaccaagcgtcgcgctacggctttttcagcgggcgcttcacccggcagaagctggcggtggacccccaggccggggtggcggatatcgagctggtctacgaaagcggcccgcgttacgccctgggcaaggtcagttttgccggcgatacgccgttcgacgaagacctgctgcaacgcatggtgccgttcaaggccggaactccctacgattctgagctgatcgccgagcttaaccaggcactgcaatcgagcggttacttcgagggcgtgcgggtcgacgcggcgccgaccgcggccgccgccgaggtgattccggtggcggtccagctggaaacccgcaagccgcgcaccatgggcctgggcctgggtttttccaccgacgtcgggccgcgggccaaggctaactggacccgacactgggtcaacgcccaaggccacagctatggctgggaggcggaagtctccgcgccacggcagaacgtcggcctgttctacgacataccgctggacccgccgctgaccgacaagctgcgttttgccggcggctaccagaacgaagaaatcgccaacaccgacaccctgagtaaactgctcaccctcggtcccgagtggcacagcaaattgcccagcggctggcagcgggtcatctcgttgaagtggcaacgcgaggaataccgccttggcgacgactcgggcctgagtaccctgttgatgcccggcatcagctattcctacctgcgcagcgataaccgcatcgacccgcacaacggctatcgcctgcaattcgacagcaaggtggccaaggaagggctgggctcggacaccaacctgttatatggcaccgtgctactcaagggcctgaccacggtatgggacaaccatcgtttcctcggccgggtgcagttcggtggcagcgccaccaacggttacaagaaggttccgccgtcgctgcgctttttcgccggtggcgatcagagcgtgcgcggctacgactaccagagcctgtcgccggagaactccgacggcgaccggatcggcgggcgctacatggtggccggcagcgtcgagtatcagtactccatcgcggaaaaatggcgcctggcgacctttgtcgaccagggcaactccttcgacaaacttgaactgccgaacctcaagaccggggtcggtgtcggtgtgcgctgggtgtccccggtggggccgatccgcctcgacctggcccatgcgctggacgatgacggcggcattcgcttgcacttttccatggggcctgagctgtgaagcgtggtttgaagatcgcggcgctggcgctgcttgtgctggtggcggtgctggtactggcgctggcttcgatactcggcacccaggccggcagtcgctgggccctgggcctggtgccgggcttgagcgtggaaaacttcgccggccacttagggggacagtggagcgccgatcacctgctgtggcagcaggacagcagccgggtcgaactccaggcgccgaaattcgcctggtcgccggcgtgcctgatgcgcatgaccctgtgcatcgagcaactggacgtggagcaggtcagcctgcaattcccgccgggcgcggaagaacaaagcagcggcccgatcagcctgccggatctgcagttgcctgtggctatcgagctggggcaggtgcgggtcggtagcttgcaattcaatggcagcgaggcgctcaagggcctgcaactggcggcgcagtggacggccaagggcctgcagatcgactcggtgagcctgcaacgcgacgacctcagcctgaatctttcggggttgttgtcgcccagcggcgactggccactgagcgccaccggtaccctgaccctgccggcgccgggtagcgtgccctggacgctggcgctgaaggtcgacggcgacctgttgaagaccctcaagcttgcggcggacagcagcggttacctgcaaggccaattgagcggtgagctgcaaccgctggcggagaacctgccggcccaggtgcggatcaccgccgatggcttcaaggccagcgccgatctgcctgacaccctgatgctcaaccagctggaactgaccggcaaaggcgacctcaaggcgggttaccaactgctgggcaaggccactctgccggccgagcaggggccggtggccctggtgctgcaaggcaaggtcgacgccaagggcgcgcagatcgcagcgctggacctgagcgccaacgacaagcagaacctcaagctgaccggtcagctggactggagccagggcctgaacgccgaagccaggctcgactggctggatttcccctggcatcgcctgtacccgctgatcgaagagcccgcggtggcggtgcgccgcttcactgccgaggtcgcctaccgcgatggcaactacctgggcaacttcaagggcgacctcgatggcccggcgggggcgttcagcctcagcagcccgttcagcggcgacctgacgaaaatcttcctgccccagttcaagctggccgccggccagggcaaggccgaaggccacctgaacctgcaattcgccgacggcatcgcctgggataccgccctggacctgtcggcgatcaacccggcgtactgggtcgccgagctgccgggcactttggccgggccgctgcgcagccagggcgaaatgaagaacgagcaactcaagctcaacgccgacctcgacctcaagggcaagttgcgcggccagcccacggtgctgcaggccaaggccgatggcgctggcgagcagtggaacctgagcaccctggacatccgcctgggcgataaccgcatcaacggttccggacgcctgcaacagcgtttggccgggcaactcgatatcaagctgccgcgtctcggccagctgtggcccgagctgcgtggccagctcaacggccgcctcgatgtggccggcaccctgaaggcgccgcagggcaagctcgacctgcaaggccagcaactggtgttcgccgacaatcgcctgcagagcctcaagctcgatgccaacctggacagcgcgcaacgggcgcaaatcgacctcaagggggccggcatccaggtcggcgaaaccgcgctgggcacactgacggccagcggccagggcgatatcaagaaccagaagctgcaactggacctgcaaggcccgcagctcaagctggcactgggcctggacggcaagctggaccagggcaactggcgcgggcgcctggccagcggtgatatccagaccggtggccaggactggaggctgcaagccccggccaagctcgaatacctggccgacggcaagctcaacttcggcgcccattgctgggccagtggcgatgccagcctgtgtggcgaggatcagcggctgatgcccgagcccaagttgcgctaccacctcaagcagttcccgatcgacagcctcgcgcagtggttgcctaaggattttgcctggaagggccggctcaacgccgatatcaagctggacgtaccggccgacggcccgcaggggcggatcctgctggacgccagcggcggcaccttgcgggtcaaggaaaagcagcagtggctggacttcccgtaccagacgctgaaactcgacaccaccctcaaccccaagcgtatcgacacccagctggcgttcagtggcggcaagctcggcgagctgatgctgcagacgcagatcaatccgctgccgaaaaacaagccgctgtccggcgagttccgcctcagcggcctggacctggcggtggcgcggccttttgtgccgatggtcgataagctcaccggcaccctgaacggcagcgggcgcatctccggcggtctgctggcgccgcaggtcaatggcaacctggcgctcagcggtggcgaagtttccggccctgaattgcccatcagtctccaggacctgcaattgcaggcgctgatcgccggtgaaagcgtgcagttgagcggtggctggaagagcggcaaggctggccagggcagcctgaacggcaatatcgcctggggccaggcgctggtggtggacctgagcctgaaaggctcgcaactgccggtcaccgtcgaaccctatgcggtgctggacgtggcgccggacctgaagatctcgatgaaggacgacaagctggcgatcgccggcaaggtccatgtgcctaagggcgaaatcaccatccgtgaattgccgccatcgacggtcaaggtatcggacgacacggtgatcatcggccaccagaccgaagagggcaaagcgccgatggccatggcgatggacatcgacgtggtggtcggcgaggacaagctcagcttcaccggtttcggcctgaccgccaacctgcaaggccacgtgcacatcggcgacaacatggacacccgtggcgagctgtggctcaacgacggccgctaccgcgcctacggtcagcgcctgaccgtgcgccgggcgcgcctgctgttcgccgggccgatcgaccagccgtacctggatatcgaggcgatccgccagaccgatgacgtgatcgccggcatccgcctcagtggcagcgccgaacagccgaccacgcagatcttctcggaaccggccatgagccaggaacaggcgctgtcttacctggtgctcgggcgtcccttgagcaccaccggcgaggacaacaacatgttggcgcaagccgccctgggcctgggcctgatgggcagttcgaacatcaccggcgggctggccaaggacctggggatcgacgacttccagctcgacacccagggcagcggcaacaccaccagcgtggtggccagcggcaatatctccgagcggctcagcctgcgttacggggtgggggtcttcgagccggccaacaccatcgccctgcgctacaagctgagcaaaaaggtctacctggaagcggccagcggcgtcgctagctcgctggatatcttctacaagcgcgacttctagctcgtcggcaatccagtcccctttggcgagggggctggcgttcacccctccatccctccaggcggtaactctcccgccgattttcgacttcaaggctttcccattaattagcttaatagcgagcatgctaattattgtttggatattggctgcctaggcagtaacatctcgacatactttcgctgcctaggcagctaacaggtggtcagatgaagcacttcaccccagacgatttccacaattgccacctcgggctcttgctgggccgcgcggccctgctcaaggaccggatcatcgacacccacatggaaccccacggcatcaccgccgcgcagttcaaggtgctgatcatcatggcccagttcggcgtcgacaccccggccgagctgtgccgccacctgtccctggacagcggctccatgacccgcatgctcgatcgcctggagcagaaggatttcctcgcccgccaacgctcggagcacgaccgccgccaggtgcgcctggtgctcaccgaggagggccagaagctcgccgactgcctgccgcacatcggcgccaacgccatgaatgaactggccggcgccatcacccctgaagagttgaaaaccctggaacagatcctcaagaaaattttgctggcggccggtgacccgatcaccgtgttgcgggtaggtgataagtaaatgagcagtaaaaccttgcgtgcccgtttgagcctggtgctgctggccatgagcctggccggatgtgccaactacagtggcctgacaaccgaaggggtgagcctcgatgccaaatccctcaaggccggacaatccctgagtggcgtgaccctgtcgccggcggcctggccgaagagcgactggtggaagagcctgggcgatccacagctcgatggcctgatccgcgaggccctgcacgacagccccgacatgcagatcgccagcgcccgcgcccaccaggccagcgcggcggcctatgccgcggacgcggcacgcatgccgaccctggacgccagcggtagtgtcagccgctcgcgcctgtcccgttcgcaggacccgagcgggcagggcgacaactacagcacgatgcgcagcctgacaggcaacttcaattacaccttcgacctctggggcggtcagcgcgatacctgggaagccgccctgggccaggcccgcgccgccgagatcgatcgccaggccgcgcaactgaccctggccgccgacgtggcccgggcctacagcgacctgggtcaggcgcatatcgtccatgacctggccactgaagacctcaagcgcacccggcagatgctcgacttgagccagaagcgcctgagctcgggcatcgacagccagtatcagtaccagcagaccgaaagcctggaggccagctccgaagccagcctgatcgacgccgagaaaaacctgcagagcgccaagatcgccctcgcggtattgctcggcaaaggcccggaccggggcaacgaaatcgcccggccgaaagtcttgcaggccagcgcggtggcactgccgtcggtgctgccggcggaactgctgggccgccgtccggacctggtggccgcgcgctggcgggtcgaggcggcgagcaagagcatcgacgccggcaagaccaacttctatcccaacctcaacctgagcgccgctgccggcactcaagcgttgctgggggatgcgatgttcgggtcggccagccgcttcttcaatatcgccccgaccgtgtcgctgccgatcttcgacggtggccgcctgcgcgccgacctggatgcccgggacgccgactacgacctggccgtggcgcagtacaacaagagcctggtgaatgccctgggggatgtcagcgacaccatttcccagctgcgtgacatcggtcggcagatcgccgcccagcaacacgccaccgacatcgcccaggactcctacgacaccgtggtccagcgctacggctcggggatcggcaattacctggacgtgctcagcatcgagcagcaattactgcaggcccagcgtcagctggcgaccctgaatgcccagcagatcgacctgtcgatccaactgatgcaggccctgggcggtggtttccagaccgacaatctggccgcggccaccccgaccccagcctcgcgcactcaataattcaaggtactcatcatggccactgtcgaaaccaacaacgctcccgaaaacaccccggacaccgccaacccgcgcaagcgcaaggtcatgctgctgggcctggtggcgctgatcgtcctgggcgggctgggggtctttgcctggtatgaactctacggacgctggaacgaaggcaccgacgacgcctatgtgaacggcaacgtggtggaaatcaccccgctggtcaccggtacggtggtcagcatcggcgccgacgatggcgacctggtccacgaaggccaggtgctgatcaacttcgaccccaacgatgccgaggtcggcctgcaaagcgccgaggccaacctggcccgcaccgtgcgccaggtgcgcggcctgtacagcaatgtcgacggcatgcgcgcccaggtggcggcgcagaaggccgaagtgcagaaagcccaggacaacttcaaccgtcgccggaccctcgccagcagcggggcgatttcccaggaagaactgtcccacgcccgcgacgacctgacctcggcgcagaacgccctggccaatgcccagcagcagctcaacaccaccaacgcgctggtggacgacaccgtggtgtcgaaccatccggacgtgcaggcggccgccgcacagttgcgccaggcctacctgaccaacgcccgcagcaccctgatcgcgccggtgaccggttatgtcgccaagcgcaccgtgcaactgggccagcgggtgcagccgggcaccgcgttgatggcggtgatcccgctcgaccaactgtggatcgacgccaacttcaaggaaacccagctgcgtgacatgcgcatcggccagccggtggacatcgaagccgatatctacggcagcgacgtcaagtacagcggcaccatcgacagcctgggcgccggtaccggcagtgccttcgccctgttgccggcgcagaacgccaccggcaactggatcaagatcgtgcagcgggtgccggtgcgcatccatgtgaatgccgaagagctggccaggcacccgctgcgggtcggcctgtcgacggtggtcaacgtcgacctgcatgaccagagcggccccgtgctggcccagcagccgccacaaaaggcatcgttcagcaccaacgtctacgaccgccaactgggtgaggccgatgccctgatcgcccgcctgatccacgacaacagcgccgccatcggcaagaccgcgcagcgctgattcgccgatccctctgctgcggccgttagcggccgcggcgcctgcctcgcttcataggattcgcgatgagcaataacgcttctttcacgccgcccagcctgttgctcagcaccatcggcctgtcgttggcgaccttcatgcaggtgctcgacaccaccatcgccaacgtggccttgccgaccatctcgggcaacctcggggtgagttcggagcagggcacctgggtgatcacctcgtttgccgtgagcaacgccatcgccttgccgctgaccggctggctgagccggcgcttcggcgaagtgaagctgtttatctgggccaccctgctgttcgtgctggcctccttcctctgcgggatttccacctccatgcccgagctggtgggctttcgtgtgctgcaaggggtggtggccgggccgttgtacccgatgacccagaccctgctgatcgcggtctacccgccggcgaaaaggggcatggccctggcgctgctggcgatggtcacggtggtggcgccgattgccgggccgattctcggcggctggatcaccgacagttacagctggccgtggatcttcttcatcaacgtgccgatcggcctgttcgccgcctgggtggtcaagcagcagctgaaggcgcggccggtggtgaccagtcgccaaccgatggactacatcggcctgctgagcctgatcgtcggcgtcggcgccttgcagatcgtgctcgacaagggcaatgacctggactggttcgaatccaacttcatcgttatcggtacgctgatttcggtgattgccctggcggtgttcgtgatctgggaaatgaccgaccgccatccggtggtcaacctgcggttgttcgcccaccgcaacttccgcatcggcaccatcgtgctggtgggcggttatgccggcttcttcggcatcaacctgatcctgccgcagtggttgcagacccagatgggctacaccgcgacctgggccggcctggcggtggcgccgatcggcatcctgccggtgctgatgtcgcctttcgtcggcaagtacgcgcacaagttcgacctgcgcttgctggccggtctggcgttcctggcgatcggcctgagctgcttcatgcgcgccggcttcaccaacgaggtggacttccagcacatcgccctggtgcaactgttcatgggtatcggcgtggcgctgttcttcatgccgaccctgagcatcctgatgtcggacctgccgccgcagcagatcgccgatggcgccggcctggccactttcctgcggaccctgggcggcagcttcgccgcgtcgttgaccacctggatctggatccgccgggcgaatgagcaccatgcctacatgagtgagcacatcagcagcttcgagccggccacccgcgatgccctgaacgccttgggcggtgccagcaaccaggcctatgcgcagttggaccaggtgctgaccgggcaggcgtacatgatgtccaccgtggactacttcacgctgctgggctggagcttcatggcgctgatcctgctggtgtggctggccaagccaccgttcaccgccaaggccgggccggcgtcggcggggcattgagggtgcggtagggcagaggaattatcgcgagcaagctcgctcctacaaaaaggtacgtcttcctgtaggagcgagcttgctcgcgattgaacgcacagcgttcgcctggaaggcctcgcaaggcccttcgggccttatcgcagcctgcggcagcggctacaggcggggcaatgcctgctgtgacggcacgaagtcgaaagctgccagctggaagccctgttcatccacctgcaaggcccagccctgacggtcccagtcgcccagcacgatgcgcttggcggcctggtcgccgatctgcaacttgtggatggccgggcggtgggtgtggccgtggaccagggtccgcaccttgaatgcctgcatgatccgcggcacttcgtccggggtcacgtcgacgatgtcgttggccttcatgcgggtttgcgcgcggctttcattgcgcagtttgcgcgccagcttgtgtcgggtgcgcagcggcaggtgcctgaggatccacaacgaaaccgggttacgcaggtagcggcgcatgcgcatgtaggcttcgtcgcgggtgcacaggctgtcgccgtgcatcagcagcaccggctcgccgtagaagtcgaccacgctcgggtccttgagcagggtcgcgcccgcggccttgcagaaggccttgccaagcatgaagtcgcgattgccatgcatcaggaaaacctgcgtgccgctgtcgctgagctcgcgcagtgcctggcaaatggaaagctggtagggggtcatggcgtcgtcgccgatccagacctcgaagaaatctcccaggatatacagcgcttgcgccgagcgggcacgcccgcccagtaaatccagaaacgcccgggtaatgtccgggcgctcctcttccagatgcaaatctgaaatcagcagtatcactcaacgatctcggctttctcgatgatcacgtcttctgccggtacgtcctggtggccggccttcatggtggtggccacgcctttgatcttgtcgaccacttcggtgccggcgaccactttgccgaataccgcgtagccccagccctgcacggtcttgccgctgtggttgaggaagctgttgtcagcaacgttgatgaagaactgcgcggaagccgaatgcggctccatggtgcgggccatggcgacggtgtacttgtcgttggaaagaccgttgtcggcttcgttctggatgcttggacgcttgtctttcttttctttcatgcctggctcgaaaccgccgccctggatcatgaagttaccgatgacgcggtggaacacggtgttttcgtaatgaccggctttaacgtattcgatgaagttggccacggtgaccggggctttctcggcgttcagttccagcacgatgtcgccgtggttggtggtcagtttgacttgggtcatgatcggtactctttataaggaggagcgttttcaaggaattcccgggttccaggaggcaggcatggggcccgcgggccggaaccgcgctggcaaaaatccgccaaggtgcgcagtttagcgtgccgggcgtgaaattcgaggctgttttttcatttgcgacggattaatcgcggcagatttaaagcccgctctgtcaggggcttgaccgcatcggctatgatatccgttttgatttatcaggccgcaccggccgcgcacttgtacgttcaaggatcctatgagcaagcccactgtcgaccctacctcgaattccaagaccggaccggccgttccggtcaacttcctgcgcccgatcatccaggcggacctggactcgggtaagcacacacagatcgtgacccgcttcccgccggaacccaacggctacctgcacatcggtcacgccaagtcgatctgcgtgaacttcgggctagcccaggaattcggcggcgtcacccacctgcgtttcgacgacaccaacccggccaaggaagaccaggaatacatcgacgccatcgaaagcgacgtcaagtggctgggcttcgagtgggccggtgaagtgcgctacgcctcgcaatacttcgaccagctgcacgagtgggcggtggagctgatcaaggcgggcaaggcctatgtcgacgacctgacccccgagcaggccaaggaataccgtggcagcctgaccgagccgggcaagaacagcccgttccgcgaccgttcggtggaagagaacctggacctgttcgcccgcatgaaggcgggcgaattcccggacggcgcacgcgtgctgcgggccaagatcgacatggcctcgccgaacatgaacctgcgcgacccgatcatgtatcgcatccgccatgcgcatcaccaccagaccggcgacaagtggtgcatctacccgaactacgacttcacccacggtcagtcggacgccatcgaaggcatcacccactcgatctgcaccctggagttcgaaagccaccgcccgctgtacgagtggttcctggagaacctgccggtgccggcacagccgcgccagtatgagttcagccgcctgaacctgaactacaccatcaccagcaagcgcaagctcaagcagttggtggacgagaagcacgtcaacggttgggacgacccgcgcatgtcgaccctatcgggcttccgtcgtcgtggctacacgccgaaatccatccgcaacttctgcgagatggtcggcaccaaccgttccgacggcgtggtggacttcggcatgctggaattcagcatccgtgacgacctcgaccacagcgccccgcgcgccatgtgcgtgctgcgtccgctgaaggtggtgatcaccaactaccctgaaggccaggtcgagaacctcgaactgccgcgccacccgaaagaagacatgggggtgcgggtgctgccgttcgcccgtgaaatctacatcgatcgcgacgacttcatggaagagccgccaaagggctacaagcgcctggaaccggccggcgaagtgcgcctgcgcggcagctacgtgatccgcgccgacgaggcgatcaaggacgccgatggcaacatcatcgagctgcgttgctcgtacgacccggacaccctgggcaagaacccggaagggcgcaaggtcaagggcgtgatccactgggtgccggccgccgccagcgtcgagtgcgaagtgcgcctgtacgatcgcctgttccgttcgccgaacccggagaaggccgaagacagcgcaagtttcctggacaacatcaaccctgactccctgcaggtcctcactggttgtcgtgccgaaccctcgctgggcaacgcacagccggaagaccgtttccagttcgagcgcgaaggttacttctgcgcggatatcaaggactcgaaaccgggcgcaccggtattcaaccgtaccgtgaccctgcgcgactcctggggtcagtgatcagttaaggaactccttgtgctaacgatctacaacacgctcaccaagagcaaagaagtcttcaagccgctcgatggcaacaaggtgcgcatgtacgtgtgcggcatgaccgtgtacgactactgccacctgggccacggccgcagcatggtcgccttcgacctggtgacccgctggctgcgtttcagcggctacgatctgacttatgtgcgcaacatcaccgacatcgacgacaagatcatcaatcgggccaacgagaacggcgaatcgttcgaggcgttgaccgagcgcatgatcgcggcgatgcacgaagacgaagcgcgcctgaacatcaagaagccggacatggagccgcgtgccaccgaccatatcgccggcatgcacgcgatgatccagaccttgatcgacaagggctacgcctacgcgccgggcaacggcgacgtgtattaccgggtcggcaagttcctcggttacggcaagctgtcgcgcaagaagatcgaagacctgcgcatcggcgcgcggatcgaagtcgacgagtcgaaacaggacccgctggacttcgtgctgtggaaagccgccaagccgggcgagccgagctgggaatcgccatggggcgccgggcgtccgggctggcacatcgaatgctcggtgatgtcgacctgctgcctgggcgaaaccttcgacattcatggcggcggcagcgacctcgagttcccgcaccatgaaaacgagatcgcccagagcgaggcggccaccggcaagacctacgccaatgcctggatgcattgcggcatgatccgcatcaatggcgagaagatgtccaagtccttgaacaacttcttcaccatccgcgacgtgctcgacaagtaccatccggaagtggtgcgttatctgctggtgtcgagccactaccgcagcgcgatcaactactcggaagacaacctcaaggacgccaagggcgccctggagcgtttctaccacgccctcaaaggcctgccgactgtaccggccgccggtggcgaagccttcgtcgcgcgtttcaccgaggtgatgaacgacgacttcggcacgccggaagcctgtgcggtgctgttcgagatggtgcgcgagatcaaccgtctgcgtgagagcgatcttgatgcggcggccggtctggcggcgcgcctgcgggaactggcggacgtgctgggtgtgctgcagctggacgccgacgacttcctgcaggccggtgccgaaggccgggtcgacgcagcgcaggtcgaagcgttgatccaggcgcgcctggcggcccgggccaacaaggactgggccgagtccgaccgcatccgcgaccagatcactgccatgggcgtggtgctggaagacggcaagggtgggacgacctggcgtctggctgactgattgctgtactggctataaacagaaacccgccttgtgcgggtttttgtttgcctgccattcgggggcagggggcgatcactcctcctgctggcgcaatcttttatagagggtattgcgactcacccccagccgtcgcgccagctgggagatgttgccgcccacggccttgagctggcggtgcaggtcggcgctgtcttgcaggtcgatgtcgccgggcggttcgtggcttgtggctggctccatgtccaggtcgacaaaaaagtcgtcgggcaggtgctcggcgcggatcggctgttcttcggccatggccagcgccacctgcatcacactgctgacctggcgcaggttgcccggccagggatggcgctcgaacagttcctggacgtcgcggctgagcccggcccattggccggactcgcggtgctgttcccagatgcgcttgaacagcgcctgtttgtcgctgcgttcgcgcaggggcggcaactccagggtcaggccgccgatgcggtaatacaggtcctcgcggaaacgcccgagttgtacctgttcgcgcagggagcggttggtcgcggagatgatgcggatatccaccgggaacagctcgctgctgcccaccggttgcacgcagcgctcctgcagcacacgcaacaggcgggcctgggtcggcaagggcatgtcgccgatttcgtcgaggaacagcgtgcctttgtcggccttgcggatcaggccaatgctgcctttctggttggcgccggtgaaggcgcctttttcatagccgaacagctcggactccaccagttcggcgggaatcgctgcgcaattgacggcaatgaacgcctgtttgctccgcgagccggcctggtgcagggccttgacgaaaacttccttgccgacgccggtttcgccgtggatcagcagcggaatgtccttttccagcagccgttcggcctggcgcacggctttctccacccggctgtcgccgaagtgcagggtgttcaggctgatggcatcggcgctggcgggagccggacgggaaggtggctcgacgaagacccgagcctggatcggcacctgccttggacgcttgagcaggcaatggaaacggttacggccggcggcctgcagggcgaagggcaggccttcgggctggttgagcaattccagcagggacaccttgaacaggctttcgatgccgacccgcgacagattgatgcccagcaggttgtcggcgcggcggttggccgaaagcacctggccgctgtcatcgaagatcaacaggccggcccattggctgtcgaggttgttcaggccggtgttgaaggtcagctggaaatgccggccttggaacaggttgaggatcagccggttctccacggtctggctcatcatcttgaccatgcccagggtgtgggagggcggcaggtagctgtcgctggagacgtccagcaccgcgatcacccggcgctcggcatcgaagatcggcgcggccgagccggtcatgaagcggttggccttgagaaagtgttcatcgtgctcgatatgcaccgcctgttcgcaagccagggcggtgccgatggcgttggtcccgctgcagtgttccagccagctggcgccggcgctgaaaccacgggccaggctcggctcgataaaacgctgggtgccccaggacgtcagcacctggccctggttgtcggcgagcatgatcaggcaattggagttgctgaggatgttctcgtagtagggcaggacttcctggtgggtggtctgcaccagggcatgctggctctccagcaactgggcgatgcgctcggcgggcagttgatcgaaggcgggcgtgctctggtggctgaggccaaaggcccggcagcgactccaggagtccttgatgatggtctcgtgagacagcggtgaggcaggtgcgctcatggcggtaggtctctgaaaacgcttttattgttgttattggcctatgcccgggtgtagccgctggcgcaggctgcgatcaagctgggcggcattccgacgtagcgctcgcaaaccaggcatcgcgattcgtctggttgaccgcgtcgttcactttgcgagtcctgcggcctcgatcgcagcctgcggcagcggctacaggtggcgtttacgggcaaaagcgtccatccagtgttgttcactcttgttcattgtcaaccgccggactgttcagttgttcagtgcgggttgttcatttctgttcagctgtgaaccttccaatagcctgtcttttaataaatatcaggcttatcagtggcttggttcggtgccacggttctggcacgaaagtcgctctgctgctgcggtcgcttgactccaataataaaaaaggccgagccatgtcattaacgctggagcacgtcagccgtgtcgtcgagggccagacctggatcgatgacatctcgctgcgctttgaacccggttccttcaatgtcctgctggggcgcacgctgtccggcaagaccagcctgatgcgcttgatcgccgggctcgacaagcccgccagcgggcgcatcctgatgaacggcgtggacgtcactgggcgcccggtgcggctgcgcaacgtgtcgatggtctatcagcagttcatcaactacccgaccatgaccgtgttcgagaacatcgcctcgccgctgcgccaggccggcgtcgccgcgccgctgatcgagagcaaggtgctggagacggcgaagatgctgcggatcgagaagttcctgcagcgccatccgctggagctgtccggtggtcaacagcagcgcacggcgatggcccgggcactggtcaaggatgccgaactgatcctgttcgacgagccgctggtcaacctcgactacaagctgcgcgaagaactgcgccaggagatgcgcgagctgttccaggcccgccacaccatcgccatctatgccactaccgagcccaacgaggcgctggccctgggcggcaccaccaccatcctccacgaggggcgcctggtgcagagcggcaagaccgccgaggtctatcaccagccccagaccgtgctggccgccgagctgttctccgaaccgccgatcaacctgatgccggggcgcatcgccggcaatgaagtgagcttcgccaatttcgtgcactttccgctgaacgtcgatctgcgcccggtcggcgagggcgagttccgcttcggcgtgcggcccagccatatctccctggtaccgagcaacgacgacgacctggagctggcggtgaccgtcgaggtggcggaaatcagcggctcggaaaccttcctgcatgtgcgcaacgaacaattcctgttggtgctgcacctgcccggcgtgcacgaatatgacgtcgacgcgccgatccgtatctatatccccacccacaaactattcgtcttcgatgcccagggccgtctggtccaggcgccggggcggcgcgtcgcgagggttgcctgatggccgagatccgtttgcacaacctcgcccacagttacaccagtaccccggccggtcccgaggactatgcgatccgcgagatgaaccatgtctgggagcagggcggcgcctatgccttgctcgggccatccggctgcggcaagtcgaccttgctcaacatcatttccgggctgctcagcccgtcccaggggcaggtgctgttcgatacccgggtggtcaacgagctgactcccgagaagcgcaacatcgcccaggttttccagtttccggtggtctacgacaccatgacggtgttcgacaacctggcctttccgctgcgcaaccagggcctggccgaggccaaggtgcacagcaaggtgcaggagattgccgaggtcctcgacctgcaggcgctgctgaataagaaggcgcgcaacctcagcgccgacgaaaagcagaaggtttccatgggccgcggcctggtgcgcgacgacgtatcggcgatcctgttcgacgagccgctgacggtgatcgacccgcacctgaagtggaagctgcggcgcaagctcaagcagatccacgagcagttcaacatcaccatggtctacgtcacccacgaccagctcgaagcctcgaccttcgccgacaagatcgcggtgatgtacggcgggcagatcgtccagttcggtaccccgcgggagttgttcgagcggccgagccacacctttgtcggctacttcatcggcagcccggggatgaacctgatcgaagtccgggcagaggccggcggtgtcaggttcgccgggacccatctggccttgcccgaggcgttgcagcagcgaatcgccgagaccgattaccagagcctgaaagtcggcatccgcccggagttcatccatgtctgggacgagccttacgaggaggtgctgcaggccgacgtggtccacatcgaggacctgggcacctacaagatcatgaccctgaacctcgacggcgcggtcttgaaagtgcggctggccgaagacaaaccggtgccgcagggcagggcctgcatcagcttccccgcgcagtggctgatggtctacgccgacgaatacctgctggaggcccacgccacgaacgaggtacagccatgaacaaagtgcagaacaacaaagcctggtggctggtattgccggtgttcctgctggtggccttcagtgcggtgatcccgatgatgaccgtggtcaactactcggtgcaggacattttcgaccagtccagccgctatttcgtcggcgccgactggtaccgccaggtgctgctcgacccgcgcctgcacgactcgctgctgcgccagttcatctattcggcctgcgtgttgctgatcgagattcccttgggcatagccatcgccctgaccatgccgagcaaggggcgctggtcgtcggtggtgctgatcatcctcgccattccgctgctgatcccgtggaacgtggtgggcaccatctggcagatcttcggtcgcgccgacatcggcctgatgggctcgtcactgaatgccctgggcatcgattacaactacgcggccaacaccatggatgcctgggtcacagtgctggtgatggacgtgtggcactggacttcgctggtggcgctgctgtgcttttcggggctgcgggcgatcccggacgtgtattaccaggcggcgcgcatcgaccgggcgtcgaactgggcggtgttccgccatatccagttgccgaagatgaaaagcgtgctgctgatcgcggtgatgctgcgcttcatggacagcttcatgatctacaccgagccgttcgtgctcaccggcggcgggcccggcaacgccacgactttcctcagccagaccctgacccagatggccataggtcagttcgacctgggcccggccgcggcgttctccctggtgtacttcctgatcatcctgctggtgtcctggctgttctacaccgccatgacccactccgacgccaatcgttgaggacggccgccatgaccaagcgcaagctgataccgctgctgatctacatcctgttcctgctggtgccgatctactggttgctgaacatgtcgttcaagagcaacaacgagatcctcggcagcctgaccctgtggccccaggacttcacctggcacaactacaaggtgatcttcaccgaccccagctggtacaccggctacctcaactcgctgtattacgtcagcctgaacacggtgatttccctgagcgtggcgctgccggcggcctatgcgttctcgcgctaccgcttcctcggtgacaagcacctgttcttctggctgctgaccaaccgcatggcaccgccggcggtattcctgctgccgttcttccagctgtattcgtccatcggcctgttcgatacgcacattgccgtggccctggcccactgcctgttcaatgtgcctctggcggtgtggattctcgaaggcttcatgtccggggtgccgaaggaaatcgacgagaccgcctacatcgacggctacagctttcccaagttcttcgtgaagatcttcgtcccgctgatcggttcggggatcggcgtgacggcgttcttctgcttcatgttttcctgggtcgagctgttgctggcgcggactttgacctcggtgaacgccaagccgatcgccgcggtgatgacccgcaccgtgtccgcctccggtatcgactggggcgtgctggcggctgccggggtgctgaccattctgccgggcatgctggtgatctggtttgttcgcaaccatgtggccaagggctttgccctgggccgggtatgaggatccgttgatggaatggatgaactggaccgccccgacggcggcattcttcggtgtcattgccttgatcctgctgggcatgaccacttgggagctgcgttcgccgagcatccctcggcgaggcttcctgccgattgccaccacccgtggcgatcgtctgtttatcggtcttctcggcagcgcctacctgcatctgctggtaatcggcgccaccgactggagcatctgggtggcgttcgtgctgtccctggtgtggctgttggctgtgatgcgttggggctagccgggcgcgtgcgcggtggtcctgcttcgaaattcaaccgggaggtctctatgttcgacaaaaacaataagctgcgacatagcgtttcattggcggccatgctggcactgagtggcttgagcgcgacggcctgggccgacgcctatgaggacgccgcgaaaaaatggatcggcagcgagttcaagccatccaccctgaccgcggaacaacagctggaagagttgaagtggttcatcaaggcgtccgagccgtttcgcgggatgaagatcaacgtggtctcggaaaccatcgccacccatgaatacgagtccaaggtgctggccaaggcttttagcgaaatcaccgggatcaagctgacccacgacctgctgcaggaaggtgacgtggtggagaagctgcagacccagatgcagtcggacaagaatatctatgacggctgggtcaacgactccgacctgatcggcacgcactttcgttatggcaagaccgagtccatcaccgacctgatggccaacgaaggcaaggactacacctcgccgaccctggacatcaaggacttcatcggcatctccttcaccaccgcgccggacggcaagatctatcagttgcccgaccagcagttcgccaacctgtactggttccgcgccgactggttcgagcgggccgacctgaaagccaagttcaaggagaagtacggctacgagctgggtgtgccggtgaactggtcggcctatgaggacatcgccaagttcttcagcgaggacgtcaaggagatcgacggcaagcgggtctacgggcatatggactacggcaaaaaggacccgtccctgggctggcgcttcaccgatgcctggttctccatggctggcggcggcgacaagggcttgcccaacggtttgccggtggacgagtggggcatccgcgtcgaggattgccatccggtgggttccagcgtgacccgcggcggcgacaccaatggcccggcggcggtgttcgccaccaccaagtacgtcgagtggatgaaaaagtacgcgccaccggaggcggcgggcatgaccttctccgaatccggaccagtgccgtcccagggcaatatcgcccagcagatcttctggtacaccgccttcaccgccgacatgaccaagcccggcctggcggtgatgaacgccgacggcacgccgaaatggcgcatggcaccgtcgccgcgtggaccgtactgggaagaaggtatgaagctgggctatcaggacgtgggttcctggaccttcatgaagtccaccccggagaagcagaaactcgcggcctggctctatgcccagttcgtgacctcgaaaaccgtgtcgctgaagaaaaccatcgtcggcctgacaccgatccgcgagtcggacatcaactcccaggcgatgaccgacctggcgccgaagctcggtggcctggtggagttctatcgcagcccggcccgggtgcagtggacgccgaccggcaccaatgtgccggactatccacgcctggcacagttgtggtggagccatatcgccgaagccgccagtggcgagaaaaccccgcaacaggcgctcgatggcctggccaaggaccaggacgcgatcatgacccggctcgagcgctcgaaagcccaggccacctgcgcgccgaaaatgaaccccgagcgcgacgcgcaatactggttcgaccagccgggcgcgccgaaaccgaaactggccaacgagaaacccaagggggaaaccgtgagctacaacgaactgctcaagtcgtgggaggcagcgcgcaaataaggttgtggatcggtaatgcgcaacggcaccttcgggtgccgttttttttcgaggcgcgcgatgattgcgttgtcgctttcgcgagcaagcctaccctggctgcttcgtggcgcaggtgccgatggtcttcagttctgtaggtgtagagggttgccgctcgattgctcgcgacagcgtcctggtgggtagtgtgatcttgccgtggcgttcatctgccagcgcttcaaggccttcgatcaactcggaaaagatgtctcgtctcatcgtctttccttgcctctatttgagtgtgacgtgtggagttcactttaaagccaggcacagttcgggtatgtcaggcatcacggatttgcttgaagggcaattcgcagggcaggggagggccgtgcccataaatgcaaaacggcgcccgaaggcgccgtcttgttttaccgcggatcgtgcttgagcgatcagcccgccagaccggattgctggaccagggtcagcagcggttgtgggtagacgccgaggaagaacgccaggaccgcgatcgccagcagcatcacgccgccggctttctgttcccagtgcagctgggcgtcgacgcggcgcaggttcggctcgatcaggtacagggtgaccatgatgcgcaggtagtagaacacgccgatggcgctgcccaggaccagggaaccgaccagccaccattggtgcgcttcgacaccggtggcgatgatgtagaacttgccgatgaagcccgcggtcagcgggataccggccagggacagcatcatcacggtgagtacggcggtcaggtacggacggcgccagaacaggccgcggtactcgtacagggcatccgcgtcgcgccccttgtagggcgaggacatcagggtgatcacgccgaaggcgccgaggctggtgattacgtaggtgactaggtagacgccgatggcttccatcgccaggcccttgctcgccaccagggcgatcagcaggtaaccgaagtgggcgatggacgagtaacccagcagacgcttgaggttgctctgggtcagcgccagcaggttgccgaacaggatcgaggcaatcgcgatcagggtcagcacggtgttcaggacaccgctgctggccaccggcgagatctggaacagacgcaccatcaccgcgaataccgccaccttgctcgcggtggccaggaaggccgccacaggcgccggggccccttcgtagacgtccggggtccacaggtggaagggtaccagcgacagcttgaacgccaggccgatcagcatcatgcccaggcccagttgggccagcgggctaggcaggccggtcgcggccagggcctgaccgatgccattgaagctcaggctgccggcttcggcgtagagcagggccatgccgaacagcaggaacgcggaaccggcggccgacagcaccatgtacttgatgccggcttccagcgagcgcttgttgaagaaggcataagccaccaggccgtagaccggtaccgagagcagctccaggccgatgaacaagccggccaggtgctgcgcgctgaccagcaccaggccaccggcggcggccatcaggatcagcaggtacagctcttcgcggttgcccgggtaaccggtgccgccgtcgcccaggtaggcatgggcgagggtgacgcaggccagggtggccaccaggatcagcgccatgtacaggcaggcgaactggtcgatctgcagcaatggagtcaccgccagaggggtgactttcagggccgggaggatcgacagcaacgccaggttcagaccggcgaccgacagcaggaaggtttgcgaatggttgcgacgccaggcgatagccagcatcaccacaatgatggtgaggctggtgatcaacagcggcgcaagcgcgataaagtgttgaatcgtaaagtccatagcgctcttaccgggccgaagcgagttgagtgaaggcggtgccgagccattgctgcacgccactcatggtggcggcagaggtatcgaggaacggttgcgggtagatgccgatgtaaatcagcagtgccgccagtccgaccaccatgatcagttcgcgagcgtccatgccgtgcaggaccgcgtccgacttggccgggccgaagtaggcgcggtgaatcatgatcagcgaatagaccgaaccgaacaccaggccagacgtcgcgagcacggtgacccatggggcgcgggcgaaggtgccgatcaggatcaggaattcgccgacgaagttaccggtcgccggcaagcccagcgaggctgctgcgaagaacaggctgatggctggcaggtaggcgatcttcgaccacaggccgcccatttcacgcatgtcgcgggtgtgggtgcgttcgtacagctggccgcagaggataaagagtgccgccgccgacagaccgtgcgcgagcatctggatcaccgcgccctgcagggccagctggctgccggagtagatgccgatcagcacgaagcccatgtgcgaaacgctggagaatgccaccaggcgcttgatgtcggtctgggcgaaggccaggaaggcaccgtagaagatcccgatcagacccagggtcatggcgatcggcgcgaactcggccgaggcattcgggaacagcggcagggcgaaacgcagcaggccgtaggccgcggtcttcagcaagataccggccaggtccacggaacccgcggtcggtgcctgggcgtgggcatcgggcagccaggagtggaacggcaccaccggcagtttcaccgcgaaggcgatgaagaagccgagcatcagcacgtactcggtggtggtcgacatcttggtcttcaacaggtcggcgtagttgaaggtgatcacgccagtgtcgttgaagttgaccagcaccagaccgaggatcgccaccagcatgatcaggccggaagcctgagtgaagatgaagaacttggtcgcggcgtagatccgggttttcttgccgtccgaagaactgtgaccccagagcgcgatgaggaagtacatcggcaccagcatcatttcccagaagaagaagaacatgaacaggtcgagggcgaggaacacgccgacgacaccgcccaggatccacatcaggttcaggtggaagaagcccacgtgacgctggatctctttccaggagcagaggacggacagcacgcccaggaggccggtcagcaggatcatcaacagcgacaggccatcgagggccaggtgcacgttgatgccgaagcgctcgatccagacgtgcttgaactccagggtccaggtcggatcggcgccaggtgccggagcgaatgaatagtcgccatgggcccacagccagaggccgagagcgagttccagggacatggtcagcagcgcaatccagcgggggagggtggcgccgaagcgctcacccatccagcacagcaggccgccgatgaaggggatcaggattagccaaggcagaatcatgacgggctcaattcctttcgcaagttcgcaaggttcatatcagaccgctaccagcacgacggcgccgataaccagcacggcaccagcagccatcgaggcggcgtaccaacgcagttgaccggtttccgtacggctcagggagttgtggccccctttggccaggcgcgggatcagaccgatggtctggtcgagcgggtctttgcgcagtacatggctgatcgccagatatggcttgacgaacagtttgtcgtagatccagtcgaagccccaggcagcgaaccaccaggctgagaggatgcggccgatgccgctgttggcgacggcggtaacgaagcgacgcttgccgaggaacagcagcgcggccagcaggataccggcgatggcgatggcgcccgacgccagttccaggctgtgcttggcttcgccgccggcatggccgacgctgagtggcagcacaccgtgcagcggtggtgtgatcatggcgccgacggcggtcgacagaatgatcagcaccgacagcggcagccagtggctgatgccgtggccggcatgggcttcggtcttggcttcaccgtggaaggtgatgaagatcaggcggaaggtgtacagcgaggtcatgaaggcccccaccagaccggcatacagcaggccgtggttaccgctggcgaaggcttcccagaggatctcgtccttggagtagaaaccggcggtgaccagtggcagggccgccagggccgcgccgccgacgatgaagctggcgtaggccagtggcagtttcttccacaggccgcccatcttgaagatgttctgctcgtggtggcaggcaacgatcaccgcaccggaggcaaggaacagcagggccttgaagaaagcgtgggtcatcaggtggaagatcgcgccgtcccaggcaccaacgcccagggccaggaacatgtagccgatctggctcatggtcgagtaggcgaggatccgcttgatgtcggtctggaccagcgcggcgaagccggccaggaccagggtcacgccaccgacgacgcccaccaggtgcaggatatccggcgccagggagaacaggccgtgggtacgggcgatgaggtagacaccggcggtcaccatggttgcggcgtggatcagtgccgaaaccggggtaggaccggccatcgcgtccgccagccaggtctgcagcggcagctgggcggatttaccgaccgcgccacccagcagcatcagggtcgccaggacgatccagaagtcgccggcctggaacttcgcaggcgccgcgaccagcagttgctggatattcagggtgcccagctgctggaacaggatgaacaggccgatggccatgaacacgtcgccgatgcgggtgacgataaaggccttgagtgccgcgttaccgttgttgcggttgctgtagtagaaaccgatcagcaggtacgagcacaggcccacgccttcccagccgaagtacaggaacaacaggtcatcgccgagcaccaggaacagcatgctggcgatgaacaggttggtgtaggcgaagaagcgcgagtaaccgtcttcaccgcgcatgtaccaggacgcgaacaggtggatcaggaagcccacgcccaccaccacgccgagcatggtcacggacaggccatccagatacagggcgaaggtcggcttgaagtcgcctacggtcatccactgccacagcacctgggtgtagtggccgccttccggcggggcgacgttgaattgccagatcacataagccgcgacaatcgccgacaggccaacggagccgacaccgatcagggcggcgaggttttccgagaggcgtcctcgggagaacgacagcagcaggaaaccgatcagggggaacaggaaagtcagatagagaaggttcatccgcgcatctcgctggcagcgtcgatatcgagagtgtggaagcggcgatacagctgcaacaggatcgccaggccgatactggcctcggcagctgccaggctgatcaccaggatgaacatgatctgtccatccggctgcgcccatctggcacctgcgacgatgaaggccagggcggaggcgttcatcattacctccaggctcatcagcacgaagagaatgttgcggcgcaccatcaggccgaccaggccaaggcagaacaggatgccggcaacggccaggccatgctccagagggatagttccgatcgtaggcatgttcttactccttcgcctcgttgcggcccaggtggaacgccgtgacggctgcggcgagcagcagcatcgaggcgagttcgaccaccagcagataaggaccgaacaggctgatgcccacggccttggcgtccacggtggtgtggccgacaccggtaccgctctggtggctgaacagcacgtacagcagttccaccagcagcagggcggcgagcaccaccggccccagccagattcccggcttgagccagatgcgttcctgctgaaccgaggcaggccccaggttcagcatcatcaccacgaacacgaacagcaccatgatggcgccagcataggcgatcacttccagcacaccggcgaacggcgcgccgaggctgaagaaggtcatcgccacggcgatcagcgaaatgatcaggtagagcagggcgtgcacagggttggtgttggtcaccacgcggagcgtggagacaacggcgacacctgacgcgaaatagaaagcgaattccatctttcttccttaaggcagcaagctcttcacgttgatcggctcggcttcgttttgcgcggagccttttggcttaccggcaatggccatacctgcaacacgatagaagttgtaatcagggttctttccggggccggagatcagcagatcttctttctcgtaaaccaggtcctgacgtttgaactcggccatctcgaaatccggggtcagctggatcgcggtggtcgggcaggcttcctcgcagaggccgcagaagatgcaacgcgagaagttgatgcggaagaagtccgggtaccagcgaccgtcttcggtttcagctttctgcagcgagatgcaacccaccgggcatgccacggcgcacaggttgcaggctacgcaacgctcttcgccatcggggtcgcgggtcagcacgatgcggccacggtagcggggcggcaggtagaccggctcttccgggtattgcagggtgtcgcgcttgcgaaagccgtggccgaagaccatcaccaggctgcgcagttgggtaccagtacccttaacgatgtcgccaatatatttgaacatgggtcaaatcctcactgaaccgcgcccgctggcgtgttcaacaacacaagcgcagcagtcaccagcaaattgatcagggtcagcggcaggcagaatttccagctgaagtccatcacctggtcataacgcggacgcgggatggaagcgcgcagcaggatgaacagcatgatgaagaacgcggtcttcagggcgaaccagacgaaggacagttgcggcaggatgccgaacggaccgtgccagccaccgaagaacagggtgaccagcagtgccgagatcaggatgatgccgatgtactcgccaacgaagaacatgccccatttcatgccggcgtattcaatgtggtaaccgtcggccagttcctgttccgcttccggctggtcgaacgggtgacggtgagtcacggccacgccagcgatgaagaaggtacagaagccgaagaactgcggaatgatgaaccacaggttctgcgcctggtagtcgacgatgtcgcgcatgttgaacgaaccgacctgggccacgatgcccatcagcgccaggcccatgaacacttcataggacacggtctgggccgaggcgcgcaggctgccgagcagggcgaacttgttgttgctcgaccagccggcgaacagcaccgcgtagaccgacaggccggccatggcgaagaagaacagcaggccgatgttcaggtccgccacgccccaggtcggggtgatcgggatgatcgcgaaagcgatcagcaaggcgctcatggccacgaccggtgccagggtgaagatcaccttgtcggcaaacggcggggtccagtcttccttgaagaacatcttcagcatgtcggcggcgatctggaacatgccgaacggaccaacgcggttcggaccgtaacggtcctgccaccagcccagcaggcgacgttcgacaaagctgagcaaggcacctgcgaccactacggccagcatgatgaccagggctttgacgaccgccaggatcacgtcgatcacttcaggggtgaaccaggtcattgcgctgcctcctgcagaccgtcaacggatttgccaaagaacgccggtggaatgcccgccaggcctgccggcagggccaccaggccagcgcccagctcttcgttgatgcgcagcggcagacgcagggtctggcccgccacgctcacggcgagcagcgcgccatcgttgacgcccaggcggtcggcttcggacttggccagggagacgtaggcggccgggatgcgttcctggaccggagcggctttcgaagagttctcctcgctgccgaacaggtggtagaacggcaccgcctgccaggtgccctgggcaggggagaaggcgcgcggcacgctggcgaaccagccgaggctgtcgccctggctttcgatcaggcgggtgcccggatcgccggcacgcagatgaccaccgacttcgtcctggaacttgttccaggcttgcggcgagttccagcccggcgaccaggcgaacggcacctgggagcgcggttccacggagcccgagtaaccttccatggagaaggaaaacgcggtgtcctggtcctgcggggtacgtggctcgtgcacgctgatatcggcgcgcatggcggtacggccgctgtaacgcagcggttcgcgagccagcttcaggcccttgatgcggaacgacgccgatggcgcggcatcgacaatgcgtgccagttgcgggttgctctgggcgcaggcggcggtcacgtggtccagctgggtccagtccaccggcttgttcagcagggtagagcgcagggcatgcagccagcgccagccttcgtgaaccaggatgctggcatccatataggttggatcgaacacctggaagaagcgctgggcacggccttcctggctgaccagggtgccatcgccctcggcgaagctggccgctggcaggaccaggtgcgcgcgatcgctggtggcggtcttctggtggtcggcgacgatcagcactttcgcggcgttcagcgcggcatcgaccttggcggcgtcggtgcgggtgtacagatcgttttccagcacgaccagggcgtcggccttaccgtcgatcaccgcttgcagggcggcgtccaccgattcgccaccgagcatggccaggccgaggctgttggcctcaggcacgatcaggctgatggagccgttcttctcgcgcagcttgagagccttggcgatgttcgccgcggcttcgatcagcgccttggaacccagggaggtgccggcgatgatcagtgggcgcttggcggcgaggagggcgtcggcgatgcgcttggccagctcaaaggcttcgctgtccaggccttcgacggccggggcgctggcatccagggcgtgggccacggcgaaaccgatgcgcgccaggtcgtcgggagcggcgtgtacacactcttcggcgacgtcgtcgagcttggtttcagcgatgcttgcaatgaacagcgggttcagcgcgtgctggccgatgtttttcaccgcggcgtcgagccatggctggacgcgcatggcgtcggccatctcttcggccttgcccttgaccgactggcgcagggccagggccatgcgggcggcggtctgggtcaggtcctcgccgaggacgaacaccgcatcgtggtcttcgatgtcgcgcatggtcggcacgggcagcgggctgtttctcagcacttgcaggaccaggcggatgcgttccagttcggcggcttcgataccgctgtagaagtgctcggcgcctaccagttcacgcagggcgtagttgctttccaggctggcgcgaggcgaaccgataccgacgatattgcgcccgcgcagcaggtcggcggccttgtccagcgcctggtccaggttcagcttggtgccgtcgttcagcagcggctggcgtggacggtcttcgcggttgacgtagccatagccgaaacggccacggtcgcacaggaagtactggttcaccgaaccgttgtagcggttctcgatgcgccgcagttcgccgtagcgctcgcccggggaaatgttgcaaccgctggagcagccatggcagatgctcggcgagaactgcatgtcccatttgcggttgtagcgctcggagtgagtcttgtcggtgaacacaccggtcgggcagacctcggtgaggttgccggagaactcgctttccagggtgccgtcttcaacgcgaccgaagtacacgttgtcgtgggcgccgaacacaccaaggtcggtgccgccggcatagtccttgtagaaacgcacgcaacggtagcaggcgatgcagcggttcatctcgtgagcgatgaacgggccgagttcctggttctggtgggtacgcttggtgaagcgataacggcgctcgttgtggccggtcatcacggtcatgtcttgcaggtggcagtgaccgccttcctcgcagaccgggcagtcgtgcgggtggttggtcatcagccattcgacgacactggcgcggaaggccttggattcttcatcgtcgatggaaatccaggtgttgtcggtggcgggcgtcatgcaggacatgacgatgcgaccacgggtgtcgttctcgtcggtgtactgcttgaccgcgcactggcgacaggcaccgacgctaccgagagcggggtgccagcagaaataagggatgtcgaggcctagtgacagacatgcctgtaacaggttgtccgccccatcgacttcgagcgctttgccgtctacgtggatagtggccatggttcaaagttcttcgttggcccggtgtcagcgggcgtggctaatggaatcttggtgctcgcctggcgcgtcgcggcgtcttcaggcgatacgagggcggcacggaccaccctcgttcgatacgtttacgcgccgactacgatcggccgggccaggggcgggacggcggcagcactggtggctgcgatgccggcctcgaactctggacggaaatacttgatggcactgcccaatggctccacggcgcccggtgcgtgagcacagaaggtcttgcctgggccgaggaaaccgaccagacccagcagggtctcgatatcgccggcttgcccttcgcctttctcgagggcgcgcagcagcttgacgctccacggcaggccatcgcggcaaggggtgcagaagccgcaggattcgcgggcaaagaactcttccatgttgcgcagcagcgagaccatgttgatgctgtcgtcgaccgccatggccaggccggtacccatgcgggtgcctaccttggcgatgccgccggcgtacatctgcgcatccaggtgttcaggcaacaggaaaccggtaccggcgccgccgggctgccagcacttgagcttgaagccgtcgcgcatgccaccggcatagtcttcgaacagctcgcgcgcggtcacgccgaacggcaactcccacagcccagggttcttcacttttccggagaagcccatcagcttggtgccgtggtcttcactgccttcgcgagcgagggatttgtaccactccacgccgtcgccgatgatcgccggcacgttgcacagggtctcgacgttgttcacgcaggtcggcttgccccacacgccgacggcggcagggaagggtggcttggagcgcgggttggcgcggcggccttcgagggagttgatcagtgcggtttcttcaccgcagatgtaacgcccggcgccggtgtggacgaacagctcgaagtcgaagccggagccgaggatgttcttgcccagcaggcccgcggccttggcttcttccacggcacggttgaggtgcttggcggcggtggtgtactcgcctcgcaggaagatgtagccgcggtaggttttcagcgcgcgggcgctgatcagcatgccttcgatcagcagatggggcagttgctccatcagcatgcggtctttccaggtgttgggttccatttcatccgcgttgcacagcaggtagcggatgttcatggattcgtctttgggcatcaggccccacttcacgccagtggggaagcccgcgccgccgcggcctttgaggccggcgtccttgacggtctggacgatgtcgtcctgggacaggtcggcgaaggccttgcgcgccgcggcatagccgttcttggcctggtactcgtcgagccataccggctcgccgtcgtcgcgcaggcgccaggtcagcggatgagtttccgggctgcgctggatgcggttggcagggccgaaggatgtcagggtcatacgtagccctccaacagtttggccacgccagcaggctgcacgtcgccgaaagtgtcgtcgtcgatcatcagcgccggagccttgtcgcagttgcccaggcagcataccggcagcagggtgaagcggccgtcggcggtggtctggccgaggccgatgcccagctcgctctggatctggctgaccacggactcgtggccgccgatgtagcagaccatgctgtcgcagacacggatgatgtgacggccgaccggctgacggaagatctggctgtagaacgtcgccacgccttctacgtcgctggccgggatgccgaggatctcgccgatggcgtagagcgcgccatcaggcacccagccacgttccttctggacgatcttcagggcttcgatagacgccgcgcgcgggtcttcgtagtgatgcagctcgtgctcgatggccgagcgctcggtttcgctgagggcgaaacggtctgtctggataagcgggctgttcatgcttagcggtccacgtcggccataacgaagtcgatactacccaggtacgcgatcaagtccgcgaccatgctgccgcggatcaccgaagggatctgctgcaggtgggcgaagctcggggtgcggatccgggtgcggtagctcatggtgccgccatcgctcgtcaggtaataactgttgatgcccttggtcgcttcgatcatctggaaggactcgttggccggcatgaccgggccccacgaaacctgcaggaagtgcgtgatcagggtctcgatgtgctgcagcgtgcgctctttcggcggcggcgtggtcagcgggtggtccgccttgtacgggccttccggcatgttgcgcaggcactggtcgatgatcttgatgctctggcgcatctcttcgacgcggaccatgcaacggtcgtaggcatcgccgttggccgccagcggtacttcgaattcgaagttctcgtagccggagtaggggcgcgctttacgcaggtcgaaatcgcaaccggtggaacgcaggccggcaccagtgacgccccattccagggcttccttggtgctgtaggcggcgacgccgatggtacgacccttgaggatgctgttctgcagggcggccttggtgtattcgtcgaggcgcttgggcagccagtcgacgaagtctttcaccagtttttcccagccgcgcggcaggtcgtgggcgacgccgccgatgcggtaccaggccgggtgcagacggaaaccggtgatggcttcgatcacggtgtaggcgcgctgacggtcggtgaaggtgaagaacaccggggtcatggcaccgacgtcctggatgtaagtgcccaggaacagcaggtggctggtgatccggaagaactcggccatcatgatgcggatgacgtcgaccttctccggcaccttgatcccggccagtttctcgaccgagagcacgtacggcaggttgttcatcacgccgccgaggtagtcgatacggtcggtgtacgggatgaagctgtgccaggactgacgctcggccattttctcggcgccacggtggtggtagccaatgtccggtacgcagtcgacgatctcttcgccgtccagctgcaggatgatgcggaaggcaccgtgggccgaagggtggttcgggcccaggttgaggaacatgtagtcctcgttggcgccggaacgcttcatgccccagtcttccggcttgaagcgcgcggcttcttcttccagttgttgcttggccagggtcaggctgaacggatcgaactcggtggcgcgcgccgggaagtccttgcgcagcgggtgaccttcccaggtcggcggcatcatgatgcgcgacaggtgtgggtggccggcgaagtcgatgccgaacatgtcccagacttcacgctcgtaccagttggcgttcggccagataccggtcacggtcggcaagctgaggtcgctctcggacaaggcgaccttgatcattacgtcactattacgttcgatcgacagcaggtggtagaacacgctgaagtcggcgcctggcagcccttgacgcttggtgcgcagacgctcgtccacgccatgcaggtcatagagcatgacgtacggcttgggcaggttgcgcaggaaggtcaggacttcgacgagtttggcgcgggtaacccacagcaccggcatgccggtgcgggtggcctgggcggtgaacgcctcagggccgaaacggttattgagttcgacgaccacatcctggtcgtctgccttataaggcgggatgtacagagcactgcctgtagtcatggttttttatcgctttcggtcaacgtaaagaatgaagccagtttttcgttctttgtaagaagcgttctggaatcagacttcgtcggggctgcgcaggttggttacctgaatacgctgttcgcggcgctgttccttttgcgacggcatttcggcgcgatacacgccttggtcaccgacgacccaggaaagtgggcgacgctcctggccaatcgactcctgcaagagcatcaggccttgcagaaaagcttcagggcggggcgggcagccaggcacgtagacgtccacgggcaggaacttgtccaccccttgaacgacggaatagatgtcgtacatgccaccggagttggcgcacgaacccatggagatgacccacttcggctcgagcatttgctcgtagagacgctgaatgatcggcgccatcttgatgaagcaggttccggcaataaccatgaaatccgcctggcgcggtgatgcccggataacttcggcgccgaagcgcgcgatgtcgtggggcgccgtgaaggcggtggtcatttccacgtagcagcaggacaggccgaagttgtacggccacagggagttcttacgcccccagttgaccgcgccgctcagcacgtcttccagcttgcccatgaagatgtttttgtggacttgatcttctaacggatcggaaacggtttcccgttcgccgatcggatactgctcgttaggagcatcggggtcgatcctggtgagattgtattgcatcgccaaagcctcattgttttagcttcgcctgccgcttacggcgaccttccggagcccaatcaagagcccccacccgccaaaggtagacaagacctgccaacagaattgctatgaaaacgagagcttcgacgaatccggtccagccgctttcgcggacggacacagaccaggcaaagagaaagagggcttcgatatcgaagatcacgaagagcatcgcgactagatagaatttggctgagagccgcaagcgggcgccaccggtaggtagcatgccggactcgaacggttcgtttttgctgcggccccaggcttttgacccgaggaggctggagacgccgagcatgaaggcgcagaggccgcctacacccagaaggaaaatggcaaagccccagttgtgggccatgagtcctgtcgcttcgggcatgctggtaatccttaacagagagcaaaggtctctgagcttgataaagaaataaagcagtgacgatatgtcgcagtgcaatcaatcgccgtgattttatggctaaacaccgggcaagtaaattttcatggcgaaattatttagcggaataaggacatagctccccttgcaagccccgtaagccacggcctgtgggcattagcgggtgttttgttaattatgttttgtcctcgctgtaacgaacattactacctctaaatgataatcaatattatttagcgctgcttttaaacaatggttcccatgaacagccgctaagttgtcttttatatgctcgttactgcaagttgcgagcgagccccttttacccgctttttcctccacgcataccgctctggatcaatgttttgcctgattggcagggtgtcctggccgacgtcgtcgcgagcaggctcgttgctgtcgcagcttgggggttgccggtgatgcctgcaaaagccgcaggcaaaaaaacgccccgaaccagtcggggcgtcagatatgcggcattgcagttagcttttaccgggtctgcaatggccgtttttcagcgcgaagtcgaatcagtggaactgttcttcttcggtggagccggtcagtgcggttaccgaagacgagccgccctggatcacggtggtcatgtcgtcgaagtagccggtacccacttcctgctggtgagccacgaaggtgtagcccttggcggcgtcggcgaactcctgctcctgcagcttcacgtaggcggtcatgtcgttgcgggcgtagtcgtgcgccaggttgaacatgctgtgccacatgttgtgaatgccggccagggtgatgaactggtgcttgtagcccatggcggacagttcgcgctggaacttggcgatggtcgcgtcgtccaggttctttttccagttgaaggaaggcgagcagttgtacgacaggatctggtccgggtattccttcttgatcgcttcggcgaagcgacgggcttcgtccaggtccggcttggcggtttcgcaccagatcaggtcggcgtacggcgcgtaggccaggccgcgagcgatggcctggtcgaggccggcgcgcactttatagaagccttcctgggtgcgggtgccggtcacgaacggctggtcgtacgggtcgcagtcggaggtcagcaggtcggcggcgttagcgtcggtacgggccaggatgatggtcggtacgccggcaacgtcggccgccaggcgggcagcggtcagcttctgcacggcttcctgggtcggaaccagtaccttgccgcccatgtggccgcatttcttcacggaagccagctggtcttcgaagtgaacgccagcggcgcctgcttcgatcatgctcttcatcagctcgtaggcgttcagtacgccgccgaaaccggcttcggcgtcagccacgatcggtgcgaagtagtcgatgtagccttcgtcgcccgggttcttgccggatttccactggatctggtcggcgcgacggaacgagttgttgatgcgcttgaccacggttggcacggagtccactgggtacagcgactggtccgggtacatcgattcggcggagttgttgtccgcggcaacctgccagcccgacaggtagatcgcctggatgccggctttgacttgctgcactgcctggccgccggtcagggcgcccatgcagttgacgaaatctttctcaggacggaaggacggtttggcaccctgggtcaccaggttccagagcttctcggcgcccatgcgtgccagggtgtgctcaggttgaaccgagccacgcagacggacaacgtcggcagcggaataagtgcgagtcacgcctttccagcgcgggttttcagcccagtctttttcaagggctgcaatttgctgttcgcgtgtcagtgccatggagataaacctcgtcgcgtcttgtgtgaaaagtcgttcttgggcggaaaattccgactcgccagatacgcagggtcaaagggtgcgtagttggctgctcgctgaccagaagcttaggcggtcaagtcgggtatggcgcgatggcgacggttgaacgatgggctcaagggggaagtgagcaggtgagggccagctgtcgggcgcattcgggcgtcgtgggccttcatacgaaccatcagtgtgttgccgatctacctagttagcttccgtccctcgggacaacctcgttccagtcgcaatctcgtcaaacacaccttgtgggcggtacagacacgaatcggctcaggtgggtaggtaagagcggcgatccgaaggcccttgccagggcccctgattagcgggagcgaggccatcatgccttcggttttttgcctcgtcaaacgttttgtagtgctttttttatgccactacatctttggtctaatacgactaatcagtcagtttccggtgctttagtccaaggcgtcgactttcactcgcaaggtcatgtcatcccggccctgagtcgagtagctgcgggttgtagcctgtttgtcagcctggttctggcgattgacgccggccagggtgatccactcgccaagacggccgctgacagttgtgtcggtactttgcacattcactacatcgggacgttcctggctcatgcggtcacggttggtactgatgctcaggtggacggtttcgccggtgacgctggccgtgacgtagaaaccctgggtgacgttgcgatactgggtctggttctgcaggcggccgtaaggatcggtctgggtggtggtcagcggcacgctctggccgacctggatcagggccggtatgccttcgctggcctggatctgctggatgccgccatcgcggctgacggtgctgcgagtgatgatgcgggtttgcggcgcgccgttgaccgaataaccctggttgttctgggtgttgttttcgttggtgtcgaccgtgatcagcaggcgtttggcggcggtatccagttgtgcgatgaaggcgcgcagttcctcgatcttctccggttccgcattgacgatcagctggttgccgtaggcgctgacccggccttccttgccgaggaagttttgtgcgacgggcagcaggtcggcgctggtgcggttgttcaggggcacgatctcggtcgcggccgagactgaaaagcttgcagtcagcagtagcgtcgtgagcagggtgcgtagggacatgtccgttatctccgctaggggtggaagccttgagtttgacagtttgtcggcctgcggtggggcaagttgaatcgccgatggcaaaacgccccggcctccaaggagccagcttagcttgctggatccggggaggccggggcgttttgtgatgcctggcaggacatcgtcagcaggttcgctgctgcgcggggcttgctcaggcgttgccgcgaaccatgtcgacgtgaggaatgcccgcttccaggaattcctcgctgacgatgctgaaacccaggcgctcatagaaggcggtagcctggacctgggcgctgagcatcagctgcttgaggccacgtttctcggcttcgccgatcactgcctgcatcagcgcatcgccgaccttcaggccgcgccagtccttgagcaccgatacccggccgatctgcccatcgggcagcaggcgtgcggtaccgatcggaaagtcgccttcgagcgcgaggaaatgcaccgcgctgtcgtcgtcggcgtcccactccagctcaggggggacggattgctcgatgatgaacaccgcttcacgaatgcgccggatctcggcgttatccttttgccagtctgcgacacgtacgcgaatcttattcatcggcaaatcccaggcttccttgcttgaccagttcgcacagcaggctgcgtccatcctcgtccgccagccaggggccgaggttgtcgaggtgcagcgcgtcggcggcgcaaatcatcttcagcagttcgcgcagcttgcccggcaggtagcggctctggccgctggcgaacagcagcaggtcgtcgtcgacttcggaccaggccaggcgcgcgctcgggttgcggatcaggatggcgccctgttcgaggctgccgagcaggtcttcttcttccagctcggggccgaccaccagttccgggtagcgcggctcggtcatgaactggccgaaccaggtcagcagcatgcgctcgtcgctcatgtgctcagccagcaggcccttgaggcgatcgagggcgtcgtgctggatctggtgtggatcgctgacaggttgcacgtcggcgtcggtatagcgctcttcatccggcaggtactggctgaggaagtcggtgaagtgggtcagcacttcggcggcgctcggggcgcggaagcccaccgagtaggtcatgcagtcgttcaccgcgacgccgtagtgggccagacgcggcggcaggtagagcatgtcaccgggttccaggacccagctttcggtttcttcgaattcggcgaggatgcgcaggtccgcgtgctgcagcagcgggctctcggcgtcgcacatctggccgatcttccagttgcgcttgccgtggccttgcagcaggaacacatcgtagttatcgaagtgcgggccgacgttaccgccgggagcggcgaagctgatcatcacatcgtcgatgcgccagctcggcaggaaacggaaatgctccagcagttcggcgacttccggcacgaactggtcgacggcctggaccagcagggtccagtcacgttccggcagcttgctgaactcgtcttcggcgaacgggccgcggcgcagttcccaggggcgttcgccatgctcgatgaccaggcgcgattcgacctcttcttccagcgccaggccggccagttcgtcggcgtcgatcgggctttcgaagtcgggcagggcctgacggatcagcaggggctttttctgccagtagtcacgcaggaattcccgtgcgctgatgccgcccagaagttgaagaggaatgttaggattcatgtgtaacctattgaaaaaatgcacttttcatacgggaataaaaacgcccggcgctgccgggcgtcaaaggtcttgccatcgatcagatgcgtttggcttgcgccgcggcattgccgatgtagctggccggggtgagcttcttcagctcggccttggcggcttcgggcatttccaacgcgtcgataaaggtctgcagcgcttcagggctgatgcccttgccgcgcgtcagttccttgagtttttcatacgggttttcgatgttgtagcggcgcatcaccgtctggatcggctcggccaggacttcccagcaggcgtccaggtcttcggcgatcttctgggcgttgagttccagcttgctgatgcctttgaggctggcttcgtaagcgatcacgctgtgggcgaaaccgacgcccaggttacgcaggacggtggagtcggtcaggtcgcgctgccagcgggagatcggcagtttgctcgccaggtgctggaacagcgcgttggcgatacccaggttgccttcggagttttcgaagtcgatcgggttgaccttgtgcggcatggtcgaggaaccgatttcgccggcgatggtgcgctgcttgaagtagcccagggagatgtagccccagatatcgcgatcgaagtcgatcaggatggtgttgaagcgggcgatggcgtcgaacagctcggcgatgtagtcgtgcggctcgatctgcgtggtgtacgggttgaagctcaggcccagctcgtcttcgatgaaggcacgggcgttggcttcccagtcgatttccgggtaggccgacaggtgcgcgttgtagttgcccacggcgccgttgatcttgcccagcagtggcacagcggcgacctgagcgatctggcgctccaggcggtacaccacgttcgccagttctttgcccagggtggtcggcgaggccggctggccgtgggtacgcgacagcatcggcacgtcggcgaagcgcagggccagttcgcggatagccccggcggtctggcgcatcagcggcagcatcacttcgtcgcggccttcgcgcagcatcagggcgtgggacaggttgttgatgtcctcgctggtgcaggcgaagtggatgaattcgctgacgttggccagttcaggcagcttggcggcctgttccttgagcaggtactcgatggccttgacgtcgtgattggtagtgcgttcgatctctttgacacgctcggcgtgctccagagagaagttttccgccagggtgttcagcacggcgttggcctcggcggagaacgccggcacttcgctgatggcggaatgggcggccaggcgctggagccagcgcacttcgaccaggacgcgagcacggatcaggccgtattcgctgaaaatggggcgcagggcctgggttttgccggcgtagcggccgtcaacaggggaaaccgcagtgagcgaagagagctgcatggggtgttctcggacagtcgggcaacgaaatggggcgcgtatcatacatgaaaatatccgccggtccgttgccaactgaccagcgttttacgcgttactgactacaaaaggtcttgcgggcgcagttcagctgctgcgcatcagcggataaagctctttgagcagtttgcggcggctgatcaccagctgccagcggtggccgcccagctggcgccacagccgcgccgaacggatgccggccagcagcagagcgcggatcttcgaggcattgctcggctgctgcaggttgcgcatgtcgccatgcacctggatccgctggcgcaaggtgctcagggtgtcctggtacagcgagccgcaagcggcaaccacgttttcgtgggccgggccgaaatgttcgacctgggactgaatctgcggcaggcgcttgccgatgatttccagcaggtcgtcgcgcttggccagctggcgctccaggccgagcatcgacagggcgtagcgcaatggctcgcgctgcagggtgctggggtcgcgttccagggcgccgatcagggcgcgataaccttcccgcagattgatgtcatcgccaccgtagacttccagggtgtctttcgggtcacggatcagcaggctgccgagcatgcaactcaaggctgcttcggtgacctggccggtcttggcgatcttgtccaccagcacggcggcgagaaacacgccgcccaatgccgtcagttgttcctgggtcgggctcatgccttgctgctccagggctctgcgacttcgatcacgccgccgcccagacagatttcgccgtcatagaagactacggattggccgggggtgaccgcgcgttgcgggtcatcgaaggtggcgcggtagccgctggcggtcttttccagggtgcaaggctggtcgctctggcgatagcgcactttcgcggtgaggcggcgcggctggctcaggtcgatcgggttgacccaatagatgtcggaggcgagcagggcgcgggagaacagccatgggtgatcgttgccctggccaacgatcagctcgttgtgttccaggtccttgatcaacacgtaccacggctcatcgccggcgtccttgaggccaccgatgcccaggccctggcgctggccgatggtgtggtacatcaggccgtggtggcggccgatcacttcgccttcggtggttttgatctcgccgggctgggccggcaggtattgcttgagaaagtcgctgaaacgccgttcaccgataaagcagataccggtggagtccttcttcttggcggtggccaggtcgtgtttctcggcaatcgcgcggacttcgggtttttccagttcgcctaccggaaacagggtcttggcgatctgttcgccgccaacggcgtgcaggaagtaactctggtccttgttcggatccaggcctttgagcagttcggtgcgcccgtcgatgtcgcggcggcgtacgtagtgaccggtggcgatcaggtcggcgccgagcatcatggcgtagtcgaggaacgccttgaacttgatttcacggttgcacaggatgtccgggttcggcgtgcggccggccttgtattcggccaggaagtgctcgaacacattgtcccagtactcggcggcgaagttggcggtgtgcagcttgataccgatcttgtcgcacacggcctgggcgtccgcgaggtcgtccatggcggtgcagtactcggttccgtcgtcttcctcccagttcttcatgaacaggccttccacctggtaaccctgctccatcagcaggagggcggaaacggaagagtccacgccgccggacatgccgacgatgacgcgcttcttttgggtgtcagaaggggctggatcacgcataggaattcaacgggtgtcttgaaaaaggacgcgattctaacaggctgaggcctgcaaggctaaaactgcggttaaagcgacggacggatcagctcgaggctgtgcagttgcccggccagatagtcgtcgacgcagcggataatcagctcgctgcgccattgcggacgcaaggccagcagttcgtcgcggctcagccagcgcgggccgatgatgccgtcgtccaattgatagtcagggtggtgcctgagcggtttgccggcaaagcagacgcgttggtaggtcacgccattgctgggggcggtgtacaggtagatgccaaccacgccggtcagctcgatgtcccagccggtttcttccagggtttcacgaatggccgcctggagcaggctttcgtccgggtccaggtgcccagcgggctggttgaacaccacctgctcgccctggaactcctcgacgaacaggaagcgcccctgatcctcaacgatggtggcgacagtgatgtggggttgccattccatatataaagctccgtcttgagtgggtggtcatcataaggcgaacgccagtcctgtaggcgcgaagcttgctcgcgataggggcgctgcggtgagtcaggagaagcgcgctgctttcatcgcgagcaagcttcgctcctacagggaaggtgttgtccaaaaaagcacaaaccccggcacctggccggggtttgcattacagcggtgttgcttaaaccagcgcagcgatagccgcgttgagggtggcgcttgggcgcatggccttgctcaccagctcaggattggcgctgtagtagccgccgatgtccactggcttgccttgaacgccgttgagttcggcgacgatggtcgcttcgttctcggtcagggtcttggccagggtgctgaactgcgcttgcagggcggtatcttcagtctgggcggccagagcctgggcccagtacagcgccaggtagaagtggctgccgcggttgtcgatgttgccgactttgcgcgatggcgacttgttgttgtccaggaactgaccggttgcctggtcgagggtcttggccagtaccagcgctttcgggttgttgtaagtgttgctcaggtgctccagggaagcggccagggccaggaactcacccagggaatcccagcgcaggaagttttcttccagcagctgttgtacgtgcttcggagccgaaccgccggcgccggtttcgaacaggccgccaccgttcatcagcggcacgatcgacagcatcttggcgctggtgcccagttccatgatcgggaacaggtcggtcaggtagtcgcgcagcacgttgccggtgacggagatggtgtccttgccttcgcgggtgcgggccagggtgaacttcatggcatcgactggcgacatcacgcggatgtccaggccggcggtgtcgtgatccttcaggtaagcctggaccttctcgatcatcacgccgtcgtgggcgcgcatcgggtccagccagaaaatcgctggcgtgctgctggcgcgagcgcggttgacggccagtttgacccaatcctggatcggtgcgtccttggtctggcacatgcggaagatgtcgccggcttcgacggcctgttccaacagcaggttgcccttgctgtcggtgacgcgaacgacaccgtcagccttgatctggaaggtcttgtcgtgggagccgtactcttcggctttcttcgccatcaggccaacgttcggcacgctgcccatggtggtcgggtcgaaggcgccgttggccttgcagtcttcgatcacggcctggtagatggtggcgtagcagcgatccgggatcagtgccttggtgtcgtgcaactggccgtcggtgccccacatcttgccggagtcacggatcatggctggcatcgaggcgtcgacgatcacgtcgctcggcacgtgcaggttggtgatgcctttgtcggagttgaccatggccagggcagggcgcacggcgtagacggcctggatgtcggcttcgatctgcgcttgctgctccgcgggcagggccttgatgcgggcgtacaggtcgccgatgccgttgttcaggttgaagccgatctggctcagcacatcagcgtgcttgctcagggcgtcctgatagaactcggcaacgatctggccgaacatgatcgggtcggaaaccttcatcatggtggctttcaggtgcaccgacagcagtacaccttgcttcttggcgtcttcgatctcggcggcaacgaaagcccgcagggccttcttgctcatgactgcgcaatcgaggatctcgccggcttgtacggcggttttttccttcaggacggtagcgctaccgtcttgagcgatcagctcgatcttcacggtgtcctgggcgtcgatcagggcggctttttcgctgccgtagaaatcgccctggctcatgtgagcaacgtgggacttggagtctttggcccaggcgcccattttgtgcgggtgcttgcgcgcgtagttcttgaccgacagcggagcgcggcggtcggagttgccttcacgcagaaccgggttcacggcgctgcccttgaccttgtcgtagcgcgccttggcgtctttgtcggcgtcgctggtcacggtttccgggtagtccggcagggcgtagcccttggcttgcagctctttgatcgcggcctgaagctgcggtgccgaagcactgatgttcggcagcttgatgatgttggcttcaggcgttacggccaggtcgcccagctcggccaggtggtctggtacggctttgtcgcccagcagctccgggaagctggcaagaatacgccctgcgagagagatgtcgcgggtttccacggcaatatcagcggaagcggtgaaggcttcgacgatagggagcagcgagtaggtggcgagggcgggggcttcgtcggtgaaggtatagatgatcttcgagcgggtgggcatattcggattaactctcttctttgctaaagcgtgcgcagaaactcgagggggcgccgggtaagcgcgttcgttcaaagtcatccgtgaaccgaatgtcgaggtttcttcgcggtgatgttgggtgcatcagtcgagcgtcaagcgggtgggctgcgataacaacccggctttgggcggaaagtctcggctccttttttccagtagcagagcgctcagccgtcgtgactctgtggtcagcggcggcattatacataggtagctggcaaaacgccgacggttcatatgcaaccgctctcgtccattggtctaaaggtcgcaggcggggtggcggcgtagagtcctgtgcagtgctcgagtttggcgcttttccctttgctttcaagcttgtaggccacgaactgcgcagccttcacggcagatgagcggaacatgaggttcccgtccagattcaactggggtacgctcgaacgcagccagatgttcaatccacacaacggagttcagcatgggatacaagaagattcaggttccagcagtcggcgacaaaatcaccgtcaacgcagaccattctctcaatgttcctaacaacccgatcatccctttcatcgaaggcgatggtattggcgttgatatcagcccggtcatgatcaaggttgtcgatgctgctgttaagaaggcctacggcggcgagcgcaaaatctcctggatggaagtctatgccggcgagaaagcaactcaagtgtacgaccaggacacctggctccctcaggaaaccctggatgcagtcaaggattacgtggtttccatcaagggcccgctgaccactccggtaggtggcggtatccgttccctgaacgtggccctgcgtcagcagcttgacctgtatgtgtgcctgcgcccggtgcgctggttcgaaggcgtgccgagcccggtgaagaagcctggcgatgtcgacatgaccattttccgtgagaactccgaagacatttacgccggtatcgaatggaaggccggctccgccgaagccaccaaggtcatcaagttcctcaaagaagaaatgggcgtcaccaagatccgtttcgacgaaaactgcggtatcggcgtcaagccggtttccctgcagggcaccaagcgtctggcgcgcaaagcgctgcaatatgtggtcgacaacgatcgcgattcgctgaccatcgtgcataaaggcaacatcatgaagttcaccgaaggtgccttcaaagagtgggcttatgaagtggcggcggaggagttcggcgcgacgctgctcgatggcggcccgtggatgcagttcaagaacccgaaaaccggcaagaacgtgatcgtcaaggacgccatcgccgatgcgatgctccagcagatcctgctgcgcccggccgaatatgacgtgatcgcgaccctcaacctgaacggcgattatctgtccgacgcactggctgccgaagtaggcgggatcggcatcgctccgggcgccaacctgtccgacaccgtggccatgttcgaggcgacccacggtacggcgccgaagtacgcgggcaaggaccaggtgaacccgggttcgctgatcctgtccgcggaaatgatgctgcgtcacatgggctggaccgaagcggccgacctgatcatcaagggcaccaacggcgccattggtgccaagaccgtgacctacgacttcgagcgcctgatggaaggcgccacgctgttgtcgtcttcggcgttcggcgatgcgctgatctctcacatgtaaattgacacgctccaaatgaaacggccggttcaatcaattgaaccggccgtttttttatgactgttttttatgactggatgctgaagattttcagctcagggccgtttcctggtaggaggggactgcggcgggggtgttctgggtcttgatggattggattttcacggcgtgcaggcccttgggtccttgagtgatctcaaagctcacggcctggccggctttcaaggttttgtagccttccatctcgatggccgagtagtgggcgaaaaggtcatcgcttttaccctcctcattaatgaagccataacccttggcgttgttgaaccacttgaccttgccgcttgccatgctcatatccctctgcaacagactccatcactggagtatcatccagttcatccgtaccggaatccgaaaatataggattgacggcacggacctttattacccaatgtgggctctattggttgtaacaccgttttgccgatagtcaaggtgacccggcggtcggagttgaaatccccctggagcgcccccaccactgtatttgctcaactaacgaacctttctttccatgcatgcaatcagccagattcgactaacattcaatcaggatcgcccggatttccaagacgacgattccgctggcttggctgtacaggaagctaagccgacgttgcaggctccgccgatgtacaaggtggttttgttcaatgatgactacacaccgatggatttcgtcgtcgaagtgctcgaggtgttttttaacctgaatcgcgagctggcgaccaaggtaatgctggccgttcatacagaaggacgggcagtatgtggattgtttacccgcgacatcgccgagaccaaggccatgcaggtcaaccagtacgccagggaaagccagcatccgctactctgtgaaatcgagaaggacggttaacgccgaccacttgggtatgaggtgaagctatgttaaaccgcgagctcgaagtcaccctcaatctcgccttcaaagaggctcgttcgaagcgtcatgagttcatgaccgtcgagcacctcttgttggctcttttggataatgaggccgccgccaccgttttgcgtgcctgcggagcaaacctcgacaaactcaagcacgacttgcaggagttcatcgactccaccacgccgctgattcctgtgcacgacgaggatcgcgaaacccagccgaccctgggcttccagcgtgtgctgcaacgtgctgtcttccatgtgcagagctcgggcaagcgcgaagtgaccggcgccaatgtgctggttgcgatcttcagtgagcaagagagtcaggcggtgttcctgctgaagcagcagagcgttgcccgcatcgatgtcgtcaactacatcgcccatggcatctccaaggtgccggggcatggcgatcattccgaaggtgagcaggatatgcaggacgatgaaggcggtgagtcttcctcttcaggtaatccgctggatgcttatgccagcaatctcaatgagctggcgcgccaggggcgtatcgacccgttggtcggtcgtgagcaggaagtcgagcgtgtggcgcagattcttgcgcgtcggcgcaagaacaatccgctgctggtgggcgaggccggggtcggtaaaacggccatcgccgaaggtctggccaagcgcatcgtcgacagtcaggtgcctgacctgttggccagtagcgtggtgtactccctggatctcggcgcgttgctggcgggcaccaaataccgcggtgatttcgagaagcgcttcaaggcgttgctgggcgagttgaagaaacgtccgcaggcgatcctgttcatcgacgagattcacaccatcattggcgccggtgcggcgtccggtggggtgatggatgcctcgaacctgctcaagccgctgctttcttcgggcgacatccgttgcatcggttcgaccaccttccaggaattccgtgggattttcgagaaggaccgggccttggctcgccgtttccagaaggtcgatgtgtccgagccttcggtagaggacaccatcggtattctgcgcggcctcaaggggcgtttcgagctgcaccacagcatcgagtacagcgatgaggcattgcgcgccgccgccgaactggcgtcgcgttatatcaatgaccggcatatgcccgacaaggcgatcgacgtgatcgacgaggcgggcgcctatcagcgtctgcagcctgtcgacaagcgcgtaaaacgcatagaggtcgctcaggtcgaggatatcgtggcgaaaatcgcgcggattccgccgaaacacgtcaccagttccgacaaggagctgctgcgtaacctcgagcgcgacctgaagttgacggtgttcggccaggatgcggcgatcgactcgctgtcgaccgcgatcaagctgtcccgtgccggcctgaaatcgccggacaagcccgtcggttcgttcctgttcgccgggcctaccggtgtcggtaagaccgaggccgcgcggcagttggccaaggcgctggggatcgaactggtgcgtttcgacatgtccgagtacatggagcgtcacaccgtatcgcgtctgatcggtgcgcctccgggttatgtcggtttcgaccagggcggtttgctgaccgaagcgattaccaagcagcctcactgcgtattgctgctcgatgaaatcgaaaaggcccacccggaagtcttcaacctgctgctgcaggtgatggaccacggtaccttgaccgataacaacgggcgcaaggcggatttccgcaacgtgatcgtgatcatgaccaccaacgcaggtgccgagaccgcggcgcgggcttccatcgggttcactcatcaggatcactcttccgatgccatggaagtgatcaagaagagcttcacgccggaattccgtaaccgtctggacaccattatccaatttggtcgcctcagtcatgaggttatcaagagcgtggtggacaagttccttaccgaactgcaggcgcagctggaggacaagcgcgttcagttggaagtcaccgatgcggcccgcagctggctggcggctggtggttacgatgtgaccatgggcgctcgcccgatggcgcgcctgatccaggacaagatcaagcgtccgctggcggaggagatactctttggcgaactggccgaacatggcggtgtggtacacatcgacatcaaggatggcgagctgaccttcgagttcgagaccaccgcagaaatggcctgaccggccgcaataaaaaaaggcgccgcaaggcgccttttttatatctgttctgtaggcaggcagagtaagtcgcaggccaacaaaaacgcccggcatgggccgggcgtcttgtattgacttgcttagcgagcgcggtaagtgatgcgccctttgctcaagtcatagggcgtcagttcgacgcgcactttgtcaccggtaagaatacgaatgtagttcttgcgcatcttgccggagatatgcgcggttacgacgtgcccattttccaactccacacgaaacatggtgttgggcagggtgtcgacgacagtgccttccatttcgaagctgtcttctttcgacatgcagtaaagccctcggtgtccaatgaatggcccggtgcaactgcgccaggcaaaagcggcgtgcattgtgcccgaaaagtggggttcaagccaagggcttctagttcaggatgacccatctctggttaatcagcagctcaatgggccgatattgggtcttgtagttcatctttttgcagtttttgatccagtatccgaggtagaccgcgtccaggcccaggcgcaaggcttcgccgatctgccacagaatggcgtagcgaccgaggctgcggcgctcttcatcgggttcgtagaaggtgtagaccgcggaaaggccattgggcagcagatcggtgacggccacggcgagcaggcgcccatcgaggcggaactcgtagaacctggagaagggcagatcgcgaaccagaaaggtcgagaactgatcgcggctgggtgggtacatgtcgccatcggcgtggcgttgctcgatataacgctgataaaggtcgaaatactcttcgctgaaccccggtttgacaggctggactttcaggtcggcattgcgtttgagaatacgtttttgctgacgattgggtacaaactgtgcggcaggaatgcgtgccggaacacaggcattgcagttttggcaatgcggccggtacaggtggtcgccactgcggcgaaagcccatttccgacagatctgcgtagacatgcacatccatgggctgactaggatcgaggaacagcgtggtcgcctgttcttcgggcaggtagctgcaagagtggggctgagtggcataaaacttcaaacgcgccaactcggtcatgaatcaaccctcgggattagctttgaattaagtgtaagccacaccggcaaaacccgcctaggaaacccatatggcgcggctgggctggtccagatggcgccgcagatagccggcgaactcctggcgggggatggcgcgggcgcccaggctgtgcaagtggtcggtgggcatctggcagtcgatcagggcgaagccccatgcccgtaaatgttggaccagcgtgacgaagccgaatttcgacgcattgtcggcccgactgaacatcgattcgccgaagaacagctggcccattgctagcccatacagcccgcccaccagcaaaccctgatcccagacttcgaccgaatgggcataaccgcgcttgtgcagttcaaggtaggcatcctgcatcgattcggtgatccaggtgccgtcggcataaggacgtggcgccgcgcaggcgctgatgaccgcggcaaaatcctgatcgaaggtgacctggtagcgttgctggcgcagcagcttgcccaggctgcgggatacatgcagttcgtctggaaataacacggtgcgtgggtcgggtgaccaccagaggatgggctggccttcggaaaaccagggaaagcatccgtggcgataggcctggatcagccggtcggccgacaggtcgccgccggcggccaacaggccgttggggtcgcgcagggccttttccagcgggggaaagtcgaaggtgttgcgttgtaaccaggtcagcatggcattcagacttgcggaaggggagggcggtggcgggcctgcaaggcccgccgcaagcgtaggtcgggaggtcagttgtcgtcgaggaatttctctgcatcgagggccgccatgcagccggcacccgcggaagtgacggcctggcggtacacgtggtcggccacgtcgcccgcggcgaacacgcccgggatgccggtggccgtggcgtcgccttcgttgccacccttgaccagcagatagccatcgcgcatttccagctggcccttgaacagatccgtattgggcttgtgaccgatggcgatgaatacgccggccagcgcgagttcctgggtctctccggtctggctgtcacgcagacgggcgccggtgacgccgctggcatcgcccagcacctcatcgagattctggttccagtgcaggcggatattgcccttggcggctttgtcgaacagcttgtcctggaggattttctccgcgcgcagcttgtcgcgccggtgcaccaggtgaacctctttggcgatgttggagaggtacagggcttcctccacggcggtgttgccgccaccgatcacggcaaccacctgattgcgatagaaaaagccgtcacaggtagcacaggcggatacacccttgccggcgaaggtttcttcggagggcaggcccaggtactgggccgatgcgcccgtggcgatgatcagtgcgtcgcagctgtaggtgccgctgtcgcccttgaggataaagggtcgctgctgcaactccgcggtatggatgtggtcgtagacgatctcggtgtcgaagcgttcagcgtgtttttgcatgcgctccatcagcaccgggccggtcaggccttcgacatcgccaggccagttgtcgacctcgatggtggtggtcagctgaccgcccgcttgcaggccggtgatgacggtcggtttgaggttggcgcgggcggcataaacggcagcgctgtaaccggcagggccggagcccagaatgatcaggcgtgaatgcttcgcttcggtcataaaaacacctcataagcctttgtcacaaaagagaatgcatgctcaaattgaatactgcgtaaagtgttcctgattatgctacacccagtattgagcagcgtggcacggcgcttacaaacccgtacaatgcgggtttgtatccctatgtggaatacatcggcattgcacgcggcagctcttacagtttcgcaatgcgtgggcagaatgttaaaagtagccccagttacgctcgtcaacttttttacctgcctggattgggcagtattttttagtcgatcaacagttggacgcgcccatggcgcaggaaaagacgcgttttgaagaaatccaccgcagcacctaaaacagtagtcccactctggcgccagcaattgcactaccggctcaaggaaggtgcgttgatcgccattggggccttgtgcctgttcctgatgatggcattgctgacatatggcaaggacgatccgggctggagtcataacagcaagattgaagatgtacagaacttcggtggtcctgcgggctcttacagcgccgatatcctgtttatggtgttgggttacttcgcctatatcttcccgttgttattggcgatcaagacttatcagatctttcgtcagcgccatgagccgtggcagtggagcggctggctgttttcctggcgcctgatcggcctggtattcctggtgctgtccggtgccgcgttggcgcatatccatttccacgcggcgaccggcctgccggctggcgcaggtggggcgctgggtgaaagcctgggcgacctggccaagaacgcgctgaatatccagggcagtaccctgatgtttatcgcgctgttcctgttcggcctgaccgtttttactgatctttcctggttcaaggtcatggatgtgaccggcaagatcaccctcgacctgttcgaactgttccagggtgccgccaaccgctggtgggctgcgcgtaccgagcgcaagcaactggtcgcccaattgcgcgaagtggatgcccgggtcgatgaagtggtcgctccgaccgtgaccgacaagcgtgagcaggccaaggtcaaggagcgcctgatcgagcgcgagcaggccctgagcaagcacatgtccgaccgtgagaaacaggtcccgccggtgattgccccggccccggtcaaagcgcccgagcccagcaagcgcgtgcagaaagagaaacaggtcccgctgttcatcgacagcgcggtcgaaggcaccttgccgcctatctctattctcgatccggcggaaaagaaacaactcaactactcccccgagtcgctggccgccgtcggccatctgctggaaatcaagctcaaggagtttggggtcgaagtgtcggtggactcgatccatccgggcccggtgattacccgttacgaaatccagccggccgccggtgtgaaagtcagccgtatcgccaacctggccaaggacctggcgcgttcgttggcggtgaccagcgtgcgggtggtggaagtgattcccggcaagaccaccgtgggtatcgagattcccaacgaagaccggcagatcgtgcgcttctccgaagtgctgtcgaccccggaatacgacaacttcaaatccccggtcaccctggccctgggccacgatatcggcggcaagccgatcatcaccgacctggccaagatgcctcacctgctggtggccggtaccaccggttccggtaagtcggtgggtgtgaacgcgatgatcctgtcgatcctgttcaagtccggcccggaagacgccaagctgatcatgatcgacccgaaaatgctcgagctgtcgatctacgaaggcatcccgcacctgctgtgcccggtggtgaccgacatgaaggatgccgccaacgccctgcgctggagcgtggccgagatggagcggcgctacaagctgatggcgaagatgggcgtgcgtaacctgtcgggcttcaacgccaaggttaaagaagcgatcgaagccggtacgccgctgaccgacccactgtacaaccgcgaaagcatccacgacgaagcgccgctgctgaccaagctgccgaccatcgtcgtggtggtcgacgaattcgccgacatgatgatgatcgtcggcaagaaggtcgaagaactgatcgcgcggatcgcccagaaagcccgtgccgcggggatccacctgatcctggcgacccagcgtccgtcggtggacgtgatcaccggcctgatcaaggccaacatcccgacccgcatggcgttccaggtatcgagcaagatcgactcgcggaccatcatcgaccagggcggcgccgaacaactgctggggcacggtgacatgctctatatgccgccgggcaccagcctgccgatccgtgtccatggcgccttcgtctccgacgacgaggtgcaccgtgtggtggaggcctggaaactgcgtggtgcgccggagtacaacgacgacatcctcaacggtgtcgaagaagccggtagcggcttcgacggcggcagcggcggtggtgacggtgacgacgccgagaccgacgcgctgtacgacgaagcggtgcagttcgtcctcgagagccgccgggcatcgatctccgcggttcagcgcaagctcaagatcggctacaaccgcgcggcccgcatgatcgaagccatggaaatggccggtgtggtgaccgccatgaacaccaacggctcgcgcgaagtgatagcgccgggtccgatgcgcgactaatgacccgacacaggcggcgcgccccagcgccgtcggttttttccacgaatctaatgaggactcccatgcgtcttatccgcatgttgctgataccggtactggctttaacgacgctgtcggcccatgccgatcagaaagacgtggcacgcctgacccagttgctcgaaaagtcccagaccctgactgcgcgtttctcgcagctgaccctcgacggcagcggcacccagctgcaggaaaccgctggcgacatggcactcaagcgcccgggcctgttctactggcacaccgatgcgccgcaggaacaactgatggtctccgacggcaagaaggtttccctgtgggacccggacctggaacaggtcaccatcaagaccctggaccagcgcctgacccagaccccagccttgttgttgtcgggtgatgtgtcgaaaatcagtgaaagcttcgacatcagcgccaaggaagccggtggcgtggtggacttcatcctcaagccgaaaaccaaggacaccctgttcgacagcctgcgcctgtcgttccgcaatggcctggtgaatgacatgcaactgatcgatagcgttggccagcgcaccaatatcctgttcaccggggtcaaggccaatgagccgatcgccgcctccaagttcaagttcgacatccccaagggtgccgacgtgatccaagaataagtcgccgccaagaggtttcaatcgtccgccatggatctgtttcgcagtgacccgatcgcccaacccctggccgcgcgcttgcgcccggccaacctggacgagtacgtcggtcaggaacatgtgcttgcccgtggcaagcctttgcgcgaagcgctggagcagggggccttgcactcgatgatcttctgggggccgccgggcgtgggcaagaccaccctggcgcggctcctggcgaaagtctcggatgcgcacttcgaaaccgtctcggcggtgctggccggggtcaaggagatccgccaggcggtggaaatcgccaagcagcaggcggcccagtacgggcgccggaccattctgttcgtcgacgaagtgcaccgtttcaacaaatcccagcaggatgccttcctgccctatgtcgaagatggcaccctgattttcatcggtgcgaccaccgagaacccgtccttcgagctgaacaacgcactgttgtcccgggcccgggtgtatgtgctcaagagcctcgacgaggcggcgctgcacaagctggtgcagcgggccttgactgaagagcgcgggctgggcaagcgccagctgagcctcagtgacgaaggcttccagatgctcctggcggcggcggacggcgatggccggcgcctgctcaacctgctggagaacgcctcggatctcgccgaagacggcacgcaaatcggtgtcgagctgctgcaaagcctgctgggcgatacccgccggcgtttcgacaagggcggcgaagccttctacgaccagatatcggcgctgcacaaatcggtccgtggttccaacccggatggcgccctgtactggttcgcgcggatgctcgacggtggttgtgatccgctgtacctggcgcggcgcgtggtgcgcatggccagcgaagacatcggcaacgccgatccacgggcactgagcctgtgcctggcggcctgggacgtgcaggagcgcctgggcagccccgaaggcgagctggcggtggcccaggccatcacctacctggcctgcgcgccgaaaagcaacgccgtgtacatgggcttcaaggccgccatgcgcagcgccgccgaacatgggtcgctggaagtgccgctgcacctgcgcaatgcgccgaccaagctgatgaagcaactgggttacggcgacgaatatcgttatgcccatgatgagccggatgcctacgcggccggcgaagactactttcccgaggcgctggagccgcaacccttctatcaacccgtgcctcgtggcctggaactgaagatcggcgagaagctcaagcacctggcggagcttgaccgggccagccccaagcagcggagaaaaccgtgatcccgttgatccttgccgtctcggtgggtggaattgccggaaccctgttgcgctttgccaccggtaactggatcagcgccaattggccgcggcacttctataccgcgacgctggccgttaatatcgtgggctgcctgctgatcggcgtgctgtacggcctgtttctgatacgcccggaggtgcccatcgaggtgcgcgccgggttgatggtgggcttccttggcggcctgacgactttttcatccttttcactggatacggtacgtctgctggaaagcggacagataccgctggccctgggctatgcggccatcagcgtattcggcgggctgctcgcgacctgggccggcctgtccctgaccaaactttgataaacgagagaccgacatgctcgattccaaactgttacgtagcaaccttcaggacgtagcggaccgcctggcatcccgtggctttgccctggatgtagcacgcatcgaagcgctggaagaacagcgcaagaccgtccagacccgcaccgaacaactgcaggccgaacgtaacgcgcgctccaagtccatcggtcaggccaagcagcgcggcgaagacatcgcgccgctgatggccgacgtcgagcgcatggcgggcgagttggcagtcggcaaggttgagctggacgccattcaaaccgagctggatgcgatcctgcagggcattccgaacctgccccacgaatcggtgccggttggtgacgacgaagagggcaacgtcgaagtgcgccgctggggcacgccgacggcgttcgacttcccgatcctggaccacgtcgccctgggcgaaaaacacggctggctggatttcgagaccgcggccaagctgtcgggcgcgcgttttgccctgctgcgcgggccgatcgcccgtctgcaccgcgccctggcgcagttcatgatcaacctgcacaccagcgaacacggttacgaagaggcctacaccccttacctggtgcaggcaccggcattggtgggtaccggccagttgccgaagttcgaagaagacctgttcaagatcagccgtgaaaacgaagccgatctgtacctgatcccgaccgccgaagtgtcgctgaccaatatcgtggccggcgagatcctcgattcgaagcaactgccgatcaagttcgtcgcccacaccccgtgcttccgcagcgaagccggttcgtcgggtcgcgacacccgcggcatgatccgccagcaccagttcgacaaggtcgagatggtccagatcgtcgagccatcgacttccatggaagccctggaaggcctgaccgccaacgccgagaaggtcctgcaactgctggagctgccttaccgcaccctggcgctgtgcaccggcgacatgggcttcagcgcggtcaagacttacgatctggaagtgtggatcccgagccaggacaagtaccgcgagatttcgtcgtgctccaactgcggtgacttccaggcccgccgcatgcaggcgcgcttccgtaacccggaaaccggcaaaccggagctggtgcataccctgaacggttccggcctggcggtcggtcgtaccctggtggcggtgctggagaactaccagcaggccgacggttcgatccgtgtgcctgaggtgctcaagccttacatgggcggcctcgaggtcatcggctaaatggaatttctgccgctgtttcataacctgcgcggcagtcgtgtgttggtggtcggcggcggggagattgccttgcgcaaatcccgcctgctggccgacgccggtgcgctgctgcgggtagttgcacctgaagtggaaccccagttgcgcgagctggttacggccagcggcggcgaatgcctgtcgcgcggttatgccgaggcggacctggacggctgtgtgctgatcatcgctgctaccgacgacgaaccgctcaatgcccaggtttccgccgatgctcatcggcgctgcgtgccggtcaatgtggtggatgcgccggccctgtgcagcgtgatcttcccggcgatcgtcgaccgttcgccgctggtgatcgccgtctccagtggcggcgatgcgccggtgctggcgcgcctaatccgggccaagctggaaacctggattccctcgacctacggtcagctggccggcctggccgcgcgttttcgcaatcaggtcaaaggcctgtttccggacgtgcagcagcgtcgtgccttttgggaagacgtgttccagggaccaatcgccgaccggcagctggccgggcagggcgaggaggccgagcgcttgctgcaggccaagatcgccggcgacgcgccccatgcgccgggcgaggtgtatctggtgggggcagggccgggcgatccggacctgctgaccttccgcgccttgcgcctgatgcagcaagccgatgtggtgctctacgaccgcctcgtagcaccggcgattctcgagctgtgccgtcgcgatgccgagcgggtgtatgtcggcaagcgccgcgccgatcacgccttgccccaggagcagatcaaccagcaattggtggacctggccaaacagggcaagcgcgtgttgcgtctgaagggcggcgatccgttcatcttcggccgtggtggcgaagagatcgaagaactggcggcccagggcattccgttccaggtggtgccggggattaccgcggccagcggctgcgcggcctatgccggaattccgctgacccaccgtgactatgcgcagtccgtgcgtttcgtcaccgggcacctgaaggatggcaccaccgatctgccctgggccgacctggtcgcgcctgcgcagaccctggtgttctacatgggcctggtgggcttgccggtgatctgcgagcagttgatccggcatggccgttcggcggatacgccggccgccttgatccagcagggcacgaccgccaaccagcgagtgttcaccggcaccctggcggatctgccgaagctggtggcggagcatgaagtgcatgcgccgaccctggtgatcgttggcgaagtggtgcatcttcgcgagaagctcgcctggttcgaaggcgcgcagtcgcaggtctgaaaagcatcgcgagcaagctcgctcctacaggtatccgcgatccctgtaggagcgagcttgctcgcgatagcgatctcaacctttgcgccaaactccacgcccgctcaaacgctcgcgatcatgcgccgcatcgaagtcctgcgccggccctttcggcacgatgccggtcgggttgatggtgcgatggctggcgtagtagtgccccttgatatgggtgaaatccacggtttcgccgatccccggccactggtacagctctcgcagccagttcgacaggttcggataatcggcgatccgccgcaggttgcatttgaagtgaccgtaatacaccgcgtcgaagcgaatcagtgtggtgaacaggcggatgtccgcttccgtcaggtattcgccggccaggtagcgttggccggccaggcgccgttccagccagtcgagttcggcgaacagatcgtcgaaggccgcttcgtaggcttgctgcgaagtggcgaagccggcgcgatacacaccattgttcaccgccggatagatgcgcgcgttcagttcgtcgatttcgcggcgtagcggctccggatagaagtccaggccgttaccgctcaggtcatcgaaggcgctgttgaacatgcggatgatttccgccgactcgttgctgacgatgcgtttctgttgtttgtcccagagcacgggcacggtgacgcggccggtgtagtcgcgggtatcggcggtgtaacgttggtggaggaagtccaggtgatccagctggtcaccgctggagcccagggctcggtcgaaagtccagccctgttccagcatcagccagctgaccaccgacacatcgaccaggctttccaggcctttgagcttgcgcaggatcagtgtgcggtgagcccaggggcaggccagggatacgtacagatgataacggccggcttccgcgcgaaaaccgccttcgccgctagggcctggcttgccgtcagcggtcacccagttgcggcgttgcgcctgttcgcgctggaaggcgccgtctttgctgctttcgtaccactggtcgtgccagcgtccttcaatcagcaggcccataaaaaaactcctcggtcagtgtgcattggagtgcagtctaatccgaggagttcgaacgaattacgcaaaagtccggcagttatgatcggttaaatcgatctttctcgcgcgtcccagtagtgctgagcctgctcgaacgcctgttcccggggcatgccgagcccgcgcagggccagggccatggtggcgatcagcgccagttgcgggtagctgtcctgcacatcgccgcgccagacggctttcaggtgctcggggtcgaggctggccggtttgacatggcgctgctcggacagcgccggccattcctcatcccaactgataccgccggtgctgccgtacaagtggctggcgctgtccgggttgatctcgatttcgccaccgtcgcccttgatcacaatgacgttgtcccccagcaggccgctggcatcgcgatgcacgccctgatagccggggtggaagatgctttgcaggccgcagcgcgcgcccaacgggttgaggatgcgcgccagggagtggatcggcgagcgcaggcccagggtattgcgcaggtcgatcatgcgttgcagctgtggcgcccagtcgcccagggggatgaaggccaggttgccctgggccagcgcggcatcgaccgcctgccagtcgcggcacagcgggatgtgcagctgctccagcaattgctcggtgtacagccggccagcggtatgggcgccgccgccgtgcagcaggatacgcacgccgttttgcgccaggcacttggcggccagcaggaaccagggcaggtggcgctttttgccggcgtagctgggccagtccagatcgaccttgatcggcggcgcctgcaggcgctggcgcagggcttcggtaaagcccgccagctcctcggggctttcttccttgtgccgcaacagcatcaggaaggcgccgagctgggtgtcctcgaccttgtcgtcgagcagcatgcccatggcttcccgggcttcttcacgggtgaggctgcgggcgccgcgtttgcctttgccgagaatgcgcacgaactgcgcgaaaggatgctcggtgggcgtctcgatggtcagcggggtgtgatcggtcataagcaattggtcggcttgggcaggcccgccagcttggcggcaagtttggcgggagtgcctttgaacagtcggttcaggtgcaggctgttgcccttgtccgggcccagcttcaaggcggtgtatttgatcagtgggcgggttgcgggcgacagctggaactcctggtagaagccgcgcagcagctcgaggacttcccagtgctcgggggtcagttcgatctgttccgccgcggccagggccgcggccacttcgctggaccagtcgctcagttccaccaggtagccgtccttgtccagggcgatggcgcgttcgccgacagtcagtgcgttcataaccagctgttgaccttgtcgtactggatcgacagcgcgacgaacgccgggtaatcgacactcgtggcccaggccggaaccaccaggccgcgggcctggtggtcttccgccaaaacgtagagcgacagcgtctcgccgcgtgcctgcagggccgccagcggcgcgctaccgggctgcagggcgtacaccgcatcgccgcacaggaggatggcatcctgcgggccgagcaggcgcaggcaactggtcagccgggagtcggtgaaaggcgagtgggacagcacgtgcaaggtcgacatcagagggtgatcacctggtcaaaacggtcaataagtgcgccgagttcggccggggccaggacctgcacctcgtccaggttcagcgcggccgggtccaggccgcgttccgccacgctggcgccgcaggcgaacagctgctccacaccaaacagcggcagggcctgcagattggcgctgaggtccttttgctgcacggcaacggctttttgcccgggggccagctgaaacacgccatcgtcaagaaacagcaggccgatcggcaagtcgaaggcgccgcccgccaggacgatgtccagggcttcgcgggcgccggggccggaccagggtgcctggcggctgatgatcaacagggattgcgccatgtttcatggccctccgaaacagatcaggcggtcggccgcctgtacggcgtcgtgcaactggccgagcccggaaagctcccagggcgcgctcagattgacggccgggcgctggtagcgcgcggcttcctcttggttcaacaccccgcggcgcagggcggcggcaatgcacaccacgccatcgagctggtgctcgttgacgaaggttcgccattgcgcgggcaggtccgcttcgtcctgcggggtgacgatgttgtccgatgcgctgtgcacgccatcctgatagaaaaacagccgcacgatctcgtggccgccggccagcgctgcctgggcgaatgccagggcgcggcgcgaggagggcgcgtgagcagcggaaaaaagggcaatggcgaacttcatgtagaactctgtctgcaaacctggggccatgataaagctttatgtcgggcccggcgaagtggctttagcgcggcatatagcccaactgccagcgatgggggatcttcagcgacaacagccccagcagcgccgacagcaggccgctgacgaacagggccgcgaggcccagatgctgctccagaacggcgcccagcacggcgccggcgaacatgccgccccagggcaccagctggatgcgccagccattgcgccgctcgccgagcatccagcggcccaggccgcgaccaaagcgcgacagggcgccggtgacataggtcaggcccacgggcagcccgttcacttcctcgacggcagcattgagcatgcccatggcgatgatcgcggccagcaccgccggtagccgttgttcgaacggccaggcagctgccgcgcacagcagcgtggcaatgcacaacagcagcggcaaggcccggcggccacccaagcggctgacgacgatgcccagggcgttgccggcgatgaaggtgacgaccagcagcaccagatgcagggtcagggccaggtcggcatcgctgatggcgacggccaggcgcgtggtgttgccgctcatgaaggagacgaagtccccggtggccatgaagccgatggcgtcggtcatgccggccagcaccgacaggctggcgaccaggcacaggcctatgcggccgcgccatttctggcgccgcagcagctgcgggttactacgaaggctggtggaagagggcagcatcagcgttgactcatggtgacaatgatcctttatcgaaggcccgagcggcgctcaatcgcgtggcaggccatgtagctcgcaatactcgctccagggcatgccggccatttccgccacttcccggtgcacttcgagccgctgcgcggcgaattcttccgcgctctgcgcggtcagttgcaggctcagctcccaggcaaacagaccctggcgttccgcctcggcctcgaaggcttcgtgcagtcgctccgcgcggtattgctcctgggtttcgcccctggcctgggcagccaaggggttgaggtgatcgagtgcttcacgaagctcggggcgtgccgcgagaaacttttgcagggccacttcatgcgggtgttcgggggcggccatcggcgatcctggatggggttgaaggaagtcgtttcggattggggctgtgcgaaagcccagcgaccataacgcctggccggtccagcgtcaaaatgctcccgggtggagtggtgcgacggacggtccgcaccgtgccactgagcggattgcccaggcaaaaatgcgtgctggataacactttccactgaatgccttggtatgagccccgttcttgtgacctattctcaacgggcactctctccaagtggcgtcgccaaggaggaatttctcatgctctcgatggacgagctttgccagatcctggagtccggtttcctgccgctttcctgcacttgcaccgtcaactccgacggctccctggcgatcaaggttttcgagccgcaaagcggacggatcgacctgttcattaccggggtatcgaccgagcatctcaccagtgttcgcgcggtggccaatttcgtcggtgagttgcggactgaaatcagggcagggcgtcgggcatttgccggcggtttctagtcgttgtgcaagtggaccatcgggcaggttgagtgcgcttccttgcgccagtgtcggacgtctgagttgtgcggggagggctagttttcagacaactctctccagttcgccagcgtgacgccgctgcgctcggcgaatgtctgcatggtgcggtaggtcccgccgcagggggtgtcatgggtaatcaggcacccggaatgcagaaaggccagataccaggtgtcgctgtcgctcaatcgcttgccctggtaagtgaaggttctttgcgaacctgcgaaacagtagcgaatttcgaaagtcttgatgctgttcatcgccgcgtcctttgggctgtgttgggtggtggcgattcaagattattcccaaaaggacgcgttgacttgcaccactcatccgaactgcatgggcagtcgccgttcactcctcaaatgcctcgcggcattctcctgtatcccaaacgcccctggctgaaaccgccctcaataggtgtcatgttgcgccaggcagcgggaacttccgtcaatcgaggcctttgcgaagaaactgccattttcctgttccgggacgtgatggggttaacggttttttgacagatatcaggtgatgatcgtggggcgggaataccgttcggcgaaagaagcaggtgtttctaacgataagcccgggcaagtgatacatttctcgattttttagggatgaggaagacatatgcgagtttggctaggcgcgtcgctgatgggactgttggccgggtgttcgttacccacggctttggcaccgggcaagccgaatgtcagtgagctgactggcaaaacgccgaaagattacgcgcagtgtgtcctgccggcctggcagcgcgagacacccaggagcacccagtccgatatctccaacggctatcggatcaccgcccctggcagcctggcatcggatgaggtcatggaagtggtgaagtcgaagaacggcagcctggtctcgctctaccagggaacaccctgggccaagtccgcggtgctgaaaaaggcagtgcatgattgcctgtaggccgcttcatgccttctgcgaaggggttgtcaaagtgacagcccgttgccgttgaatcgcgcgttcctgcccacaaaaaaagccctgattaatcagggctttttttgtgccgggtcttgtccgggcctcaccttgctcgcattcaggcgaactcttgaatcatcaaggtccttttctgcataaaaacaggacaaatcagacagtttttttgacggctttatccgtccagtagacaatggtacgttagccaccacccatgatggccattatgtccgttttcagcaggagggctgccagggttggggcggtccctgtatgcgatacccatggccttgccgctgtcaggcggtgatcgagggcattggcagcaggccgatcgtagtaccgggtgttgttgactcactcctttggttacacccgactagtctctctaggggaatgtggttttagcgggcgtttcggaccgtcgatcgatgctgtccgaaggcgtcccaacaaaatagtgtcactcaagtagctgaagccaatagcgaataagaagtcagcgcaggagcgacatataaactgaggtcgatagtgtcatgtcggccttgtgtgcccacccttcagttcttctgagtgcgggaacccatggcggtgccggggcgactgatgatcgagaatgggggggcggatggcgttctatcgtaggaactacagtatgttgaaaaaagtgaacacggccctgctgggcttggcgatgacgatggggctcagctccgcgtacgccgccgagaccaagaaagtggatgtgctgctcatcggtggcggcatcatgagttcgaccctgggtgtctggctcaatgagctggagccgggctggtcgatggaaatggtcgagcgtctcgacggcgttgccgaagaaagctcgaacggctggaacaacgccggtaccggtcactctgccctggcggagctgaactacaccccggaaaacaggacggcaaggtcgagatcgccaaggccatcgagatcaacgaagcgttccagatttcccgccagttctggtcgtggcaagtcaagaacaatgtcctgaaggacccgcgttcgttcatcaactccactccgcacatgagcttcgtgtggggcgatgacaacatcaagttcctgaagaaacgctacgaagcgcttcaggcgagcccgctgttcgccggcatgcagtattccgaagacccggagcagatcaagcagtgggtcccgctgatgatgcaagggcgcgatccgaagcagaagatcgccgccacctggtcgccgctcggcaccgacgtgaacttcggcgagattacccgccagttcgtcggccacctgaaagcccagccgaacttctcgctcaagctgtcgagcgaagtggaagacatcaagcgtaacgaagatggctcctggcgcgtggtgtacaagaacctgaaagacggtaccgaaacccagaccgacgccaagttcgtgttcatcggcgccggcggcggtgccctgcacctgctgcagaagtcgggcattcctgaagcccaggaatatgccggtttccctgtgggcggctcgttcctggtgaccgagaacccggcgatcgccgagcagcacctggcgaaggcctacggcaaggcgtcggtcggcgctccaccgatgtcggttccgcacctggacacccgcgtgctggacggcaagcgcgtgatcctgtttggcccgttcgcgaccttctccaccaagttcctcaaggaaggttcgtacctcgacctgctgaccactaccaccactcacaacatctggcccatgaccaaggtcggcatcaaagagtacccgctggtcgagtacctcgccggccagctgatgctgtcggatgaagatcgcctgaatgccctgaaagagtacttccctaacgccaaggctgaagactggcgtctgtggcaggccggtcagcgcgtgcagatcatcaagcgcgacgagcagctgggtggcgtgctgaaactgggcaccgagatcgtcagctccaaggacggcagcattgccggcctgctgggtgcttcgccaggtgcttcgaccgccgcgccgatcatgctcagcgtgctggagaaggtcttcaaggacaaggtcgcgactccggcctggcaggcgaagctgcaccagatcgtgccgagctacggtacccagctcaacggcagtcctgagcgtgtcgcccaagagtgggcctacaccagcgaagtgctgcaattgactccgccaccggccatcggccagatcgctgcacctgcgcaacctgcggctgaaaagccaaaggcgccagtgagcaacccgtcggctgacatggccctgtaataccggccgcgcccgacctgtcgggtgaaccggaacctggggcggatatccgctccaggctaaaaaaaaacgccgctcccaggagcggcgttttttgtttgtgcggcgcattcaagagcctttgcccttgcgtcctgcaaccctgccttgcgcccatggcgcatttctaaccgaaacatccaggtcacgcctgcccgggaactattgtcgggaaatccctttccataagctcgacgcaatgatgcctggagaaggcgatgttcagagctggctctttaatctcgatcgtctcgattctgctgtcgatcccgctggatgccggcgcgcagtccggcacgcaggcaaatgcccggtactccaacgatcatgcgaattgggagcgccttcccgtgatcaatgactaccaggtgagagcgctgttgcaggcttcgaaacgggactggaacccggccgcggcgctgccggccgatgccaggcagaaccttcgccggggcaggacgttacccaagcagcaatcgcgacgcttgaaccccaggctggtccagcagttgccgcgttacgacggctaccaatggtggcgcgcgggttccgatctgctgctggtcaggacctcgaaccagatgatcttcgacgtcctggtcgatgccttccagtaggactggccccgatcagaagttgatcgaggcactcaagcgcgcggtcaggggcgcgccctggaacaggtagccatggcccatgtattcaccggcgtcacgccagtagcgcttgtcgaacaggttgtccacggtcagccggaacacggtgtcgtaaccgtcgatgcgggtgctgtagcggctgccgatgttgaacacggcgtagctgccggtctgcacctcgccctcgcggttggcgtacttgcgaccgctgtactgcacgccgccgagcaacgccaggccgtcgaaccagggcagggcgtagtcgccatagagactggcgcgcagggtcggcacgttgagcgcctggtgaccttcgtactccggggtgtcgctgccggtgacccgcgcgcggatcgccgcgacgctggccgagacctgcaggcgttggctggcccagccattggccgagagttccaggccggtgttcttctgttcgccctgctgggtgaaggtgaaggtaccgtcgccattcggccgggagtattggtaggcctggcggatctggaacagcgccgcggccaggctgatgcgctgccagtcgtacttgatgccggcctcgatctgccgcgacacggtgggcgcgaggatttcaaaggcattgctggcgaaccacggtgcctcgccacccagggacaggcccttgctgtagcgggtgtacaacgccaggttctgcaccggcttgtagatcagcgcggcctggggcaggaacacataacgctgggtgtggcgggtggtatcgccctggctgtcgaaggtttcctcgtccaggcgtacctcgcgcccgccgagcacggtctgccagtgttcgttgaaactgatgcggtcgttgaagaacaacccgtactggcggctgtccaggcggcggtaggagtcgttgagcgggccgtcgtaacgggcgaaatccgctggctcgccgtcgatgttggcgctaccgatcatctggttgatcgggtcgcgtttgtccaccacgcggcggaatgcgctggtgccgacgctgagttcgtgacccaggccgccggtgtcgaagttgccgctgaggacggcctgaacctcgtcgttgcgccgtgtatcatccgggctgcggaaatcgtagaggtcgtagtcgccctcggggctgaagtggttgggcaccgccgcgccggcgcagctggcggcaccgtagcagccccaggcgaacgagctgtagtcatcgatcaccacccggctgcgcgaggcgctgaggttgcctttccactgatcgttgaagcggtactcgaagttgccgttgaggttcagcgcgtcggtgctgaccggtttcgaaccgctctggtgcgccaggagctttttcggcgaggcgtggtgcggcaggctggagccaccgagcaattggtaacccggggccgagcgctgttccttggtctggtactcgatgtccagttgcagcagggcgtcggggctgatgttccagtcgaaggccagggaggcgaagtcgcgctggccattggtgtgttcgacgtaggagtggatgtcctcgtgggccaggttggcgcgcagcccgaactgctgctcgctgccgaaccagccaccgacatcggtggccacatagccgctgccgcgatcgtcggtggaaaccgtgaccgagcgcacgtcggtgggccgcttggtcacgtagttgatcagcccgccgggctcgctgacgccgctctgcaggccgttcagccccttgagcaattccacctgctgcttgttttccaggccgacgttctgctcgccggtgatgctgcggccgttgatccgatagctgctggcggcgttcagggagaagccgcgcaccgtgaagttctcgtaatagccgaccggcgcataactttcgccgaccgaggcgtcgttcttcagcacctcactgagcaggcgggcctgttggtccttgatcaagtcttcattgatcaccgcgatcgaggcgggtgcatcgagcaggggagccgcctcgaaaccgccaaccgcggcgctgccggcctgataaccggagcggtcttcgccggtcacggtcagcgccggcagctcggtgtcggcggcctgggccacgggcgcggcaccggccagcagcaggcccagcagattgcgcgcgaaccgcggggcgggcagcccctggcgggaggcccggtaaagcatatccatgaaaagctcctcgacgatggcgcgagtaccaggcacggagggccaggcgcgctcgggaaagcatcgtgctgtttaagacgggggaagcgtgtgtgccctgaaggcgtcaggccggatgtgctccggtggtcattggcaagacgaaatcggcgacccattcttgaggcgcgccatcatacaagagatcgggtccgcggcatgccccgacgtaccgcgtcgcttggatcgccagcaagcctggcgcctacagaggcgatagcgcgcgggggcgttcagccggcctttctgctctgatgcacgggaagctcgacgcggaaggtggtgccgacaccgacctcgctgcgcaccgagatgtcgccgcggtgtttcttgacgatgccgtaggacagcgacagccccagccccgtgccctggcccacgggtttggtggtgaaaaacgggtcgaagattttctgcaggctgtccggcggaatgcccgagccattgtcggccacttcgatccacacgttctcgccctcgacgccgttacgcagggtaatggtgccccgttcgttgcccatggcctgggcagcgttgacgatcaggttcatcaccacctggttgatctgcgaaggcaggcactcgacctccggcagctcggcgtactccttgatcacgtcggccttgtacttgatctcggcggcgacgatgttcagggtcgagtcgatgccttgttgcaggttcgcccattgccattcctgggtcgaatcgacccgggaaaagtccttgagatccttgacgatctggctgacccgaccgatgccgtccttggactccttgatcagcagcggaatgtcctcgaggagaaaatccagctcgatatccgtgcgcagctgtttcagccgatcgcgcagctcgctggcgccgatcccggtttcggcattgccgtaagcctcgagcatcccctgcaggcgcttgaagtaattgtccagggcgccgaggttggaggaaatgaagccgatcgggttgttgatttcatgggcgaccccggcggccaactggcccagggaggcgagcttttccgattgcaccagttggctttccagcagcttgcgttcgtcgatttcccgttgcagcgcggcgctggcctgcttgaacgccagggtacgttgctccacccgttcttccagctcgctcatctgcagctgcgcgcgcatggtcatttcccatttggtggtgagggtgttggccatctgctggacttcgatattgtcgaagggctttttcaggatcagcagccggtcgtggccgttcaggcgatcgagcaactcgtcccaggaatagtcggagtaggcggtgcacaccaccacttgcagcagtgggtcgtgcttccacaactcttcgatggtttgcgcgccgtcccagccatcgggcatgcgcatgtcgacgaaggccaacgcataggattgccccttgcccgccgcctccagcagcttgcccaggccttcctggccaccgtaggccgagtccagttcgaacaccgtggcggtggtttttggcgcactgccgaacagcgcgctttccatcgcatcgaggtcggcgctgtctccggtcttgggcgtgaggatcttgcggaagtcgtcgtggatcgccggggtgtcgtcgatcagcaggatgcgccggttcatcgggttattcatgcctcaacctcggcggtgatcagggggatctgcaggacgaacagcgcgcctttgcccgggccgttgctgtgggcggtcaggtggccattcatctcgatggccgccagggcgcaactgtgcaggccgaatccatggccttccttgcgggtggtgaagccgtgggtaaagatgcgggtcatgttttccggagcgatgccttcgccttcgtcgcgcacgctgatctgcaaggtctcgccgtcgaccaccgctgccgccagggtcatgttacgcgtctgcttggacaggtcggacatggcgtacttggcgttgctgatcaggttgatcaggatcagcagcaggcgatgcttgtcgcccatgatcagtggtacgtcggcgtagtccttgagcaccgtcacatgatggcgggtgagggcgccggagttcatgcgcagcgcgtcttcgagcagttcgctgaccgacagcggttccagcaggctgctggcacccgcataggattgctgtgtagcgacgatgtccttgatgtgatcgacgcttttgctcagttggctcagttcctcggccatgccttgctgttccaggtcgatagcctcgaccagctggttcaggtagccgggcagcaatttgccctttgcgtcctcggtgagaaagctgcccaggtcctgcgtgtgttcgttgatcaactgcatcgccttgcccagcccctgggccttgctgttgcgcagcttgcggctgaccaggtcggcggagatgttcacgctgttgagcacgttgccgacgttgtgcaggacattggtggcgatttccgccatgccggcctggcgggcggtgtcgagcagttcgctctgggtatccttgagctggcgtgtgcgttcttcgacccgttgctcgagttcgtcgttggcggccaccagggcacggttcatccggttgatctcggcaaaactgcggatcaggcgaatgcccagccagatcaatagcagcaccagcagcgcggaaaacagcagcaggtagaaatggtatcgctggtcgacgacctcggcctgttgctggtcgcggttgagcaggacggtgatgtcgtccaggcgctcgtcgaccggcaccacttcgatttcctccagcaggcggttgaccttgggttgctcgcgcaggatcagtccgacgtggttgctgagggtatcgatcagctcatggaactccgtgggcaagcgctccttgttgacccccagcttgttcaggcccaccaggatgtccgcggccctgtcgttggaggtgacctgggcgaattccaggctgctgagcaacagatcgtaggtatcggtggcgatgttctgcagcagcagtttgtccgcgtcgtgcagttgggcgagctccagctggatatcgtcctcgacggtcggcaggaaggccagggagttgcgcagcacggcgttgtgcgacttgaactgttccaccaaccgggtcttttcctttatcgcgttcaggtagccgtcatgggcgttgcgccacagtggcgaatcgtcgcgctggttctgcgcttccatcgagtcgaatttctgccacaggcgcgtcatttcccccagcggtgataccagtgggtcgtagttatgggtgatggccaccctggccttgagtatttcgttttcccacagcgagtcctgctgtttgatctggcggatcaggtcgcgggattcggagtaggtcgcggtctggtcggagctggacttgaggtagagaaacagcaggatcgaagccatcaataccgccagggcggccagcaacaggatgcttacgcgacgggatactttcataagggtttgccttcccattcgccggtcagggtcttgaggaatttgacgatcaggcgtttgtcttcctcggacggcgtacgtcccagctggtacttgaacatcaccgccacggcgccttcgagggtggcttgcgaaccgtcgtggaagtacggcgcggtgaccgcgacgttacgcaggctcggcaccttgaacacattgcggtcttcttcttcgcccgtgacgttgaaccgtcccaggtcggcctcggtggggttgccccgggccgcgaagtagtcgccgagcacgccgaacttctggaacatgttgccgccgatattcaccccctggtgacaggcgatgcagccgtattcctggaagcgctggtagccgtacttttcctcgatgtcgaggatctcggtgttgcccgccaggtattggtcgaagcgcgagttggcgctgagcagggtgcgttcgtaatcggccagggcgccctggatgttggcctgggtcacaccaccggggtaggcatcggcgaaggcggtgcgataggccgggtcgtcggcaatgcgctgcaccacgactttccagtcgctgcccatttcgctgggactctgcaccacgatatgcacctggtcttccagggtttcggcccgaccgtcccagaactggtggaagttcaggctggcgttgaacacgctcgaggtattgaccgccacgggcttgccatcgaaacccagggagtgcggaacggtatcggcaccgcctttgtcgaggcgatggcaactggcgcacgacaggctgttattcaccgacagactcgggtcgttgaacaggcgtcgtcccagttcgacccgcttgctgtccagcgccggtgctgcggggaggggtttgagcggtccttccaatggcgcggccttggcgcctggagcgagcagcaggctggccgaaaggagcaatgcgagtgacgacatggtcggtatccttaccaggcacaacttcatggatggggcaggtgaggcggcagggagtcgaccaggaagcgggcgaaggcgtcgggttccacggccttgctgaagtagaagccctggccttcctcgcactggtggagcttgaggaagtccagctgttcaagggtctcgaccccttcggcgatgatgctcaggttgaggcttttgcccaggtcgataatgctgctgaccagtttcgcgtcgttgctgtcggtgcccaggtcacgcacgaacgactggtcgatcttcaacacgtcgactgggaatttctgcaggtaactcaggctcgagtagccggtgccaaagtcgtcgatggccaggcgcacgcccagctgcttgatggcgcggagcgtggcaatggtggcgtcgacgttctgcatcagcacgctttcggtgatttccagttccagcaacgtcgggtcgagcccggtctcggccagcgtgcgggtgaggcgttcgacatagtcgtgctgacggaagtcgatagccgacacattcaccgacatgcagatgggcggcaggccctgcttctgccaggcctgcgattgcaggcaggcctggcgtaatacccattggctgagggcgacgatcagcccgctgtcttcggccaccgggatgaagtccgaggggaacacccagccatgcccgggccggttccagcgcaccagtgcctcggcaccgaccaccgtgccccgcgccaggtccagcttgggctggtagtgcaggacgaactcttcacgctgcaacgccaggcgcaggccggtttccagggtctgttgttggcgcgcgcgcaggttcatgtcttcgatgaaaaagctgaagttgttggggccgcaatccttgacgttgcgcatggcggtctcggcgttcttgatcagcgttacggcatcggcgccgtcgtagggatagatgctgatgcccagactggcggtgaccgtcaggtcgtggcccgccacggagtgggaggtattgacggcggccaggagtttttcggccacccctcgggtctgctgcggatgcaggatgtcgccgagaatcaccacgaactcgtccgaaccgtagcgaaacaccgagtcggactcgcgcaccgtcgctgccaggctctgggcgacgagcttgagcatctcgtctcccgccgggtgcccgagtgcattgttgatgcgtttgaaacggtccaggccgatgaacatcaccgccagcttccggtcatggcggcgggactgggacagatgctggctcaggcgatcaccgagcaaggtactgttgggcagcccggtgagcacatcgtaatgcagcaggtgcgacacgctcagcagttcctggacccgttcctcgatggtcgtttccaggttgcgcatcttgcttgccacgtcctgcgccagctgccatttccaggtcagggcactggccatctggcggatctccaggctgtcgaacggctttttcaggatcaacagctggtcgccgaactcgatgcgttcggccatggcttcccatgagtagtcggagaatgcggtgcataaagcgatctgcaattgcggatcggttttccagaggtgttcgatggtctgcaggccatcccagccgggtggcatgcgcatgtcgataaaggccagggcatacggccggccttcggcctgggcgcgcttgaccagttccacggcttcttcgccctggtaggcggaatcgagctggaagtgctggtggggcctgctgttgacgccgaacagcaaggcttcggtgctgcccagcagaccttcgtcttcggggctgagaatcttgcgaaagtcctgatggatcgccggtgtgtcgtcgatgatcagaattcgccggttgggtaccacggataacgggctcacctgaaattctccgacgtcgggtccgccgacctggtgccgccatccatagcagcagacctggccttgagcagttcgccagcctggtcactgtcgactgccgtaccgggcgagtgccccagtggcgtgccgctggatatcaaggtcgtgcgctgctcctgggtttccaccccttcagcggtgaccccgatgcccacctcgcgggcgaagttgaggatggcccgcagggtcatggcgttgtccgggtcgctgctggcgctgtcgagaaagcgctgggcaagcttgaggtggttgaccctgtaggtcttgaggtagtcgaacgaggagtactcggtgccgaaatcatcgatggcgatcttcacgcccagctcgcacagcctgggcaggatgtcgttgtgggtccacttggtctgggccagggtgccctcggtcacgtcgaatctcaggtcccacgggcacaggtcccagcgcgcggtggtgcgcaatacgtcgtagatcagttctggcccggtcttgagctggaccagggacaaatggatcgcaatcaaaggcggtgccacgttctggtcgcgccaggcgcgcatctgccggcaggcctggtccagcagccaatgaccgagggcgatgacgatgccggtcttctcggccgcgggcatgaaatccacggcctcgagccagccgcgccgggggtggagccaacgaacctgggtcgccatgccgaggatcctgccggtaccgagatcgacttccggcaggtagtgcaggtgcagttcgtcgcgttccagggccagcttcaggtcgttggccagggtcacccgctccgtgacctcctggttgatttcctcgctgtggaaatggaactggttgcggcccttgtccttggagcgatacagcgccatgtccgactgcgccatcaggctgtcggcactcaggatctgcgggctgtagaggctgatgccgatgctcaccgagatgcgcacctcgttgccttccagggagtaggggagcagcagggtgtcgcggattttcgtcgccagcgcagcgcaatgcgtggcctcgtcgacgtccagttgcaggatcgcgaattcgtcgccgcccaggcgcgccaccacatcgttttcccgggtgcaggccttgatgcgccgggacacttcctgcagcagcaagtcaccaatagggtggccgagggtgtcgttgatgcgcttgaagtggtccaggtccaggtaaaacatcgcgaagggcgcggctccccgtcgggccgcggcgaatgcctggtgcaggcgctcgatcagggtggcgcggttggccatcccggtcaggctgtcggtgcgggccatcagggccattttttcttcggccagcttgcgttcggtaatgtcgaggatgatcccttccacctcgaccaattggccctggtcgttgcgcaccggaatatagcggttctccacccagcgaaaggcaccatcgccggtgcgcatgcggaactcgatggacgctcccgccacatcccgatcgaggatccgcagcatggcgttcttgaccttgccctggtcgtcggggtggatcagggtctgggcccagtcggccgaggccaccagttgcgccgccacatggccgaacttggtgatgttgtgggaaatgtacatcagggtgaacgatggctcgcctcgcaggcgatagaggatggtggggctgttctgcacgatgatattggcgtcggccaactcgcgggtgcgttcctcgaccgcctgttccagctggtccattttcagctcggcgtcttcggtcatctgccatttgacggtcagggcgctggccatctggcggatctcgatggcgtcgaagggctttttcaggatcagcaggcggtcgcccagttgcaggcgctcggcgatgtcctcccaggaatagtcggagtaggcggtgcacagggcgatttgcagcttgggatcgacctgccacagccgctcgatggtttccaggccgtcccagccgggcggcatgcgcatatcgatgaacgccatggcataaggcgcatcgtgatccactgctgcctgcaccttgtccagcgcctcccggccctgaaacgccgagtcgaggaaaaaatgctccagcgaggcactgacgggcgtaccgaacagggcggcttcggcgtcgctgaggtcgtcttcgggggcatccgtgcaggcgaggatcttgcgaaagtcctcgtggatcgatgccgtgtcgtcgacgatcagaattcgccggttggtccggtctgccgacgccatcatcggcgtgctccaactcggtgcgggcaccttgtatataagctcatcgggcttcccttcctgcgttctgaacatacggtccattttggccttgagcatagtcaggctcccccgtatgcgctaatcggccggcgtcaaattcatgccgaaacactacaagtcatctagcctgtcccagaaggcaggtctgatcgaagtcaaaggggagggggaaccatggaagaacatacagcgggcgcagcccaggacagaccgacggtactgctggtcgacgatgaggaatcgattctcaatagccttcgtcggctgttacgcagccagccttacgacatcctgttggccgacagcgctgccaaggccctggagatcctcgaacaacggccggtcgacgtggtcatgagtgacgcccgcatgccgagcatggacggcgcgaccttgctggcccatatccatcagcgttatccatcgacgctgcgcatcctgctcactggttatgccgacatgaccttgatcgccaaggccatcaacgaagggcagatccatcggtatatcagcaagccctggaacgacgaggacatgctggtgacgctgcgccaggccctggcccatcacaattccgaaagcgagcgccagcgtctggaagccctgacccggcaacagaacgagcaattgaaaaccctcaactcgaccctggaaaagcatgtggcggcgcgcaccgccgagctgcaacagaccgccgacatgctcgatctggcgtatgaagagctcaagcgcagctatgtgaccggtaccgaggtgttttcgctgctggccaacctgcgcttgcccaaggccaagcagaccaaccggcagatcattgagctgattcgcgtctattgcatcacccatggcctggacgaagccgacagccgcaacatgaccatggccgccgcgctgtacaacatcggcaagctgagctggaccgacagcatgatgaccgcgcccgcggacttgttgcaccacaacgagcgcgacctgtaccgggcctacccgaagcagagcgagtcgctgctgatgaccctggaaccgatgaaggacgcggcgcgcatcatcctgcatcaccaggaacgctgggacggcagcggttttcccgatcatctcaagggcgaggccattccgctgggctcgcgctggctcaagctggccgtggacttcatcgagctgcaacgcgggctgatactcgaacggcagatgaacagcgatgaggcgctgctgttcattcgcaaatacgccggcaaactctacgaccccgacctggtggaggacttcgtcggcgtctgcgcggcttatcagagcgatgtcaccctggccgatccgacggtcagggtcctggctacgcgcgacctggccgccggcatgaccctggcgcgcaacctgaatgccgacaatggcatgctgctgctcaatgccggcaaggtgctgagcggcccgctggtggacaagctcatcgccttcgaagcgatggagggggcgaaatacagcatcttcgtcaaaatacccgaagagccggaaacggcggcctcggccgccggttgaggcgcgaacgggttaaccgccgctggcggcgacaatgctggccacctggcgtggctggcagttgaggtagggcgaggatttcagccaacgctggtcggggtaccaggaaaacatgaactgaccgtccttgaggcggtcgatcacctggcgcgccacctgcggacgcacggccgggcaacccaggctgcggccgatgcgcccttggcgccggctccacagggggctcacatagtcggccgcgtgaatcacgatatcccgatcgcgggcgaggtcattgaaacctggctccaggccatccatgcgcagcgaataaccgtggctgccttcataactttcctgggtgcggaacaggccgaggctggactggaagctgcccatgcgattggaaaactgggtggcgaagttttccccggatttctgcccgtgggcgaccaggtcgcgcagcaccagggttcttttattcaagtcaaagatccacaggcggcgggcggtggaaggttgcgaatagtcgatgaccgccaggtgccgggcctgcctggcgccgctgttgactgcgcattgcatggcgctcaaggcacttttcagcacttggggattgagttctggagcggcgtgggcgaggctgttgtaaagcagcggagtcgtattgttggcggcgagcgcggggctgcagatcgcgcctagggtggtcattgccaggcagagccggcgcaagaaggtcagcattctagagtgtccccacagtcactttggctcctgacgtcctgtcgctctcctggcagttctggttacaggtggttggatgatttttcgcagccactgccgaggttgaccatcacaatgatggccatgattggagtaaagcagttgttcaaaaaacacgcatgttacttgagccttttcctgctcgctgcgccgttggtcgcgactgctcaggatgtaccggtcgatcatgagaaccctgtgcaacaggtcttcactcgactgtccgatgcctgtccggggttggcggtgcacctggacattcccgcccagagcctgttacaggctttttaccaacagcagggtgaccagccgctctggtcgtccagcgcacgtttggaggcgttgcaggcccagttgcagcaactggccgacgatggcctggacccggccgactaccgttcgccggccagtgcgctcgcgggcgacgcgctgtgcaccgacctgagtttcagccagcattacctgcaggccctgcatgatctgcattacggccgtctgtcgcaggcccgtttcgagccgatgtggcacgcccatccctcacagctggatcgccaggcgcaggtgctcgccatcgccgggcccggcctgcaggacatcccggcagccttcgcgctggcgcggccgagcctcgagcaatatcagaacctgcgccagctgtatgcccagcagcgccagctggcgttgccccattggcagccccttcccagcgggccgctgctgcgtccgcagatgcaggacgcgcgagtgccggaactggcgcaacggctgttcaaggaggggtacctgagccccctcgccaacgagggcggtaccctttacagcgacgagctggtgagtgcggtgaaaagcttccagctcagccattcgctgcaagccgatggggtgatcggcgcggggaccttgaatgaactgaacatcagcccgcagatgcgccgcgaacagctgcgcatcaatctcgaacgctttcgctggctggcgcaggacatggagcccgacagcctgctggtcaacctggccgcggcgcagttgatcgtctatcagggcggcgtgccggtctggcagacccggacccaggtggggcgtgccgagcgccagacgccgttgctgaaatcccaggtcacgcgcctgaccctgaacccgacctggacggtgccaccgaccattttccgcgaagacaagctgccggaaattcgccgcgaccagtccttcctcaatcggcagaacctgcaggtgctcgacagcgaagggcatcgcctggcggtggaagatatcgactgggacaaccccggcaatatcctcctgcgccaggacgccggaccgagaaacccgctggggcagatggcgatccgcttccccaacccgttctcggtgtacctgcacgacacgcccagccaggcgctgttcaacaaggggccaagggccttcagttcgggctgcgtgcgggtcgagcatgcgttgcagctgcgcgatctgctggtgagcccggcggagcgggtgcgcaccgacgaattgctgagcaccgggctcactcatgagttcaggctatcgacgccggtaccgatcctgctcacgtactggacggcgcaagccgacagccatggccagttgtcctatgccccggacatctacggacgggacgcggccttgctggtggcgctggacagcaagctttgaggacttggccactggcctcgcacgctgtgcctttggtcaggaaccgctgaacatctgtcggcgtgcgacgatctgaataagtaagagggccatgaaggagaattggaaatggttcagcgtcgccgtcatcacatctcgcagctgtcccttcgtatcgaaggcctgcgggccaatgtcctgcaattcaagcaggatgagttccagatccaggaagccctgtgcggcgctttggcgacagcgaaggtgcgcgatctggaggatgccttcgatgagatccgggaatcgatcaaccacaccgaggccttgctggaagccctggtccaggtcgcaggtggagcaggggaagagggtgcaggagcttgccaggccgctggacgttaaggaaggctggcgctggggccgcctacgggcaccgctacgcgattgatgaaaacccggccgctgcgccgggttttttatggcgacacgaatggctattatcgctcggtgatttttcagcgtagggcgccatggcctttttcgagttattcgaccaattcatgagaagcatgctggcggcctggctctttgtcggtatctgccagttggcccggttcgtcttctcgcagactccgtccaggttgtccggatggatcaccctcgccgggctggccttcttgatggtctacccctgcggttgggactgggcttccggcttcatggaaaacgcctgggtggcgatgtgcagggtctaccagcattcggcctctcaactggcgctgtttctggccgatgcggcgggcgcggggttgggcgggctggtggcttacctgatgtcccgttatgtcatggcggccccggcgccactgaaacctgccggctgaagcgctgacagatacgaaaacggcctcgccactgtgcggggctttttattgccttcgcaaaatcggacctgtcgtctctaacccttgatggggggtggccatcgactggcgtgaatcaatgggctgtgccttactcgaacttcatttactgagggatgcggccatgactgagcgtcatttgaatcacagtgaaacgctttcgaatggatgcaagatcaaggtgcgatcagagatcctcagagatggctcgctcaagatgttcatcggcatctacacgccggatggcagcgttatcgtcgaagacaacgacctggccccggatggcctggacatggaggatgcgtttgagtgggggatcgacagggctaagaaaattggcaacgggcataagcttcaatgaccggtaatgccggaaagctgtgcagtcccattggctccatgccgtgtgccggctatccgctagcgcgggggctgttggcgattgaggcgtaaaatggcggtgctacctcgtcaaaaggagcccccatatgatcgccgaccaagtaagcaaacaggcgtcggagcaaagagtctgggatcaatatttctgcgctgcgttgattgccgaaagcaatctgacggcaccggtcgtaggagaggccactcatgaagataggcagaacctgttgatcgaaagagccaaaactctcgccgacaagatgatggcatgtagaaaataatcgaagcccagccagagtgctgggctttttgcatcctccgcccttgcacatgaccaaggtctgccgaccgttatagtcgccaatacagcggacgctatggatgatcagtggtcgcgcactggcagcaagtgaggtttggatctgttctaagtaaactccggcgaatttgaccggagggacgcgatcatgaattggcaaatcagacaggccgtcttgagcgatatcgaatggttgcggcgtgtggatcctgtcgcggcaaaagaccacggccgtcgagcacaaatagaaagggtagtaggcgcgggtgaatgctgggttgcttgtgagacgagcgatcccagtgtcccgatcggttacggctgtttggacaaaagttttttcggggagtggttcatcccgctggtagtcgtctcaaacgctcatagacgttctggtgtaggtaggcaaatcgttgctcacttagagcattgttcctctgccagaaagatcttcacttcgaccaacacgtccaatgcacccatgcggcaattgttggtacagcttggatatcaatacagcgggactgtggaaaatcttgaccctggtgatccagagctgatttttgtgaagtttttgaattaactccgcacaaacaacggcggcaaggtcctcaccatccatgttgcgctgtagacgctggttagctgccaccgatgacgggcagctatcggccagaagtggacgttcaacgtgcggcctcgttagaagagcgctcaacaagccaggatgattgcctttggtttctcgtgccccccgctggttttcaccatggacacaaggtcctggcttgtcgatatcagacacggatatggcgcaatcaggctactgagttgtctgatggtccggctaatgtgacgtgtcttttcaccaaagtaaccacatcgtgatgatgggtttgataagaactgtggcggttgaacgaggcttccttcggggatctgagcaggcaacgatggtaatcgttttccccggtcaactcgcttaaatgtcgatcagcagagaataaaaaaaccaatgatcagcccgaactccatggattcgagtagccaattggcacagggcttcaagcctcgtcatgtcacaatgctgtccatcgccggaattataggcgcgggtttgttcgttggctcagggcatgccattgcaacggcagggccggcggttcttctggcttatctcttctcaggcctgctcgtcgttctggtcatgcgcatgctcggtgaaatggcggtggccagtccggacaccggctcgttctcgacctatgccgatcaagccatcgggcgctgggctggattcaccattggctggctctactggtggttctgggttctggttattcctatcgaagcgctggcggccggtcacgtgctgaatcaatggtttgcgcaggtcgatgcctgggtattcgcgttggggtcgatcattgcgctggtggtgaccaacctgttcagcgtgtccaagtatggtgagttcgagttctggttcgcgatgaccaaggttgtcgcgatcatcggcttcatcggagtcggttttgccgtgttgatgggctgggtgcctgatcgcgaagtcagcggattgagtggccttatggcggagcacggcggatttgcgcccaacggcttgtcagcggttgtcggcgccttcatcaccattatgttcagtttcatcggtactgaagcggtgaccatcgcagccgccgaatccagtaacccggcgcagaacatcgccaaggccacgcgttctgtgatgtggcgtatcggcgtgttttacctgctgtcgatcttcgtggtcatctccgtggtgccttggaatgatccgctgctggcctcggtaggctcttatcagcgcgccctggaaatcatgaacattccacatgccaagttcatggtcgacctcgtcgtcctgattgcagtggccagttgcatgaactcctcgatctacattgcctcgcgcatgttgtactcgttgggccgccgtggtgatgcgccgaaaaccctgaaggcaacctctgcggcaggcgtcccgcgcgcagccgttatcgccagcactgtgctcggcgcggcgattaccgtgtggagctacttcatgccatccggactgttccagtttctactggccagctccggcgcaattgccttgctggtgtacctggcgattgcggtatcgcagctgcgcatgcgtcggatattgcgtcagcgcaacatcgagctgagctttcgcatgtggctgtttccatggctgacgtggctggtgatcgtgttcatctgcgcagcgctggcagtaatgatggtcaccccggagcaccgcaccgaggtcagtacaaccattggattggcgctagcgatttccttcatcggtcttgtgacttcgcgtcaccctgcgccggctgcgcgggccacgtcggtggggtaggcgtttacaccgaactgatactcccttcgccaaagccgcagggagaatgataggctcctgtgaagcagacccatctttgcaaggacatgatcaggatgtcatcgacctccgccgtggccgagggtacgacttaatctatccgccgccatctccgaaatgtttgtctacgagcgcatccgcaacgagcaggaccatcagcgcgtgccgctcaaacatgtggtcggtactcatcagcccaagctgcaagaagtcgttgccttgatggaggcaaatatcgaggagtcgatagacctggatcacctggctgaatgcatcgatctgtcacgtcgacagctggagcggttgttcaagaaatacctgcaatgcacgccgtcgcgctactacttgaggttacggcttattcgcgcgcgacaactgctcaagcaaacttccttgtcgatcgttgagctggcgtatgtttgcggctttgtgtccacaccgcatatgtcagtgagcgaaactttcacgcagggcggtgaactcggttggtatctctagatggcggacacccgaactggcgactgtactctcggctgaattgcgatgggctttcgtagcccactcgatagcaggcactcgccacatccagtccctcgccgagtaacagacggcgtgcttcctgcagacggagttgtttctgatactgcagcggactcatggccgtcactgccttgaaacgatgatgcaacgtagagctgcccaaattggctactcgtgcaagttcttcgatgcgtaagggttgggcgtagtggttgttcaaccaatcgatggcccgcgttacccgtcgcgtttgcgaatcaccgagagcaagctcatacagacgacgtccatgtacgcctctcaggaggcggtaatacagctcccgcagggcgagcggggccagcatgccgatatctttcggtgtttccagcagtcgtaccagccgaagcattgtttccagcagggatacatcgactttctcaaggaaaaggccaagctccggctcgtccgggacgcccgtcggaggcgcatcggcgatgacctgagcgatttccgtggcctcgaaatcaaaacggatacacaggtagggcgcatccgggctggccatcaggatgcgcccggaaactggaagtgtcaccgataccaccaggtaactgagcgggtcgtacagataacggtcgtcacccagaccgatttctttttgtccttgcacgatcaggcaaagtgccggcttgtggacggtatggataagctgcgaaggcgcgtcaaaacgaatgacatgcaggggcgctatcgcggtctcatatatcccgggtgtggtaaaccgttgcgtcagcaagcgaaccagttcgtcacggtagatggctgtgttctgaaggatgaaagcatcgctctgttccatttcaaggctctcacaagtgttcatgagcgtctgcctggggctttccaggcagacgatattcacccgatatctttaaattgctcattgccgataaagaatcatgccggcgtgatacagcacatcgtcatgaaagtgcccatcggcggtgaagccgctatcgtcccagtactggatgtagtcccccaccatttcgtagcggccttgataggcgctcttgtttttaccacgggcctcgtcgtaacgcccagtcgccagaagctcgtgacggatgaatccatcggcggtgacccacatacctgcgtaacgaagatcaggagtggcttgtttggcatttttcattgttcagtcctcattgacgttgtcatctgagtggcctgccgtggcctgtgtctgcatccgttgcgtactttcagattacgtagccgagcggagcggtgttaggacgaaactgccgcagatttgcctgatcctctcgggcttgccgagcatgtccggcggctccttcctgcggtggctcacccggccgtgacggtcatgccgccgtctgccataaccaccgaaccgaccatgaagctggcacgatccgaggagatgaacgcgaccagttcggcgatttcttccggttgtgcggcgcggccgatcggtgcggcttcgccatgttgggcgagaaatgccgggccatcgttgaccacattgttgaggatgttggtcaccacatcccccacacccacggcattgacgcggatgccgtggccaatgacctcaagcgccagggtgcgcgtcagttgggcaagcgcgcctttagaggcggtataggcggcaatggtggggaaggcgaagtaggacgcgtaggacgcgatgttgacgatcgagccggatttattgggcatcatcgctttgaccgcttcgcgactatgcaggaatgccgccgtagcattgaccgcctgaatgcgttcccagtcttcgcgagtcatgtcgatgaccagcttgttgatgatgatgccggcgttattgaccagaatgtccagccggccgaattgctcgacggccaaagcgaccgcgcgctcggcggcgccgtcctgagtgatgtcggccaccagtggtaccaggccagggcgggccagcgcttccacctcagggtttatatcttcggcgatgaccttggcgccgcgggcatgcagcagcagtgcgatggccttgccgatgccactggccgcgccagtgaccagagcgactttacctgccacttcgtttggcgtgctgttcttgatatcggtcatgatgttctccagcgttgtgatcgagtaggggataagccgtgtcggcgcccacaaggcgcttgtcatcggcgacgggcctactgtctcgcagcgaggcgaagtcagctttcgtgagattgcccacgatgtcggggttttgcgccgaatatcagtgaggacggttcgctgctcggttcagccagcgggaaaagcccgatatcatcgatccggtctccgtcgtgcggagttcgggcagcatctggaaacctgtctggctttgcacagccgaatatgaaaaggacgtgttcatggcaaacaccgggcgaacgtccctggaacaagggtcgacatccagccaggacttgcgcatcacatggcagtccatgcgtgaatacctgccaggcgagccgcaggatttaccgccgagcccggaaatcaaggacattgtgattcagctgtttacccatcgcagcgtcattgaacccattctcgtacctgcggtggtggagccgctgctggtgttggttctggcgggggcggcgagggtggaggagcgcgtactgggcggggagtggactgcggcagaggtctgcgccggcgattttttcctcacaagttccgatgagccgtatgaaatgcgctggcagactcacgggggcgataccttcgaagtcatgcacctttatctggggctgccgctgattgagctagcgtcgcgagagttgtggggtgagcacgccgggcctgtgcgtttgcgcgatatttcaggggcacgtgacggctgcgtcgcgtttgtcatggagcagttgcgcactgaactggttcaggaacgctcgcccagcgctcttttcgcccgttctctggcacaggcgctggccgtacatctggtgcgcagctatcgcgccgaggcccggcccggacgtcgggtcaacgccttgcaagcctacaagctgcgcaaagtcactgacgccatgagtgcggatctgggcgctgaattcagcctggcaaaactggccaggttggccgagctgagcgagtaccacttcagtcgcctgttcaagcgtgcgacgggactgtcgccgtcgcagtacttcattcgcttgcgcatggttcgcgcgcggcacttgttgctggaaacccggcttagcgtcatcgacgtcgggctggaggtcggctattcaagccccagtcacttctcccaggtgtttcgtcgtgaggtgggtgtaacgcccagcgagttccgtggcggttgagtgccgttgtgtcacacgttttgcgggcgatgcacacagacacgaataggcaaaagctgcgcaggttttggcacgcatcgagcaggcctgtgcccttaatcttttcgacgtaccccgcagcaacgcccgcgtcttcagcggtcggtgctgaacctcaatgcttacagcaggagctacggatatgtcgaacattcaaaacaaagtcgtcctgattaccggtgcaagcagtggtattggcgaagcggcggccaggctgatcgccgccaaaggtgcccatgtggtcctcggtgcccgccgtaccgagcgtctggacaaacttgtcagcgagatccaggccgaaggaggctcggcaagtgcctgcgcactggacgttacggatctggaatccatgcaggcgttcgttgcgttcgccaaggcgcaacacggcaaggtcgatgtgatcatcaacaacgcaggcgtgatgcccctgtcacccttgacctcgttgaaggtcaacgagtggaaccagatgctcgatgtcaatgtacgcggcatgctgcacggtattgccgccgtcttgccggacatggaggcacaagggttcggccagatcatcaacatttcctcaatcggcggcctcgcggtttctccgacagccgctgtgtactgcgcgaccaaatttgcggtcagggctatctccgatggtctgcggcaggaaacggacaaaatccgggtcacggtagtgtgcccgggcgtcgtcgagtccgaactggccgatacgatttccgatgaggtggcacgcgaggaaatgaaagcctttcggcgtgtcgcgctcaacgcagacgccattgcgcgggcactcgcctatgccatcgaacagcccgacgatgtggatgtgagtgagattgtggttcgtccgactgccagtccacactgaaagggcggggtaaaaatcgcagaccccagaaacgaaaaagccccgaataatcggggctttagcgtgacgaatatggcggaggcgatgggattcgaactcatggacctgttacagtcgacggttttcaagaccgttgccttaaaccactcggccacacctccgtttttgttgcgggcgccataatacctgaatgaaacacactgtcaaactctgtacatagcttgttgcagagcgtctgttatgatctttgccactgaacgtttcaaaccaacaggagtgtcgccatgcgcgaacaggattacgcagttaataacagcgtgcaggccgagcagctagaagttagccgcgtcctgcgcaacacctacggcctactcgctctcactctcgccttcagcggcgtgatggcttacgtggcccagcagatgcgggtcggttacccgaacattttcgtggtgctgatcggtttctacggtctgttcttcctcaccaacaaactccgtgattcggcctggggcctggtgtcggcgtttgccctgaccggtttcatgggcttcctgctcggcccgatcctcaaccgttacctgggcatgcagggcggcgctgaagtggtcagctcggcctttgcgatgaccgccctggtatttggtggcctgtcggcctacgtgctgatctcccgcaaggacatgagcttcctcggtggtttcatcaccgccggtttcttcgtcctgctgggcgcgacgctggccagcctgttcttccagatcagcggtctgcaactggcgatcagcgcgggcttcgtgctgttctcctcggtgtgcatcctgtaccagaccagcgccatcattcatggcggcgagcgtaactacatcatggcgaccatcagcctgtatgtatcgatctacaacctgttcgtcagcctgttgcagctgttcggcatcatgggccgcgacgactgatcgtcagccttgaaacagaaaagcccgcttcggcgggctttttgttgtctgcgatctgaacgtccggggcactactcggcaatgatcaggctgccatcggtttgttgctgatagatggtgtagggcagcagcaaggtgtcgagcacacctgaaacggccatgtcgagcagcatggcctggttcgaggccgggccggtatgagttgcgccgttctctggctcaggggcatgcaggctgcagaaatcataagtcacgccactgtagatacgcgggacgccaccgcagtaggtttttcgctccttgagtttctcgctggccaccgcatcctccctgaagacggtatcgatggttccacaacctgagagcatcaatgccgccagcaacagaaaagaggttttcacggtgcgaatccttcgtcgatgaggtcctgagtctagccagtttttgggtgccaggggcaaacgccgtgtgtgagcccaggcattacgccatcggcggcaaccgccgtttcaccgggcttttcttgacgatcgcggtgttggtttccgcgcagctgttgaggtggtcgagcaggctgtccagttgctccatgtcgcgtacatgcaggcgggcgataaagcagtcctcgcccgtgaccttgtcgcattcggtgaactcggggatggccaggatctgtcgttcgacttcctggagtttccccggcagcggccggatgcgcacgatggcctgcaattgatagccgaagaacttcgggtctacttcgacggtataagccttgagcacaccacgctcttccaggcgtcgcaggcgttcggcgacgctgggcgaggacagcccgctgatctgcgcaagggccttgagcgaacggcgtgaatcttccatcagggcgctgatcagcgcctggtcaatttcgtcgatcatgccaacctcattaggtaaaacctaagaaataccttgataaaaaaggcataagccgattttagcctgccgttgagtcttgagcggggcaggagccgattgtcatacttttggctcttgttgaggagaatgatcatggacaaattgttacgccgcggctcactggaaatgaccgccgccatgttgatttccggcaccatcggctggttcgtgctggtgtccgggcagccggtgctggacgtggtgttctggcgctgcgtgttcggtgccgcgaccctgctgctgatctgtgccggcttcggctttctgcgccccggcatcctgacgcgcaccacctttctcctcgccgtgctcagcggtgtcgccatcgtcggcaactgggtgctgctgttcgcctcctattcccgggcctcgatcgccatcggcaccgcggtctacaacgtccagccgttcatgctggtggggctggcggcgctgttcctcggcgagaaaatcaccgcgcagaaactgttctggctgagcatttccttcgccgggatgctggcgatcgtcagcgcccatggcgagcagggcgcggcgggcaatgactatctgctgggaatcgccctggcgctgggggcggccctgctgtatgccttcgccgcgctcttgatcaagcgcctgaccggcacgccgccgcatctgatcgcgttgatccaggtctgcaccggggtgttgctgctggcgccctgggccaatctctccgcgctgcccacggcaccggaggcttgggccagcctgctgaccctgggcatcgtccacaccggggtgatgtacgtgctgctgtacggcgcgatccagaaactgccgaccgcactgaccggcgcactgtcgttcatctacccgatcgcggcgatcttcgtcgactggttcgccttcggccatcgcctggagctgctgcaatggatcggcgtgatcgccatcctgctggcggccgctggcatgcagcagggctggagcctgggcttgcgccgtcgggtggcggcgcagtgagcgttgggttccggtgagtgactggtcgccgaattaatacgaatgataagtaactacccgatttgccagctatttattgccttgacaggcggggacgcaccactaaggttttaactcagggtgaaagattcaagcgcaacccttcgtcgttgattcaaaggtttcaagtcctcaaacccggttctgggttgcgtgtcttttttgctgttcaggtgtgacatctaccgccccccgattcgggtcggtaggtcgttaccgaatgccgccatggcggcggatcccaggcaaccaatgcttcttgtctacagggcaggggcgtatggggagcgatcatgacgactcgacgcaaggtacccggtgttcgtaactacgacggccccgctggcggctggggggcgctcaaggccaccgcgacagcggttcgggagcagatggatacgctgaaagcgcccatcaccctgatgcgcaccaaccagcctgatggcttcgactgcccaggctgcgcctggcccgacaaggagcacaaatccaccttccagttctgtgaaaacggcgccaaggcggtgacctgggaggcgaccaacaagcgggtcaccccggacttcttcgccaatcatccggtcgcctcgttattgcaccgcagcgattacgagctggaggacctgggacgtatcacccatcccctggtatatgaccgtgccagtgacacctaccagccggtcgaatgggaggcggcgttcgcgcgaataggcgagatactccgggggctgcaaccggagcaggtcgagttctatacctctggcagggcctccaatgaagcggcctatctgtaccagctgttcatccgggaatacggcagcaacaactttcccgattgttccaacatgtgccacgaaccgaccagcgtcgggctgccgcgatccatcggtatcggcaaaggcacggtgtcgctggacgacttcgatacctgcgaactgatcatctccatcggccacaaccccggcaccaaccacccacgcatgatgggcacgctgcacgaggcctcgcggcgcaaggtgccgatcatggtcttcaaccccctgcgcgaacgcgcgctcgagcgctttgccgatccgcagaacatggttgaaatggcgacttacggctccacccggatcgcctcgtcctacttccaggtaaaagctggaggcgacgcggcggcgatcaaggggatcatgaaggcgctgctggagctggagcggacggtgggcgaagtcctcgaccatgacttcatcgcccagcacacccagggtttcgacgagctggtcgccgatctgcacgccacggcctggcccgatatagaacaggccagcggcctgcagcaggccgagctggaaaaggtcgccgccgcctacgcaaaatccaacgccaccatcgtcacctacggcatgggcatcacccagcacaacgaaggcacggccaatgtccggctgatctgtgacctgctgatgttgcgcggtaactttggcaagcctggcgcgggcatttgcccgttgcgcggccattccaatgtccagggcaaccggaccgtgggcattaccgagaaaccgtcgaaggcatttctcgacaggctggagaaagtattcggcttcaagccgccagcggcccacggccacgattcggtaaaagccatgcaggcgatgatcgcgggcacggccaaggcgctgatttgcctgggaggcaatttcgccgtcgccttgcccgatccgggccagtgttttccggccatgggcaagctcgacctgagcgtgcatatcggcaccaagctcaatcgctcccatctgctggtcgccaaggagtcctatctgtttccctgcgtggggcgcactgaattggacgtgcaggacgggatgcgccagtcgatcaccgtcgaggattcgatgtcgatggtccacgcatcggccggcaagctgaccccggcatccgagttcctgcgctcggaaccggcgatagtggtcggcattgcccgggccacgctgccaggcagcaaggtgccctggcaggaactggtcgccgactacgacaagatccgcgacctgatcgagaaaacggtgcccggcttcgaggcgttcaaccagcgcatccgcgtgccgggcgggttccgcatgccgctgccgcccaccgagcgcatatggctcacgccctcgggcaaggccgagttctttgtctttcccgggctgcatgaagacaaggtggtcgatggcgcggacgtcctgcgcttgatcaccattcgcagccatgaccagtacaacaccaccatctatgccatggacgatcgttatcgcggggtattcggccggcgcgacgtgctgttcatcaatcaggcggacctggatgcccgtggcctggcccatggcgatctggtggatatcgagacggtcacccagggccgcaagctgcgctacgagaaaatcaccgcgatcgaatacaagatttccccgggctcggtcgcggcctattaccccgaagccaaccagctggtgccgctggattacatcgacgtggatagcgggactccgtcctacaagtcggttccggtacggattgtgcgttcgacgctgaactgaccctggcgatccagggaagggggcgcatggggcgcccctttttcatcggtgggctttcatgagcgcgaggctcgctgccggactgcagcgccgcgattatttgctactctgcggtctttcccgttccgccgagtgctcatgcccatgtccaacgatattcctgaaccgcaatccgtctgcaacccgattaccagcagcgcgatctttattgtcgccaccctggcccccggccgtgacgccgccgccaaggtgcggagctggtgcgaggatgtggcgggcctcacccgttcggtcggcaagcgggtgcccgcgggtaacctgtcgtgcgtctgcggttttgcttcggcggcctgggaccggctgtttggcgggccgcgcccagcctcgctgcacgcctttcgcgagttcggcccgcaagagcgccgggccgtggcaacccccggcgacatcctgctgcacattcgcgcggaccagatggacctgtgcttcgaactggcgacgcaactgatcggggcattgggcgatgcgatctcggtggtcgatgaggtgcagggtttccgctatttcgacatgcgcagcatcatcggttttgtcgatggcacggaaaacccggtcgggcgcaaggccgtcgagttcaccctggtcggcgatgaagacccggcgttcagcggcggcagttatgtgctggtgcagaagtacctgcataacatgaacgcctggaacgagctgtcggtcgaggcgcaggaacgtatcatcgggcgcaagaagctgtccgatatcgaactcgacgatgccgtcaagccgacctcttcccacagtgccttgaccaccatcaccaaggacggcgaggaggtgaagatcctgcgtgacaacatgccgttcggccggccgggggcgggggagttcggcacctatttcatcggttacgcgcgctcgccggagcctatcgagcagatgctggaaaacatgtttgtcggccggccggcgggcaactatgaccgcttgctggatttcagcacggcggtgaccggcggcctgttcttcgtgccttccgccgatctgctggaagcgttggccgaacgccagccctgatccggatgcaaagagcccgcgaggtgagggcctcgcgggctcgttgcatctggtggatgctattcaatggttgccgggaccgagcaccgggaaaggcgccgggcctttaccgatgcgatcagcaatcagtgagtgctcatgccggccatgtgcatcatcagccgcaacaggccggccaccgcacccagggccagcacactgcccagccagatgctcaccagccatgccagccgccgataccagggggcgctcgggctgcccgtggtcgatacctcagagcgttccataagccaactccatcatcagtgcggtggcggcggccagcatcaccagcccgccgaggaacagcaggctcagctgtgccacctgctggtagaaaggcctctgcctggtattggttcgaagggtttcgctgtcaatggtaaccatcgccgatcctcactttgccgcggaacacatagtagctccagcaggtgtacatcaggatgatcggcagaatgaacagggtgccgatcaggatgaacagctggctggacgggggcgatgcggcctgccacaggctgatggaaggcggcacgatgttcggccagatgctgaaggccaggccgatgtaacccaggaataccagcgccagggtgaacacgaacggccagtgcgagtgatgctggcgcaaggtgcgcagcagcccgaacagcgccagcagcgcgagaaccacaagagcgccgaagaccacgatatgcgcgtgggtgaaccagcggctggcgatctccgggtgcagcatgggcgtccacacacagagcaccgcgaccaccgccatcagcacgaacgccagcggccgggtgtagtggcgcatgcgcgattcgagcatgccttcggtcttgaccagcagccaggtgctgcccagcagtgcgtaggcgacgatcaggcccaggccgcagaacagcgggaacggcgccagccagtccaggttgccgccggcgaactggcgatcgaccaccgggatcccggcgatatagctgccaatcacgatgccctggcagaaggtcgccagcagcgagccaccgatgaacgccatgtcccagatatggcgtttttccgggctggccttgaagcggaactcaaaggctacgccgcggaagatcaagccggccagcatgaaaatcagcggcaggtacaaggcctccagaatcaccgaataggccagcgggaaggccccgtacagcgccgcgccaccgagaatcagccaggtttcgttaccgtcccagaccggcgccacggtgttcatcatcacatcgcgctcctgcgcgtccgggatgagcgggaagaggatccccagtcccaggtcgaagccatccatgatgacgtacatcatcaccccgaaggcgatgatcacgccccagatcaacgacagatctataccttgaatgcccatgggcaagctcctagttcagttggcggggttgccggacgcgaaggtctcggtgaccgcggacagcggccggcgcggcgtgcggtcctggccggggccgccttgtggcggatgatcgtgatgcggctgcgggcctttgcggaccagcttcatcatgtaggcgatgcccacggtgaacaccgagaagtagatcagcacgaacagcgcgagcgagatgctcagttggctgaccgagtggttcgacgccgcgtcggcggtgcgctgcaagccgtacaccacccatggctggcggccgacctcggtggtgatccagccggccagcatggcgatcaggccggtcgggcccatgaatagcaccaggcgcaggaacaaccggttgcggtacagcgcgccgttgcggcgcaaggccaggccgagcaggccggtgaggatcatcaacatgcccagcccggccatgatccggaagctgaagaagatgatggtcgcgttcggccggtcctctttcgggaagctcttgagcgccgggatctgcttgtccaggctgtgggtcaggatcaggctgcccaggtaaggcacttcgatcgcataaccggtcttctcggcgtccatgtcggggatgccgaacagcaccagcggcgtcggttcattgctgatgttttcccagtggccttcgatggcggcgattttcgccggctgatgttccagggtgttcaggccatgggcatcgccgaccactgcctggatcggcgcgacgatcagggccatccacatcgccatcgacagcatcttgcgcacttgtggcgtgtcgttcttgcgcagcaggtgccaggccgcggacgagccgacaaaaaacgcggtggcgacgaacgcggcgatcgccatgtgcgccaggcggaacgggaacgacgggttgaacacgatggccagccagtccatcggcacgatccgtccatcgacgatggagaagccctgtggcgtttgcatccagctgttggaggcgaggatccagaaggtcgagatcagcgtgccgatcgccaccatgaccgtggagaagaagtgcagcccgcggccgacccggttccagccgaacagcatcaccccgaggaaaccggcctcgaggaaaaacgcggtcagcacttcataggtcagcaggggcccggtaatgctcccggcgaagtccgagaagcgactccagttggtgccgaactcgtaggccatgaccagcccggagaccacccccatgccgaagttgacggcaaagattttcgaccagaagtgatacaggtccttgtagaccgagttattgcttttcagccagaggccttcgagcactgccaggaagctggccagcccgatggtgatggcgggaaatatgatgtggaacgagaccgtgaacgcgaattgaattcgcgcgaggtcaagcgcttccaggtttgacatgacgataccctcagagtggctcgatacgtgtgcacggcccggccgaccgcgtgagcctcgcggctcgcggtcaacggcaatgcaggtttcgaaagggccggggcgacgcgcgccgccccgggcaggttcaatcgacggaggactggatcaggttgctgaccggcgccggctcaaggcgaatcgcgatgaacttcgaggtcggggtgaaggtgcggtcgccgtagctttccagcggcaccaaagggttggtttccgggtagtaggcggcggcctgaccggctggaatgtcgtaggcgatcagggtgaagccgctcacccggcgctcgcgaccgtcgccccacagcgagatcatgtcgaccttctgccccggctcgtaacccagcttgcgaatgtcctgctcgttgacgaacaccacgtcgcgcatgccgtagaccccgcgataacgatcgtccaggccatacagggtggtgttgtactgatcgtgggaacgcatggtctgcaggatcagctccggcttcacgcccaggtcgcgcacgccctggctcaccaggtgttccggcaatacgccgggggtgaactgggccttgccggtggcggttttccagatgcgctgggcggcgtcgttacccaggtggaaaccacctgggtgcagcagcttcttgttgaagtccttgaagccgggaatggtgtcggcgatcaggttgcgaatgcggctgtagtcttcgatcacccagagccagtcgatggggtggctgccgagggtggcgttggcgatcccggcgatgatcgccggttccgaacgcatcagcggcgacttgggtttcaactggccgtgggagatgtgcaccatgctgaaggtgtcttccacggtgacgccttgcgggccctgggcttgcaggtcgatatcggtgcgccccaggcacggcaggatcagcgcctcgcggccggtgaccaggtggctgcggttgagcttggtggcgatgtgcacggtcagctcgcagttgcgcagggcggcgtgggtacgcgggctgtcgggggtggcctgggcgaagttgccccccaggccgatgaacaccttggcccgaccttcttccatggcggcgatcgccatcaccgtgttgtgcccgtgcttgcgcggtgccttgaaggcaaaacgcgcttccagggcatcgagcaactcggtgggggccagttcgttgatgcccatggtgcggtcgccctgcacgttactgtggccgcgcaccggcgacagcccggcgcccggacggccgatattgccgcgcagcagttgcacgttgaccacttcctgcacggtcagcaccgagtgggtgtgctgggtcacgcccatggcccagcacatgattacccgcttggccttgcgatacatgcgcgcggccagctcgatgtcctccagggacagcccggactgttcgaggatgtgctcccaactggtggcgtcgacttcggccaggtaggcgtccaggcccgaggtgtgctcggcgatgaaggcgcggtcgaacaccgcttcgccgttgttggccagggcttcgcgttcccactgccagaggaacttggcgatgccgcgcatggctgccatgtcgccgcccagggccgggcggaagtaggcggaggaggtgggctcggagccgttggtgagcatctccagcggatgctgcgggtgctggaagcgttccaggccacgctctttcagcgggttgaaacagatcacctgggcaccgcgtttcaccgcttcacgcagcggttcgagcatccgcggatggttggtgccggggttctggccgatgacaaaaatcgcgtcggcttcccccaggtcctcgaaggtcaccgtgcccttgcccacgccgacgctgtcgtccatgcccaggccgctggcctcgtggcacatgttcgagcagtcggggaagttgttggtgccgtaggcacgcacgaacagctggtagaggtaggcggcttcgttgctggcccggcccgaggtgtagaactcggcctggtcgggcgactccagcccgttcaggtgcctggcgatcagggcgaaggcgtcgtcccagctggtttcgacgtaacgatccaggctggcgtcgtaacgcatcgggtgggtcaggcggccctggtattcgagccagtagtcgctttgcgccgccagtgccgacaccgtgtatttgttgaagaaggccgggttgaccaggcgcccggtggcttcccagttgaccgccttggcgccgttctcgcagaacttgaccatgccgttttccggcgactcgccccaggcgcagcccgggcagtcgaagccgccgttctggttggtcttgagcatggtgcgaatattcttgaaagcgttttcgctgcccaaccagttcctggtcacggcaatcaatgcgccccaaccggccgccgcccccttgtacggtttatagcgttcaacttcgctcatgatacttctccaggacattgcacgtaggctgcgcctaatgccgagtcattgttaatgactgttttcttgtgtgcataaataaccaactttaagtggctgttaattacaggccgcacggttttatgcacttcgcggattgcttcaggactgcggggtcaagcctaagccgcttataaagtgcctgtctaatcgcaaataatgaccggatgatcgaaatgctctatcaaggaaaaaatctatactaatcaataaaataaatacttaatttggggcggaatgggatgatttttcttctgataaatcctatcgatcaaccggttgttaatagcaattagacggtggtttgaaatgtccttagtcttgcctcaaacaaggccttctataacggtggccttccaataacagcattcgggtcgatacacctgaagtgctgacggaggcggtaatgtcagatcgaatcctgcaggatggtttttccaggcgagtcgactatctgcgaatgtcggtgaccgatcgctgcgactttcgctgtgtgtattgcatggccgaagatatgcagttcctgccgcggcaacgcatcctgaccctggaggagctttatcagctggcgcaaagtttcgtcgccctgggcacccggaaaatccgcctgaccgggggcgaacccttgatccgcccgggcgtcgtcgagctgtgccggcgcatcgccgcgctgccggggctgcgtgagctgtgcatgaccaccaatggctcgcagctgggcaagctggcgacgcccttgttcgaggccgggctcaagcgcctgaacatcagcatcgacagcctcgatgccacgcgctttcgcgagctgacccgcaccggcgacctggcccaggtgattgccggcatcgatgcggcgaacgccgccggtttccagcacaccaagctcaactgcgtggtgatgaaagggcgcaacgatcatgagatcaacgacctggtgggctttgccatcgaccgtgggctggacatctcctttatcgaagagatgcccctgggggtgatcagcgaacacagccgcgccgatgcgttcttttccagcgcccaggtgcgcgagcgcatcgccgagcgctacaccctgatcgactccaccgaatcgacccaggggccatcgcgttactggcgcctggccgaggcaccggagattcgcctggggttcatctcgccccacagccacaacttctgcgccacctgcaaccgggtgcggttgaccgttgagggtcggttgctgctgtgcctgggcaacgagcattcggtcgatttgaagcaggtgctgcgcagccatccgggcgagccgcagcgcctggagcgggcaatcatcgaggcgatgaaaatcaagccgtaccgccacaacttcgcactcaatgacgaggtgcaagtggtgcggttcatgaacatgaccggcggctagcccgcgcggttttcccctctgcaaaaaggctgtcttgcgatgatcgtcagatccaaacccaacctgatcaatgtgctgatctccctcaagggctcgattgccaagcgcatcgccctgcgcagcctgctggtgaccctgctggcctcggccatcgtatttatcgagaccctgtacccgacctatttctccagggtcaatgccacgccgttcaccctgttgggcctgtcgctgtcgatcttcatgagctttcgcaacaacgcctgctacgaccgctggtatgaagcgcgcaaggccctgggcacactggtgacggaggtgcgttcgatgatccgcgaaacccaggcgatcaaggattcgcggcagcgcggcaagatcttgcgcgacctctgtggcttcgcccatgcgctcaacgccaggttgcgccaggaagaccagctgagcgcggcgggcacctggctgagccagttgccgccggcccaggcgcccaacgtgccggacagcatcctgcgccacgtcggccaacagtgttcgatgctggccgaatccggggcgatcagtgagtggcgctacacgctgatggccaatcacctgagcagcctgaccaacgcccagaccgtctgcgagcggatcaagagcacgccattgccttttccctacacgctgttgctgcaccgcaccagctacatgttctgcatcctgctgccctttgccatggccgagcccctgggctggctgacgccgatcttcacggccatcgtcagttatacgttcttcggcctggacgccattggcgacgagctggaagaccctttcggccgggacgagaacgacctgccgaccaatgccctggtgcgcaccatcgagcgggaggtgctcgatgccctgggggcgacccagctgccgccggtgctgcaaccggtggacttcgtgctgagctgaccggcgcccatgcattcgccccggttcccccgggccacatcactcaacccagccaacaggctgcgaggataaccatgaaccacgattccacgatcctgactcacctggacgccgaaggccgggccaatatggtcgatgtcagcgacaagccgcccaccgaccgtgaagcccaggcccaggcctgggtacgcatgcggcccgccaccttgcagatgatccagcagaacggccaccccaagggcgacgtgttcgcggtggcgcgcatcgcgggcatcatggcggcgaagaaaacccatgaactcatcccgctctgccacccgttgctgctcagctcgattcacctcgatctgaaggcggtcgagcccgacagcgtcaggattgtcgccacctgccggctcaacggccgcaccggtgtcgagctcgaagcgctcaccgcggccagcgtcgccgcgctgaccatctacgacatgtgcaaggcggtcgatcgcggcatggtcatcgacagcatccaactgctgaagaaacagggcgggcgatcgggcagctttgacgcgggagtcacagcatgatcctgatcaactactttgcccgttatcgcgagcagctcggtatcggcggcgagaagatcgcgctggatgattcgttgcgcagcgtcggcgacgtgaggacgttgctgatgaccaggggcgagacctggcaggcggtgctcggcgaaaccagcctgatgtgcgcgctgaaccaggacctgtgcaacctcgacgcgcccatcgaggacttcgacgagatcgcgttttttccgcaagtcacggggggctgagccatgaccgtgcacgtccaggccgaggccttcgaccttgatcgactgcaccgcgaggtgcacggcgaggaccccggcgttggtgcgctggtgactttcgtcggctatgtgcgtgacctgaacctgggggagcaggtcggcagcctgttcctcgaacattacccgggcatgaccgagcgttcgttgcagcgcatcgtcgatgaggcccatgagcgctggccattgcaacgggtaagggtcgtgcatcgggtgggggcgttgcaggtggccgagccgatcgtgtttgtcggcgtcgccagcgcccatcggcaggcggccttcgaggcttgcgccttcctgatggactacctgaaaacccgcgcgccgttctggaagcgcgaacagacctcgtccggcgagcgttgggtgcagggcagggagagcgaccaactggccgccagtcgctggtagggcagggaggcgccctgcggcgcagcaccttcagtcggccgtgggcgcttgcccggcaaacagtttcctggcttcggcaaagcacttttcggcaatggccgagcgcggttcggtcttgcgcatcaccaatcccaggggcgccagcacgctggcatccggcaggttgatgaacgccaggttctcgatcgggttttccaggccgctggacagcggcatgatcgagcagcagaagccttcgtgaatcgcctggaacagctgataggtcgaatcgctttcgaggatcggctgcgggtcgaggccgcggctgcggaaactcaggtcgatggatttgcggtagtgcatgccattgctgatcatccccaggggcagctcggcggcctcttcccagctcatttcgctgctttcgaaatggaagtggcgggtgtcgtacagcaggccgacgcgggtttcgccgatctcgaaaaactcgaaatagttcgggttcacgtggtccaggtaacacacgcccaggtccagctggttgttgcccaggccttcgatgatctggtccgagctcatggacgacagggcgaacttgagctccgggaaactcttggaaaggccctggacgtagccgatcgggttgaagctgctcagcggcaccaggcccaggagcaggctaccgaccagttggccacggcacgcggcggcctcggcgaacagcccatcatgggcggcgagcagggtccgcgcccaggccagcacccgttcgccggcctcggtgaaaccttcgaagcgctggccgcgcttgaccagcaccaggtccagctcgtcctccaggttgcgcaagcgcatggacagggtcggctgggtaatgtggcagcgcgccgcggcctggccgaagtgtcgggtctggtccagggcgataaggaacttgagttgtttgatgtccacgatggcacctgctgaagaaggggttgatgtcaggggtaagtccaggatgcacgaagcgtttggaaatcccgatccgacctttggaggaaaagactgtgcgtccgttcggtggcacgcggagctgttaaaaagccgttaaaaaagtagctcaggggtgttgaagttgctcaggcgcgggtcgtcctcggcgcagaccagggcctgcggccggtgcttcgacaaggcgcgctgcaggctgcgttcgccggcatcccagtcgcgttgcaggctcgccagcaaggccgtggggatcaggctgaacatgggttgccagtggccggcctgttgcaccatcagcaccgagtccggggcggggcgcgccgccagcatggcgccgatcagcgcggcatcgattttcggtgcgtcgcaggcgaacaccagcagccacggatgacgcgccactgccaggccggcgagcacgcccgccaggggccccgggaaatccctctgcgagtcttcgaccagttggtcggcataggcccgatactgctcggcgttgcggttgcaggagatgatcaggtcgtcggtgaaaggtcggaccgccgcctgcacatgggcgatcagcggcttgccctgccagggcagcaggcccttgtcccggccacccatgcgcgcgccacggcctccggccagcagcagcaccgagcaggggatgggcgaaggggcggcggggcaggtcggggtcattgttcgaggcacactggttgggggctcagacgatctcattgtcgccccttcgagtccaatcggaagtatcgaatgagcgatcaaaagtctctatcggccgcggatttcaccggcgtgggccggtactccagggggaaagagtccttgatagatatgctcgataaagtggtcggccagagtgattagacaccgacggtttcagcgctttagcctctggccatggtttttatgactgcccgccggagaaagacatgagtgtgaaatcggatgcattgtttgtccccctgaatattgccgtgctgaccgtcagcgatacccgcgaatacgccaccgacacctccggtcaattgctcgtcagccgactgctggaagctggccacaccctgagcgagcgcaacctgctcaaggatgacctgtacaagatccgcgcccaggtcgccctgtggatcgccgatgagactatccaggtggtgctgattaccggcggcaccgggttcaccggacgcgacagcacgcccgaggcggtgagctgtttgctggacaagcggatcgacggtttcggcgagctgttccgggcgatttccattctcgatatcggcacctccaccgtgcagagccgggccctggccgggctgtccaacggcaccctggtgtgctgcctgccgggctccacgggcgcctgccggaccgcctgggaaggcatcctcgccgagcaactcgacgcccgccaccggccgtgcaatttcgtgccacacctcaagcaggtgcaagcctgcgggacccgcggatgagcgccttaccgctgatgccggtggaggaggccatcgcccgcttgctggccatggccgaggcgcaacgcttgcaggacagcgagccggtggcgctgggcgaggcgcggcaacgggtgctggccagcgacctggtggcgaccctcgacctgccgccctggccgaacagcgccatggacggttatgccttgaacctcgatgcctgggacggccagccgctggcggtgtcgcaacgcattttcgccggccaggcccccgagccgttacggtcgggcacctgcgcgcgaatcttcaccggcgcgccgctgcccgagggcgccaacagcatcgagatgcaggagaacgtcgagctgcttgacgacggtcgcgtgcgcttcagacagccgctcaaggccggtcagaatattcgcccgcaaggccaggagaaccgtgccgggcaagtgctgctgcgtgccggcaaacgcctggggcctttcgaactggctatcgccgcggcccagggctgtacccatctgccgctggtgcggcggccgcgggtggcgttgctgtccaccggcgacgaactggccgagccgggcacacccttgcgccccggcggcatctacaacagcaatcgcaccctgctcagccactggctgaatgccctgggctgcgaggtgatcgatgccgggattctccccgaccggccgcagcagacccggctgcgcctggagcagttgcagtgcgcggcggacctgatcctgaccaccggcggcgtgtccgccggcgacgccgattgcctcggccaggtactgcgcgagtgcgccaccccggtgttctggaagcttgcgataaaacccggcaagccgttgaccgtggggcgcttcggcaccgtgccggtgatcggcctgcccggcaacccgacctcggccctggtgacctttggcctgctggcccggccttatctgttgcgcatccagggtgtcgaggaggtgatgccattgagcttcccggtcagcgtcggcttcgactggccgaaagcgggcagccgccgcgagtacttgcgggccaggctggaggagggccgcgccgtgctttatccgaaccagagttccggtgtgttgctgggcgcttcctgggccgatgggctggtggagattcttgagggcagcaccttgcagatcggtgagccggcacggttcattccgttcagcgagttgttctagccggcgcggtctggcggcaggcgcggggcactcagatcttccagtgctccgcgcttttcgccaggcgctggcgcatctcgttgaggttggccaccagttgccgggtcagcaggcggtagccgtccagcgcggtgtagaccgaggtatcgagggtcgaggaggacgggccatccaggggccgccccaggcgtctggtggcgccggattgcagggcgcgggccatgcccaccagctgtatgcgcacctgccggtgctcgtgtttcaacacctgttgcagctgctcgcgagcctgtggggcgctgaggtccggccgggtattgccgaggatttccagggtgctgaagcacatgcgcaggttgcgctggatggcgtccagttcagtgatggagatccgcacttccttggacaccgagggcatcagcgagcgcagttgcagcaaggtgccgttgaggcgcccgagcaacttcaggtgttcatcgtcggtcaccgactggccgccgatgatgcgtccgtaaagggtggcgcagtcgcgcaaggcgctggccaggctgtagcgccaggagtagaccgcatacagcgggatggcgaaggagaacgccagggccagggcgataccgatgaggatatccacggtgcgccacaggccatcgctgacgtggttgtcgccatggccggcgacgatgaacacggtgatcgccgccagcagcgcggtgtagccgcccttgccgatggcgtgataggagaaatacccgcacaccaccgacatccccaggtaggtcagccaggacaggcccaggtaagcctgctgcaccaccagcaccaggccgacgcccgcgccgatcagggtaccgatggcccgttccgcggccttcttgccgatgttgccgtggtgctgcaggccgccgatcaccaccagcatggtcaccgatgcccattcgccgtggggcagattgaggccggtggtcagcgcgatggtggccagcaaccccagggccacgcgcaccgcatggatcagcttggcgtagcggtagcgccgatacgggtccagtaccgggagcaggaatcggcgcaacagcggtggcaggcgaaaggtctggcccaggggagttctccgtttctagaaaatgtaatcggtggtcaggaagctcgactcgcggttacggatgatgtcgctgatcaactccttgttgctctcctggaacttggtggccaccagggtgcggatcgagaaggtgcgcagcgcgtcatggaccgacagcgtaccttcggcagagttcttgcgcccgttgaacgggtaggtgtccgggccacgctggcactgggcgttgaggttgatccgcccgacctggttggcgaaggcgtcgaccagcggcccgacttgcgccggctgggtgccgaagatactcagctgttggccgaagtccgattccaggacgtagtcgatcaccgtttccaggtcgcgatacggcacaatcggcaccaccggcccgaactgttcttcctggtacacgcgcatctggctgttcaccgggtacagcaccgccgggtagaagaacgaggcccgcgcttcgccaccgccggggttgaccaccttggcgcccttggcgagggcgtcggccaccagggcgtgcaggtaatcgaccttgcccgactccggcagcggcgtcagcgccacccccggctcccacggcatgccgggtttgaggctgagcagcttggcgttgaatttctcgatgaaggcatcgaccacgctttcatggacgaagaggatcttcagcgcggtgcagcgttggccgttgaacgacagcgagccggtgaccgcctcgttgaccgcgttatccaggtccacctccggcagcacgatgccagggtttttcgcgtccaggcccagggccgcgcgcaggcggtgcggcttggggtgcagtttcttcaggtcgctggcggccttgttggtgccgataaaggcaaagatatcgatcttgccgctggccatcagcgcgctgacggtttcccggccgctgccgtagatcacgttgatcaccccggccgggaagctgtcgcggaaggcttccagcagcgggcggatcagcagcacgccgaacttggccggcttgaacaccacggtgttgcccatgatcagcgccgggatcagggtggtgaaggtttcgttcagcgggtagttgtacggccccatgcacagggccacgcccagcggcacgcggcggatctggccgagggtgtcctgttccagctcgaagcggctggaacggcggtcgagttccttgagggcgttgatggtgtcgacgatgtagtcgcaggtgcggtcgaactctttttccgagtccttgaggttcttgccgatttcccacatcagcagcttgaccaccgccgagcgctgttcgcgcatgcgcccgaggaaggcttcgacgtgctggatgcgttcggccacgcgcatggtcggccacgcaccctggccacggtcataggcgcgcacggcggcgtcgagggcggtcagcgcggtatcggcgtcgagcagcggggtgctgccgagaatcacttgttcgtcgccatgggcggtggccaggtacaccgggctgcgcaccagggccaggggcccgttccaggtctgcaactgaccgtcgaccaggtactcgcgttgctcgacctggccgtccaggcggtactgctcggggatgtcggcggcgacgggaaacagcgtgttcaacagaggggctgtggtcatgactctattccgtaatggcaatgggcaatgcaccggcgggctggagagcgcgccggcgctgacgggcgagacgggtcttcaaggtttgtttctacgggtatacgccttgatgtctcgggtctcgggctctgtacaaaaagtggctacgctcggccatgctgcgttaaaaacaggctcggaatgctcatgtaggtccctacactccgcttcctcgcctgtttttgccttgcctggccttcgctcgccgacttttcgtacaggcccttagcaaaaagctgggccaaaatggcggaaagtcgtgcagcagaggtgtgatggtgtggttctttgggccaagagtagccgttttttcccatggaaaaacagcctttgtttcaactggcgctgaacaattggcggatcagcctgggtgtgctgccggtccagcgcttgaacgaacggcggaaattcgccgcgtcgttgaagctcaggtactcggcgactgcctcgttgctcaggcccttgatctggtacaggtacagcgccacatgcttgcgcaccaggtccgcctgctgctggaaaccgctgtcgtgcttgtgcagcttgcgcttgagggtggccgggctcatgccgaaggcctgggccgtctgttccaggcttggggcctggcgcacccggccttgcaggtagcggtagacgcagtcgagaaagcttgaggcaaaccccagttgctcgagctggccctgggcttcctggcgcgccacctggccggcggtggccgaggcgttgggccagggctgggcgaggaattcccgggggatgcgcatcaggtccatgggccgcttgaactgggtgtgctcgcccaggtgcacccagtactgctcgacataacgcggctcggcatggctgaagctgcattcccagggcaggcgctggccgctcagccactgactcatggccaccagcgaggtcatgctggcttccagcaggaaacgccattgctcgccggcgccacagctgtccagccagtagaaataggcgtgctggtcgtccagcagcaagcgcgggctggccagcgggctgagcagcgcctgttgctgcaccagagtgtcgagagcctggtgcaggttctgcgcgtggcgcagggcgtggctggcggcgccgtagtgcccgggcagcaggcgctggccgaacaggaagctgctgtcgtcggcgtccagcagccgtcggctgttgccaatcaggccgagaaactgctgtgggctgaggcgggtctggccggccaggatgtcctcgtggaacagcccggtgccgcgcagcagacgatggctatcgatgtcccgcgacagcgccagatcgatcaggctcgctggctggtaatgcccgggaatgaaccggctgtcgttttcgtaccaacgggtcttcagggtcatggccgggcctcaggcgctttttgccagcggctgcttggctcgggccagggccaggttgaggcgcttgagcagcacctccggcgtttcgtcgagggccatcaccaccgcggtgcaggcgcacagctgcaagcgttcgccgtgctggcggctcttgtgcgccaggctccgtaccgcctgttgcagctcctgggccagcagccgcgcctggctctcgccggtgttcggcagcagcaccacgaagcggtcgccagccagccggcagagcaggtcctggcgacgcaggttgagcagcagcagatggctcagcgcctgcagcaccgcgtcgccctcggcgtggccgaagtcctggttgatcgcggcgaagttgtccaggtccagggccagcagcgacagcggctgctgctggcgctggctgtcctgcaggctgtcggccagctggcgcttgaggtagtcggcgccgcccagcggggtgagcttgtcgaacagccggtgctcgcggaacagccgttcgcgtttttccatctgcgcgctgatcgccagctgttcgcggtgccagtggtagatgccgatggtcagcaggaccatgcccaccggcatcggcccggattccagccagtggtcccaggcgatgctgtcgggcaggcggatgaattcgtcgaggctgtcgatccaccaggagaaaaagatgcagctcaggcccagggccaggtagttggtgacccgtcccgccgggcggcttttcagcaccaggccgagccagatcagggccagcagggcggtgccgccttcgccgacgatgtccagccagacccattcgctgaccgccttcaactcgccacaggccaggtgcaggagcaggccgagattggccgccagcagcaggctggcgagtttccaacggtggggtttgagcactgagaacatggccgcgatcctttggcgaagaagcaatgcgcgccagcacagcagatgtgtgtgacagccgggtgacggcggcgaagcgggtaggggaggtcgaatcagctcaccgtggtggtgtgtttttttgcgatctgggggcggtgtggccgctgacgttacgcggtgtaggagcgaggcttgcccgcgaaagcgtcagaccagtcaccgccacccccgggaaaaggtcatttcagctcactttgcccctcgaacccggcccaaaccccggttcgccagccttcctgccaacccctgtcactgaaccgtcattcgccgaccctagcttgccctcccagttgccgggcccctttgcctggcgtcaccggactcttgggggaggaccatcatgtacaagcgcagcagcaccgccggcctgctcggcttcacgctcaccgccctggccatggcgatcgccagcgaacgcttgagcgccgccgaagccgactcgagtaaaaccaccgaacacctggaagtggtcggccaggccgcgagcatcgaccaggcgctcaaggagcagcgcagcgccgacagcatcaagagcgtggtgcacgccgacggcatggcccagttgccggacgagaacgtcgccgaagcggcgcagcgcctgccgggcatcagcgtcgagcgcgaccagggcgaagggcgcttcgtcagcgtgcgtggcctgggcccggacctcaacagcgtgaccatcaacggcactctggtgccggccccggaaagcgaacgccgcgccgtggccctggacgtgctgccctcggagctggtgcagtcgttgtcggtgatcaagaccctgaccccggacatggacgccaactccctgggcggcacagtcgatgtgcagagcctttcggccttcgatcacaagggcctgttctacaccggcagcagtgaagccagctacgaccggaacactcaccagaccagcccgaaattctccggcgcggtcagcgaccgcttcagcctcggcgacggcatcgacaacttcggcgtggccgcggccctgagctggcagaagcgcgacttcggttcggacaatgtcgagaccggcggcgcctgggacttcgaacagggcgcgaaactgcaggagttcgaacagcgcgactacgacatcagccgcgagcgcgccggcggcggcctgaacttcgactacaagccggacgacctcagcagttactacctgcgcaccctgtacagccgctacaaggacagcgagacacgcaacgccgccagcctggagttcgccgagccccaggcggccggcgagctgggcgacgccgaaggtaaacgcaagctcaagcagcgcgaggaaacccaggagatccagtcctacgtgttcggcggcgagcgcatgttcgacctctggaccctcagcggccaggccggctacagccgctccagcgaagacagcccggggcacatcgccaacgcggtgttcgaaggcaacgacgatttcgccgacagcggtttctacgacaaggacaagccgcggccgatcgtcggccagggtttctacgacccggccaacttcagcctggacaaggtcgagtgggaaaagcagcgcaccaccgacaccgagaaaaacctgcgcctggacctggcccgcgactacgacctcagcggttatgcgtcccaggtcaagttcggcggcaaggtcagccggcgcaacaaggacaacgacctcgatgcctgggtctacaaggacttcgacgaactgggtttcagcgacgagcagctcaacctcgaccgcttccgcaaaggcagcgtcgactatcgcctcggccgcttcggcccgggcatcagcggcggctcgatcaagcagttgatcggcggcctggaccgcgatgcgtttttcgacgaaaccgaatcccgggtcaacgacttcaagatccgcgaagacatcaacgccggctacctgatgaacaccctcgatatcgacgactggcgctttatcgccggcctgcgctacgaaggcaccgagttcgaagccaagggcaccggcgccaccgacggcgcgttccagtccaccgcgaccaagcgtcgttaccaccactggctgccgggcctgcacgcgcgttaccagctggacaagaacacccaggtgcgcgcggcctggaccaaggcggtggtgcgcccgaccttcggccagctggcgccgggttttgtcatcgacgatgacgaggccagcttcggcaacccggacctcaagccgctggagtcgagcaacctggacctgggcatcgagcacttcatgggtcgcgccggcaccgtctcggccttcgtgttctacaaggacatcaagaacttcgtctacaacaccgacctggccggtaccggcgcctggaccgacttcgccgaggcgcacaccttcgccaacggcgacagcgccaagctgtacggcctggaactggcctactcgcagaaattcgactggctgccggcgccgtggaacggcctgctgctgggggccaacgccaccttcagtcgctccgacgccgagatcaagggtttcgacgccgccagcggggtcaaccgcaagcgcagcatcgacctgccgaaccagtcggataccgtcggcaacctgatgctcggctgggaaaacgacacgctcagcctgcgcctgtcggccaactacaagtcggactacctctatgagctggcctcgatcgacgacaaggcccacgacctgcacgtcgatgcccagaccttcgtcgatttcagcgcccgctactcgctgaccaagagcctgcagctgagcttcgaggcgcagaacctcaccgacgagccgtacttcgtctacaccggccaccgctcctacaacggccagtacgaggagtacggcccgacctacaagctcggcctgaccttcacccacttctaacccacaccgcacacgctgtaggagcgagcttgctcgcgaaggtcttgaacgatgacgcgggctgtttgtaagcacgcggggtcttgaggtttttcgcgagcaagctcgctcctacagagggcggtttgcctgacaaggattttgcctgttcatgagaagttcctacctgtacctgttgatggctgcgttgacctgcggccagacgatggccgccgacctggctctgcgcccttgggcaccggcgcttgaggcagatgccatcaccttcctgcccaacggctccgagcgcctcgccgcgagcaaccgtgacggcctgctgttgctggatgccgaggggatcgagctggctcgcttcaaaggcaacttcagcagcctggatacccgcgccgccggccgccaggtgctggtcgcgagcctggacaacgatcgccagcaggcgctgctggtcagcctcgatccacagagccgccaatggggccagccgctctacctgccggcgcgggacttcccggtcaacggcctgtgcctgtaccgcgacgaagccagcaacctgttcctgttcctggtgggcgaggagggcaagggcgagcaatggctggtgggcgccggcgcccaactgagcgccaccgcgcaacgggtacgcggcgtgccgctgccgccggcggcgcagttctgccaggtggacgatggcgccaatcagttgctggtcaacgaagagaacgtcggctggtgggcctacccggcgcaccccgaggcgcaggtcgagcggcggccggtggccatgcgcgcgcccttcggcgacatcgcccaggccgccggcgccatggccctggtgccgggcggcgtgctggcgctcgaccccaaggcggcgcggctgcacctttatcagcagggcgaccaacaacagggcgaaggctggtcgcccagggccaacctgagcttgccgggcctgaaggagccggaaaacctcgccgtgcaggccagcgccaagggcctgcaaatactgttgcgcgacgatgacgacgggcaggtctaccagggccggctggactggcaggctaccccggtgccgctggcgccggtgctgccgaatgtgccggccctgagccagagcgagccggtggggcgccagggcgacgcggcggacgacccggcgatctggattcatccgcgccagccggagctgagccgggtgctgggcaccaacaagaagcaggggctgctggcctacgacctgcaaggcaagttgctccaggagttgccggtgggacgcttgaacaacgtcgacctgcgggcgaacttcaagctgggtacccaggtggtcgacctggcggtggcgagcaaccgcgatcacaacagcctcagcctgttcagcatcgatcgcgccagcggcgagctgcgcgaagccggggagatccccacgccgctcaaggaaatctacggtatctgcctgttccagccggccagcggcgagctgtatgccttcgccaacggcaaggacggcagcttcctgcaataccgcctgagtgccgccgatggccgggtccagggcgagctggtgcgccagttcaaggtcgacagccagccggaaggctgtgtcgccgacgaccagcgccagcgcctgttcctcggcgaggaagacgtcggcgtgtgggcggtggatgcccgcgccgaccagccggccaacctcagtagtgtgatcaaggtcggcccgcagctgcatgccgatgtcgagggcctggcgctgtaccagagcgagacgcatgactacctggtgatttccagccagggcaacgacagctatgtgctgctcgatgccgagccgccgttcgcctcccgcggggctttccgggtcggcctgaatgccgccgcgggcatcgacggggcgtcggaaaccgatggcctggaagtcacctcggccaacctcggcgggccctggagccagggcttgctggtggtccaggacggccgcaagcgcatgcccgagcagacccagaacttcaagttcgtgccctgggccgaggtggccagggcgctgcaactgccctgagctgtcattaaccgttcatcaacatgtcatcgaatagccccggcgccgtcgcgcattgacggcccgggcgcacaggcaaaggagtttcaccatgcaggcgacactggaacacatgaccatctgggggctgatcagcgatgccagcctgttggtcaaggcggtcatgctcaccctgttgctggcgtcgctgctcagctggtacctgatcatccagcgcaccagcgtgctcaagcgcagcgaacgccagttcgacgccttcatccagcgttttcgtagcagcgccgaactgaacccgctgtaccgcgaaagcctgcaacaggcggacggcgagggcggggtcgagccgatcttccaggccggtttccaggcctacagccaactgcgccagcagggcggcaacccggccggggtggtgctcgaaggggtggaacgttcgctgtacgtggccatcagcgagcaggaaatccgcctggaaaaaggcttgcagttcctcgccacggtcggttcggtcagcccctatatcggcctgttcggcaccgtgtgggggatcatgaattccttcctcggcctgtcccaggtgcagcaggcgaccctgtccaccgtggccccgggcatcgccgaagcgctgatcgccaccgccatcggcctgttcgcggcgattcccgcggtgatcgcctacaaccgtttcgccgcccgtggccagaccctgctgacccgctactacgccttcggcaacgaactgcaggcgcgcctgcatcgccagttgcacggcgcgtcgtcgaacctggccgtcgcggcctgagaggagagtgcagatgctagtcaggccgcaacgcaagcacgggcccaaggccgaaatgaacgtggtgccctacatcgacgtgatgctggtgctgctggtgatcttcatggtcaccgcgccgatgctcacccagggggtgaagatcgagttgcccaaggtcgccagcgaggctctggccactgatacccgacaacagatcctgaccctgtcggtgaaggccgagggcggctactactggaacctcggcggcgagctggatacgcgccagcagaccgacagcgcggtggacctcgacgagatgcgcgccaaggtcgcgcaaatcgtcgccgcgcgcagcgatacccaggtctacatccgcgccgaccaggacgccggctacggcctggtggtggcggccatggcggcgttgcagcagggcggggtgagcaacctggggctggtgaccgaggccccgcaatgacggcgatgatcatgcacagtccacggcaggctttcgacgaattctccctgcaaccctcgcccaggcactggcggccccatgcgctggccgcggcggtggcggtggcgctgcacgccggggtgctggcgctgctggtggcgggctggtcggtagagccgccggccgccgaacagccggcggtgttgcgtacccagctggtgatgttgccgccgacagcgccacaagcgcccgagcctgtgccggctttagtcgagcccgcaccgacacccgcaccaccggagccggtgctcgcggccccggtcgagccagtcaagcctgctgtcgatccgcagctccaggcgcgcaaactcgaacaggcggccctggcgcgcaagcgggtcgaggacaagaaacgcgagcaactggccgaacagcagcgcgagcgccaggaaaaccagcagcgcagccgcgaagccgagcagcagcgtctggcccaggagcaagcgcaacagcagcagcgtgccgaacaggcccgcttggccgccgagcgcgcccggcaacaagctgccgcccaggccgcggccgacagccgccagtacctgcccctgagcaaggaggccccggactacccgcaacgcgccctggacaagcacatcgagggcgactgcaccgtggaatacagcgtcaacccgcaaggcagggtggagaatcccaaggtgctcgatggctgccacccgctgtttatccgcccctcgctggcggcggccaacaccttccgctaccagccgcgcatcgtcgacggccaggcggtggcggtgcccgcggtgcgcaacactttccactaccgcatcaaataaccctggcaccacacctggcctcagcctctgtaggagcgcagcttgcccgcgatgaacgagaacgcggtgcacccggtagaccgcgtcgtctccatcgcgggtaagccggatcgccgcccgctcgctccgacgtgtatcgaacagaaactttctcactgtttccattcgtatacagattgaatgaccagttgttttgttaagtgatttttagaggcgatataagatgttttttatataaggcgattcttaaatttccatgtaagacgtttctgaaaataagtcagatttttaagttttgacaatgttgatgatataaagctgatcccatttttcaagatgctcgatatctcatgtatttatattttcggaagcattttttcgggattcttgtgtttgtcctttcacttgtctgctcgaaagtacaagcaagttgcactattgattatggcggcactaacgtcggtacgcgcactatcagattgccaatgacaccctccgaatcctttgatcccagtgttcctgacggcacggtcctgtacagttcaacctcacaaggatcagcgcaggtaggcaccgccgagtgctccggacctattggccgtctcgagtttaggggggtaggggctgtgggcaggttcaatacctactcgacttcggtttccggtgtgggtattcgaataaactactataaagcgggatggtggccacagtcactttcgtccagctcgacgatgtacgctctgtacgattactccccttccgtaaaaatcgagttggtaaaaaccggccctattacggcggcggggcggatgaccgggcttatcggtacctttacatctatcgatcacggcatggactttcagcgttttgtaatcagcggcaatctggagatcaagccgagagtccctacgtgcgccgtatcgacccccacaatcgccgtgggcatgggcaaagtacatgtcggtgctgtggccgataagggcgctactaacccggcacgtcctctggagattcgtttgcaatgctcgggcggggatgcaggcgcccatacaagaatgttcatgaccttgagcgacgccgccaacccgggcaatcgctccactacgttgtcgttgctgtctggcagttccgccacgggagtaggcatccagatactgcgcagcgacgacacgccggtcggctttggtcccgactcggcggtagctggcaatccgaatcagtggcaagtaggcgagtttggtaacggcctggtgaccattccgttaagggcacgttatatccccaccggtggcaaggtcggccctggaacggccgatgctgccgcgaccttcaccatgagctaccagtagccgaacggacgctctccattcagcggtcaatccagtaatccagcacatcacgctcaaacgctcttgtgctgctgcaggggctggccgcagatgcccccctcgctggcccgcaatgccctcaggccgtggccgcgcctgccttagtgttggctctgggtcgatcccgaccgtcacccgagaggaacaccatgccggcaccgactgcctcgctgcggttttcatccgtcgtcacgctgtatcgcctggggcgcgtcgccttatggctggcactgggcgggctgctggtggcctgcggcgacaagcccgcgccgccctctacggccgtggtgcaacagctgcccgacgatccggcgctggcgcggatctacgacagcagctgcaagctctgccacgccaacccggcgtccggcgcgccgctgaccggcgatatccaggcctggcggccgcgcatcgcccagggcgccgataccctgctggaccacatcatcaacggctataacggcatgccgccgatgggcctgtgcatgcagtgttccgaggagcagttcctcggcctgatccgcttcatgtccgcacaagacctccaataatccggcacaaggacactggcatgagcatgcacctcacacgacgtcagctgttgcaacgcgccgcagtggccgggaccttcagcgcgctggccagcaacccactgctggccgagctggcgcgggcgccccggctgattccctggcgcaactggtccggcgcgcaaagctgcctgcccctggcgcggctggcgcccaaggacctggatgagctggtgcaggtgattcgccagaccccgggcaagatccgcccggtgggttcggggcattccttcagcgccctggtgcccaccgacggcacgctgctgtcgctgagctttttcagcggtctgctcagccacgatgccaccaccttgcaggccgagttcgccgccggcacgccgatgtcgcgcatgggcgcgccgctcaaggcgatcggccaggccctgccgaacatggccgacatcgactaccagaccctggccggggccatcgccacctcgacccacggcaccggcgtcggcttcaaatcctattcggcccaggtgtgtggcctgcaactggtgaccgccagcggcgaggtgctggactgcgacagcagccgtaacgccgaaatcttcaacacagcgcgggtctccctcggtgcgttgggcgtggccacccgggtgcgtctgcagaatcgcccggcctatcgcctgcgggaaaaacagtggatcgccaagaccgaggaactgctcgaagacctggcgaaaaacacccgcgagaaccagcactgggaaatgctggtggtcacccattccgactacgcactgtcgattgccctgaatgaaaccgatgacccggcgaccccgcccgtggacccggcacaagagggcggcaacgagttcgtcagcctgatcgagaacctcgataaatacctcagcgactttcccgaaacccgccgcaccctgctcaacagcctgcggcatttcgcccgcttcgacgaccgggtcggcgactcctacgaggtctacgccaacgtgcgcaacgtgcgcttcaacgaaatggagtactcggtgccggccgagcacggcccggcctgcctgcgggaaatcctcaagctgatccgcgacaaggacctgcgcacctggtttcccatcgagtaccgctatgtccaggccgacgacattgccctgagcatgttcgagggccgcgacagctgttcgatctcggtgcaccagcactacgccatggaccaccacaacttcttcgccgccatcgaaccgatcttctggaagtacgccggccgcccgcactggggcaagttgcacagcctcaacgcccggcagttgcaggcgttgtacccgcgctggcaagcattcacccgggtgcgcgaagcgctggaccccggcggcaagttcctcaatgcacacctgtcgtccatcctgggcgtggtctgaagggagaaaaaaagcatgaatcgacgcaacttcctgctcggtactgcgggtgtcggcgccttgttggcgggggtgggtgcctggctgcggcccgccgaccggggcgggccctacagcgactatttccgcgcgctgaaccaggaactcaaggcccacggcccgatgcgcccggtgctgctgatcgacctcgaccgcctggaccacaacatcgatgtggtgctgcagtcggtcaagcgcggcggcaagcagctgcggctggtggagaaatccctgccgtcgccggggctgctggcgtacatcggccagcgtgccggcacccagcgcctgatgtcgttccaccagccgttcctcaatcacgatgccctgcgttttcccgaggccgatatcctgctgggcaagccgctgccggtgcgttcggccgagctgttctaccaggaccacaaaggccggttcgacccggcccggcagttgcaatggctgatcgataccccggaacgtttgcagcaatacctggccctggcccgcggcctgggcacccggttgcggatcaatatcgagctggacgtcggcctgcaccgcggtggggtgaaggacagcagcggcctggggccgttgctgaccctgatcgcggccaacccccaacacttggagttcgccggtttcatgggctacgacccctttgtcggcatgggcgtgccgggcattctcggctcgcccgaagcgctgttcgccaaggtcatgcagcgctaccagagcgccgtggacttcacccggcaacgccatccgacgctctggcagccggggctgaccctcaataccgccggcagccccagctaccgcatgcatgagcgggaacagttgagcagcgaggtgtcggtgggcacggcgatgctcaagccgacccattacgacctgccgtccctcagcgaacatcggcccgcggcctacatcgccaccccggtgctgaaaaacacgggcccggtgcgcatcccggcgctggacgacaagtcgaagctgctggcttggtgggacccgaaccagcgcgagacattcttcatctacggcggcaactggcaggccgagttcgagtcgccggcggggctgcaaagcaacggtctgtttggccgcagttccaaccaggagatggtcaacggttcgccctccgtgggcctggggccggacgaccaggtgttcctgcggccgatgcagagcgaagcgctgctgctgcaattcggcgacctgctggcggtgcgcggtgggcggatcgtcgagcgctggccggtctatagctaggtttttgcgctgttctcaaggtctttcgcgagcaagctcgctcctaccagattgcgttcttctgtaggagcgagcgggcggcgatccgacttgcccgcgatgaccgtgacgcggaatgtctgaaccaccgcgttatcgttcatcgcgcgcaagctgcgctcctctattacaaagagaacggaatcgtcagcttggcccacagcatctcgccctcgggccggttctccacgtcgaattccttggcccagcggatctccgcgctggcgtacttgaggaaggtcaggtacagcgccgggccgatggcgaacacctggccgcgcacgccatcgtccacgtcctcgccgagaaactgcacggtgcggccgtactgtttgtcgtcgctggtctgcttcaggtagtagccgttgagccccaggctcaggttgtcggtcaccttgtagctggcggaatagtcgaagtggaaaatctgcccggacttgtagtcggtggcgtggttttcctcgttgaagctgtaggtggtcttcagcgacagctcggtgcgcggagtcggcagccaggtcaccgaaaccagcggcttgtaagtgtagaagttgttgctggtgttggccaggcgcgtcgcgtcgtacttgccggtgggaatggtgatttccacggcggcgcccagggtcaggttcttgcccaggtcccacaggatgatcggcgcgatggtggtgtcgcccatgctttcgcgctggtccttgaggccgaagacccccacctgctggcgcagatagggctgcgccacgtagccgccgaggcgcccgccgaatacccgcagcgggctcaggtagtcgaggcggggaatgatcgcgtccgagacgatccgcacgtccggcaccttgccgcccagggagctgatattcagcttccgcgcttcgtagtggttgtaatacaggttgttctggggcttgataaacgttaggtcataagtgttttataaacaataaattagaaaacaattgtcgaattgaatcgccccggcttttgtggaggccgtttcgtttaagtcaggccgccatggcctgacctgcttgttgctggtgaaagtttgcctcagcctccgcgggcgggatatatccgattgagctcagcaggcgttggtggttgtaccagtgcacccatttcaaagtcgccatctcaacagcttcgcggctcttccatgattgacggtaaatcagctcggccttgtacagcccgttgatggtttcggccaaggcattgtcgtagctgtcacccttgctgccaaccgagggctcaatgccgcctctgccagccgctcggtgtagcgaatagagacgtactggctgccacggtcgctgtgatgaatcagtccatcggcacggtgtggctggcgggcatacagggcttgctccagggcatccagtacgaagtcggtcttcatgctggtactgactcgccagccgacgatgcgccgcgcaaagacgtcaatcacgaacgccacgtacagccacccttgccaggtcgagacataggtaaagtccgagacccagagctggttcggacggtcggcatggaactggcgttgaacacgatccagtggacacagcgatttgtcgctggccaccgtcgtccgcacaacctgtccgcgccttataccctgcaatcctgcctgccgcattagccgctccaccgtgcatctggcgatcccaatgccctctcgctgtagctgcttccagaccttcaccgcgccatagcactgcatgttggtatcccatacacgctggtgatctccagactcaacacctcatcgcgttgagcacggcaacaacgcaagtcagggttacgtagttgggccgcatgcctgcggtaaccggacggggcgatctgcaaaacacggcagatcgactcgaccccgagacggtcacggtactggtcgacaaaggccctcaggacttggtacggcggtcgagttccgcctgggcaaaatacgcactggccagacgcaggatctcgttggctttgcgcagttcgcggttctcacgctccagagccttgatgcgctcgcgctcttcggtggtcggccccggacgttgaccggcatcggttggatgacggcgaatccagccatgcaacgtttgcgctgcacagccgatcttcggggcaatggcctcaatggccgcccactcggacgggtagtcgttcaggtgctccagaaccatgcgcacggcacgttcacggacttcaagggaataggtcgtagtctttctcatggcctcatcttctcaagagttgaggcctccacgaaacccggggcgattcagttttatccgctggtttggtttgctggccggttattgggtcgaactcgcctaagtgtttgccgcgtttgttgtacttctccagcctgccgtgttgggagtcccattcgtagatcgtaccgtctttgtctttccatcgatcacgcaagccgccaccttttttgggggttttaggctttgaccatttgaggccagggaaagcgtggagattttggggtttgggatgatagttctggcctctgggcagatttaacacgatatagagcggccgaaccccagaccccggcgggaacaccaggatgaagtccttgtactccggcgggtagattgggttgacgatgatggtgtccgcctgttcggtgggcggaaagatccagatgtgcggcgcttggggcgcggcctccagtggggggatgccggaggtgctggacgggtcctccgcgggcgtccagatcagggtgacgccgtcgccgaagtcggccacctgttgctggccttcggcagcaaagtgcaccaccgggaccatttcccagccacgctgcttttgcgtgttgtagccatagcccttgagcgtgccgtcaggccgttgttcgagatgcaggcggacgcgggtgcggccttctttcagggcgtcgagttgctcgggcgtgtacaaggcgctatcgcccaggctcgaaggccagagcatggccaccacgccagccagggcacccgcgaccacgccgccgcttgccatgccggccccggcagacgccacggcctcgccacccagcgcaaggctgcccagcgcggcgggaagggcgccgctgattttcttgagcgggatattccccgtcgcgtccgcgccacggccccccagtaagacaagctcgccatagtccttgatggcgtcggtgggaatcgccccggatgggctgaggtagtccatgaccccgtcgggcagcttgcaggatttggtaaaggtgcagccggccatcgcctgttgcttgcggggtgggctggcgaggctgtctgcgtaggcttgttggcgaaccagcatccgttcataggcgttttgcctggcctcttgctcagcccgttcgctgggggtcatgtctcgataggtgatgtggtgcccgtcgccggaagggggattcttgatcggggggagtctgttgcgcgccatcgagggttctgcctgtccatccagtgcggttttccagccggcggcgggatggcatcaaccctattggctatggacaggcattactgcgggaggaatctgaaaggtttgaagggcaagtctttacttttacgggctgacaagcaggacgattctggctaatgccgatcagttaaggacgagagtgggggctggtgtaggagcgagcttgctcgcgatggacttgagagcgccgcgttcatccactcgacacgcgttatcgttaaccaccatcgcgagcaagaactaggcgtcccccttgtaagctggttttacctgcttcagatcgtggttcgcaaaggtttcaagatcgtgagcgagcctgagccggttcaggcttcccggccgtgggccgctgcggccagttgctcggtatcgacccgcacgaagatcgagtcgccaatcgccgtcagcacatcgccggcgtagacctcgcagatcacccggctcttgcgcccgacttcgccttcgaccttggcgcgcaaggtcaggggcacgcccatcggtgtgggcttgatgaatttgatgccgaggttgccggtcacgcagttgatccgcggctggctgtccagggcgcgtttctcggcgcggtagtggtaggccatggcggtccagttcgagtggcagtccaccagcatggcgatcaggccgccgtacaccagctcgggccagccgcagtattggctgtccggcaggtgctcggccatcacatgcaccccatcctcatgccagtggctcttgatgtgcaggccatgggggttgcggctgccgcagccaaaacaaacgccgtccggcgcggtgctgtcttgcagggagagtgggtgcatgtgtcttaccttttttattgttggagaaggaaagcctcaggccgccagtgcctgtatctgcaggtcgccgtcgacgtccttgaccagcccgctggccagcagcaggggcagcaggcgctgatgcagttgcggctcgacgaattccttgacggtgtccagcgccaggttgccgctggtttccagctcggccttggtgtaggacagccaggccttcttcagtaccagcagtacgtcgctgccggcggtggtggcgaagcggcggtgggtgactttaccgtcgaaatcgaagctgtgctggtaggcataaccgctctcgacgcccgcgctggcgacacaacgaccgcaggtgcatttgccgtcgccgaaggccgtgcgcagataggtgttgaagtccaccacgggcttgagccccaggcgcttgtcgacttcgaacagatccccggtcagtttttcttcagtgctcaacgtccatttcctcaagtcatgcggcgtgttttgacagggccgcacgataccagccggacgcttgcagggggaattttctgcccgaaggtggcgagaaacccgcgtcaggaacctggaccggcggctgttgccgagcctggcgcccgtagtgaacaagtggccagtaaaagagaggcacattgccttctccaataaggcccgatgctggccccgcagtcactcaatcaccgccaaaatcactttaatttcaggtggttaggtagatcgaaaaatgcgcaatgtgtggatgacgctgacctcgttcgccttggtcagcgtggctgtcgcggccgagggcaaggagttgccggccaatgaccggtatgtgtgcagttggggcgcggggacggcggcgcgggcgcaggagttgaaactgtcgggggtttcgctgtatgccgcgcggcagaagctgcagacctacaagttcagcaagggctggatgcgcatgctggccctgggcattaccgaacagacctacgacagcccctcgcgggccaagccggcgacggtgcggcagagtttttacgacgattgcgtgcgctacaagctggcgcgcaaataacccgggaaggcacgcggaattgccggttgcccgggctgccatgctggcgtgggcgccggcgatcctgggtcgaggcctgtcggctttgcctcatgtcctcggacctttggtccatggatcgacagagtccgccgccatctgatccgtatttttcttcgtcacctgcgtctgtatcgggatcagatctggcctgacaataacgcacccctcaggcgcaccggcctgccggctggagcctgaggttgcgttctgcttttcgcgttggcgaaaacctattgttcaggaggcctttatggcgaagatggcgattttcttgtttggattcttggcgctgaccatcgcgatcggtctgctggcgaccatctctccgacttgaggaggtattcaacgtttctgtctgtttgttttcgctttggaaagttgcactttccgtacaaggctgacgttagttaattggtattcattcggtgactggcaccatattttggggtgttgtgctgaatccttatctcacttttttagtgagttcagataggccgacttcagtgcaaggcgaacagttttcaatgattcagggtcaagtagcgcaatatctttagtcggcaatgattgcccaggccggtcaaccttgatcctactttttccaacagagattacaccgcttacatcaaccgaaatttcaacctgacatgccgtgtattcgggggtattccaggttttaagaaatatctgtttgatttcgatttttgctttgctcttaccctccgaacgcgagtcaagcgccgatttcatcagtgcgtgccagtcttgtaccgggatcatggtgtacccctcatacagaaaaccgctgtaattagcggcgtgccagacaatcttgcttcgctccgtgcagttgctgcagcgttctatcccagaaacttcaataacttcgacatcagttggcgttttgcggatttcggataactcctgctccgtgctgtaggaggccaaatgaagctgattggtagtgcatccagccataaagaccatagctaccaacagcgtgtaccgaattaactgcattctcctgcccctccctttgactgatcgatcagaatactcaagccaggtattttgagcgccgccatcctactgtctgttgtgtctatttgccaggatgcagaaaggttcttgaacgcattgttaatgcagatgtttcagctactggtttcggatggaatggcctcctagagcaaaacagagtgaggttggccgtgctgttcaacgttctagtagatggggggagggactgcagtcgctgtaattctgattaagaaagcggttcgatcttatttacttgatgcccatttcataagtttcttgctcttccctgaaccgctatttggaaaacttcctcgccccggccacgcacaaaatcaccgccacggtcactcccagcatgcccaggctgacctgctcatgcagcagggtggccgccagggccaggccaaagaacggttgcagcaactgcaactggccgacggcggcgatccctccctgggccagcccgcgataccagaagacaaagccgatcagcatgctgaacagcgcgacataccccaggctcagccaggcgggcagggtaattccgctaaatgaaggcggggcacgcaacaggctcagcagcgccatgaccggcagcgccagcaccaaagcccaggaaatcacctgccagccgcccagggtgcgggagagcttggcgccttccgcgtaacccaggccgcagaccaggatcgccagcagcatcaggatgtctccggccggcgcggcgctcagcccctgggacagggcaaaccccaccaccagcaggctgcccagcaccgagaacagccagaacaccggccgcggccgctcgccgccgcgcagcacgccgaacaccgcggtggccagtggcagcaagccgaggaagacgatggagtgagccgaggtcacgtactgcaaggccagcgcggtcagcaggggaaagcccaccaccacgcccagggcgactatcgccaagggccacagctggtttctgttcgggcgtttttccttgaacaacagcaacaagcacaaggccaggaccccggcgatgctggcgcgggccacggtcaggaacaacgggtcgaattccagcacggcgacccgggtggccggcagcgagccgctgaaaatcagcacgccgataaaaccgttgagccagccgctcgcggccttttgcgtggtggggtgtggcaggggggatgtccgttccattcaggggctcagctctgttcaaggggaagcgctgcgccgcagggcgagattgcgcctgggctgttcaggccccatcctaggagcgctaagcaatacaatcaaaatattgtcatggatatattccgctatggcccgtgcccgctacaaacaactggtcgatgcttttgccgccgatatccgtggcggcgcactgccgcccggcgcccgcctgccgactcaccgcgagctggccgccagggaagggctgaccctggtgaccgcctcgcgggtgtatgccgagctggaggccatgggcctgatcagtggcgaaaccgggcgcggcacctttgtccgcgagaccgcgttgccgccgggccagggtattgaccagcaggccacggcggcgggcaccctggatctgaatttcaactatccggcgttgcccgggcaggccgaagtgttgcgcggcggcctgcgccaactggcggccgccggtgacctggaggcgctgctgcgctaccagccccacagtggccgcagccacgagcgggccgcggtggcgcggtatctggtctcttgcgggttgcgggtagacgccgagcaggtgtcgatcgtcagcggcgcccagcatggcctggcgaccacggtgatggcgctgctcaagcccggcgatgtggtcgccaccgatgccctgacctacccggggttcaaggtggtggccgacgcccacggcgtggagctggtgtcgattgccctgaccgagcacggccctgacctggcggccttcgagcagttgtgccgcagccgacgggtgcgggcggtgtacgccatgccgaccctgcacaaccccatgggctgggtgctggacttggcgtggcgcgagcgtctggtgcacatcgcccggcagcatcgcctgttgattatcgaggacgccgcctatgcctttctcgccgaggatccgcccgcgcccctggcggccctggcgccggaactgacggtgtatgtgtcggggttttccaagaatgtcgccaccgggctgcgggtcggttttgtcgtcgcgccgccggcctgggtgccgctgatcgaacgggtgatccgcgcgaccacctggaacacccccggggtgatgacggcgctggtctgcaactggatcgacgacggcaccgtggcgcgcctggaaaccgagaaacgccaggatgcgcaagcccgtcaggcgctggccagggagatgctggccggcctggcgtacatcgggcatccggcgtcctattttctctggctgccgctgcccgaggaggtccgtgccgatcaggtggccatggccttgctgcgggagaatgtctcggtgtccatcgccgcgccctttgtcagcgccgcgccggtgccccacgcgatccgtctggccctgggctcggtcgatatggatcagctgcgggtggcgctggaaagggtgcgcaaggtgattgctcaatacgcctactgaaggccccgcgcggtgaggcgcgggagcccgttggctgtcagaccttgaactgggttaccaggccgttgagttccaccgccaggcgcgacaggtcctggctggcggcgttgctctggttggccccggccgaggtctgggtcgccaggtcgcggatgttcaccaggttgcgatcgacctcgcgggcgacctgggcctgctcttcgctggcgctggcgatcaccatgttgcgttcgttgatcgaggtgatggcctgggtgatctggtccagggccagacccgaagcgcgggcggcttccagggtcaggtgggcgcgttcgttgctgtggcgcatggcgctgaccgcgccttcggtgccttcttcgatggtgttgatcatgctttcgatttcctgggtcgactgctgggtgcgatgggcgagggcccgcacctcatcggcgaccacggcgaaaccgcgtccggcgtcgccggcccgggcggcctcgatggccgcgttgagggccagcaggttggtctgctcggcgatcgagcggatcacctccaggacctgaccgatattgcgcacatccactgccaggtgctcgacctgctcgcaggtgcgggtcacctcgtcggccaggtcgccgatggagtcgacggtgtgctgcacctgttgccggccgtggtgggcggtggcgtcggtttcccgggacgcctcggaggtgctgacggcgttgcgcgccacttcttccaccgccgcggtcatttcattgaccgcggtggcggcctgttccagctcgttgctctgctggtgcagggtcttgctggaatcctcggtcaccgcatgcagttcttcggcggccgacgccagttggctggaggaatcggcgatcttctgcagggtgctgcgcaggctgttctgcatgcgttgcagggcgtgcagcaggcgcgccggttcgtcgttgccggtcacgctgatggcatggcacaggtcgccgttggcgatggtttcggcgactgccacggcctggctcagcggccgcacgatgctgcgggtgagcacgatggccaggccgacggtcagcaccagcacgatggccaggatcgccaacaccagcccgaccgcgctctggaacacttcgttgctgcgtgcggccgctgtttcgccgccgtgggtattcacctcgaccacgctcagcagttccttgagcatggcgtcggcattggtcaggaacggcccgccgtcgacgatggcgatcgcctcgtccttgcgcccctggcgcgccaggtcgaggacgcgctgctggtccttgaggtacagcgccctgacccccaggtagcgcgcgtacgcagccttttcctcgggatcgatactgagtttttcgtaggccagttgctgggccgacagttgttcgtcgagctgcttgacccggtccagcagggcctcgacttcggttctgtcgcgtacgaccagcaggcgcagggtcagggtacggatctgggtactggtcagggccacggcgttggccgcgacgatcgagggcagccagttcctgtcgacctcgagcgactgctcgttcatgcgccgcatttccagcagggagaacgccccgagcgcaaccgcgagcaacgcgatcagggcaaaactgaggcctgcacggcgggaaatgttcatcgatcgtaaaagcatgactgtgttccttgtggcggcaaaaggcacaacctgcgcggcatccggcaggttcgcagcaaagcggcgcgcgctcggaaaggttccggggcgtcgtcggttcttgcaggcaagacaggcgggaggcgcatcgtggcgccttcttttatgaggtcttccggggtggatggggctgcacgggcccgaccggagaggtgggggatgatatcacaatgatgtcgtttttttgccgaagccgccgtcagcactgcgccgcggcccttgcgccagggatgggaggccgtggctatttgtagaacatatctaccgctacggcagcatcgaaggggccgatgactgtcttgtcgcgccagatgagatcggccctgaagtctgtcctcaccgctgaggtgccggccaggtcggtcaatttgaaccaggtgctgaaggggatcttttcctggttgtcggccctgacgagcgaaataccgaccgaactgttgttggttggaaccagcagattgttgatgacagtaccgctcttgggcgtgaagcgtgcattgaccgtgtaaggggtgtcgcagttctttctggtggacaagctgaaggtggccgagctggcgagtgcgccattttttgcgttgtggctactggggcgaggaagtctgacggtgctgggcgcgatagtcaggttgggagagcaaggaacgaagcggatattctgcattcctgatatgaggtaattgaggtttttaggcgccgggttgttcatccccccaactccgtccagttgaaagacgcgatattcactgcgtgttgtggcctggcctgactggggaacagcgccatatttttctatgtacacggtgaaactcagggtgaagtcggctctgttccaacctctgcagttaatccaattacaacctagcattgaatcgaaaccggtactgtatttgcctgtagcctgggtgatcagggtattgttgtaacggattccgactcgaatgccttgtccgacactgacttgtgcagggttcggatagaagtacaccaattctcttatacctgtttccatgttatcggcacacctgactcttgttgagcgcgggctggattcccagattatcgtgccattgggcgcgtccgcgggaaccgccagggcggtacccagagtttctctaatgactgccgaggcgctatcttgctctacacacgacaaggcatggctggtcgccgggaaagccatgatgagcagtgcgaaaaacgagttgttttttatcagtgaaaacatcggatatatgctcgcattcattgccggatatcggtgtcgtaattgatcttgaatccagtgtcgttaatttccaggaaatctatttttatctgactttctttgtaatcttccggtatttcgatactttccgttgccccaggggcgatgaacaagtaatcggctaagacgcgtggttggcccttcatagttgcttttatatcgatcagcgacttatggagcttggtagggttcttgacgttgatctggtgcttgcctgccaactcccagatcagcgcgctggctgtttcaaggggctgatttttcatgaagtacgggcgataaaaaaacttgagttcatggcgaatggccaattgcaacgtgtctgcggccccgggcttgatagggacctccacgaagttgagtgaaaaatacgattcacgatcttcggggagccctctcccttcatagagaatacgtatggttttgcgctcgtgaggggcaagctttaccaacggcgtaatcaccgcgaaaggaatggcagccccttcgtgctggctgtctatatagacttggacaagtgtggtttcaggattgcggttgataatggaaatattggcttccttatctttttcataataaatcaaccgtgttccgtcaatgtccaaggatgcctttgcgctatttatgcttaatagcagagtgctgatgagggttgtccagaatagtgaccgagttttctgcatgagtgttgccttgcggtaaaccggaaatatcctatatgtaacgtcaagttctccatcagataattcttaaatttctggtcggcgtataagggcgcccttgtgagttgactggacccgggaccgtatcgatccggccccaggtggccgcgcgctcagccgtgctggatgcccgcgcgcttgagcaactgcttgcagcgctcggacaggtgggtcacccgcaggtgcttgccggccttgttgtagcgttcgcgcagggttttcagggcggcgatggccgagtagtcgacgaagctcaggtggcggcagtcgagggtcacctgggccgggtcgcccgccggatcgaagtggttgaggaaggacgtggtcgaggcgaagaacagggtgccgtggacccggtacagcttgctgccgtcggcttcctcgtggctgtcggcgtacagctcgcgcgaatgctgccaggcgaagttgagggcggcgatgacgatgccgcacagcaccgcgatggcgaggtcggtgaacacggtgatgatggtcaccgcgactatcaccagcatgtcgttcagcggcactttgtgcagcacccgcagcgagccccaggcgaaggtctgctgggccaccacgaacatcaccccgaccagcgccgccagcggaatacgctcgatcaagggcgagagaaacagcacgaacagcaggatcatcgtcccggcgaccaccccggacaaccggccacggccgccggagctgaggttgatcacggtctggccgatcatcgcgcaaccgcccatgccgccgaacaggccggaggcgatattggccgcgcctagggccacgcattcgcggtcggggaagctgcggctctcggtgatttcgtcggtgaggttgagggtcagcagggtttccagcaggccgaccatggccatcaggaacgcgtagggggcgatgatgcccagggtctccaggttccacgcaatgtccggcagcaccaggcgcggcaggccgccggcgatatgggccatgtcgcccagggtgcgggtcggcaggcccagcaggtagaccagcaggccgaccccgaggatcgccaccagcgccggcggcaccgcgcggctcaagcgtggcagcagatggacgatggccatggtcagcgccaccagcccgagcatcagccacaggggcgtgccgccgagccagcgttcatcggccttgaagtgctccagctgggccagggcaatgatgatcgccaggccattgacgaagccgagcatcaccgggtacggcacgatccgcaccagcttgcccaggcgcagcaggccgaaggcgatcatgaccaggccaccgagcagcaccgtggccagcaggtactgcacgccgtgctgcaccaccagcgcgacgatcaccaccgccatcgacccggcggcgccggaaatcatccccgggcggccgccgaacagcgcggtcagggtgcagatgataaaggccccgtacaggcccatcagcgggttgaggtgggcgaccagagcgaaggcgatgcactcgggcaccagggcgaaagaggtggtgagtccggccaggatgtcggcgcgaaggcgagcgggtttcatggtttacctgagagggtggccagggtcggccggggttgcgggggattgtcgaaaggcggcgaatattacggaataaccgccgcgccagccagccgtggggcttgtattgatgggcgctcgcggcaagactgcacggtcccggcgcttaataccgggcagccaaggagccaccatgccatcaagcaaacgcgagcaggcgcgtctcgaacgccgcctggctgccagcctcaccgacgcctgcgaaaccgccaaggcggaaattgtcggtttctcctggctgacccatgtggccgattacgcggcgtttcccgccagcctgagggtggtatgggtgttcgacacccaggccagcaagtccctggccctggcctgcgggcagggcgagcgcatgctcgaactgacagccgtggcgctgcatgacgccggcgtggagttgcaggcgctggcggcccatgtgcgctacgacagcgaagaacagtgccagcgcatcaacggcggcaactggcaacaacgcctggcgcggctgggctgagcgccgctggcaagcgcggctaaacgccgcacccgaccaaggtcgcacacaacctgtcatccatttggcaggaagcggggcgcctcgttttgctaccatgcgtggcttttacggatgggccgcctggcgggtcgtctggactttcggctcctcaaagggcggtaacgaatgagtgttttgttgagtcgccgcgaggtgattgcaggtatgggggtgttgggtctcggtcttttggccggctgcgatactcggggccagctgtcgtacaaatatggcaaggatctgagcgacaagatcatgggccgtaccttcaagctgaaggacaccgagggcaacgtcaggacgctctcaagctatagcggcctgatgccgatggtgttcttcggtttcacccagtgcccggcgatctgccccacgacgctggcgcgcgcggcccaggccaagaaactgatgggccgcgacggcgaccgcctgcaggtgatcttcatcaccctggaccccgagcgggataccccggaggttctcgacgcctacgtcaaggccttcgacccgtcgttcgtcgcgctgtacggcacgctggagcagaccgcggccacggccaaggaattcgacgtgttctacgagaagatccccagcggttcgacctacaccctgtcccacaccgccaccagttttgtctacgactcccggggcacgctgcgccttggcttgtcccaatcgcttaccgcgcaagagtgcgcggaagatctactgaccgtcatggaggtctgctgatgtacccggccctgaataaaaccgctattgcccaacgcgccaaacgcatcctgatcggcttgtccctgctgggcctggcgggccagaccgcggcccagacccaggtcgacgacgcctgggtacgcgccaccgtcgccgggcaacaggcgaccggggccttcatgaccctgaccgccagcgatgacagcaagctgctcagcgtcgagtcgccagtggccaagatcgtgcagattcaccagtcgagcatgcacaacgatgtgatgagcatgcgcccggcggacttcgttgcgttgccggccggcaaggccgtcgccctggacccccacggttatcacgtgatgctgatcgacctggtggcccaggtgaaggaaggcgacaaggtgccgctgaccctggtggtggaaaatgccaagggcgagaaagagtcgatcaaggtcgaggcccaggcccgcgcgctgaacatgccagaccacagcaagatgcagcattgatggttggcagcacctgcgacgaccggcagccaggctgacgcatggccaaggaaatcgacaacccctgcatcgccgtttgccaactgagcggcgacctgtgcctgagttgcgggcgcagcaaggacgacatccgccaatggaagcgcatgaagcgcccggaaaagatggcggcggtgcagcgggcgagccagcgcttgaaggcgctgcgcaagaagggcggcggcgccagccgctgatctcccccccagccggcctccagcgccggccttcaggttcccggcgtctgcgccgcacactcccgtaaccaggcgatacaggccgagacccgtcgcggcagggcctccagggccgggtggacgatgtagtagtcgtattcgccgctgcgggtaaaccccgtgaacggcagcaccaaccggccttgcccgatcgcctcgctgaccagatgctcgcgcccgatcgccacgccggcatggtggatggcagcggtgacgcagaggtccgagcgatcgaaagtcaccccgcgtttcggcatggccacaccgccgccgtgctggcgaatccacagcgcccattcggaatcgaaggtggcgtggtcccaggccagcgagtcatgcagcagggtgcactgttgcagttgctcgactgcgccggtcaatccatggcgttcggcgtattgcgggctgcacaccggcgcaacccgttcctgcatcagcttgtgcgccaccagcccctggaactcgccattgccgtagtacagcgccaggtcgatctgccgggtgcggaagtcgatgcggtcgttgcccacccgcaggtcgagcctgaccccgggaaagcgctggccgaactcggccaggcgcggcaccagccaggcatgggcgatggacgggtgggcgtacagggtcagcggcccggccaggtcggcgtcgaccggctgggccaggacttcggacagttcgcccagggtctgctggaggatcgcgaaaatccgttcgccggcctcggtcagctccacccgccgggtcagccggcggaacagctggatcgacagctccgcctccagccgggcgatgcgatggctgaccgcgctggcggtcaggcacaactcatcggcggccttgctgaaactcaggtggcgggccgcggcctggaaggtgaacaggttcgagaactggctgctgttgagcttggcatccagtcggggcggtaggttgtacaagccggcgcttctcctgtcggtcggttatgagccttgcagtacccgggcgccttgcgccaggtaggcctgcatctcggtgtccgggaccatgctgccgcccgtggcccagaccaggtgggtggcccgggcgtaagccgcggcgctcaggccgctgcgctgcaggtactggtcacgctgcgcgtgcacccgggcgatgcctgggacgccggccaccgccgagggctccaggtgcagctgttggtgcttggccatcagccagaccagagcatgcagttcgtcatcgctgacggtgtagtaaccctcgatcagccgctgcatggcccggccgacaaaacccgaggcgcggccgacggccaggccgtcggcggcggtgaggttgtcgatgccgaagtcctgcaccgacacctcgtcatgcagcccggtgtgcacccccagcagcatgcacggcgaatgggtgggctcggcaaatatacagtgaacggcgtcgccgaacgccagcttcaggccgaacgccacgccgccggggccaccgccgacaccgcagggcaggtagacgaacagcggatgctcggcatcgacccggaccccagcctgctgcagttgccggctcaggcgttcggcggccacggcgtagccgaggaacaggtcggtggagttttcgtcatcgacgaaatggcaggccggatcggcgctggcctgccggcgcccctgggccacggcgatgctgtagtcgctctggtattccatgacattcacgccgtgggcgcgcagcttgtccttcttccattggcgggcgtcggcggacatgtgcaccgtgacctggaagccaagccgggcgcccatcaggccgatggacaggcccaggttgccggtggagccgacggcgatccggtagtggctgaagaacgcccgggcctcgggcgagtcgagcacgctgtagtcctggtccgggcgcagcaggccggcctccagggccaggcgttcggcgtgcttgagcacctcgtagataccgccgcgggccttgatcgacccggagatcggcagatggctgtcctgtttgatccacagcgcgccgggcagggcctggccatagcggtcggccagcaccgcctgcaaggccggcagcggctggatcggcgattcgagaatgccctggctggccaaggtctcggggaaggccacgcgaaaatacgcggcgaaacgcgcaaggcgggcgctggcgtcggccacgtcggcggcactcagcgccaggtcgcccaggccatcggccaggggcgcgcgggtggcggtgaaccaggtggtttcgcgcaacgccatcagctcttcgagcagcgggaagcggcgggtccaggtagcgagtggctggcctgcgatcatggggatgactcctgtggcaaaggtttaaacgaaatgagagagggccagggtcagcaacagggcgaccaccgaggccaggaccgtggcgctggtgaaggtcttgagggcatcggccagcgacaccccgaggtattccttgaccacccagaaggccgagtcggtgacgtgggtccagccgatggccccggcgccgatggcgaccacgatgatctccttgctgtagccggagtcgacgcccagggtcggcagcacaatggcggcggcgctcatcatggccacggtcgccgagcccaccgcgaagtgcatcaggcccgccaccagccaggccagcaccaccgggttgatgtccagccgggtcagggagtcggccagcaccttgcccacgccgctgtcgatcaggatgccgttgaaggcgccgccggcaccgatgatcagcaggatgctggccagcggcggcaggcttttctgggtgtgccccagcaggtcttgcatgcccaggccgcggcgcaggcccagggaccagtaggcgaagaccacggcgatcagcagtgccaccagcgggttgccgaagaacgacagcagcccggacagcgtcgagccggcgggcagggcgctggcgaaggtcttgccgatcatcagcagtagcggcagcaggatggtcagcaacgtcagccagaagcccggcagcactcgttcgccacgggcctcgcaacgctcctcgaggaaggccgcctgccagggttcggcctggctgcgcgccaccaggcggatccacagcggcccggcgacgatggcggtgggcaggccgacgatcaggccgtagaggatcaccttgccgacgtcggcccccagcaagtgggtaatggccatggccgccgggtgcggcggcagcatgcagtgcacgcacatcagcgacaccgccagcggcacgccgaggtgcagcaggttgaggcgggtggccttggccaccacgtacaccagcggaatcagcaggatgtagccgacctcgaagaacaccgggatgccggcgatgaaccccaccagcatcatcacccaggaggcgcgacgctcgcccagggtgtcgagcaaggtccgggcgatgcgttcggcgccccccgattcctcgagcatcttgccgaggatgctgcccagcccgatgatcgcggcgagaaaccccagggtatcgcccaggcccttctggaacgattcgagcatggcattcaagggcattcccgagcccaacccgaccaggccgcaggcggcgatcagcgccaggaaggcatgcaccctgaacctgacaatcaacaccacgatcatcacgatcgcggctaataacacccatagcaacgcgccattgctttgcatcggccaaccctcttattgattttgtgacggggtccgtcaaaggacttcgcggggcgagagttaacgctcggccgcgcggggctgacaaaagatcattgctcagcagatgggtgatgctgggtcaggcgtgggaatgggcttgggaatgggagccgcgaggccggtctggccgtggaatcccgggccacgggcgtgacccggtcgagggggtgtgagtcagccggcggtgctttccggcagtctggcgatgaccttgatctcgaagtcgaagccatagagccaggtcacgcccacggcggtcagcgtcgggtgcggcgcctggccccagaactccggcaccaccttccagatggcttcgaatttgtcctcggggtcgacgataaacacggtgacgtcgatcacctcgtcgaaggagctgccggcggccgccaggatggcgttgaggttgtggaaggcgaggcggacctgggcctcgaggtccggctcgggcgagccgtcggcggtgctgccgacctgccctgagacgaacagaaaaccattggagcggatcgccggcgagtagcggttgcgctggtaaagcgcctggcgtccgggcggaaaaaccacgtcgcgctgagtcatgtgttgcctccatcgataagggtcgaagccgacctggtatgaacgatgaagctgactctaggcacttgcgccgggccgataaaccagcaaccgtagccatcactgtttgtggaatccaaacaatccaatggttagccggggtggaaatggaccgatttgatgcgatgcaggcctttgcccgggtggtggaggcgggcagcttcaccaaggccgccgacacgctgcacatgagcaagaccagcgtgacgcaactggtgcagcagctggaggcacgcctgcgggtcaagttgctcaaccgcaccacgcgccgggtccacctgaccgccgacggcgcggtgtattacgagcgtgtggtgcgcctgctggccgacctcgacgatgccgagaccagcctgtccagtgcctcggcgctgcccaggggacgcctgcgggtggatgtgcccagcccgttggcgagcatgatcctggtgccggcgctgcccgggtttcacgcccgctacccggacatccagatcgacctgggcgtcagcgaccgcatcgtcgatgtgcttggcgagaacgtggattgcgtggtgcgcggcggcgagctgacggaccagtcgctgatggcgcggagggtcggcgacctccagctgggcgtgtatgcggcgcccggctacctggagcgcctcggcacgcccgcgcatccgcgcgagctggaggattcgttgcatcgcatcgtcggttttctctgggcgcgcaccggcaaggccttgccctatgccatgcacggccacggtgagagcctgcagatcaagggccgctacgtgctggcggtcgacgatggcaatgcctacctcgccgccggcctggcgggcctgggcgtgctctggctgccggactacatggcccgggcgcatcaggaacggggcgagctggtgcgtctgttcgaggactggcggctcgagccgatgccgatctacgtggcgttcccgcccaaccggcatatcagcatcaagctgcgggtgtttatcgactgggtcgccgagctgatggcccgacatgcgcccatcgccagccgagcaggggcgtgaagcgaccggttacatgaattttttgggcgccgcccagaaacccgccagagcagctttacttgtccaggcaagtcgcgcctgtagatggccgttcggccgccgcattctgcccgggaccggcattgcgagaaggacacggcgtgtcgttcaaccccgtacaaaacccttgtcgcccccctgacatgaacgcctgttggagcagtcgtttgctggccagtacctcatcgcggtctggtcgcgcccgcgccatcgcagcccgggcgccgcctctttaaaggagtaaagaaatgactcagtacgacaaacagctcaacaaccccaaacagccgtcgcgccaggcacgcctggaaagcaccggcgccgaacgcctgacgctggccaacgccgggccgatccagatgggcttctgggtgcccaaccgggtatgggccacggccaagttcctggtgccgctgcgcaacctgatcgccgagaagaaaaaggccggcaccctgaccccgatgcgcacggaaatcatcgagttcaagacctgggtcacccacaacagcgtgtaccgcatgtgggtcaactcgatgatcgaacagtcgaacgcctacgtggcgacccttgacgaggcgaccaaggagcagatcaaggacgcggatggcgatgcgctgtggatcgccggctacgacagcttcttcgagattctcaacgagatcatcagcacttcctcgtcgttcaacaccacggcccaggtcggcacgccgatgaacgctttcctggcggtgtcgatgggcaccgaggcgggtgtcgcgctgttccatgacacgaccttcaaccagcagttcaagaaggtgctcaatgcctggaacgctttcctcaagagcagcgcttccctcgacaagctggacatcaacgatccggaaaaagagggttcgtggatctccgcggcggcccacgaggccggggtctggacgcagatggagcatgacccgaacctgcccggctacggcttcgattcctggaacgcgttcttcatccgcaggttcgtgcccggcgcgcggccgttccagggcaacccgctgacccaggtcgatatcggctgcgagaccacgccctggcagtacgaaaacgatgtggcgttcgagaccgagttctggatcaaggacgtcaattactcgctgctcgatctgttcggcggccaggagcagtgggccgcgccgttccagggtgggcaggcttaccagggcttcctgtcggcgacccactatcaccgctggaacgccccgctcgatggcaagctggtgcgctcctgggtgcagccgggcacctatttcgcccagcgtccggcccagggcgaaggcgagggcacctgggagggcaccgagtcgcagccatacctggggcatgtcgccgcccgggcgatctttgtcttcgagcacccgacctgcggttatgtcgcgctgatctgcatcggcatggtcgaggtctcgacctgcgtgatcgagccgccgttcatcgtcgacgaaggcgcggcaccggtgaacatcacccgtggcaccgagatcgggcatttcgagttcggtggttcgacccacatgatgatcttccagaagggccgggtgcagttggaggactgggcggtgaacgcggtcgcgcaccagaacgacccgcaaccgacgcccatgggcacggtgatcgccaccgcgttgctgaacaagggctgagccgccgagcacaagcgacggcgccctcgcgccgtcgcctgcaaaccgctgtcagccgctggcctggaccaggtacttgtggaaccacaccagcgtccggtcccaggccagggtggccgccgcctcgtcgtagcgcggggtcgagtcgttgtgaaaaccgtggttcaccccggggtagatataggcttcgtaggtcttgcccgcggctttcagtgcctgctcgtaggccggccagccttcgttgatgcgggtgtccagttcggcgtagtgcagcaacagcggcgcctggatccgctcgacttccgcgctgtccggctggcgcccgtagaagggcacggccgccgccagttccggataggccacggccgcggcattggccacgccaccgccataacaaaagccggtgatgccgaccttgccggtgctggcgtcgtgctcgagcagccattcgacggcggcgaaaaagtcgttcatcagcttttccggattgaccttcagttgcagctcgcggcccttgtcgtcgttgccggggtagccgccgagggaggtcaggccgtcgggggccagggcgatgaagccggccttggccaggcgccgcgcaacgtcctcgatataggggttgagcccgcggttttcatgggccaccaccaccgccggcaacttgccttcggccttcgccgggcgcaccaggtatccccggacctgctcgtggcccttgggcgaggggtaggtgatgtactcggcgacgatcgccgggtcggtgaatgacacctgttcggccagggcgtagttcggcgtcagggcggcgagggtagcgctggcggtcagcccgaccagggtgaaggccgccgcccggtcgagaaactcgcggcggctgatcttgccgtgggcgtagtagtcgtagagctcgagctgctcgggggcgaagtctttggcactgagacgttgcatcgcgcgttatctcctcactcatgggcgtccgggtgccacatgacctgtgggcgggacgaattcgccccggttgcctcagtaaagcaagcctgggcccgggcggccaatgcgcggggctggcgttgtgtttgggcaaagccttggctaatctcgcataaacacgcaaaatcaggcataaccatgcaaaaccagcattccatcgccgaactgccccatgtgcgccggcagaagatcctgttgctgctcgaacgcgacggcaaggtcatggcgtccgaactgggccagcatttcgcggtttccgaggacaccatccgccgcgacctggcggaactggccgatgccgggctgctgcaacgggtgcacggcggcgcactgccacggcccaaggacaccggcaaggatgtgttcacccgcctgggcgaaagcagcgaggtcaagcgccacctggccaggctcggcgcgcagcgggtgcaggaagggcagatcgtgatgttcgactcgggctcgaccacgctgctgatcgcccagtcgctacctgccgatatcggcatcaccgcggtcaccgcctcgccgctgatcgccgtcgccctggccgaatacccgcgcagccaggtgattctcgccggcggccggctcaacccggcgactctgtcttccggcggccatgaagcggtacgcctgatccaaggcatccgcgccgacctgctgttcaccggggtgtgcgcgattcacccggaggtcggcatcacctcgctgcacttcgatgaggtaccggtgaagcaggccttgctcgacagcgcttcccaggtcatcgcggtgaccaccgccgacaagctcggcgcggtggaacccttcgccgtggcgccgtgcaatcgcctgcatacgctgatcaccgagcagcacctggcctcgggcagcatcgaggactaccggcgcctgggcatcgaggtggtgcaggcgccggtgtgacggtggtggcaagagccgggaggtgctgggctttatcaggggctggcctgggtcggtggatggcgagttcggcgctgcggcaagcccggcctgaaccgccgcgggcttattcgacccggcggaacaccaacgccttcaggccgctctcgatatcgctatcgggaaactccggtgggttgtccaggcgttgctcgaagcgcaggcccggggcctcgcgggtgacgccgtcgatcaggaagtccgagccgacggccgggtcgttcatgcaggccagcacgcagccgtcggcggtgagcaattccggcaggcgccgcagcacccgcgcgtagtccttggtcagcaggaagctgcctttctggaaggaaggcgggtcgatgatcaccaggtcgtaggggccgccgcttttcactttgctccaggacttgaacaggtcgtggccgagaaagctcacccggctcaggtcgtggccgttgagccggtgattgtcgcggccacggctcagggccgcgcgcgacatgtcgaggttgaccacatgagtcgcgccgccttcgatggccgccaccgagaagccgcaggtgtaggcgaacaggttcagcacgcgcttgccccgggcattggcgcgcacccagttgcgaccgtagcgcatgtcgagaaacaggccgttgttctgcttctggcccaggtccacccgatagcgcaggccttcctcgaccagggtccattcatcgataggttcgcccaccagccagtccaccgggctttgcagctgataacggtgttgcagcagcagggtgtgggcgccacaggcctgccactcgggcgaggtgctgagtgccagcagcaattgcttgagcgcctccagctgctgcggctctggctctttgaacaacgccaccagcaccacgccctgcagccagtccacggtcagttgctccagccccggccagcaacgcccgcggccatggaacaggcgccgggtttccgccggagcgcaggccagggctgtcagcaggtgatggtgcagggtggcgagggcgtcggggttcatcgaaggagggccggcaataaaagggcgggcattttaaacacaaatgccgcgtgggaaacgcggcaagtcagtggcctgcgcccgtgccgatggccggggctatgtcgagcggggctgccgatcaggtatggaacagggcgatggcaaaggaaaccacgatcatgcaggcgaccgcaaaattgatattcatgacgtacttgtccgacggtattgaaggtggcgccattctgaaggcatcggcggaaaatgaaaaatccgctttcatgatttgaatgatcgatagcagtgatggttgacggcggcgtggcaggagggccgccaggcggcgggcgagtggatatctgcgcgaagctgattatgcttcagggaaacctggcagcaatgcgaggccgtcagcctgtttccatgctttgtgcaatccgtagttcgatgagcttcagttcgatgacatcagcccagggcctgggtgcggcaagggtagtaaggcactccggcctataacaagaacaagacggagaaccctcatgccggcaatcgacagtacaaccacgggcagcgcgcccaaccgcgggatcaccagggaggagcgcaaggtcattttcgcctcgtccctgggcaccgtattcgagtggtacgacttttacctctacggctctctcgccgcgatcatcgccaagcacttctttgctggcgtcaacgaaaccacctccttcatcttcgccctcctggcattcgccgcgggctttgccgtgcgaccgttcggcgcgatcgtgttcggccgcctgggcgacatgatcgggcgcaagcacacctttctcatcaccattgtgatcatgggtgtctccaccgccgtggtcgggctgctgcccagctatacgaccatcggcgtggcggcgccgatcatcctgatcagcctgcgcctgctgcagggcctggccctgggcggtgagtacggcggggcggcgacctatgtggccgagcacgcccccaagggcaagcgcggctacttcacgtcgtggatccagaccacggcgaccctgggcctgttcctgtcgctgctggtgatcctcgcctgccgcacgatcctcggcaccgaagccttcgaggcctggggctggcggattcccttcctgctgtcgatcctgctgctgatcgtctcggtgtatatccgcctgcagctgagcgagtcgccggtgttccagaagatgaaggccgaaggcaagtcgtccaaggcgccgctgaccgagtccttcgcccgctgggacaacctcaagatcgtgatcatggcgctgctcggcggcaccgccggccaggcggtggtctggtacaccgggcagttctacgcgctgttcttcctgctgcagacgctcaagatcgacccgcagaccgccaacctgctgatcgccggctcgctgctgatcggcacgccgttcttcatcctgttcggcagcctgtcggaccgcatcggccgcaagggcatcatcatggccggctgtgtcctcgcggcgctgacctactttccgatcttcaaggcgctgaccgaatacggtaaccccgaggtgttcagcgcccaggagcgcaacccggtcacggtgatcgccgatcctagccagtgctcgttccagttcgacccggtgggcaaggccaaattcaccagttcctgcgacctggccaagagcgtgctggcgaagaaagccatcccttacgcgaacgagaaggccgagcccggcgccgtggcgcggatccggatcggcgacaaggtgctgccgagcttcgaaggcaccggcatgccggccgccgacttcaaggcgcagaacgatgccttcgtcgccaccctgggcagcgccctcaaggacgccggctaccccgagaaggccgatccggccaagaccaactacccggcggtgctggcattgctgaccctgctggtgatctacgtgaccatggtctacggcccgatcgccgcctggctggtggagctgttcccggcgcgcatccgctacacctcgatgtcgctgccgtatcacatcggtaacggctggttcggcggcttcctgccgacggtggcgttcgccatggtggcggccaccggggacatctactacgggctttggtacccgatcgtcatcgcggtgatgacggcgatcctgggcaccttgttcctgccggaaaccaaggaccgggacattcaccacacctgaaggtcttcgcccgtcctctcccgcaagggagaggacccgtttgttttcagctcaccgcgccggggctgttcagttctgctggacgatctggatcaggttgccgcagatatcgtcgaagaccgcgagggtcaccgggccggcgactgtcggcgctcgggtgaactgcacaccggcggcgctcagccgggcatattcggcgtgcacatcctcgaccccgaagaaagtgaaggggatgccgtcctgcttgagcgccgaggtgaatggcttggcggccgggtgggcgtcgggctccagcagcaattcgacgccgtcgggatcgccgggggaggtcagcgtcagccagcgatgctcgcccatggcgatgtcgtgcttgagctgaaaacccagcacatcccggtagaaggccagggccttggcctggtcgtcgacgactacgctggtgatgacgatcttcatggggttcttcctccgtatttgaggtacaggtggcagcagggccgggttgccacacgccgtcaataccggccgacgatcaatacctggcaggaataatagccgggcagccgcggtgtccacgccctggagagcgaccggctgtccagtggacagggcggggtgtcggcagcccggcaggctgccgggttttcccgccgattcccgcacgacccggcgccggggcggtaaactggcgctctttatcccctcgaacaagagagccccatggccaaccacgatatcgatttcattcccgatcccgacgcggattccatctcttccgacgttgccggtttcgccggcatcctggtctccacccagatccccacccgtgccgacggcagcctggagctgggcgacatcactgcgcagagcgagtgcaccctgcaggcgctcaaggtggccctggaaaaggccggcagctccatggaccgggtcctgcacctgaccatctacctcaccgacatggccgagcgcgcggcgttcaacgaggtctaccagcgcttcttcgccaagccctggccggtgcgcgccgccgttggcgtggcgtccctggcggtcgaaggcatgcgcgtggaagtcaccgcgatggcggccaagggctgagtttgcggcgttatccggtggtgccgctcggcgagtgggcgccaccgggcagtacacgggtgccggtcaggcgtttcgccgctacaatgcgcgcctcgacgagcctgactaaaaaaatatgtccttgcccaagcatcacctggaattgctcagccctgcccgcgatgtcgccatcgcccgcgaggccatcctgcatggcgccgacgccgtgtacatcggcggcccgagcttcggcgcgcgccacaacgcctgcaacgaagtgagcgaaatcgccgagctggtggagttcgcccgccgttaccacgcgcggatcttcaccaccatcaacaccatcctccacgacaacgagctggagccggcgcgcaagctgatccaccagctgtacgacgcgggcgtcgatgcgttgatcgtccaggacctgggcgtgatggagctggacattccgccgatcgagctgcacgccagcacccagaccgatatccgcaccctggcccgggccaagttcctcgaccaggccggcttctcgcaactggtcctggcccgcgagctgaacctgcaggaaatccgcgccatcgccgacgagaccgacgcggcgatcgagttcttcatccacggcgcgctatgtgtggccttctccggccagtgcaacatctcccatgcgcagaccggccgcagcgccaaccgtggcgactgttcccaggcctgccgcctgccgtacaccctcaaggacgaaaagggcggcgtgatcgcctacgagaagcacctgctgtcgatgaaggacaacaaccagagcgccaacatccgcgccctggtggaagccggcgtgcgttcgttcaagatcgaagggcgctacaaggacatgggctatgtgaagaacatcaccgcctattaccgccagcgcctggacgacgtgctcgaagaccggatcgacctggcccgcgcttccagcggccgcaccgcgcacttcttcctgcccgacccggaaaagactttccaccgcggcagcaccgattatttcgtcaccgatcgcaagatcgacatcggcgccttcgactcaccgacctttaccggcttgccggtgggcgtggtcgagaaggtcgccaagcgcgacctgcacgtggtgacccatgagccgctgtccaacggcgacggcctcaacgtgctggtcaagcgcgaagtggtgggttttcgcgccaacatcgccgagcccaagggcgagttcgaagaggacggcgagaagcgctatcgctatcgcgtcgagcccaacgagatgccggaaggcctgtacaagctgcggccgaaccacccgctgaaccgcaacctcgatcacaactggcagcaggccctgcagaagacttcgtccgagcgtcgcgtggccctgagctgggtcgcgcgcctgcgcgaagaacagctggaagtgacagcgacgagtgaagaggggatcagcgccagcgtgaccctggacggcccgttcggcgtcgccaacaagccggagcaggcgctggaacaactgcgcgacctgctcggccagctcggcaccacgcagtaccacgccatcgacatcaagctcgatgcgccacaggcattcttcatccccaactcgcagctcaaggccttgcgccgggaagtgatcgaagccttgaccgccgcgcggatcgccgctcacccgcgtggcagccgcaaggccgagaccacgccgccaccggtgtacccggaatcgcatctgtcgttcctggccaacgtgtacaaccagaaggcccgcgacttctaccaccgccatggggtgaagctgatcgatgcggcctacgaggcccacgaagaggctggcgacgtgccggtgatgatcaccaagcactgcctgcgtttctccttcaacctgtgcccgaaacaggccaagggcgtcaccggcgtgcgcaccaaggtcgcgccgatgcagctgattcacggtgacgaagtgctgaccctgaagttcgactgcaaaccgtgcgagatgcacatcatcggcaagatgaaaggccacatcctcaacatgccgcaaccgggcagcgtggtcggccacatcagccccgaagacctgctcaagaccatcccccgcgccccgcactgagtggcgggcgggcgcggcgcctcggcgtcgcgtttgctcaagcgctggctgtcgcgcatcaacgccattgtcgacctgggtcggcaatggcgttgttgtttcagcgaaccgccttaacgcgctggatcttcctcggcgcgcaactgaacgctcatgtcatcgcagctttgcgaccagtcttgcagccactgtggcaactcgggcgagatgtctatgcccagttcgtggacgaactcgccgggggcaatcgtgcctttggccgagcggaacagcccgcgcatcaccaccacgccgatcacccggcctttgctcacgaagcggtgttccataaagctccatttctcgtcccagccgaggatccggctgtggatctcgaaggcttcgaacagcttcagttcacggcggaacttgccccacacatcgccaacgatcggcactgccctgtggcgcagggccacgcggtaggcgccgctgcgcaggacaaaatccatgcgcccgaggtcggccagggtgaagtagcggccattggtgacgtggcggttgaggtcgaggtcgagcggccagacgcgcatgcgcacgacggtggtggccaggccttcgaccggcttgcgccacggacgacgaaacagcatgagcagcatgcggaaccagagattcatgagtacaccgatgattgaaaggatggccgcactttaggcaagggggatcgcctaagctaggtgcgcaaatgacatttttcatgcgaaaagcgcaacggaatccactatgcacgtcaccttgctcctggccgatcactgttccgccgccagcgccaccctggccctggaagtgctgagcgccgccaacctgttcgccgacagcgccagcgcgccgttcgaggtagtggtcgcttcgctcgatggcgccgatgtcagcgcctggggcgggcaggcgctgcgggtgcagcgttcggtggccgagatcgcccagaccgacctggtgctgatccccggttttctcttcaccttgaaggaagccttgccggcatttgccaggcacgggccctggctgcggcaacagcatgcccggggcgcggtgctggcctcgatgtgcaccgccaccttcctgctggccgaagccggcctattgaagggcgctcgcgccaccacccactgggctttcgccgagctgttccggcggcgttatgccggggtcgagctggacgaggggcagcttctctgcgaggacgatcgcctgatcaccagcggcggcgcgagcgcggccatggacctgctgctgcatttggtgcggcgtttcgcctccctggaactggcgcagaaatgcggcaagtacctgctgatcgacaaggtgcgcagcgagcagtcggtctatgtcatgtggtcgttgcccaagagccacggcgatggcgagatcctgcgggtgcaggactggctggaggaacacttcgaccagccgctgctgatcgacgacacggcccggcgcttcggctttggcgtgcggaacttcaagcgccgcttcaaggacgccaccggctacacgcccctggcctatctgcagaccctgcgcctggaaaaggccaaggagctgctggaatccacgcgcatgaccctggacagcatcacctacaaggtgggctacgaagacagcaactcgtttcgccggctgttccagcaacgggtcggcctgctgccggcggcgtaccgcaagaagttccaggccggtgcgagttgattcgcaggcgagtgccaaagcttgcgcttctgtaggagcgcagctggcgcgcgaagaacgctaacgcggtggggcaggcgttcggcggcgtggcctctcgggcctaggcagccctggccgcttacaaaaccttgctcatgaagacccggctgctgcccgcgggctcgcaagggatctcgccgaagcgttgccagccgtgtttttcatagaaggacggcgcctggaagctcagggtgtagagcacggccgagcggcagccgcggcgccggccttcgtcttcgcaagcctgcagcagtcgggcgccgaggcccgcgccgcgcaggcttgcgggcaggtagaacaggtcgatgaacagcaggcccagggaggtgcgcccgctgatgccgcccaggacctggccggtctccggatccttgagttccacggccaggggctgccgatcgttgtagccggtcatctgctcattgaaggtggcgagaccgatgtcgagcagggtttcgaaggtgctgtcgagcgtgtcgctgataacgatcaaggggttggtcgtgacgatgggtttcataggggattccagttcaggcgtcgcgcaacaggtcgtgggcgtcgagcaggcggtaggcgatttccgggttcttttccaggccgcggcggatggcggcggggatcgattggcgggtcttgcggcacaggcccggcagttcatcgagctggatggcgatgccgcgcatgctgcgcacttcgttgaagctgggggcgatctgtacgcggatgcccagcagttcgtacatccgccgctgcatgtgttcgaggtcgctcaggctttgcaggttttccagccgctcgagcaggcgcttttcttcctggcgggtcaggccgaggatgcgcaggtcggtgccaggggtttgcagcaggcgctcgcgctcgcaatcgcaggcgccgggagggcagggctggcggatctggaaatcgggcatctatggactccactcgaagcgatcgcggatcgccgttgcccatggggttgcctggaaatatacacagacggggcaggctgtggcgcgggattcgccagccatgccgtcggttttttcaaggctgccggcgccgccacaacaggcgcccgtagaccagggcgttgatcagcagcaccagcgcgccgaggcccagctggatctgcggcgtcagcccggccgggtagatcagcgggatcaggtagtgttcgatgaaaccgtcgccatacccctgctggccggcgccgtggcgcaggcggttttcccactcggtcagcgggcagggcagggggaagacttcgaccgccacgccccaggtcgcggcgggcaggtgcagccaggccaggcgcggccacttgagcaccagcaggccgccgaagagtacgaacaggataaaggccaggtgcagcgatactagggcatcagcggcgaagcggtagagcatgtcgagtctcgttgcggtcagggatacagcagtggttcaggttcgcgcgcggtcgaaccagcccagcgcggtgcgccagatgcagatgcccaggaagtacgccgacatggccagccacaagcccatcacccacgggccattgtaaggatggttgatcaccagcgataggctgcacagcagccagatggcggtcaccgcgatattcaccggcatgaagcggcgcacgcggaaggggtggaggaatttcatccgggtcagggtcagcagcgccaggaccacgatgctcgacaggcttagccagggtgttggggcaaggatgtacagcgccagcgccaccacgttccaggccgcgggaaagccgacgaaatagttgtccttgctcttcatgttgacgttgcagaagcagaacagcgacgacaccaggatcaccgaggtcgccagcagcgcgctgtagtccggcagcgggatgtagcgatagatgaacagcgccggaatgaacacataggtcaggtagtcgatcaccaggtccagcaccgagccgtcgaaatgcggcagcaccgactgcacattgaccttgcgcgccagcgagccgtcgaccccatcgacgatcagcgccacgcccagccacagcaggcaggccttgggctggttgtcgaacagcgccagggtggcgagaaaggccgtgaccacgccggtcgcggtgaaaccatgggcgccccaggctttgagactggcgatgtgtcgggtcgttatcacgggcgttctccaggaaatgaaaccagccatacgacgccccattggaagaaacgggggcttatcgccaaacctggccagattgcatctatcgaccgggcaggcggcgataaggttcacccttgcccgtgtctttgtcgggccgctcatggacttgcccgcgtgcagcagggcgcccaagcccgtgacggctcctaagactgtagccacagtttggcggggaagggccctggagaaagcgaatttcttcacggcgccggggaggcagggtgcctcgccggagcgttcactccctgtattgcgtggctacattccgttggcgaagggcacggcgcggatatcgatgcgcgagcgcaggtgcttcagcgcgccggcgtattcggccaggacttccaggctccagtcggcgcgggcgcgcaggtggcgttcttcaggcgtgggctcggaatgcgcattgaatacgccttccacctggcgaacgatcagctgttccggcaggtagcagatccggcagttcttgtagctggaggcccgcagctcggcgagcgggtaggcgccgcccaggccggccgagaccccgaccagcaatgccggtttgtgccccagctcggtgtggccggcatacacgaagaaattcttgatggccgggcaggccatgccgttccactccggcgtcaccaccaccagcgcgtctgcctgcagcaagctggccgagtactggctccaggcgccgttcgagtcggggcttggccagagcggcaagggcgaacgcccgaggtcgagcagcgtgacctgctcgcagagtttcagttggcgcaggcgttggcccaggtaatgggcaaccttggccgactggctggcgagctggctggagccggcgagcagcgcgatatgcaggctcattgcgccacctcctgcttggcttcgggacgcgccgcgggtttgggagaacgcaccagcggccagaacagttcctgctgccagctgattgggtgcaggtcttcgatgccataggcggtggggcggcggcgggtgattttcgcggtgccgaacagcacatcccagaagaacagcagattgccgaaattgcccttgtagtgggtcaccccgtcatgggcgttcaggccgtggtgggtggagtgggtggaaggggtcgagatagtccgctccagcagccacatcagcgggcgcagggcggggatgcgatagagcctgtcgtcccaggcgacgctgctgtgggcggcgaagatcaccgtcatcttgacgatcaggtagccgtagtagaccggcgccaggcccaggtagatgagcacgccggagagccagatgcccggcatcagcaggtaatagaagctgttgttgcggtagacgatgcggatgctcatgtacggcgccgaatggtgcgcgcggtgcagcgcgtagaggaacggcaggcggtgggtcaggcgatgccaccagtactgggtcatgtcatcgagcagcaggaacagcgccgcgcccgccacccagtgcaggttgcccaggctgttcttcaaggacggcgcgaaggtgtcgagcagcagggtgctgaggaacatcaccagggggaaggtgaggcccagcaatagcgacgaaccgatgatctcgatcagcacatcgcggcgctgacccttgggctggcgaaagcaggtacaggcgatttccaggaggatgaaaccgaggaaaatcccggccacgaccaggattggattgttggcgagcattgttgtattcatggcaatctcgagtcaggcccgacatgggcattgcccgaacaataagaaaccaagagccgcccggaccctatgcgcgaactggacaaaaacactggcgaagaggccaatcaaccggtccgccgttttcaccggggccagctcggccgggtgctggaacgggtcctgcaacgccagacccgcggcgaccgccaggattacaacttgctggaactggaacagttgtggcgcctggcggcggagcgcgacccggccatcggcctgcacctgttcggcgaattcaccccccaggacctgcacgtactggcctacatctgcctgtactgcccggacgtgcgcggcgccatgcaatgctgggccgactacgccgcgctggcctcggacatggacagcctgaagctgggcagcgacggcgatctgctcggtgtcgaactgtgcatcgacgcgcccgcgaggctgacccgctacgtggtcgagcattactgcgtcatggccctgactcagatccgccacggtaccgggcagcctgtgcgcccggtgcgcgcctgcttcagccatccgcgcccggcttaccacgaggaatatcgccagtggttcggcgataacctcgaattcgactgcccgcacaactgcctgtactacgaccaggccaccttgcgcctgccgctgctgacgcgccacgccggcatgcaggcgttgttgcgcagcgagctggaccgccgcctggcccagcgcctgcaactggccggctggaccggcaaggtcgcggccagcatgcgcgacagcctggcccgtggcgtggtgccgagcctggagaaccaggccgaggcgctgtaccagagcccgcgcaccttgcgtcggcgcttggaggagcagggcatgacctttcgccagttgctcgatcaggtccgcgccgagctggagcagcaactggagtttctcggcgagagccgcgcccagatggcggcccagctgggttacggcgacctcgcggcgtacctgcatgcccgcaagcgctggaagcgcgactgaatccatcaggctcgcggcatcaccgcaggcgttgcgcggattccttaaaggaatccactgcataaaaaacatgaattttatttatcgcaatcgagcctgtagcgtggccccgtccctgaccgatggagcgcccccaatgtccaccccgcagccgctgtctcccgccgaacgctactggcagcgcaacctcgcggtgtgcgccctgggggcgttcaccaccattgtcgcgatgaccctgctgctgccgttcctgccgttgtacgtcgagcaactgggcgtcagcgatccggcggccatcgtccagtggtccggcgtggcgtttggcgcgaccttcctgtcggcggcgatcaccgcgcccttgtggggccgcctgggtgaccgctatgggcgcaagctgatgctgatccgcgccagcctcggcatggccgtggccatgtcgctgatcggcctggcggagaacgtctggcagttggtgttgctgcgcctgctggcgggcttgctggggggctatgcctcgggggcgaccatcctggtcgccacgcaaacccccaaggcgcgctccggctgggccctgggcgtgctgtcttcggggatcatggccggcagcctggccgggccgctggtgggcggtctgctgccgccgctgatcggcatccgcaacaccttcttcatcgccggcgcggtgatcttcgtgaccttcctggccaccacctttctgctgcaggaggcgccgcgcgagccgcgcccggccacgcaaaagggccaggcgccggacaactcctgggcgtccgtagcggacaaaaaaacggtattgagcatgttcgcggtcgcctgcctgctgatgttcgcgaccatgtccatcgagccgatcatcaccgtgtacctgcaggagctgcgggcggaaaacgtcaccctgatggcggggctggtgatgtccgccgcggccctgggcagcattatttccgcgtcgcagttgggcaaactggccgaccgtatcggccactggcgggtgctgactgtgtgcctggccgccgcggccctgctgctgattccccaggcgctggtcagcgcgccctggcaactggtgctgctgcgctttctcatgggcctggcgttgggcgggctgttgccttgcatctccagcatcattcgccattcggtgccggaaaacatcgccgggcggatgctcggctactcgacctccagccagtacgtcgggcaggtgctcggccccctggccgggggctttctcggcgggcacttcggcatgcgcacggtgtttgtcggcacctgtggcgtcatggccttgtgcgctctggtcacctggtggttcggctcgatgaaacctgccgtggcggtggcaggcgaagccggttagaccgggccggcgccacgccgcgcactgcgctcgaccatggcgacgatgctgtcgaacaactcgtcgcgagcctgctcgcggctgatttctccggtggccgcggcatgggacagcgcctcggccgccccgagcatcgcccgcaggccagccgtggctatggtcccgggcgccgcgaagggggcgagggcggcgcggcatttttccaggaagatcaactcgtattcctccttgatccgcgccagttccggcgaactggccagagcggcgatcacccccgggatctcgcggccctgggtcaggacgcagtcgacataagagccagcgatgaccgctgcgcggctggccagggtcgcttcgctgcggtccagggcggcgtccatcagcaatgtctggcgtgcatcgaagtcctggtacagcgccgccagcaatcctgcgcgggtgacgaaatggtcatagaccaccggcttggtcaccccggcctgttcggcgaggcggcccagggtcagggcttcggtgccttccgcgccgatcaattgccaggccacttccagcaactgttgcagacgctcttcgcgggacaggcggcgacgggggggtgaagtctcggagggggtgcttgacatgcttatataccaaaagtaacttgttgttcgtaacttaccaaaagtatatagggcctggttgccgccctcaatccaatttgcctccatcggcaggagtcttcgccatgcatgcgcttatcgttgtcgcccaccatgatccccgctccctcagccacagcctggcggcccaggtcgccgaggggcttgggccgtcccactcgttcgagatcgccgacctgttcgccgaggcgttcgacccacgcttcaacgtcgccgaccacgcggtccatcgccggcaggaacagcccccggccgacgtgctggccgagcaggcgcgcatcgaccgcgccgatgcgctggtgctggtctatccggtgtactggtggtcgatgccggcgctgctcaagggctggatcgaccgggtgttcgccaacggctgggcgttcgatttcaacctcgaagccaataggtttgagaagaaactcggacacctgcgggtgcatctgcttggcgtcggtggggccgatgccggcacttacgggcgccacggctacgagacggcgatgaagacccagatcgaccacgggatcttcgactactgcggggcgcgggtgctgacctcggagctgctgctggaatcggaaagccaggatccggcgctgcatctgcgcacggcccgggccatcggtcacgatctgttcagccgcgccagcgccgccgcggcggttcaggcgggatgaggggataaggctccgcgacgtcccggtcgcggagcgcgggacggctttggccgtcagtgcccggcgggctgcgcctgttgagtgaggatcgccctggccagttcttcatcgctggcattgaggcctgggttttcctggcggattttctgcagcaccgactccaggtagacgccacggatggcgccaccgctggcgacgaagctggaggcgtcgtcacgggcgggaatcaccatcttgtcatccttgaaggtcgagtacagcgaggcggaaacccctgcggaggtggcgacatcacccgcatcgacacgggccatggctgaacctgcgggcagacagagcaacaacgaagaaacgagtaataggcggcgcatgggggcgtcctccgacagcgtgaagcgaaaaggaagtactacacaatctaggatgcgcgacgcagccccggagttccctgaacgctcgcggtggccgctggccgggcgttttgcagggggcagccagcagcccccggcattgcaccgggggctgtggtcaacgggttgtcagctcacgacccggtagcacggcacgtaggccgcgccgcccggcagtttcatccggtgctgctggacgaaggatttgagcaggtgatccagcggctgcatgatcgccgtgtcgccgtggatttcgtacgggccgtgcttctcgatcaggcggatgcccttgtccttgacgttgccggcgacgatgccggagaacgcgcgacgcaggttggccgccagctcgtgggacggcagtgcgcggtccagttgcaggctggccatgttggcgtgggtcgggtcgaacgggcgctggaagccttcgtcgattttcagcagccagttgaagtggaaggcgtcgttgcgttcgcggcggaactgcttgacctccttgagcccctcggtcatctgccgggcgacctcggccgggtcgtcgatgatgatctggtacaggctgtgggccgcatcgcccagggtcgcgccgacgaaggcgtgcagttgctccaggtagggcgcggcgcttttcggcccggtgaggatcaccgggaacggcagctcgcggttgtccgggtgcatgaggatgcccagcaggtacaggaactcctcggcggtaccggcgccgcccgggaagatgatgatgccgtggccgacgcggacgaaggcttccaggcgcttctcgatgtccggcaggatcaccagctcgttgacgatcgggttcggcgcctcggcggcgatgatgcccggctcggtgagccccaggtaacggctgccgctcatgcgctgcttggcatgggcgatggtcgcgcccttcatcgggcctttcatcacgcccgggccgcagccggtgcagacgtccagtttgcgcaggcccagctcatggccgaccttcttggtgtactggtattcctcggtgctgatcgagtggccgccccagcagaccaccatcttcggttccacgcccggacgcagggtgcgggcattgcgcagcaggtggaagacgtagtcggtgatgccctgggagctttccaggtcgatgcgctggctggccagctcgctttcggtgtagacgatgtcgcgcagggcgctgaacagcatttcccgggtgctggcgatcatctcgccatcgacgaaagcatcggccggggcgttcagcagttccaggcgcacgccgcggtcctgctggtggatgcggacttcgaaatccttgtaggcgtcgaggatggtcttggcgttatcgacatgggcgccggtgttgaggatggccagggcgcactggcggaacagggcatagatgctgccggaaccggcttcgctgagttgttgcacttcacgttgggacaaagtctccaggctgcctttggggctgaccgaagcgttgatgacgtgtcttgaatgcattctggattccttgaaagcgagaccaccggcccatgcgggcccatggcttaagaatagtgagcggcgggcgggacgccgggaaaaacattctcccgggcttcaccacgcgaaggcaaacggccaccggaacgtgcggcgcgtccgccacgctactttctcacagctggtggtccgaagcgaaagcggcatgcatcgccgttgctatgccagcccagtcacccacggtcttgcccagcacctcggcaggccgagtgaatttatcggccaggcgctgctcataactctaaatggcgtaatcgcgccagggttgtgtacgcagtcagggagcggcatccacatgagcccggtttcatctgtcaatccaggccagccttgtcgcctggtgttagtggtcgaggacgagccgatgatcctggagtttctctgcgagatcctgcaggacgagggcttcgtcacccaggccatgctccgcgcggatgaggcgctgcagttcctggaaagccacccggaccaggtgcgtctgctgctgaccgatatcaatatgccgggcaccctgaacggcgcgggcctggctaaccgggtgcgtgagtgctggccggagatgccggtgctggtgatgtccggttatgagacgccgcagagttccggcatccgctatccggtgtcgttcatccgcaaaccctggaccatcgggcagatcctcgacagtgtcgaccaggcgttgaacaaggtggggaataggtaactggggggggggcgctggcgagatgaggagcgaagcggctttcgaccacccaggacctcgggtcctcggtgatcgcaagggagggtgagctagcggctcactctttgacgctcatgaactctttggcccagacgatgtactcctcgggctgggtgtaggtgtgggccagctcggtggcgctgaggtccgaggcctgggtgaagatctgccgctgttcgcgcaggcagtcgtaggtggccttgatcgccgcgaagtacgccgcgtggccgtcgacgatgatcttcgcgcccagttgcgccaggcgcgcatcgtcgcgcagcgccgggttgccgtaggtcaccagcatcaaggggaccgacaggtgctcggagatctgctccagttgctcgaaatccttgatcccgaccatgcagatgccgtcggcgccggcacgctcgtattgctgggtgcggctgatgatttcctggatcggcaggatcgccgcgttggtccgggcgatgatcgccagttccgggtcgacccgcgcttccagggccgcgcggatcttgcccacgccttcggcgaccgagatcaggtcggtggacttgcgcccgaactgggccggcagcagggtatcttcgatggtcagggcggcgacgccggcgcgctccagttcgaccacggtgcgcatcacgttgagggcgttgccgtagccatggtcggcgtcggcgatcaccggcaactgggcgacgcggccgatgcgggtggcctgctcggcgaattcgctcagggtgatcagggcgaagtcaggcgcggccagcacctgcagcgaggcgacggagccgccgagaatgcccacttcgaaacccaggtcggcggcgatccgcgccgacatcgggtcgaagacggaggcggtgtgaaagcaggagtctgaagcgatcaactcgcgaaaactacggcgtaaatcttgatgagacagcctggacatacgaactcccggaaggaggtaaaagagatgccgacgatagcgtcgagtcaaaaatgcaatcggttgtccagcgcgcctgtgtcaaaggttcgctgcgaaaacctgggcagatgaagacgaagcaagcaggtatgaaacggcgggtgacgccgcaccggatggaaaaagccaggcgggcgctcttgttatggccgccatgaaggctatcacgccgccgcggcgaaaatgatgacgaattcgtatgggcccatgccagaacggcataggccatgccggttgtcatgggcgccaaggcgggtcgatcatgccgaatgagacggttcggttatcactggcgtttatgggagtgtcgatctgtagtggcgaggacgagagtacgcagcgctcgttgctacgcctcgaaccaggggaaaggctcaataaaatgtcagaatttgagtccgggtctggaccttttcccctgatgcgcaatcattaggacgtggatacccaaaggagagacgcatgttcattcggtcattgaccctcgcaacgctgctcgctgtcgtcggccccgtaatggcggccgataacgaaggccctctggcccaggatcagggcaaggcgcgcccactgatcgtcatcgctcccagcaccgtggacccgaccctggtggcgctgaagaagtccctcgacgagccggccaaccgccaggccttcagcgaacgcaacatggtgctctacacggtgattaacaccatcggccagcgcgacggcaaggacctggacccgcaatcgaccatggcgttgatccgcagcctgaagctcggcgccggggcgcagaccaaggtgatcctggtgggcaaggacggcgagaagaagctcgagcattccggggccatcgaactcaaggaagtcttcagcaccatcgaccaactgccggcggcggaaaaggaagccgttgcgccgacgttggcaccggtctcggaagtcaaggcggcccacgccggcaaggccgccaaatcgggcaagcctgcggcaccacccaagccgctggacgactcgagtctggccatcaccgtttcctgactagcgcatcgcgagcaagctcgctcctgcagaaacatacgggcttctgtaggagcgagcttgctcgcgatggcgttctaactcacctcgcctgagctcagctgaccatcaggcatcggtcacgacactgccagcatttctgcctcttttgctgcaccgccatcaccttcagtgctttgcagcgtccggctgaccccgcgcacgatcatctcgacttcccgttcatcgatgatcagcgctggcagcaggcggatggtggtaccgcgggtcacgttgatcagcagtccgtgatcctgcgccgcccgtagcgccagctcgcgccgcggggctttcagctcgatgccgatcatcagccccaggccgcgcacctgcaggacctgcgggtgatccgccagctccacccgcaagcgttgcaacaggtgctcgccctggcgcctggcgttggccagcaggccttgttcctcgatgatctccagcacggtgcaggccacccgacaggccagcgggttgccgccgaaggtgctgccgtggctgccgggggtgaacagctgcgcggccttgccccgggccaggcaggcgccgatggggataccgttgcccaggcccttggccagggtcatcacatccgggaccacaccttcgtgctggcaggcgaaccactggccggtgcggccgatgccggtctggatctcgtcgagcatcagcagccagttacgccggctgcacagctcgcgcacggccttcaggtagccgggcggggccaggcggataccgctttcgccctggatcggctccatcagcaccgcggcgatacgcgggccgtgggtttgcgcggctcgctccagggcggccaggtcgccgaagggcagcttgaggaaatccccgggcagcgagttcaggcccaggcgcaccgccggtccgtcgctggccgccagggtgcccagggtacggccgtggaaggcgttctccatgacaatcaccagcggccgctcgatgcctttgtgccagccgtgcagccgtgccagcttcagcgcggtttcgttggcttcggcgccggagttgttgaagaacgcccggtccatgccggccagcagggtcagccgctgcgccagccgctgttgccagtcgatgctgtacaggttggaggtgtgcagcagcaggccggcctgttcgcggatgacgctcaccagcttggggtgggaatggccgatgcccgtcaccgccacgccggccaccgcatccaggtattcgcggccggcctggtcccagaggcgggtgcccaggccgtgggtgaagctcaggggcagcggttgataggtgctcatcaggcaggtggcggtcatgacgggtagctccatcgagtggggtgtgctggcagtatcgttagccaccctggctagataaactcgtcaattctttaatcatcttcaagtcagggttgataatggatctgttccaggcgatgacggtgtacgtgaaggtggtggaggcggggaacatgaccgctgccgcccgcgagtgcggcctgtccaccaccatggtcggcaatcacctgcgggcgttggagcagcgcctcggggtcagcctgctcagccgaaccacaaggcgccagcgcctgaccgagttcggcgccgagtattaccagcgttgcctggcggtgctggggctggtggcggactccgagcgcatggcggaacaggtccagggcgagccgtccggcaccctgcgcatcaccgcgccgctgaccttcggcaccgagcgcctggcgccggcgctgagcgaattccagcagcgctgcccgcaggtcaaggtggaactgaccctggccaaccagcgcttcgatttgatcgatggcgccttcgacgtggcttttcgcctgggcaacctggacaccacgtcgctgatcgcccggcccctggaggactacaccctgaccatctgcgccgcgccggattacctggagcgctgcggcacgccgcaagtcccggaggacctgcagcaccacaactgcctggcgttcgcctatccggccggtgacgagtggagctccaccgccacccagtggccgttgcgcgggcccgagggggacgtgctgatcccggtgtccggttcgctgctgaccaacacttcgtccggcctgcatcgcgcggcgcggggtggcctgggggtggtgatgatgcccgatgccctggtggaggaggacctgcaacaggggcggctggtgcctgtgttgcaggactatcaattgcccttgcgggcgatgcacctgctgtacgcccaggactgttaccgcctgcccaagctgcgcagcttcgtcgaattcgcgttggagaagtgggggcgctgatcggccgcgccatcaagcaaagaccccgtcgtgccggtctggcagcgacggggtcgggttcacgcaggttcggtcaagccagttcgacaggcttcagtttgtcccaggattccaccggccccgggttgcccggcaggctgccgctgccaaaacacaccgccagcttgttcaccgcgttgagcgcggtggtgaccgcaccttcggcccagccagcggtccaggacacgtcatcgccggccaggatgaagcggtcgggattgtccgtgccgacgtcgctcatgaactgggaaaagatccgccgctgatactcgtactgccccggcaggttcatcttgaaggcgcccaggtacagcggctggtcctcccagttgtgctccacgaacgcatcgaccgtgctgtattgctcgttgaggttgatctgcgggtagaggttgtccagcaggttggtacacagatcgacatgctgcggcagcggcgcggggcggtcgccgaggaacttcagggcatcgtcgttccaggtgtaggacaggaagatcccgctgcctttgtagtcgcccttgctggccgagtagtccaccaggtaggtgccgcgggtcagccggtcggacagggtgatgctcatcttgcgttgctcgccctctgccaccgggtcgttccagaacggacgccgggtggcggcgaaaatcttcgccgactgcatgtagtgggtgtacatgatggcttcccaggtatcgatgggcagcaggccgttcatggcgggaaggcttcgtgggttccccgagtagcgcagtttgtcgaggatccgcacatgcggggtgtagatgacgctggggaagtagcgttgctgggttttttggttgcgggtgtcggtgatggaaacgaggaaggagccatcccgctggcgctcgatgtgtcgcacctcctgatggaacgggtcggtgaatacctcgcgggccagggtttcgaccgtggtttccgcgggccaatgcttcatcgtgtcgcccagctcttgcggggtcttcgaccagagccgttgcggcaggctggaagagccgtcgaacatcagttggtggtcggcatccaggccggtgtacagcacgcgcagcagttcaaggatgctgttcgggtagtcggtgttccagccgccggtgccgaagccgatctggccgaacaggtcgatatcggccttgctccagccggagttttccaggagcgcggcgtagaagctgacatcgtcgccgctggtgccggtcgtggggttgacgatggcgttccacagcttcttgatcgtctgttgactgatggagccttcggtcatggccttttccatggcggtgaaatcgtaggtttccaggaagttatcgaagaactggttttccaggtcggtgtattccggtggttttggaaagtcggggttgccgtccacttcgtaataggttttttccccgcggtaatcgaccacggtgctaatcgccgcggcggtgcccgggttgggaaagtccgccgagttttcggtcatgccgacttttttgaagtagtggaacagcgccttgctggacaccggaaagcgcatcgcgcccagttcgcagagcacctggtcgcctgggttttcggggtcgccctggagcttggagtagagccgcccgccgatgcgctccgaggcttcgaccaccaccgggtgcaggcccatgcgcatggcctcataggcggcgaccaggccggcgacgccggcaccgacgatcagcacctgtttcccgtagttctccggggcgacatggcccaaggggctgccctgtgctttctgcagaaagtcggcgtagtgaaaggggaagtccggaatcagcgcggtgacgtccttgttcatgcgcaggggagagcggttggttctggaaggaatcgcagacatggggtttctccttgaaagtcatttccatgtgtttccacttgctcgatggctctatatcaatagtcgccagaggtccaagcctagaacagattccgggatgcatagagtcgggcgggggttgtgcccgcgcggggcggcagcgcaagagcgtgagaggaggacttaatgtccgatgccctggtgccggaggacccgcagcagggctggctggcgttaggccgactcgctggccagcagcatcatcgccgccgacagggtgtggccgtcggtgatccggccggtggcaatcagcgtcatcaattcctggcgactgacccacagcagatgctccacttcaccatcggtggcggcggcctgttgctcggcaatctgcacctggcacaccgccaccgcgctggcgatcagcgacgtgttgctgtgcagcaggcccagttcgcgaacgtgcgacgcctgccagccggtttcctccagcaattcgcgggccgcggcgtcaacggcactttccccggcatcgatggcgccgcggggaaactcgatggactggccgccgatggcccgccgcttgaggttgaccagcatcagccggccatcggccagggtcggcacggccaccacgccgttcaccgcccggggttccttgatgatgaagtagccctgctcacggaccaccttgaaatacggggtttccagcaggcactggttgtcggcgatggaactcatggggggtatcactccagaaaacagcgatcgaacaggtacagctcggcgggcttgagattttccactgtggcttgcggccggccgccgtcgccgcttttcttgcgtccggtttcgcgcaggtaaccggcttcgctcatcttcaacaggcgctggcggatgctggtcttgagcactggccgttgcagcaccagggagaagatgctcaccgcttcgggggcgctgaactcgctaccgagaaacatcaacggcaggctgctgtacagggatttggaaaacagccgctcgtgcacctgggccaccaggctattgtggtcgaagggcagcttgaagctgccgctggccacgtcgccgagggtaaagaaaccctgctgcgggccgggctccaccggctcgctgacgatccccaggtagaaggtcgaggacgaccagcagcgcgggtcgcgaaaggcgtcgccgaccgtgcccacctgctccagccaggccaggggcatgtccaccttgctggagcgccgcagccgctgcaccgcatcattcaggctgcggtcctcgacatcgccgttgaccacgatgcccggcagggcccagtgcccggcgaagggctcgctgtcgcgttgatggaggaggatttccagctcggagcgttcgcggttatagcgcagcaggcacaggtcgatggtgtgcaggtaggcgctgggggagagggggcggtcgggcatatcaacttccgtggacggcgtagaggccgtagtttagcggattcatgcccggtgccagccattggcttggcggtgtttcgccgcgggccaggcattggcgcaacacgctgctgcgcacccccggttgttcttcgatccgcaggatggagaagcgctgcagcagctcctcgccgcgatggaacccgggcaactggcgcgccacgtcctcacccaccaccaaggcaatgcgcttgccgtccagagccaggtcgtccgccagccgttgcagcagggtgtagctgtagaccggggcgggatcggccaggcccagtcgctgctccaggcggctcactgccagttcggctgggcactcgggttgcaggtgccgggtgatggcctgcaaccagtccacccgttgctcgaagtcggccatgcgcttgccgtccggatggcgaaagctggggaccaccagcacgcgccgggcgtggcgggcggcttcaagcatgacccgggcgtgaccggcgtggggcgggttgaaggcaccgccatagagggccagttcaaacatctgcatctccttattggtacatgacgtgtaccttatcattgcttgtgtgcgcagggaatcggcatgtcatgcgctatttatattgtttggttcggatcggtgaaataaaaaacggagtcaaagggggttgtctttaaggtacatgacgtgtacttttagctccatgcaaaggagaggaccagcatgaacagccaaacgatgaagaccgcttccttcgatgtcgatgcacaaaagagctttaccccgctgcgcccggacgaactgcccgtggccgagggcgaccgcatcggtggcgagctgaatttcatggcgaccctggccagcctgcgcatcggcagcaaggacgcccacagcccccaggccccctgggtggtggccgagcccgggcagatgctcgagcccaccggcctggagcatgccgacctgacctgggtcagccactgcgtaccgggcaccgaagggttcgccctgctggacgaattaccgacgccctatgactacgactacttcgtgtggaagggcgtggagccggacctgcacccctacggcgcctgctaccacgacctgcacggcaagctgtccaccggggtcatcgaatacctcgacagccagggtgtgcaacgggtcatcgtcggcggcctggccctggatttctgcgtcaagaccaccgccctgcaactggccgccgccggcttcaaggtgatcatccatctgccggcatgccgcgccatcagtgcagagggcgccacccaggcgatcgacgagatgcaacaagcgggtatcgcggtggccgcgacccgcgaagaaaccgccagattggccagtgcctgaggagtcaccatggaaagtgcatttgaccgtaacaatggcgtgatccagagcctgctggacaccgactactacaccttcaccatgatgcaggcggtgctgcatcagcaccccaatgtcgatgtggaataccagttcattgtccgctccagagagtccctggtgcatctgatcccggagatccgccaggaactggaaaagctcgccagcctgcagatgcgcgaaggcgaacagcgctttctgttcaacaagcgttttcgcgagtacctgaccccggacttcgagcagtttctcggcctgttccgtttcaacctgcgctacatccacgtggcggcggtcgatggccaactgagcatccgcgtccgcggcccgatgctgcactgcatcatgttcgaacagccggtgctggccatggtcagtgagttgcgcaaccgcgataggtatccggaggtggagcttgcggacgtcacccgccggctctatcagaaattcgaatggctggagaaaaacgccagccgcgaagaactcgccgagctgcgggtctcggacttctctacgcgtcggcgtctgtcgttcaaggcccagcgcgaggtggtgaagatcatgcgcagcgacttccccggggtcttcgtcggcaccagcaacgcccacctggcctatgagttcgacctgccgctgatcggcaccatggcccaccagtggctgatggtgcaccagcaactgggacggctgcgggagagccagaacacggccctggaaaactgggtgcgcgaataccgcggacgcctgggcattgccctgaccgactgcatcagtacggacttctttctcaaggacttcgacctgtacttcgccaagctctacgacggcctgcgccaggattccggggacccgattgcctgggccgataaggtcctggcccgctaccgggaactgggcatcgatccacggaccaaggacctgatgttctccgatggcctgaacttcgagaaatgcctgccgatcctgcgtcacgtgcgtggccaggcccggttcggtttcggcatgggcaccagcctggcctgcgatgtcgaaggcgtcgagccgctgagcatcgtgatgaagctggtgcgagtgcatggcgaaccggtggtgaagttctccgatgacccgatcaagaacgtttgcgaagacccgtcattcctcaggtacgcggcgcaggtgttcaacgtcaacctcagtaactcgcccctggaggcctgatatgagcagccaaacccaagaacgaattgcccgggagctgggcatcgatcggcaactggcgcgcggagacgaagccgcggaaatcgtccggcgcgtggacttcatccagcaggtgttgcgcgagtccggcggccaggccctggtgctgggcatcagcggtggcgtcgattccctgaccgctggccgcctgtgccagctggcggtggagcagatgcgcggggcagggcacgacccccgttttatcgccatgcgcctgccctataaaagccaggctgacgaaagcgatgctcaggcctccctggactttatccgcccggactcggtcagcacctgcaacattgccgagagtgtcgacggtctgatgagccaggtgcggatcgatggcttgcggccgtcggccgagctgaccgacttcgccaagagcaacgtcaaggcgcgggcgcggatgctggcgcagtatgcggtagccaatttcagcaacggcctggtggtggggaccgaccacggtgccgaggccctgatggggtttttcaccaaatacggcgacggtgcctgcgacctggctccgctgtcgggcctgaccaagacccaggtgcgcgcgctggccgaggcgcttggcgcccccgggcatctggtgcacaaggcccccacggcggaccttgaagaactggcgccgggcaagctggacgaaacggcttatggctgcagctacgccgagatcgacgcctacctgatgggcgaaccggtgtccgatgccgtgcgccatctgatcgaaaccgcctaccaccgcaccgcccacaaacgcgccttgccgcgcatccccgcctgacccgccttggcttgccggcgatggcgatctcaaggatgccatcgcgagcaagccgggccgagggggctaggactgcaccgccgtgcacaactccaccagcaggccgtcggggcaacgcacgtaggacacggtctgcccccagggtttttcgctgggcgcgctgagttcgctggcgccggcatccagcgccttttgatgggctgcgtgcacgtcttcgcagaccagaccaatctccatgcccagcggcctggccgagctatgggcctcgacgtgaccgccgctgaagttcatctcgcccagttcatgggcggcgaaggcgagggtggtggcgccggtttccagttcgccataggtaccggattcatggaggaaacgggtgggcaggccgaaggcgcgattgaagaaagccagcgaggtgctgacatccgggacatagaaaatggtgtaggcgaatttcatgcttgagcgatccttgttcattgaaactggagggccacgaaggccggtttatatgtcgccctggcacccgcttgggcgtgcgcttgagtaggagtgcccggtcggttctggcactgagcattcagggtgccgcgcaagcgtactacccgattccagggtcgacgattttcaatggttacagatcgctaccgggcaggttccgcgggcgaaaggcttgctggcgatggcggtcttgagggcgccatcgcgagcaagcttcgctcctaagaagcgaggagtacggggccttagcgcaaccgttcgagcatctggtagtaccacatgcccgccgccagcatcgggttaccgagctggtcgccgaagggcacgcggatgtgctggcaggcggcgaaggtgtcgtagtgctcgaggtgcccggtgatggcctgggccatgatctcgcccatgatgtggctggtggcgatgccgtgcccggagtagccctggcaataccagacgttgtccgagagcttgcccagctgcgggatgcggttgatcacgatgcccatggcgcagctccactggaagtcgatggccacgcccctgagcgccgggaaggtgcgttcgatgcagggacgcagttcgccggcgatgtcccgtgaatccttgccgctgtagttggcgccgccgccgaacagcaggcggccgtcggcggtcatgcggtaatagtcgagcacgaagcggcagtcgtagaccgccaggtcctgggggttgaggcgcttggccaggtcgcccaggggcgcggtggtgacgatgccgcccatggccgggaagatcttgcccttgagctgtttcggctccagcttgtgatacacgtcgccggccagcagcacctgcttggcgtcgatgcggccctgggcggtgatcaccgccgggcgctcgccgtggacgatccgcagcacctcgctgtgttcgaagatcagcgcgctgaggctttcggcggcgcgggcttcgccaatgcacaggttcagcggatgcaggtgcaggttgcgggtgttcttgatcgcgccgtggtacagctggctttccagcacctcgcgcagctgttgccggtccagcaggctgacctcgtcgcccatgccgcggcgcaccgcttcttcgtagtcggcgcgcaggccggcgaggtggctgggcttgtaggcagcgtgcaggtggccgtgcttgaggtcgcaggcgatggcgtatttgtccacgcgctggcggatgatccggtgcccgcgccaacgcagttgccagatgaaatcgtcgacttcgtcgcccagggtgcggcgcatctgcttgcgcatggcctcgtcgccggacaggctgccggtgacctggccgccgttgcgcccggtggcgccccagccgatcttgtggctctcgacgatggccactttcaggcctttttccgccagttccacggcgctggcgacgccggtgaaaccgccgccgatgatcaccacatcgacctgatgggtgccttgcagggtcgggtaatgggtttcctgattcagggtggcgctgtaatacgaagggcagcgttcggctgccggtgtgaccgggttgaatgcgactgtcatgggctgttctcgaatttttattggggccgggccggcgccgtgacgccggccagcgcgtcacgcctgggtcaggtaccagcgccagtcctgctcgccgacttcggccatgaactggcggtattcggcgcgcttgaccgccaggtagaccccgaggaattcgctgcccagggcgtcgcgggcccaggtggaattctccagggcggtcagcgaggtcagccagtcggtgggcagcagttcgctggcctgggcatagccgttgccttgcaccgggtcgcccggatcgagttgttcgcgcaggccgcgatggatcccggcgaggatcgccgcggcggccaggtaggggttggcgtcggcaccgcagatgcggtgctcgatatgccggctgttggccgggccgcccggcacccgcaggctcacggtgcggttgtcgacgccccaggtcggcgccagcggcgcgtagctgttggcctggaagcggcggtaggagttggcgttggggcagaacagcagcagcgagtcgagcagcgacgcgagcatgccgcccaccgcctggcgcagcagcggggtgccggccgggtcttcggcggcgaacaggttgtggccctcggcgtcggcgatgctcacatgcatgtgcatgccggtgcccgccaggtcatcgaagggcttggccatgaaggtcgcctgcattccgtgccggtgggccaccgccttgaccaggcgtttgtagcgcaccgcctggtccatggcctccagggcgtcgccgtgttccagggtgatttccacctggcccggggcgtattcggagatcgccgtgcgcgccgggataccttgcagtttgcaggcggcgtagaggtcggcgaggaagggttcgatctgctccagctcgcgcaggccatagacttgggtgtgccgtggccggccgccgtcggcgtccagcgccggttgcgggcggccgttgctgtcgcgcttggcatccagcaggtagaactccagctcgcaggccatcaccgggtaatacccctcggccttgagttggtcgatgaccttgatcagcaggtggcgcgggtcggcgatgctggcgggcaggccttcctgcgggtgcatgctgacctgcaccgcggcggtggggatctgccgccacggcaggcgcaccaggctgccggccagggggtaggcgcggcagtcgatatcgccgacgtcccagaccagcccggagttttccacgtcgtcgccctgcagggtcaggccgaggatggtgctgggcagcggccggccgctttcatagaccgccagcagttcctcgcggtgcaacagcttgccgcgcggcacgccgttggcgtcgaggatgaacagctcgatcatgtcgatatcggggttggcggccaggaagctacgggcctcgtcaagggctgcaaatttcatggttctctcgcttgcgccatggcggcgcgcaggttcggttcatgcagcggcgccggcagggcccggttgcaatggcagatagcaaggcggcaaggctcgacgcgcaaaggcgcgcgttcagagcgaaagcgagaggtccggagggcgcgaggaatgacgcaggcgggagcggcacagggccatgggcaggttgaccagcagtttcatcgccgggccccggggttgccgtggagatcgccgtgggtgcgttgcgttgttgccgttccaatgccgatgccgaggcggctgcacgaggcagcagcgcggggctggcagggcgggcggcaacacaaggcgttcatcggccggcggatctcgtcaagaattcacggacatttcgtgcaagtgaggttcactgttttaccgggactggtcctcgctgccaaggggcgcgtcacaaaatatttaacaccgcccccggcagcccggcggaaaaaatcctcagtaaacccacggcaccaggcgccaggtgtaggcgcagtaggtgtcgtattgcttgccgaattctttgcgcagcaaggcttcttcggcgtggatgcgggcaatcagcgggatcagcatcaaggcggtcagcagcaggccgaccccggagcggaaggccagggcccagcccacgcaattgatcagcagccccaggtaactcgggttgcgcagggtgccgtagatgccggtggtcaccagctgatggccgggctggatcgccaccaggccgctgaagcgcttgcccagcacgaacaccggccacagccgcaatatgccgccgccgataaagaacaccacgccgaaccagcgcacgtcggtgctaccaaaggtccagaagtccaggcggtcggtataggcgggaagaaaggccagcaacagcccgaggatgccgaaggcgacgaggacccagcggttttcccggtcttcctgtttgccggggctcaggttgccttcgctgaactgggcaacaaaggccatggccagcagggacagggtaatgacccacaacgccgggtgggagaagaacgccaccggtccgcccatgccgaggatggccaggccgaggtaggcgagggtagcgatcaggctgagcgccgcgagttggggagagttacgcatgatggcccctcacgaatgccgaggtgtatgccttcagtgtaggtccatcgtcgccacatcccgcgccgcccggtcccggtaggagcgagcgtgctcgcgaagcggtgtgcctgccgcacggcgtcgccctacggcagcacaggggctttgtcggccagttgggcgaccaggaactcgataaaggcccgggtcttctgcggcacgcgccgggcggacgggtacaccgcgtggatgctgatcggcggcgcctgccattcgcatagcacgggcaccaggcggccggcggccagggcgtcggcgacgatgaagtcgggcagcagggcgatgcccatgccggcctcggcggcctgggccagcaggtcgccgttgttggcgtgcagcgggccggtgacgtggacgcgctgggtgtccttgccgttgctcaactgcaggctgaccccgctttgcaggtagccgtagttcaggcactggtgggcggtcaggtcgcggggcgtctgcggggtgccggcacgcttcaggtagtccggcgaggccaccatgatccgcggcgccggggccagcagcttggcgaccatcgacgagtcggccaggctggcgatgcgaatggtcacatcgaaaccgccgcgcaccgggtccacttgctggtcgctgagcaccagctgcaattcgatgttcgggtgctgctcatgaaacagcggcaccagcggcccgagacgacgcaggccgaaggacatcggcgcgttgacccgcagcaccccgcgcaattcgccgatgccgtcccgcgcccgttgttcggcctcgtccacggcggccaggacttcccgcgccgactcgtagtactcggcaccggcttcggtcagatgcaggctgcgggtggtgcggtgtagcaactgcacgccgatggcttcctccagcgcctggatctgtttgctgactttcgagcgcggcacgtccatggcccgggccgcggcggcgaagccgttggcgtcgaccgtgacgacaaacgcgcgcatgcattcgatgcgatccatgactgtcccttttttggaatcaatgattctcgattttagggaattgttgctttttattccagcccctaaattagccaccaagccggccgcacagcctcccgcagcggaacccgcgccgagctcccgaattgtgcaactcaacgtttgaacctactcgacagcaaaaggaacgcgccatgtctatccgtgaactgctcaacccaaacaactccgccctgatcctgatcgaccaccagccgcagatgtccttcggcgtgcagtcgatcgaccgccagaccctgaagaacaacaccgtgggcctggccaaggcggcgaagatcttcaacgtgccgaccctcttcacttcggtggaaaccgagagcttcagcggctacatctggccggaactgctcagcgtgttccccgaccatcagccgatcgagcgcacctcgatgaactcctgggaagacaagaaactggtggcagcggtgaaggccaccgggcgcaagaagctgatcatggccgcgctgtggaccgaggtctgcctgaacttcccggccctggaagccctggccgaaggctacgaggtgtacatcgtcaccgacgcttccggcggcaccagccaggaagcccacgacatgtcggtacagcgcatgatccaggccggcgcggtgccggtgacctggcagcaagtgctgctcgaattccagcgcgactgggcgcacaaggacacctacgacgcagtgatggacctggtgcgcgagcacagcggcgcctacggcatgggtgtggactatgcctacaccatggtgcacaaggcgccgcagcgtcaggtcaagtaagcccctctccagcgggcgccgcaacagccgtccgctggaccctttcctcatatggcctggagcctgtcatgaacctcgaactttccgatggcgtggtcaccctgctggtgcggcaccgggtcaaggcgggccaggaccaggcgtacgaagcctggttgcgccggatcatcggcacggcccgcggctaccccgggcacctggggatcgatgtggtgcgtggccacagcggcggcctggcgctgttcaccagcgtattgcgtttcgccagcaccgagcagttgcagcactggctcgattccaccgaccgccgcgacctggtggcgcaagcgcaatccatgctggccgacggcgaccagaccgaaatcaatgtcgagcgcgaattctggttcacccccaatgaagccgggaccgccacaccgccaccgcgctggaagcaggcgtgcgtgaccttcctggtgatcctgccgctgagcttcctggtgccggccctgtggcaaccgctgttcacctggttgccctggttcggcggctacattgcggccaacgtgctgatcaccttgagcatcgtgttgctggtggtctatgtattcatgccttgggtgacccgtctgttcagccgctggctgcaacctcgaaccagcgtgtagcgggcccaagcgggcctcctcttttgcgatatcaaggagcaacgtcatgagcaacgctattgccgatctgatcctgcacaacggctgcctgcatacggtcgaccgggcccggccgacggccagcgcggtcgccatcagccaggggcgcttcgtcgccgtgggcaccgatgccgaggccatggccctgcgcggcagcgccacccaggtcatcgacctcaagggtcgcacggtgatccccggcctcaacgactcgcacctgcacctgatccgcggcggcctgaactacaacctggagctgcgctgggaaggcgtgccgtcgctggccgacgccctgcgcatgctcaaggaccaggccgaccgcacgccaaccccgcagtgggtgcgggtggtgggcggctggaacgaattccagttcgccgaaaaacgcatgccgaccctggaagaactcaaccaggcggcgccggacaccccggtgttcgtcctgcacctgtacgaccgcgccttgctcaaccgcgcggccctgcgtgttgccggctacacccgcaacacgccgaacccgccgggcggcgagatcgtgcgcgacagcaacggcgagcccaccggcatgctggtggcgcggccgaatgcgatgatcctttattcgaccctggccaaggggccgaagctgccgctggaataccaggtcaactcgacccgtcagttcatgcgcgaactcaatcgcctgggcctgaccagcgccatcgatgccggcggcggtttccagaactacccggacgactacgcggtgatcgagcaactggcccgggagcagcagttgacggtgcgcattgcctacaacctgttcacccagaagcccaaggaagaactcaccgacttcaagaactggaccggcagcgtcaagctgcaccagggcgacgacttcctgcgccacaacggcgccggggaaatgctggtgttctccgccgccgacttcgaggacttcctcgaaccgcgtccggacctgccgcagaccatggagcaggagctggagccggtggtgcgccatctggtggaacagcgctggccgttccgcctgcacgccacctacgacgaatcgatctcgcgcatgctcgacgtgttcgagaaggtcaaccgcgacattccattcaatggcctgccgtggttcttcgaccacgccgaaatcatcacgccgaaaaacatcgagcgggtgagggcactcggtggcggcatcgcgatccaggaccgcatggcgttccagggcgaatacttcgtcgatcgctacggcgccaaggccgccgaacagaccccgccgatcaagcgcatgctggccgaaggcgtgccggtgggcgccggcaccgacgccacccgggtctccagctacaacccctggacgtccctgtgctggatggtcagcggcaagaccgtgggcggcatggagctgcatgccgaaggcctgccgcggcagaccgcgctggaactgttcacccatggcagcgcctggttctcctcggagcagggcaagaagggccagatcaaggtcggccagctggcggacctggcggccctgtccgcggacttcttcagcgtcgaagaagaagccatcaagtggatcgagtcggtgctgaccgtagtcgacggcaaggtggtgtacgccgccgacgacttctccaagctctcgccgccgatggtgccggtgctgccggactggtcgccggtggtcaaggtgccggggcactggcgcccgacctcgccgctggtggctcaggtgcaccagtgcagcggcccgtgcgcggtgcactcccacagccacgagcgggcgcgcctgtcgaatgtgccggtcagtgacttccagggtttctggggggcgtttggttgctcgtgctttgccttttgagctgagccacgaaaaggcgacaggacgctaggccgtactgtcgcctgttttctgggaatacctcccggcctgctcgggataaacagtctctcagtcagcgccaggaggcgcatacgcctgttcgatatggccgatatttttgttcaaggcgggcttggagatcctgagaatcagggattcaacatgttttggataatccagccagtcggagctgccgacgtcgtaagccgatatgtaacgaacgatttcatagcgcttctcgggcttcttcctgatcccggcggggaactggatatccacgtctcggcgaatggccgagtaggcttccttgaccaggttggtggctttgccgatgtagatgaggttggccatcgagtcgtagaaggcatagatgccggcccgatcctcatgtcccttgaacaggtttttcaactgcgccatcaccggttggtccggcttgaactcggcgaattcgaccactgactggaattcgggggtaaaggcgcggtgaatgaagtactcgaccgtgatgtgctgaggctggcgttggcctgagcaccagtcctcgatctgcttgacgctgtacccggtgacggcttcggctgtttcaagatcccccgagtaatactgctcaatgatgtaactcaaaacaccgctgcggtcagtcacacaaaatcctttttcaggttcaattaccggttatcgagtatccgcctggcggttgctctgagtgctcggcagggcgctggcattccgtgttgcaacgctcaggtcggcttgagcggcagggatgctactaattggccattattctgtccagtcgctgaaattattgggctcttcatttcatttcggttgtcggaaacgttattcagggttattgcaggcaataaaaaggggcactgaaagttcagtgcccctagttgacttgatagggatctacaacttgcctcaacagaaccgatcaatcacccgaacttccgacttgttctgcagcgattgccattcattcttcagggtatcgaatacccgtccgatgaagtccctgtcggcggcggccttcttgccgacgtagccctggccacggcggtacattttcaggcgggccagcaggtcctggttgttcttgtcgaactcttcttcatgggcgtggggcgacaggcagtcgatatggacctggccagacttggcaatccacaggatgtggctgtcatggctgtctttctgtgccgcgaacagatgagacagttcatcaatagtaggttgattgttcagattcatttgtaagccccttgaccatttcgatctatctagttgagtcgctaattgatatcgctacatcggtaagttgaaccctgataccggaaacagggcgacagagggtgtctgtcggatacagataaggcccagagcctgatgcgtgtagtcgtcttgattaactgctacgcaatagcgtcacaacgaagagaagcagcgtaaacctggatcaagctgccgaagttttcagtttcggccacaagcatcttgaggagttttcgccagcttcccgccctttgtactggacgttcatgccaggtcagtttcatcaatctgccttgtgggcagtacacatccgggttaacagctcggcggtcagacgagcttgctcataacacctttgccacgtctcccgatcggggagacgcctgcatcatgcaagggcaaattcgcctcgtcaacggatttgtagtgaaaattttcaagcactacatattgtccggcaaaacctttcggcacatgagcggaacgggctatcgcgaccgaggacaggtagaatcgaggccttgaaacaggtgcttgaggttgcagtggtggatttacagcagggcttcgtcctgacccggcattggcgtgacacgccggcaggcacggaagtcgagttctggttggcgaccgatgccgggccgcgccagatccgcttgccggtgcagacctccgtggccttcattcccgccgaacagcaggaacaggcccggcgcctgctggccgacgatcgcgatgtgcaattgcgccccctgggcctgtgcgacttccagcaccgcccggtgctcggcctgtactgcccgcagcacaatcaattgatccgcctcgacaagaccctgcgccgcgccggggtcgaggtgctcgaggccgatgtgcggccgcccgagcgctacctgatggagcgcttcatcaccgcgccggtgtggtttggcggcaccccgggcgagggcgggatactgctggaggcgcagatgaaaccggcgccggactaccggccggcgttgaagctggtgtcgctggatatcgagaccagcgagaccggcgagctgtattccatcgctctggaaggctgtgggcagcgccaggtgtacatgttcggccgcgctcgcgaggacgacagcgcggtggatttcgacctggagttctgcgccagccgcgagcagttgctcgaacggctcaaccagtggctggcacggcacgatccggatgcgatcatcggctggaacctggtgcagttcgatctgcgggtgctacacgagcacgcgcggcgcctggcggtgcccttgcgcctggggcgcggtggcgaggaaatgcaatggcgcgaacacggcagccgcacccattatttcgccgcggccgccggacgcctgatcatcgatggcatcgaagccctgcgctcggcgacctggagcttcccgtcgttcagcctggaaaacgtcgcccagaccctgctcggcgaaggcaagtcgatcgacaacccttaccagcgcatggacgaaatcaaccgcatgttcgccgaggacaagcccgccctggcgcgctacaacctcaaggactgcgagctggtgacgcggattttcgccaagaccgagctgctcacctttcttctcgagcgggccacggtcaccggcctgccggccgaccgcagcggcggctcggtggcggccttcacccacctgtacatgccgctgatgcaccgccagggtttcgtcgcgccgaacctcggcgagaagccgccgcaagccagccccggcggctttgtcatggactcgcggcccggcctgtacgagtcggtgctggtgctggactacaagagcctgtacccgtcgatcatccgcagcttcctgatcgacccggtggggctggtggaaggcctgcgccacccggcggacgacgagtcggtgccgggctttcgcggtgcgcggttttcccgcacccggcattgcctgccgtcgatcgtcgctcgggtcgccgagagccgcgaggtggccaaacgcgaacacaacgcgccgctgtcccaggcactgaagatcatcatgaacgccttctacggtgtgctcggttccagcggctgccgcttcttcgatccgcgcctggcgtcgtcgatcactatgcgcggccacgaaatcatgcgtcgcacccgccagttgatcgaggcgcagggccacaaggtgatctacggcgacaccgactcgaccttcgtctggctcggcagcgcccacgccgaggcggatgccgcgcgcatcggccgcgcgctggtggcgcacgtcaaccagtggtggcgcgatcacctgcgtgatgagtacggcctggaaagcgccctggaactgcaattcgaaacccacttctgccgcttcctgatgccgaccattcgtggcgcggaggagggcagcaagaagcgctatgccggcctggtgacccgcgccgacggcacccaggaaatggtctacaagggcctggaagcggtgcgtaccgactggtcgccgctggcccagcaattccagcaggagctgtaccagcggatcttccaccgccagccgtaccaggactatgtgcgcgactacgtgcggcgcaccctggccggcgaactggacgagcaactggtgtaccgcaagcgcctgcgccgccagctggacgactacgaacgcaacgtgccgccccatgtacgcgccgcgcgcctggccgacgaatacaaccagcagcacggccggccccagcgctatcagaacggcggctggatcagctacgtgatcaccctggccggccccgaacccctggaaaaccgcaccgcggccatcgattacgatcactacgtgacccggcaattgcagccggtggcggatgccatcctgccgttcgtgcaggacgacttcagcaccctggtgggcgggcagatgggcttgttctaggaggcgtctcgtcgtagccgctgccgagcctgcgaggctgcgaacgactgggcggcattccgacgcagcaggcgcaaaacctgagaatgcattgagtcagggtaaccgcgatgcccctgctacggccgctgcgctgccgatcgcagcctcgcgggctcggcagcggctacacgtgcgtgagttggctcagtcgtcgaccgaggtgcaaatgccgctggcaccctgtttgccgctgtaggtcacgaccaccgagtcgtcatcttccacgctgatggccaccgtgatgcccgagcccttggcctcgaaataacgctcgttgacggtcttggtctgggcctctttgccgttgatgaacaccgggcctccttcctccgcgctgaccggaatattgcctgggcagtcgacgttgaacagcgggatgccttcggcgtgggcggcactggcaacgatcgacagggcacagctcaggaggatttttttcattgtggactccttgaggaaacaggcagaaacacgaatgtggcagtggttccattagcgctgaagcttagcgtatggcacgccggggcagggagtgggtagcgattttaatgaggcgaaaagtcgcccgggcatattgtcggacaataaaaatcgtggacgccacgccagggtttgtgtcagtttttccccgccttgaatagggcgagtgataggacgatctcgctaacaggtcgccgtggtctatcggaaattttcagcgttgaacaaggacgtaaatgatgtcaaaagccaaagaaaatgccggtttttcggcagctccgggcagcgatgcctaccaactgatcactgccttcagccatgcctatgaccgtggcggcgcggagctggtgaacggcaagccgtcgtacaccgcggaccaggccgccgagcagatcctgcgcaagggcctgtcctggtacgaccagaacggcgacggcaaggtcgagctcagctatagcttcctcaccagcaagccggccaactacaacccgaacctgggcagcttcagcgagttcagcgccttgcagaaagcccaggcgttcctggccctgcaatcctggtcggacgtggccaatgtgcgcttcaacgaagcggcgagcggcggcgacgggcacctgagtttcggcaactacagcgtcagcaccggtggcgcggccttcgcctacctgccttcgggcagcagttatgacggccagtcctggtacctgatcaacgatcagtaccgggtcaacgaaaccccgggcaacggcaactacggtcgccagaccctgacccacgaaatcggccacagcctgggcctgtcccatccgggcacctacaacgccggcaacggcaacccgacctacaacgatgccacctatgcccaggacacgcgcggctacagcctgatgagctactggagcgagagcaacaccgggcagaacttcagtaaggacggcggtggcgcctatgcctcggcgccactgatggatgacattgtcgcggtgcagaaactctacggcgccaaccacgaaacccgcgccgacgacaccgtgtacggcttcaactccaacaccgggcgcgatttctacagcgccagctcatctgcctccaagctggtgttctcggtgtgggacggcggtggcaacgacaccctggacttctccggcttcacccagaaccagaagatcaacctcaacgagggctcgttctccgacgtcggcggcctggtgggcaacgtgtccgtggcccatggcgtgaccctggaaaacgccatcggcggtgcgggcaacgacctgctgatcggcaatgccgcggccaacatcctcgagggcggtgccggcaacgacatcctctacggtggcggcggtcgcgacacgctatggggcggggcgggggcggacaccttcgtgttcggcgcggcttccgattcgaccttcgatgagcccgactggatcatggatttcaccagtggccaggacaagatcgacctcagcggcctggcgccgttcgcctcgggccaggcgaccctgaacttcgtcagcggcttcaccggccatgccggcgacgcgatcctgacctactacgccgagaccgaccagaccagcctgctggtcgacctcaccggcctgggcgcggtggacttcgccgtgggcaccgttggccaggcggcgaccaccgatatcgtggcctgatcgacagcaacggaagcggcgcgccatggcgcgccgtttttttgcctggtgcccttggctgacgttgagggccccaaggcctgcaaccctgcttggggcgctgccgtcagccgggcttttcagttcttgtcgatatcgacgttgcgggtctcgcgcaggcagatcaggccgacgagcaggctgaccccggtgatcaccaccgggtaccacaggccgtagaagatatcgccggtgtacaccaccagagcgaaggacacggtgggcaggaagccaccgaaccagccgttgccgatgtggtagggcagggacatggaggtgtagcggatgcgggtcgggaacagctcgaccatcagcgccgccagcgggccgtagcacatggcggcgatcaggatcagcgcgacgatcagcaccaccaccatggttttattgacgttctgggtgtcggcctgttgcgggtagccggccagggtcacggcgccgcgcagggccgcttcgtcgaaaccgtcgagctgcacgtcaccgacgctggcccgcaccgggctgccggcgggcgcggcgacgctggtgtagggcaggccctgcttgaccaggaaggtcttgaccttgtcgcacgggctgtcgaaacgcgccttgcccaccgggtcgaactggaaggtgcaggtggcggggtcggccagcacgctgatcggcgcctggcggctggcctggtcgatggccgggttggcgtagtgggccagggacttgaagatcgggaagtacagcgcggtggccagcagcaggccgaccatcagcaccggcttgcggccgatcttgtccgacagccagccgaagaagatgaagaatggcgcgccgatcaccacgctgatgatcagcagcatattggccagggccgggtccatcttgaggaactgggtgaggaagaacagcacgtagaactgcgcggcgtagaaggtcaccgcctgcccggcgttgatgctgaacagggcgatcagcaccaccttgaggttttcccatttgccgaaggactcgcggatcggcgccttgctggcgcggccttcttctttcatcttcaggaaggccggcgactcgtgcaggctcaggcggatccaggtggaaatacccagcagcacgatcgacagcaggaacggcaggcgccagccccagacttcgaactgatcgccggtgaagtagcggcagcccagcaccaccagcagcgacagcagcaggccgagggtcgcggtggactggatccagctggtatggaaaccgcgcttgccctggggggcgtgctcggcgacgtaggtcgcggcgccgccgtattcaccgcccagggccaggccctggagcatgcgcagggcgaccaggatgatcggcgcggcgatgccgatgctcgaataggtcggcagcaggcccacggcgaaggtcgccaggcccatgagaatgatggtggcgaggaaggtgtacttgcgcccgatcatgtctcccaggcgaccgaacaccagggcgccgaacggccgcaccacgaagccggcggcgaatgccatcagggcgaagataaaggcggtggtgtcgttgaccccggcgaagaactgcttgctgatgaccgccgcgagggcgccgtagaggaaaaagtcgtaccactcgaacaccgtccccagggacgaggcgaagatgactttctggctttcctggctggtgggcgcggcgaccgccgcgtccatcgattgagcatgttccgacatatcgatatccctcacagtgattgtttttgttgttccactgtcggcgccagggtggcgtcgctatctgcatcttgtcgctgtcttctgcatctgtaggtgtaggtgtaggagcgagctggctcgcgataattccttgagccttgcaccgcccttcaggtcgttatcgccagcaagctggctcctacatggatctcatcgttgctgctcctgtgcggatcaggccggggtgacgcttggtttttcggcggcagggctcctggtcgaggtggcgagaatcagctcggcggctttctcggcgatcatcagcgtcggcgaacaggtattgccggaggtgatgtacggcatgatcgaggcatcggcgatgcgcaggccggggatgccatgcacccgcagctcggcatcgaccaccgcctccggcccctggcccatgcggcaggtgcccaccggatggaagatggtggtgccgatgcgcgcggcggcttcgtgcagttgttcctcactctgcaactcggctcccggcaggtattcgatcggcttgaaggcttgcagggctggggcggcgacgatgcgccgggtcaggcgaatggcgtcggcggcgacccgcaggtcctccgggtggctcaggtagttgggctggatcagcggcgctgcctgcgggtcggcggagcggatttccactcggccgcggctttgcgggcgcaggttgcagaccgacgcggtaaaggccgggaacgcatgcagcggttcgccgaaacgctccagcgacagcggctgcacgtggtattcgaggttggccgaagtctgttccggcccggagcgggcaaacgcccccagctggctcggcgccatggacaacgggccgctgcggtcgtacaggtagcgcaggcccatgcccagcttgccccacaggctgccggcgatctggttcagggtgcgggcgttttccagtttgtagatcagccgcagctgcaggtggtcctgcaggttgccgccgacccccggcagttcgtgggcgacgccgatgcccaagcgttgcagcagtgcagcggggccgattcccgaacgttgcaggatgctcggcgagccgatggaaccggcgctgaggatgatttcgcgacgcgccttgaaggtctgcggctggccctggtagcgggcgctcagcgccgccgcgcggccgttttccaggagcacgcgatcgacctcgaccccggtcagcacggtgaggttgggccgctggcggatcggcttgaggaaggccttggcggcgttccagcgcaccccggctttctggttgacctggaagtagccgcagccttcgttgtcgccgccgttgaagtcgtcgacgctggcgatgccgctctgttcggcggcgttgcggaaggcatcgaggatcggccacgacaggcgctggcgctcgacccgccattcgccggcggcgccatggaactcggagtcgccggcaaagtggttttcgcttttgcgaaacagcggcagcacgtcctgccagttccagccggggttgccgtcggcggcccagcgctgatagtcgccggcctggccgcgcatgtagatcatgccgttgatcgacgagcagccgcccagcaccttgccgcgcgggtagctcaggctgcggccttgcaggccgggttcggcttcggtcttgaagcaccagtcggtgcgcgggttgccgatgcagaacaggtagccgacggggatatggatccaggggtagttgtcacggccaccggcttccagcagcaggacacggtgggccgggttggcggacagccgattggccagcaggcacccggcagggccggcgccgaccactatgtagtcgtagggatcaaaggcaggcagcatccatgacctcgttttatcgttcttgttgcggctcatcctagttgttagctttcgttaaaagaatgttagtttttgctcagccgctgtgcgtttttaaacagcggctccccccggcatctgcaaggaagagtcatgttcgactggaacgacctgcggttttttctcgagctgcaacgcagcggtcgcctgctgaccgcggcccagcggctgaagaccacccacgccacggtggcccggcatatcgaggcgatcgagaaaagcctcggcaccgcgctgttcgtccagcacgcccagggctatgaactgacgccggccggggaggcgctgctcaagcacgccgaggccatggagaacgtggccttgctggcccaggaggaaatcacccagtccacggcgcccctgggcaagatccgcgtgggcgtcaccgagggcctgggcatcatctttctcgccagccgcatgcgcggcctgttcgagcgttatccggggctggaggtggagctggtggcggtgccgcgttttgtcagcatcctcaaccgcgaggcggaaatcagcatccacctggagcggcccaacgccgacatgctggtgacgcgcaagctcaccgactaccgcctggccctgtacgccagccaggactacctggaccgcgcaccgcccttgcgcagccgcgaggacctggggcggcatgcctggatcggctatgtcgacgacctgctgttcagccaggagctgatcttcctcaccagcttctgccgcaacccccaggtggtgttccacagcaccagcgtgatcgcccagcaacaggccgcgcgctccggcctggggatcgccgtgctgccgtgctacatggccgccggcgatccgcagctggtgcccttgctgcccggcgagagcatccagcgcgcctactggatcagcacccgccgtgagctgcacaagtccgtgcgcctgcgggtggtgtgggattacgtggtcgagctgtgcgcggccgagcagggcttgctgctcgccgaaccgggcgtggtataggccctgggacgagggccgcggtttcagtcgtggatatcgaacgctgtgctgcccaggcgctcgccgttgaccaggatatgcagctcgtgatgcccgggatagtggcggcgggtgctcagttcgcggatgtgctgggcgcggccgagctgttcccgggccttggcgggcagggtgaaggccttgagcttgaacaccttggcgcgggtgccgccggaggccttgacgtagtcgatggcgtaatccaccaccaggcgctggctggcgtcggcggtggactccagggcaaaggacaggttgatgcgttcgcccaggcgaatcaccgccggctcgacccgcaggccatgcaacttcaccagcggcgcatgcccggcgccgacgatcgccagcgcccggcgattgccctgcttgatcaggctgcgcagggcatggcgggcgatccaggcggtgtgcgggttatccagcggccagccttcgagcaaccccagcagccagtcgggatgatccttgctgatgtcgttgaggtggttggccaccgacttgcgcacgtacaggctggggtcggccttgaggcgttcgaggataggcacagccagggtcgggtcggcctggatccgttccaggcggaacgaccagggcaggcgcgggcggctgccttcgctggccaggcggcgcacatgctcgttgtcgtcccgggcccagtcctgcagcaccgccagggtgcgcgacaggtcgctggcgaggaacgggcggatggcgaattccgaggagccgaaggcggtgaaatacttgagcgccgccatcgagcgctcgaaggcgtggccgccgtaactggccacgtagtgcggcaggaacatgcagacgaagcggctgtccaggcgcggcgcgagatcgtacagccgtgcgaggttggcttcgtagtccgccggcagcaccgcgtgcaggctctcgctgacccgcgccaggcgctgcatcaccgacaactcggcgaggcccttgttcgcgtgggcgagaaagccgcggtggtcgaacgccgggtacaccgcgagcatttcttcggcgatgtgttccaggcgttcggcgttgaagatttccttgagggcaggggtgttgctggtggcggtcatcggcgtatccattcgggacggggcgccgggcactgtagcgcagcgggctgacagattgtgtcaggagcgctccctgtaggagccagcttgctggcgatgcaggcaccgcggtggatcagaccggacgccatcgcgagcaagctcgctcctacagaaaggattcggaccgcgccgcccgatcaacgcggcggcggcaacaccccttcggactgctcgtcctgggcatccgcctcgaacagccgcgccagctcggcccgggcttcctgggccgattgcaggatcttcgcgtggtcgtcgtagatcgcgtgctgggcttcgagcacctgttcgtcgtgggcggtgaagcgcttgatccgcgagtcggcctgggcgtgggtcaggcccaggccgatcagcgccttgcggctcatttccaggctggagtaataggtttcccgcaccgcttcggcccccaggtccaccagcttgtgcacgtgctggcggttacgggcgcgggcgatgatcttgatgtgcgggtagagcttgcgcaccaccgcggcggtgttgatgttggtctgcgggtcgtcggtggcgatcacgaagtactccgcctcgccaaccttggccgccttgaggatttccgcgcgcatcgggtcgccgtagaacaccggcatgccgccgaagctgcgggtcagctcgatggtgtcgaccgaggtgtcgagggccacgaaagggatgttctgcgcccgcaggatccgcgcgacgatctgacccatccggcccatgccggcaatcaccacccgcggcgcgtcggtttcgatctcgcggtattcggcgggcatctccacgggcttggccttgggctgcaagaagcgcgcgcaggccaggagcagcagcggggtcacggccatggacagggtgatggtcagcaccagcaggtcatacaggcgcgcctcgaacaggccctggtcgcggccgatcttgaacaccacgaaggcgaattcgccgccggccgccagcaccacgcccaggcgcaccgcgctcaagcgccccaggccgccggccaggcgcccgaccacgaacagcagcggcagcttgatggcgatcagcagcagggtcaggcccagcaccgcgatcggcgcgctgaacagcaggccaatattggcgcccatgccgacgctgatgaaaaacagccccagcagcaggcccttgaagggttcgatctgcgcttccagttcgtggcgatattccgagtccgccagcagcaggccggcgagaaaggcgccgagggccatggacacgccaaccatgtccatcagccaggcggtgccgatcaccaccagcaaggcagtggcggtggacacttccggcaggccggtgcgcgccaccacccggaacaccgggcgcaacaggtagcggccgccgatcaccaccacggcgatgctgcccagcacttgcaggccatggcgcaggtcttcggcgctgctggtgttgtggtcgaccccggccaataccgggaccatagcgatcaacggaatcgccgcgatgtcctggaacagcaggatggcgaacgccaggcgcccgtgggggctggtcagctccttgcgttcggccaggctttgcaggccgaaggcggtggatgacaacgccaggcccaggcccagcacgatcgcgctgttgagcggctggccaaacaggaacagggcgacgcagccgatcaccaccccggtcagcagcacctgggccaaaccgacgccgaacaccgctttgcgcatcacccacaagcgccgtggcgacagctccaggccgatgatgaacagcagcaacaccacgcccagctccgacacatggctgatgctctgcgggttgcccaccagccccagcaccgccgggccgatgatcactccggccagcagataaccgagcacggcccccagttgcaggcgcttggccaggggaacggtcagcaccgccgcgaacaggaacacgacagcggcttgcaacaggttgccttcatggggcatgggcttactcctgggaaacgggtattgggtggtgcacggaaaaaacggctgcgcctcaggcaaccgtttggcccgcaggttccatggggggatggctgtgcagcataaagtctggggccggcgcagtcagccgttaatggccgatacgccgcaggttgtcaggcgcaggttgcaggcgttcgtgcgcttttatgctggcatgcctgcaccatcgaccgtcaatgcggccattgctcgagcaggatcgacacgaacttttccgcggccggcgacagcgaggcgccgcggcggtagaccaggcccagggtgcggttgaccaccggttcgctcagcggaatgctcaccagggtcgggtggtcggccgcgggcatggccaggctgggcatggccgacaccccgagcccggcctcgaccatgcccagcgacgtggacaggtgctgcacctcgtagaaccactggggacgccagctcaggccggacagggcgtggtccagcagcatccggttgccgctcaggcggccgacgccgatcagtcggtaatcgctgagttccgaccaggtgaccgaggcctttttcgccagttcatggtcacgccggcacgccagtacgaaaggttcgttgaccaggggcacgaactcgatgtccgggtgctgtccgctcatcatgttgatgccgaagtccgcttcgccgcgcagcacggcttccagcccttcattggcgctgaggtcgagcaggcggatgcggattttcggatagcgctcgttgtagagacggatcaccgacggcaggaagtagaaggccgcggtgggaatgcaggccagggtcacctggccgatctgccgttccgccagttcgcggatattgaggatcgagtcgtcgaagtcatccagcaggcgccgggccttgggcaggaagtcccggccgacgctggtcaggctgaccttgcgcgtggtgcggtcgagcagggcggtgcccaggccttcctccagcttcttgatccggcggctcagggccggctgggacaagtgcagggcatcggccgcctcgtggaaactcccgagttcggcgattttcacgaaggatcttatgtcctggagctcatattccatgttttcgtctcaagcgaaggtgggaaggcagcgctgttcaccttagatttatcatgtgcaagacgcaataatcgctacgatctttgcattggaaacatgatttattccctgacactcttgtgcccagaacatcaattaacccgattgattaacaagagtctgtgtccatgcaacgaattccttgtgtgctcatgcgcggcggtacctccaaggggccggtgtttctcgcctgggatctgccggtgtccatcgaacagcgcgatgagctgctgctcgacctgatgggctcgggacatgaactggagatcgacggcattggcggtggcagcccgcagaccagcaaggtcgcgatcgtcagcccgtcgctgcaccccgaggccgatgtcgactacctgttcgtgcaggtgatggtgtcccagcgccgggtcgatacggcgcccaactgcggcaacatgctgtgcgcggtcggccccttcgccgtcgagcaaggcctggtcaaggccacgggcgagcagacccaggtgcggatccgcaatctcaataccggcaccttcgtcaattccctggtgcagacgccggcgggcaaggtcagctacgaaggctataccgccatcgatggcgtgcccggcaccgccgcccccgtgcaactgacgttcctcgacgccgcgggcagcaagaccggcaaactctttcccaccgggaacacccgggacctgatcgatggcgtaccggtgacttgcatcgacatggccatgccgctgctgatcgtcgaggccggtcaattgggcaagcgcggcgatgaaaccccggccgagctggacgccgacaaggaattcctgcggcggctggaggccctgcgcttgcaggcgggcctggccatgggcctgggcgacgtcagcgacaaggtgatccccaagccggtgctgatctcgccggcggtggccggcggcaccgtgcaggcgcgttacttcatgccgcacagctgccatcgcgcgctggccatcaccggcgccatcggcctggccaccgcctgcgtcagcgagggcagcgtcgccgctgaactgctgggcggagccacgcaactgaagcaagtgcgcctggaacatcccagtggcgcgatcgatgtcgtattgtcctacaccggcaaccagggagagaccattcgcgcctcggtggtacgcaccgcgcgaaggctgttctccggtttcgtctacgccccggcgtcacaacgcctggccggatagtcctgcaccgcagtgacagtcgttcgcatcagaacaattctaaaaatgggtgatgccatgaaagtcgttaaatcgctctacttccagattatctgtgccgtgctgctgggcgtggtagtcgggcacttctgggcccagcaggccattgccctcaagcccctgggcgatgccttcatcaggctggtcaagatgatgatcgcgccggtggtgttctgcaccatcgtcaccgggatcgccgggatgaacgacaagcgttccctgggccgcctcctgagcaagaccttgctgctgttcctggcgttgacggtggtcagcctgatcatcggcctggtggcggtctacctgttcaagcccggcgcgggcatgaacatcgcccccactcacctgagtacccagggcttgtcgcagtacaccgagtcggcggcgaagctgggggtggtggagttcttcatgcacatcattcccgagacctttatcggcgccttcaccaagggcgaagtgctgccggtgctgttcatcgcggtgctctgcggttttgccctgtcgtccctgggcgagcgcggcaagcccgtgctggatgtgctggaagccgcctcgcacatggtgttcaagatcttttcctacctgatgcgctttgccccgatcggtgcgttcggcgcgctggccttcacggtcggccagtacggcatcacctccctgggcgccctggccaagctgatcatgaccctctacatcgcctgcggattcttcgtcttcgtggtgctggggggtatttgtcgcgcccatgggttcagcctgtggaagctgttgcgctacctgcgtgaagagttcctggtggtgctgggcacctcatccaccgagccggtgatgccgcgcatgctggaaaagctccaggccctgggttgcaagaaaggcgtggtgggcctggtgctgcccaccggctattcgttcaacctcgacggcacggccatctacctgtcgctggcggcgatttttattgcccaggcctgcaacatcgacttgagcctggggcaggtgatcacgatgctggcgatcatgctgctgtcgtccaagggcgcggcgggggtgactggcagcggcttcgtcgccctggcctcgaccctgacggtgatccacgacatccccttggcggggctggcgctgttgatcggcatcgaccgcttcatgtccgaggcccgtgcgctcaccagcctggccagcaatgccgtggccacggtcgtgatctcgctgtcggaaaacgcctgcgatcgccaggtgctgctacagaccctggatggcaaggcgacgcccgacgcccaggccagtgacccagcctgggagccggtgcaggccggcaaacacctctagccgcttgcggctccctccaccttccgtttctgaccccggttgaaaccctcgccaggccccgcctggcgggtagggggccgtgcgcctgggcgtcggccatgcttgtccataacaacaagagaatccctcatgcttgcattactcggcctggccatggtggtcgtgttcaccttcctgatcatgaccaagcgcttgtccccgatcgttgccctgaccctggtgccgattgtcttcgcggtgatcggcgggtttgccggcagcaccggaaaaatgatgctcgacggcctgaaaatggtcgccccctccgcggcgctgctgctgttcgcgattctgttcttcggcctgatgatcgacgcgggcctgttcgacccgttgatccgcaagatcctcaagcgggtcaacggcgacccggtgaagatcgccgtcggcaccgcgttgctgtcgctgctggtggccctggacggcgacggcaccaccacctacatgatcacctgcgcggcgatgctgccgctgtacaagcgcatcggcatgaacccgatgatcctcgccaccatcgccatgctgtccctgagcatcatgagcggcatgaccccctggggcggtccggccacacgggccatcgccgccctggggctggatgccggcgagtacttcgtgccgttgctgccgaccatgatcggcggtgcggcctgggtggtgttcagcgctttcctgctgggccgcgccgagcgcaagcgcatcggcaacaccgagctgcagagcggtggcggcaactgctacatcaaggccattgtcgaagacacgccctgcaagcgaccgaagctggcctacgtcaacctgttgctggtggtggcggtgatggtggcgctggtgatgggcctgatgcattcggcgatcctgttcctgatcggcttcgtgctggcgctgatgatcaactacccgcaactggagatgcagaaagagcggatcctcgcccattcgggcaatgccatgacggtggtgctgctggtgttcgccgccggcatctttgccgggatcttctccggtaccaagatggtcgatgccctggcgcagaccctggtggactggattccgccgtcgtgggggcatctgttcccgctggtggtggccatcaccagcatgccgctgaccttcgtgctgtccaacgatgcctactactttggcgtggtgccgatcctcgccaatgccgcggcggcctatggcatcgatccgctggagatcgcccgggcctcgatcctcggccagccggtgcacctgatgagcccgctggtggcctcgaccctgctgctggtggggatggtcgaccgcgacatcggcgacttccagaaagccaccgtcaaatgggcggtcctgacctccctggtaattaccgccctggccctgctgaccggcgcgctgaccctgttttcctgagcctgttcccctcaggcacccctgaaccatcagctgttccctggcgcgccgggtccatggcgcgcggcacctgcaccttgaataacggcacctcgaatagctgcaccttaaaaaaacaacaactcgaataacaacaacttgaataacaacaatgagtagtccgatatgagccgttcgatcacccctggggcgtggtttcctctggtcgccctgttgccgctgacgactgtcggcgcggcaggctttggcgacgacagcacgctcaagctgcaactgcgcaatgtctacttcaacgagaacttccgtgacgagcatggcctgagcgcccgggcggcacgcacggccaagagcgagcgcacggagtgggcccagggcctgctgctggatttccagtcgggtttcacccccggcaccctcggcctgggtatcgacgggctggccctggtcggggtcaaactcgactcggggcggggccgcagcggtaccggcctgctgccggtgcatgacgacggtcgtgccgccgacgcgttcgccagtgccggtgtcacggccaaggccaggctggccgggactatgctcaagcatggcaccttgctgcccaggaacccggtgctgatctacaacgacgcgcggctgctgccgcagacctaccagggcacgcagctcaccagcagcgacatcgacaacctgacgctcaccgccggccggctggatcgcttcaagctgcgcgattccagcgacagcgtgccgatcgttgcggacggttatgccggcgacaagtccggggacttcacctatgccggggccgactacaagctcggcaaaaacctgcgcctgagctacttctacggcgagctcgagcacttctaccggcagcacttcgccggtctccagcacgacctgaagctgggcgccggtgtgctgaccagtgacctgcgttacttccacagcagcgacagcggttcggcctacggcggcaacatcgacaacgatatgctcagcggcctgctgtcctatgccgtggccggccataccctgagtggcggctatcaggtgctcagcggtgatgccggcttgccttatatcagcggcgccacggtgtactcgttcagcaacgtgggcattggcaagttcatcgaggaggacgagaaaacctggatgctcggctacggctataacttcgccgcgctcggggtgccggggctggcgttttccacccgctacctgagcggcagcgatggccgctcgaacacggcgatcaaggaatgggaacgcgatgccgaactggcctatgtggtgcagcaaggccgcttcaagggcctgggggtgaagctgcgcaactatgtgtaccgctccgactttgcccgggggcgcgacagcaaccgcctctatttcacctacgagatcgcgctctggtaaggagggcggtgcctgcccagcctggtgctgggcaggaatggttgaccggtactcagagcgtggcggcctggggggcgctggccgatgcctgggagggcgcgggctcggtgactgccgggggcagcagcggcggcatcgggcaatccagcacatcggccacggcgcgcatcagctcggcttcggccacggtgacctggccgtcgtagcagacgcagcgggccatggcctgcagcagcgtcggccgttcctcgggcatcaactggcgcaggcgcaccagggcggcatccaggtgttcgaggtcgacctccgccggttgcggctgggcgaagggcaggccggtccaggcatgagccagggccagttgggcctgctgcgcggtcttttgcccggcactggccagggcgccgagcaggaccgccagttcttcgctgcgctggaacagcccccatttgtactcgggcgccggcaggccttcgacattgcgttgcacgatgcgcagcagcgtccactccagcagctcgacctgatcgtcggcgtcgatcagttgccgcaggttgtccatgaatgacttgcaggctttcttgtccagctgctgcagggccggtatcgacaggtccagcagcggcaggcgcaggttcgggtcgagggccgccagttgtttttgcagggcttgcaggcaaccgaagacctcggtggggctgttggcgtccagctgcgcgagttgccggtggcgcatcgagtcgttggcggacagcagcaggccaaagaccagcgcctgggcgccggtggtgctgtgggcgctgcgctggagcgccgggtcgaggctgaccagcgtcgcctgggccgccagcagatgttgcgcgttcgggctgccgatgctggcaatcgactgcttgatcgcattcaggtcgaacaccagggcgctggtcgcttgcgactggcggctgaacaccccggagcgggcgggttcggccggcagttcgatggcttcgatggtgggcaagcggccgtcccagccgggttccaggcgccggatccgcgccgagaggggcggatgggtcgcggactggccgtagacggagagggtggccccttcactgaaatacaggtggctgtattcagcgctgaaggcgctgtcgagtttcgagctggcggcgtaaccgccgatttttttcagcgcgccgaccaggccggccgggttacgggtgaactgcaccgccgaggcatcggcgaggaactcgcgttcgcgactgatggcgcccttgatcaggttgccgaaaaaagtcccgaccgagcccagcaggatcagcgccaggccactccacatcgccagcccgccgacccggttttgcgctagccggccagcctggttgaccccttcggccatcgcctcgccggtcaggccgatgaccaggatgccgtggacaatcgccaccagccgggtgttgaggcgcatgtcgccgttgtagatgtggctgaactcatgggcgatcaccgcctgcagttcctcgcggttgagcaccatgatggcgccgcgggtgaccccgatcaccgcctcctgtggcgtgaagccggcggcgaaggcattgatcccggcatcgggcagcacgtacacctgtggcaccggcgtgcccgaggccagggccatttcctcgaccacattgagcagtcgttgttcttccaggccgtccgggtgcaggttgatcagccggccacccaggcgcttggcgaccaccttgccgccggctttcagttcggagtgcttgcccatgctgctgccgatcaccaccaggaacaccaccgcggcgatcattgcggtcaggtgccagtcgaagctcggcgactgcttcatctccttgagaaattgcagccagagcaggttcagcgccaggctggtgacggccaccagacacagcacggccaggatcatcagcagcaccagggtgccggtacgccgcttggcccgggcctggtgttcaaaaaaattcatcggaccatccagggtgacagggggttagaacgcgaccttgggggcttcctggatcagggcgctgtcggcgaattgcagcaggctggcatcggcgccgtggccgaacaggccggccaggatcaccggcgggaaactctgtttgtagctgttgtaatccatcaccgtgtcgttgaaggcctggcgggcaaaggacactttgttttcggtgctggtcagctcttcgctcagctgttgcatgttctgcgacgccttgaggtccgggtaggcctccatgctcaggttcagccggcccatggcgctggagagtacaccttcggcctggcccagttgcgccatgtgctgcgggttgccgggctcggccgcgacggccttgagacccgccagcgcggcattgcgcgccgcggtcacggcttcaagggtgtcgcgctcgtgcttgaggtaagccttggcggtttccaccaggttggggatcaggtcgtaacggcgcttgagctggacttcgatctgcgcgaaggcgttcttgaagcggttccggcgggccaccaggccgttgtagacagtgatgacatagatcaccagcagggccagaacgagcagaatcacaatagttgaaacagccatacggatgtccttatcgacgtgcggatttcagggggggcgccatggtaaccgaattcatggcgggcgcagccatgggcagccgtcggcatgcgttcttcggcagcgcctcgcaccaggaggcgcaatcggcgccagcgtgttgtgaatgattgccgggcgctgtggtcggaccttgcatggcttgtcgtcgatcccggattacccggcaggcgcgccacccaaccctgggcccgccagccacgccgcgggcgtcaccttgtgaaggatcatcccgaccatgctcgaacccacctggacggcactcaaacaccataagcgggtgcaccagattgtcgccgtgctggcggccttcggtgcccaggacgttttgctgcgcctgggcctggggcgccttttgggcgagtcgccagccgctggtgaagcgcagccacaggactcgacgccacagcgggtgcgcctggccctggaaaagctcgggccgacctttatcaagctcgggcagatcctcgccagccgcagcgacattctgccgccgcactggatcagcgagctggaggcgttgcacagcggcgccgcgaccctgccttggagcgagctggaagctcaggtacgtgacgacctgggctgcgagctggaccaggtgttcgccgagttcgacagcgagcccctggccgcggcctccatcgcccaggtctatcgcgcgcgcctgctcagtggcgaggcggtggtggtcaaggtccagcgccccggcctgcggcgcaagatgagcgccgacctgcaattgctggaaggcgtggcgatgctggtggaagagaacaccgccctggcccattaccagccgcggcagatggtccggcaactggcccgggcgatgctcgaagaactggacttcacccaggaggggcagcactgcgacgcagtggcggcgaatttcgccgagcatccgcagatcgccattccgcgtatccactggctgcacagcagcgagcgcctgctggtccaggaatttttgcccagtcacacgccgctggaacgccaggccctgatcgagcagggcctggacccgagcctgctggcgcagcgcggggcccaggcgttcatcaagatgctgttggaggacggcctgttccacggcgacccgcaccccggcaacctgcgggccatggacgacaatcgggtcggcttcatcgacttcggcatggtcgggcgcctcgacgaacgccggcgcctggaggtcatgagctttatgcgggccatgaccgaaggcagtaccgaagcgctggtggcggtgctgatcgactggagcggcgagcaggtgcgcgacctgtccgccatcgaacaggccgcccgggaattcatgggccgacacggcggcaaggcgctgaacatgagtgcgatgatcgaggacttcctcggcctgatgcgcgaataccaactgttgctgccggccgacctgctggtgctgttcaaggcgctgatcaccgccgatggcgtactcacccggctcgacccgcagctggacctgatagccaccgcgcgcccggccatcagcaagatgctcaagcagcagttcagttggaaactcgcccgccgcctgggcctcgacggcctggaactgggccgtggcgtcgccgtcgaactgccgcagctgacccgcctgctgatcaaccgcctgaaacacggcgtggtcgacctgcgcctcgacatgccgggcatcgagcgcctggaaaaatccctgcgcctggcctccacccgcttgtccctggccctgctgatcagcgcgctactgatcgccttcggcccgcagatcgccgcggccggcccggcctggcaggggttgtcggtggtggggtggctggcgggggtggcgactgtgggtggggtggtggcgtttgtctggagtttgttcaagcggtcttgaggggggatcagcgctttgccagatcccaccgcggtcttctcgtctgtctatgttgccgtctgaagctctctgatggctggatttagtactgggaggccgacttcatcaaggtagatatcgctagtcacatgttgcgtattgtcccgttttcatcaagcacgaactctagtccaataccaacctctttcagcacctcagtagcacgatcaatgaagaactcaccttgctctggtagttcatgcagtccattgatgcgaatgatgggggacttaccaagtgcaccgggaatctcagtgtagatttccccgctctcaatgaaagcaacatatgtgttgatcttgtcttgtagtagttgcagatgttcgccttgttgggctttatcgccccattcaaggtggtcggagataatcagcacaatgttattgggctcccaggtggggatgacccagatatcgattacctgcggattcgtaatagacatgtctgttccctcagggctttggtcgaataatttcgactttggttggtgggatttcagtaccaccggggaaccccggcttccctttgcctacaactattgcaccactttcttggatttcagggaaagcaactttctggttcttggtcagtggtgctgtgtctgatgatttgcactcgatacaggaaagtttgccatcagcatcacgccccagcatgtcgagccttgtacgggctccgcttttggtcttgatcgtcacttctcggccaagctcgggttgagtctggctgagctcatcatatttggcatcttcaaacgccttgccctgcttcctgttcttctccaactgaatgttgaacacgatgtacagaggctgaatcccggaccccggcgggaagaccaggatgaagtctttgtactcgggcgggtagatcggattgacgatgatgttatccgcctgctcggtgggcggataaatccatatctggggagcttgtggtgcagcttctagcgggggaattcctgacgtgctggacgggtcaatggctggtgtccaggtcagggtgatcccgtctccgaaatcggccacctgctgagagccctgagcctcgaaccgggcaacagggatcatttcccagtcgctgcgcttctcagtgttgtatccgtagcctttcagcgtaccgtcggcctgctgttccacatgcaaccggacacgtgtgcggccttccttgagcgctttgagctgttcgggtgtgtacaggctgctgtcgcccaagctcgatggccagagcaacgcggctatgcccgccaatccacctgcaataacacccgtggtaaaaaacgtggtacccgcactcgcgcccgttgccgcagtacccgtgctgattccagcaccggctccagtgccaacccctgtagcagcaccagcagtagcagccactccacctaatagaagtgttccaagtgcagcaggtaacgcgtgaccactgatttgctggagagggattttccccgttgcatccgcttcgcgtccgcccagcaaaacgagctgcccgtattcgctgatggcattggtggggatgacacgagttgcgtagttgataaccccatcagggagcttgcagggcttggtaaaggtgcacccagctgtctggggtttggcttctgccttcggtggcaggtccgggtattgcgcccagcgttgggcgcccagatcgacgggctctactcccttgttgcgatagcccttcggggcgttcggtacgtagccactcatccgtgtttgcgtccacattgtccataaagaagcccccgtcagagggggagcaaagagcatttgcagttggcttagggacgctattggatttggctatggagggtctgtagggacaatctgaaagatggtggctgggccaggaggcatcggtaatgtgccctgcctcagccccaaccaggagcatgccttacaggtcgagagggcgaaaatttgttattttccgcaccctcggtggccactgccggccgccgtcaatagagagtgagtggatgagcgattcgttgcaggtgatcgatatcgaagtgggcgagggcaaggcggtggtcaagggcgccttgatcaccacccagtaccgcggtttcctggaagacggcacgcccttcgattcgtcctgggagcgcggcaagccgttccagtgcgtgatcggcaccggacgggtaattaaaggctgggaccagggcctgatgggcatgcaggtcggcggcaagcgcaagctcttggtgccggcgcacctgggttatggcgagcggtcgatgggcaagatcccgccgaatgccaacctggtgttcgaaatcgagttgctggaagtcctgacccgcgacgattgatttcgcccatcggccaggtcaggagatctgcctgatctgggcgcaaccttcctcggtaaatccctctttgaaatcgtgtctccgtgcttcgccaggcggggctgggccgtgggtgatcgataggcagtggcggacgaccggcgtcatcaagcccttgcgtgggcccgtggcatcggccaggataagcgccatataggtatagggggtatgggtatgtcgcacacgcacgcacagaaagacgatctgctcaaacgggtccggcgcatccagggccagatgcaggccgtggagcgggccctggagtccggcgcggagtgcgccaagaccctgcacctggtggcggccacccggggcgcgatcaacgggctgatgggggaaatcatcgaggcccatgccctggagcatgtggcccatcctgaactcagcgatgccgaacgggccaagggcgtgaacgaactgctcgaagccattcgccgttattcctgaccggaggccacaccatgcgcccgaccttgccaccggcaggcttgacccacgaccaccacttcctcggtgccgcccacgatgaaaacgcccgtcgcaccctgtgggtggtggcgctgaccttcgtcatgatgattggtgaaatcgccgccggttatctcaccggttccatggccttgctcgccgatggtttccatatggcgacccacgccggggccctgggcatcgcggcggcggcctacggttttgcccggcgcaatgccgacaatgcgcgtttcagcttcggcaccggcaaggtcggcgacttggcggggttcgcttcggcgctgatcctcggcctggtggccatcggcattgccggcgagtcgctgttgcggctgttgcagccgacccaggtggctttcaccgaggcgaccgtgatcgccgtggccgggctgctggtgaacatcgtcagtgccttgctgctttccggcggtcacgcccatcacggccacggccacgttcatcagcaggctcatgagcatccgcacgagcactcacacgggcacggccatcaccacgacaacaacctgcgctcggcctacgtccatgtgctggccgatgccctgacctcggtcctggccatcgccgcgttgctggcggggcgttacctgggatgggtctggctcgacccggtgatgggcatcgttggcgcggtggtgatcgcccgttgggcgtatagcctgatgaagtccagcgcggcggtgctgctcgacaccacggatgaacagctggccggcgagattcgccagtcggtggaagccgccggcgatgcgcgcatcaccgacctgcatgtgtggcaggtcggcccgcaggcgcgggcggcgatcgtcagtgtggtggcggccgctggtgtcagcgccgaaaccatccgccagcgcctggcgccggtccacgaactgtcgcacctcaccctcgagcaccgcagtctgtaacgctggcccctgtctacaccacaggcgggcaggggtaatgccggcgcagaaaatccagcagccgcagattgacctcctcggccttctcactctggatccagtgcccgcaatccgccagccgatgctgttccaggcgcggcaccttgccgggcatgcgctccagcgtgcgggcttccagctggcccaccgggtcgcggtcgccgatcatgaacagggtgggttggctcacctggcactcgcccaggtgttcggtccgttgccagttgcgctcgaagttgcggtaccagttcaaggcgccgcgaaaacctcgccctgcaaaggtgcgccggtacaccgcaaaatcctccggcgtgcaccaggcgggcggtgcgtggcgcgcaggcatgccctcgaacagcagggccgacgggcttttttcatccagcaggtattcacagtcgtgcatgaaatgcagcaggctgcggtcgatgtcggcgtccagttcccgctcggcgacgccgggttcctggaagtacaggatgtagttgaaacgctcggcgaacagctcgcgcatgatctccacggccgggcgtttcgggcggccggcgaacggcaccgacagggtcaccagggccttgacccgctgcggctccagcagcgccaggtgccaggccaccaccgcgccccagtcgtgaccgacgatgcaggcctgctcctggcccagggcatccatcgcttgttgaatatcggcgcacagggtcaacacgtcataggccgccacctcctcgggggcgctgctgtcgccgtagccgcgcatctgcgggagcagcacccggtagccggcggccgtcagcggcgcgacctgccggcgccacgaataccagcactcgggaaacccatgcagcagccacaccggcgggccgtccagcgggccggcggcatgcaggtgcagttcgatgccattgagcttcagggtatgttgggtgatctggctcatgagtgtgtcctcccaggtccagccatgaccctagcagaagcccgctgaccttctgaccaccattcattgttcgaataggcgcccagcagtgttacccggcatgggcccggcggctgtccgccggcgcctgctcgcgctgggtcagcccgtagtcgcgcgccacctcggcgacccgcagccggtagtcggcgaacacctgggtccgccccagggcctgggccgtgcgatggcgttccagggtgcgccaggcttcgaccgcttgctcgtcgcgccagaacgacagggacagcagtttgtccggctcgctcaggctctggaaacgttcgatggaaatgaagccgtcgatctccagcagcagcggtttcaacgcggcggcgaggtccaggtaacgctggcgatgttccgggcggggcagggcttcgaatatcacggcgatcatcagtgcgactccggcaggctagtgaacaaggggatgcgcccgttgagcgagggcttgtaggtccaggtcatgggctggtcgagggtcgattgccgcagcagcgcaccgaccaccgagctggcgatggccagggccaactcttggccggggcattggtggcgatcgctgccaaagctgaaactgcgccgcgcctcgcgttcgagcagcaggcgatccggctgcgggttcaactgcgggtcgcgattggccgaggccagcagcaccagcaccactgcgccgggctccagcgtcaccccggcgatgctgcaaggggtggcgacgaagcgccgggtgttctgcaccggcggatcgtggcgctgcacttcggccagcaggtcggcgacccgggtgggcgccgctcgcaggtccgcgagcaaccggcgatcgcccagcagggcgcagagggtattgccgatcagcccggcgctggcttcgaaggtctgggacaacagaccgatcaggttggcgatcaggctgtcgcgatcttgagcgtcgaagcctgcgacgatccgttgcaacagtgggctgacgggcggctgatcgagcagaacctcaaagcgtcgagtcagttgtccggctgcccggtgggcggcatcccgttgtgtccgatcgctggccggcgacaggcaggcgacaaagtccgctgtcagcccggcaatcgccggcaattggtgcgcggcaaagcccagcagcccggcgaccaccgccaccggcaggtggaactggcagtcatgcagcctggccgcggtatcccttggcaggcccagcagcagggcggcgacccgctggctgacttcctcggcatgcacctgttgcaggcccggctcgatggcggcccgggggcagcgctggcgttcgccgtcgttcatccgcatcagcaggccgaacacttggccggcggcaccgccgacgatgccttggggcaccggctcgtgcgcaggacgtacccgacactcgggatgggccagcaccgcggccaccgctgcggcgctgctggccagccacattcccagtccggggtcgaaggccagcccgccccgggcccgcaggctggcgtagtaagggtagggatcggcgtgggtgacggcggtgatcgggtccatggcgtgcggccttattcgcgggggagaagtgttgctactatcggcaacctgcgaggggcacgattcgttcgggagcgaaatatgaatgcacagcagcacgacaacgccgtatcccaggttgccgcggccattgccgagccggcgcggacgaaaatgctctgcgcgctgatggacggccacgcgcgcaccagcaccgagctggcggcgatcgccgatgtcagcgcctccaccgccagcgcgcacttgggcaagctcaaggaactggccctggtgcgcctgcatgtgcagggccgccaccgttactacagcctcgccgacaaacgcgtggcccaggccctggaagcgctgatggtgatcggccgcaacgccgcgcccgcgttcagcccacgcactctggaccgcctgcagttcgcccgcacctgctacgaccatatggccggcaccctggcggtgcagttgcatgaccgcctgctcgaggccggctggttgcaggagccgcaggagggctcccaggagtacgttctgagcccggctggcgaagggttttttgttgggctgggcatcgatgtgcaagctctggccagcctgcgccggcgctttgcctgcccgtgcctggactggagcatgcgccgcccgcacctgggcggggcgctgggggcggcgttgttgcaggagacaatccggcgcaaatggctgacccaggacctggacagccgggcgctgggcttgaccgccctggggcgcaaggagctcgccagtcggttcgccgtccggatcgaagaaccgggcagcccggccctgcgtgtcaggaacgttgccaaaccgggtcgcccggccgttacccaggtttcatagcggttatcaaccccatggctggcgttgccgtcagcctccaaatgcattcccggcctggagttctgcctatgctcatcgtcttcagtggcctgcccggcagcggcaagaccaccatcgcccgggccctggccagccatctgcgggccacctacctgcgcatcgacaacatcgagcaggcactgcgcaacggcgggctggcggaagtcggcaaggccgggtacgacatcgccaatgccctggcccgcagcaacctggccctgggcaaccgggtggtggccgattgcgtcaatccggtcgccgagagccgccaggcctggcagggcatcgccgaggccgagcagagcccgctgctcaacatcgaggtggtctgcaccgacatcgccgagcatcggcgccgggtggaaaaccgtgaggcggatgtgcccggcctgcgtccgccgagctggcagtcggtgctcgatcacgattaccaggcctggagcgacgagcgcttgaggctggacagttcgctgttgtcgccggcggaggcggtgcggatcatcgtcgggcatctggaaaccttgtagtacctgacccaccgtggtgcctgcatcgcgagcaagctgcgctcctacaggttcggtggtgggggtagggcggtgataaatcctggctgattgcacccaatcaataaacactggaatgaagacttcggcggataacgtcggcgaacgttattccttcgggcgcgaaccgtgcgcagtcggaaatgcccggttcaattatgtccgacacttttacaaactagcgctggcgaaaagctgaaattgcgccaatagttggcgctattgggtgtttcgttcgccgttggtgcgttttccggaccgctaatggtgcgctgttctttctctcggcaggccgcgtcaactcttgctttgtgcaaagcgataacagctgctttgccaaaaaaccccgtgtcagggcaaaaaaaccttcctcgacagtttctgcacttttttcgttcgcgccagtgttgtgcaaagccgttcaggcggctttccggataaaacgtttcagcgtcaaccggggatggggccccgtggttgagtgaaaaatgccgtcgagcgggcgttttttcacccttgaggactttatttgcagggaggcggggtttgggcacagcgattgctacagcagataaacagccttcgaattccagtgaagtgcgctgtcgaagtttcggaaaactttcagattgaaagttcacattaaaacgaaaaaggaggtgacgagttccacaaccaatggacgtcatcgcgggcgatccattgccgaaaatccatacgggaagtttcgccaggcgactggcgtcaataagtgggggtatttccgccagcatcgagcggaatattcaagccgcacaatgaggtgctcaacagaacagtttctatcgcacagcgtaaggcccgatttattgaaacagagagtttaaataaaaaagccgtttaaaccacggcgaggagttggggtatgtcccgtgctttttttaacgaaatgtatgatgcgagtggtggctgccgcccacattaccaggagttcgcccgctggctggcggacacccccgtggagctgctggaccagcgtcggcgcgaagccgacctgctgttccaccgcgctggcatcaccttcacgttgtacggtgacgagcaaggcactgaacggctgattcccttcgacatcatcccgcgcagcatcaaggccagcgaatggcggaacgtcgagcgcggctgcatccagcgggtccaggccctgaacatgttcctggccgatatctaccacgggcaacgcattctcaaggagggcatcatcccggccgagcaggtgctggccaacgagggttaccaggtggcgatgcgcggcctggatttgcaccgcaatatctattcgcacatctccggcgtcgacctggtgcgtgacggcgacggcagctactacgtgctggaagacaacctgcgcacccccagcggcgtcagctacatgctcgaagaccgcaagatgatgatgcgcctgtttcccgaactcttcgccgcgcaacgggtggcgcccatcgaccactacccgaacctgttgctcgataccctgaaaagctccagcccgctggacaacccgacggtggtggtgctgaccccggggcgcttcaacagcgcctatttcgagcatgcgttcctggcccgggagatgggcgtggagctggtggaaggcgccgacctgttcgtgcgcgacgaccgcgtattcatgcgcaccacctccggtgcccaggcggtggatgtgatctaccgccgcctcgacgacgccttcctcgaccctttgtcgttcaaccccgattccatgctcggcgtgcccgggctgatcgccgcctaccgttccggcaacgtggtgctggccaacgcggtgggcaccggggtggcggacgacaagtcgatctacccctatgtcgacgagatgatccgcttctacctgagcgaggaaccgatcctgaagaacgtgccgacctggcaatgtcgcaaacccgaggaactgtcccacgtattggccaacctgccggacctggtggtcaaggaaacccagggctccggcggctacggcatgctggtggggccggcggccaccgcggcggagatcgaagacttccgcgcccgactcaaggcccgcccggaggcctatatcgcccaacccaccctgtgcctgtcgacgtgcccgacctttgtcgagaacggcatcgccccgcggcatatcgacctgcgtccgttcgtcctgtcgggcagcgaaacccgcctggtgccgggcggcctgacccgcgtggccttgcgcgaaggctcgctggtggtgaactcgtcgcagggcggtggcaccaaagacacctgggtcgtggaggattgaccgatgctttcaagaaccgctgcagacctctactggatgtcccgttacctggagcgcgccgagaacctggcgcgcatgctcgaagtcagttactcgctgtcgctgatgccccaggcggggcgtagcgacgggcatgccgagctggcgatgtcgctgctggccgccggcaccctggacgactacaaccagcgttacggcgagttgaacaccgaacgcatgctgcacttcttcgccctcgacgaaaccaaccccggcagcatctattgctgcctgcgggcggcgcggaccaacgcccacgcggtgcgcgggcgcatcaccgccgacatgtgggaaaacatcaacgccacctggctggagatgcgcaacatcgccaagagcggcctggggcgctacggcatcagccatttctgcgagtgggtcaaggagcgttcgcacctgttccgtggcgcgacctcgggcaccatcatgcgcaacgacgcctattgcttcattcgcctgggcacctttatcgagcgggccgacaacaccctgcgcctgctggacgcgcgctacgaaatgttcggcgaggagtcggaggaggtcagcgacaactcggcccgtggctactaccagtggagcgccttgctccgcgccctgtcctcgttcgaggcgttcaacgagatctaccgcaatgcgccgggggccgagcaggtgtccgagatgctgctgttgcgcgccgacgtaccacgctcgctgcatgcctgcgtcgaggagctggaccagatcctcgccagcctgccgggcaacaacggccgtccggcccagcgcctggccgccgagctgaacgcgcgcctgcgctacaccgggatcgacgagatcctcgcgtcgggcttgcacctgtggctgagcgatttcatcgcccagatccgtcacctggggcagaccgtccacgaatcctatctggaggttgtatgaaactttccatacgccacgacaccacctacagctacgccgacgaagtctgcaccagcatccagttcctgcgcctgaccccgcagaacagcgagcgccagcacatcctcgaatggcacctggaactgccgcgcctggtgcgcagccaactcgatccctacggcaatatcctgcacgtgctgaccatggacgaaccccatggcgccctggtcctgagcgcctatggccaggtggaaatcgaccaggcccgggaggtggagcacgacagccagtcgccgctgccgttcctgcgcagcagcccactgaccaaggccgacgcggccctcggcgcctttgccgcgcagcactgcggcacccggcgcgaccgcgcggcactgatcgagctgatgcatgccctggccgcgcacatggtctacagcccgggcgcgaccacggtggacaccaccgcggccgaggctttcgccggccgggtcggggtctgccaggaccacacccatgcgttcctggcctgcgcccgcggcctggggattcccgcgcgttatgtctccggttacctgtgcaccgaagacgaaagccacctggccagccacgcctgggcggaggcctggatcgacggcggctggtacagcttcgatgtgaccaaccgcctggcacggcccgagcggcacctgaagctggcggtcggcctcgactaccttgacgcctgcccggtgcgcggcatgcgtcgcggcggtggcgccgagcacatgctggcacaggtccaggtgaactcgatgttccaggtccagcaccagtaaccgcgaccttttccgcaccatcgggcatgccggccccggcatgcccaccccttggggcgtagtagccctgcgtggcccatcatctgtgctctctgtcgtcggactttctcagcgactttcggacttttcctaaagacagtctttcctcccggtccctagcatgcgccgctccgcaggcctgcaacgcagcaagccaggcggggaaaggaaagcaacgttcaagggcaagtcatgaagaaatacaccacggtcttaagcctcttgctggcgatgagcggttgtaccagcagccaccaagacacctccgaggcaaggcttacggagaacgagggctacgtcctttcgaaaggcgaaagggcggtggcgcagaaccatcggatccgtttcctggtcctgcactacaccgcgctcgatcaggcgcagtccttcgaaacgctgacgcgatcggaacacgtcagcgccaactacctgattcccgaccggccgaagacctacaagggcctgccggtggccgaccagttggtcgatgaccacgaccggtcctggcacgcgggagtgagccagtggaagaaccgcagcaacctgaatgacacctcgctcgggatcgagatcgtcaacgctggctgggacaaggacaccggccaattgctgggcgagccctacaacgagcgccagatagaactgctgatcagcctgacccgggacctggtcaggaagtacgacatacagccgacggacatcgtcgggcactcggatatcgcccccgggcgcaagatcgatccggggccgttctttccctggaaacggcttgccgaagccggcattggcgcctggcccgacgagcgcaccctcgacgactacctggctcgcttcagcgtgtcgccgccgagcatggtccaggtcacgaaggcgctgcaaacctatggttatggctatctggaccaacaaccggaaagggtggtggaagccttccagatgcgctttaaccaggagaatgtcagcgggatcgtggatatccgcacggctgccatcctgttttccctgatcgacaaatatcacggcaaggacaaggcgagcgccattctgctgccgccggaagtggcggctctcggctaggggcacaggtttcggcgcccatgaaaaaagcccgccgatcacgcaagtgaaaggcgggctttttgctgtcggggggcgtcaggtcaaaccttgacgatccagccggctggcgcttcgacgtcgccggtctgtacgccggtcagctctttgtagagcttctgggtgatcgggccgacttctttttcgctgtagaacacgtgcagcttgtcctggtactcgatgccgccgatcggcgtgatcaccgcggcggtaccgcaggcgccggcttccttgaagtccgacagcttgtcgatcagcacgtcgccttcgatcacttccaggcccaggcgggtcttggccagttcgatcagcgacaggcgggtgatgcctggcagtaccgacggcgacttcggcgtgacgaatttgttatcaaaggtaatgccgaagaagttggccgaaccgacttcctcgatcttcgagtgggtcagcgggtccaggtagatgcagtcggcgaagtgcttcttcttggcttccgaacctggcatcaggctggcggcgtagttgccaccgaccttggccgcgccggtgccctggggcgccgcgcgatcgtaggtggagatcaggaagttgtgcggggtcaggccgcccttgaagtaggcgccgaccggaatggcgaagatcgagaagatgaactcgggggcggtgcgcacgccgatgttatcacccacaccgatcacgaacgggcgcaggtacagcgcgccgccggtgccgtaaggcgggatgaagcgttcgttggcgcgtaccacttgcttgcacgcttcgacaaactgctcggtggacacctgcggcatcagcaggcgcgcgcagctgcgctgcatgcgggcggcgttctggtccgggcggaacaggttgatcgaaccgtccttgcagcggtaggccttcaggccttcgaagcactgctggccatagtgaagggcggtggagccttcgctgatgtgcagcacgttatcttcggtcagggtgcctgtgtcccactcgccgttccgccagtgcgacagatagcgcttgtctgtcttgatgtagtcaaaacccagcttgtcccaattgatgctttcgttacccatgacaccctctatcgcttaacaaccgtcgcaacggctcaaggcttctgacgttttttggatgggcacaacaatactgcattccgggggggcaccgcatcccgggcgatgggaggggcagcaaaaaaacctggcctgctcatgaaccctcctgtcgtcccgtggagcgccctgtagccgctgccgaaggctgcgatcggcctcgaagaggacgtgctcttgagatccttgaaggccctgcgggccttatcgcagcctgcggcagcggctacagggtgttgcccccggtgtggcgtttacagatgcaaggcgtggcccagggcccgcaatgccgcttcctgcaccgcctcgcccagggtcgggtgggcgtggatggtgccggcgatatcttccaggcgcgcgcccatttccagggactggccgaaggccgtggacagctcggacacgccgacgcccaccgcctgccagccgacaatcaggtgattgtcacggcgtgccaccacccgcacgaaaccgcttttcgattccagggtcatggcgcggccgttggcggcgaacgggaagctcgacacgatgcagtccaggccggcggccttggcctcgtccggggtcttgccgaccaccaccagttccgggtcggtgaagcacaccgcggcaatggccgtcgggttgaattcccggtgctggccggcgatcagctcggcgaccatctcgccctgggccatggcccggtgcgcgagcatcggttcgccggcgaggtcgccgatcgcccagacattgcgcatgctggtctggcaacgctggtcgatgcgcagggccgagccgttcatgtccaggttcagcgccttgaggttccagccctgggtgttcggcttgcgcccgaccgccaccagcacctggtcggtttccagctgcaggctgtcgccgttcgggtcacgcacctgcaggctgtgggttgcagcatcgaaaccttcgacgctgtgcttgaggtagagcttgatccccagttgcttcaccgattcaagcaccggctgggtcagctcggcgtcgtaggccggcaggatgcgctcctgggcctcgaccacgctgacctcggcgccgagcttgcggtaggcgatgcccagttccaggccgatatagccgccgccgaccacgatcaaacgcttgggcagggccttgggcgccagggcttcggtggaggagatgatcggcccgccaagcggcagtatcggtaggttgacgcttttcgagccggtggccagcagcaggtgctcgcactggatgcgggtgtcggcgccttcgatgtccacggtcttgccatcgacgaccttggcccagccatggatcacctggaccttgtgctttttcagcagggcggcgacgccggtggtcaggcggtcgacaatgccatccttccattccacgctcttgccgatgtccagggtcggcgccgagacgttgatgcccagggccgagccctggctgtgatggcgggtctgctggaactgttcggcgacatggatcagcgccttggacgggatgcagccgatgttcaggcaggtgccgcccagcgcctggccttccaccaggatggtcgagatgcccagctggccggcgcggatcgccgccacataaccgccagggccgccgccgatgatcagcaaggtagtgttcagagtctgttgcatgggttactccagaaacaggctggcgggttgttcgagcaggccgcgaatggcctggatgaagagcgccgcgtccatgccgtcgaccacccggtgatcgaaggagctggagaggttcatcatcttgcggaccacgatctggcctttgatcaccatcggccgttcgacgatcttgttcaccccgacgatcgccacttccggcaggttcagcaccggcgtgctgacgatgccacccagggcgccgaggctggtcagggtgatggtcgagccggacagttcgtcgcgggccgccttgccgctgcgcgcggctgtagccaggcgagagatctccgcggcgctgtcccacaggctgcgggcttcggcgtggcgcaccaccggcaccatcaggccgacgtcgctttgcgtggccaccccgacatgcaccgcgccatggcgggtgatgacctgggcttcgtcgtcgtaacgcgcgttgatctgcgggaagtcgcgcagggccacgaccagggcccgcaccaggaacggcaacagggtcagcttgccgcgggtggcgccgtgtttttcattgaggtgcgcgcgcagttcttccacggcggtgacgtcgatttcctcgacataactgaagtgggcggcgcgctgggtggcttcctgcatgcgctgggcgatcttgcggcgcatgccgatcaccgggatctgctcctcgtcgtcacgttgggcatagccggacggcgccgagccgctctgggcgcgctgattgccctgggccaggtaggcgtccaggtcttcgtggaggatgcggccggccgggccgctgccctgcaccaggcgcagctggatgcccaggtccagcgcatgcttgcgcacggccggggaggccagcgggcgctcgtcggcgtcgcgggctaccggcgcctgtggcgcggggcggcaagcggcgggtttgctttcgaccactggcgcggcctcgaccttgggcgctgctaccgcgggtgctgcttctttaatagccgcgggttccttgagcaactgatcggatgccttgaggttgccggcgccttcgacctcgatgctgatcaacacactgcccaccgccatcacttcgccgggctggccgcccagggatagaaccttgccgtgcaccggggaggggatatcgaccatggccttgtcggtcatgacgtcggccagcacctggtcctcgaccaccaggtcgccgaccttgacgtgccactgcgccagttctacttctgcgatgccttcgccgatgtccggcatcttgattacgtgcgtgcccattcagacctccatgacccgttgcaaagccgcgcccactcgggacgggccagggaaatacgcccattcctgcgcgtgcgggtagggggtgtcccaaccggtcacgcgctcgataggcgcttccaggtggtggaagcagtgttcttgcaccagcgacaccagctcggcgccgaacccgcaggtgcgggtggcttcgtggaccaccacgcagcggccggtctttttcaccgacttgacgatggtttccaggtccagcggccacaggctgcgcaggtcgatgacttcggcgtcgatcccggtttcctcggcggccacttgcgagacatacactgtggtgccgtaggtcagcacggtgacgtccttgcccgggcgggcgatggcggcgacgtccagcggcaccttgtagtagccgtccggcacctgggccgaggggtgtttcgaccagggggttaccgggcggtcgtggtggccgtcgaacgggccgttgtacaggcgcttgggctcgaggaagatcaccgggtcatcgttttcgatggaggcgatcagcaggcccttggcgtcgtaggggttggatggcatcacggtgcgcaggccgcagacctgggtgaacatcgcctcgatgctctggctgtgggtctggccgccgtagatgccgccgccgcagggcatgcgcagggtcatgggcgcggtgaactggccggcggagcgataccgcaggcgcgcggcttcggaaatgatctggtccgaggccgggtagacgtagtcggcgaactggatttccgccaccgggcgcaggccgtaggcgcccatgccgacggcgacgccgacgatgccgctttccgagatcggtgcgtcgaacacccgcgaggtgccgtacttggtctgcaggccctcggtgcaacggaacacgccgccgaaataaccgacgtcctggccgaacaccaccacgttgtcgtcacgctctagcatcacatccatggccgagcgcagggcctggatcatggtcatggtggtcgtggtcatggcggtatccaactggatattgttgttgtggtcgttcatgtcagattcccagttgctggcgttggcgcttgaggtgctcgggcatttccttgtacacgtcctcgaacatggtcgcggcgctggggatctgcccgccggcgagggtgccgtactgctcggcctgtttctgcgcggcgatgacttcggcttccagctcggcgctgaccgcggtgtgttcctcttcggaccactggccgatcttgatcaggtgctgcttgaggcgggcgattgggtcgccgagggggaagtggctccagtcgtcggccgggcggtacttggacgggtcgtcggaggtggagtgcgggccggcacggtaggtgacccattcgatcagggtcgggccaaggttgcgccgggcgcgttcggcggcccagcgggacgcggcgtagaccgcgatgaaatcgttgccgtccacccgcagcgaggcgatgccgcaacccacgccgcgtccggcgaaggtggtggcttcaccgccggcgatggcctggaaggtggagatcgcccactggttgttgaccacgttgaggatcaccggcgcgcggtacacatgggcgaaggtcagggcggtgtggaagtccgactcggcggtggcgccgtcgccgatccaggccgaggcgatcttggtatcgcccttgatcgccgaggccatgccccagcccacgccttgcacgaactgggtggccaggttgccggagatggtgaagaaaccggcttctttcaccgagtacatgatcggcagctggcggcccttgagcggatcgcgctcgttggacaacagctggcagatcatgtccaccagcggcacgtcgcgggccatcaggatgctttgctggcggtaggtggggaagcacatatcgtcgatgttcagcgccagggcctgggcgctgccgatggcttcctcgccgaggctctgcatgtagaacgacatcttcttctggcgctgggcgaccaccatgcggttgtcgaaggtccgggtcttgagcatggcgcgcatgccctggcgcaggacctcggccggcacgccttcggcccattcgcccagggcattgccctggtcgtcgagcacgcgaatcaggccacgggccaggtcggcggtgtcggcgggttctacatcgattgggggtttgcgcaccgtgccggcgtcggtcagacgcaggtaggagaagtcggttttgcaaccgggacggcctgagggttcgggcacgtgcaggcgcagcggttcgtacgcttgggtcatggcttgtctacgctcgatcttgtgaatttcttgtagtgggcgcgcttagctgacagtcattctttgggtaaaagaaatcttgtcctacaacaatcataggccgggccaaggagaatatttatctctgtttcgttgcgctcaggatgatttgcagataaaaaatctgcataaacataaaaatcaggttgatttgtctcatgcgcaaactggaccgtaccgacatcggcattctcaacagcctccaggagaacgcccgcatcaccaacgccgacctcgcccgttcggtgaacctttcgcccaccccgtgcttcaaccgcgtacgcgccatggaggagctggggctgatccgcgagcaggtgaccctgctggatgccgacctgctggggctgcacgtcaacgtgttcattcacgtcagcctggagaagcaggtggaagaggcgctgcagcatttcgaagaggccatcgccgaccgcccggaagtcatggagtgttacctgatggccggcgatccggactacctgatccgcgtgctggtgccgaccatccaggccctggagcgcttcatgatggacttcctgaccaaggtccccggcgtggccaatatccgctccagcttcgccctcaagcaggtgcgctacaagaccgcgctgccgctgccggctaatgggttgaccctggggtcttgaggtcctacgggggcttcgttcgctgacggctggcgtggcctgaagtcccgacgcccccggacttgacccttatcaacacggcttgcgcggttccgggccatccttgctgcctctgcaatggaacaggaacaggcccatgacccagcctctgacaacggcgcccgcggccaaggccgtattaccgattggcttgctgatcgctgtgttggccatggtcggggtgctgctcctgccactgcccgccgacctcccggtggtggggcagcggatgctggcgatcctcgcgttcgccgtggtggtgtggatcagcgaggcggtgtcctatgaggccagcgcgatcatgatcaccgcgctgatcgccttcctggtcggcaccgcgccgaccctgcaggacccgacccagctctacggcagctcggcggccatcggcctggccctgaccggtttctccaacccggccctggccctggtcaccggcgccttgtttatcgccgccgccatgacccacaccggcctggaccgacgcatcgccctggtgaccctgacccgggtcggcaccagcacccggcgcatcctcctcggcgccatcgccgtgaccattctcctcagtctgctggtgcccagcgccaccgcgcgcagtgcttgtgtggtgccgatcatgatgggggtgatcgccgcgttcggcgtcgacaagcgctcgaacatcgccgccggcctgatgatcgtggttgcccagggcaccagtatctggaacgtcggcatccagaccgccgccgcgcagaacctgctgaccgtgggcttcatggacaagatgctcggccagcgggtggcctggctcgactggttgatcgccggggcgccctgggcggtgatcatgtccctggtgctgctgtggctggtgctgaaactgctgccgccggaaaccgacagcattgcgggcggcaaggaagcggtggcccggtccctggtggacatcgggcccatgactgctccgcagaagcgcctgctggccgtgtccttgctgttgctcctggcctggtccagcgaaggcaagctacatccgttcgacaccacgaccaccacctacgccggcctggtgatcctgttgctgccacggatcggcatcatgacctggaaggacgtgcaggcgcggattccctggggcacggtgattgtcttcggggttggcatcagtctcggttcggcgttgctcagcacccaggccgggcagtggctgggcgtccaggtggtgacccacaccggcctcgaccaggtcggcccgttggcggtgttcgcgattctcgcggcgttcctgatcctgattcacctggggttcgccagcgccacggcactgacctcggccttgctgccgatcctgatcgccgtgctgcaaaccctgccgggcgagttcagccggctgggcatgaccatgctcctggggtttgtcgtcagctatggctttatcctgccgatcaacgcgccgcagaacatggtctgcctgggcaccgaaaccttcaccgcccgccagttcgccaaggtcgggctgctggtgaccctggtgggctacctgttgatgctggtgttcgccatgacctggtggaaatggctgggctggctctagtccagcctccagggggcgtatggctgcaccagcaccctcgactcacagccagccgctgaacaccggggtcatgctgccggccagccgcaccttgccctggccattccagctgacggtgacggggccgccgtcgcacagcacccggaccgggctgtccagcaggccgcggcggatgccgttgaccgccgcgccacaggagcatgagccggagcccagagggatggcgccgttgcgttcccaaatgcgcaggcgaatggtctggcggtcgatgacctggacgaaatgcacattggtcttctgcgggaacagcggatgcgcctcgatccgcgggccgagtgtcgccacatcgatggcttgcacatcctcgacgaaaaacgtgcagtgcgggttgcccatgctgcacgccgccggctcgccgggcaggggcagggccaggctgtcgagggccgtcgccagcggaatgtcttgccaggcaaattgcgccacgcccatctccaccgctaccgactgatcgtccaggcgcgtgcaatgctggatgccgcgcacggttttcacccgtaccgagtctgcgccgctttcgcgcatcagcaggtcggccgcgccgcgggtggcgctgccgcaggtgctcaggctggaaccatcggcattccagaaagtcagttgcgccgccgtctcggggcaatcgccgagcaccaccagttgattgaaacccacgccgcgatggcgatcgcccagggccctggccagctcgctggtgatcgggttgtcgcgcccgcgggcatcgaccagcatgaagtcgtcgccattggcatgcagcttctgaaaaggcaggggcatggaggtctccgcggctggaacgcaaggggaggttgattctagaggggcaggggcggcgatggtaagcgcgacgtcgcaagaaatgatctgtaggagccagcttgctggcgatacgggtaccgcggccagccaggcacaccgctatcgcgagcacgctcgctcctacaaagacgcctcaggttccggcaaactgccgggcaacccggaacaactctggatcgtccgccactcgggcggacatgggacaagctcacgcaatggcaaggtcaataaatggatagttacgccccgcgcaactggcaaccccacgaaaagcccagcttgcccggctccccctcgacgccgctgcaccccacgcacaagcgcctggcctatgccctggtcggtttgctggtggcgatcaccggcggcctcggcaactccctggtgatcgccaacctgccgtatctgcaaggcgccctgggcgcgaccaccgcggaaatggcctggctgccggccgcctacgtgatgaccaacgtgtcgatgaacctgctgctggtgaagtttcgccagcagttcggcctgcgcgcctttaccgaggtgttcctggtgctctatgcgctggtgaccttcggccacctgttcgtcaacgacctgagttcggccatcgccgtgcgcgcggcccacggcatggtcggcgcggccctgagttccctgggcctgtactacatggtccaggcattcccggccaagtggcggatgaaagccctggtgctcgggctgggcgcctcgcaactggccttgcccctggcccggctgttttccgaagacctgctgcagatcgccgaatggcgcggcctgtacctgttcgaactggggctggcgctggcgtccctgggctgcgtgttcctgctcaagctgccgcccggcgaccgtttccgcaccttcgaaaagctcgacttcctgaccttcgccatcctcgccagcggcgtcgcgctgctctgcgcggtgctgtccctggggcgcatcgactggtggctggaggcgccgtggatcggctacgcgagcgccggttcgatcgtgctgattctcgccggcctggccattgaacataaccgcagcaacccgatgctgatgacccgctggctgggcagtggggcggcgatccgcctggccctggcggtgatcctgatccgcatggtgctgtccgagcagtccaccggcgccgtgggttttctccaggcgctgaacatgagcagccagcaaatgcgcctgctgtacggggtgatgctgctgggcagcatcgcgggcctggccaccagtgccctgaccatcaacccggcgcacctgctgatgccgctggtcatctccctggcgctgatggccgtgggctcggtgatggacagcttctccagtaacctcacgcgcccggccaacatgtatttcagccagttcctgctggccttcggcggcaccttctttcttggtccgaccatggtcctgggcacgcgcaacgtgctgaccaacccgcgcaacctggtgagtttctcggtgctgttcggcatctgccagaacctcggcgggctgatcggctcggcgctgctggggaccttccagatcgtccgcgagaaataccattccagccatatcgtcgagcaactggtgctgatggacccgcgggtgctgggccgggtgcagagcggcggggcggccgtcggccgggttatcgccgacccgcaggcgcgcgagctgcaaggcatccgcagcctggccagcgccgccacccgcgaagccaacgtactggcctacaacgatgtgttcatgctgatcgcggtgattgccgtgctgaccatgatctggatcttcattcgcagcctgtggctgatgagcacgaccaaggcggtcgcgccagccaccccagccccgactcccgtccaacccagcggtgccatttcttcatgaccgaaccgaccatcaccaccaacgccatagcctcgaccccggaaggcagcacgccgccctcgatgccgatcaccgagccgcgttcgctgcgggtgcggatcatctcgtccctggggttcgccgcgatcgccatcaccggcgtattgatcgtgctctatgcctggcagctgccgccgttcagcagccccatcgaaagcaccgagaacgccctggtgcgcggccaggtgacgatcatcgggccgcagctcagcggctatgtgttcgaggtgccggtgcaggacttccagttcgtcaaggccggcgacctgctggtgcgcctcgacgaccgtatctacaagcagcgcctggagcagtccctggcccagctggcggcgcagaaggcggcgctggccaatgtggtgcagcaacgtaacagcgccgaagccaccatcaagctgcgccaggcggcgctggccgacagccaggcccaggcgcgcaagagcgccgccgacctgcgccgtaaccaggaactgatcgccgacggttcggtgtcccagcgggacctggatgtgacccgtgccgccaacgcccagaccctcgccgcggtggcccaggcccaggcgcagctggacatcgcccgccaggacctgcagacggtgatcgtcaatcgcggctcgctggaggccgcggtggccaatgccgaggcggcggtgcagctggcgcggatcgacctgtccaacacccgggtcaccgcgccgcgcgacggccagctggggcagatcggtgtgcgcctgggggcctacgtcaattccggtgcgcagctgatggcgctggtgccgaaccagctctgggtgatcgccaacatgaaggaaacccagatggacaacatccgcgtcggccagcccgcaagcttcaccgtcgacgcgctcaaccaccgcaaattccacggccatgtgcagcgcatttcgccggccaccggttcggagttcgccttgttgcaggccgacaacgccaccggcaacttcgtcaagattgcccagcggataccggtgcgcatcactgtcgatcccgaccaggcagaaagcgaacgcctgcgtccggggatgtcggtggtggtgagtatcgatacggcggcggagggcgacgcccacatcgagtgatgtgcatcccttgtaggagcgagcttgctcgcgaaaaaaactttacggcgacacgttcacacagggcaatcgccgcttcgcggctatcgcgagcaagctcgctcctacaagggggcgggatgtcaggcggtgagaggcggcaaggtgccgagcagcgacacggccgccaccgcggcgatgcccagcagccattccagcagcacgctgcggcgcagggtgcccaggcgttgctggcagtcctcgatccgcaggcggttgaacagggccagggcgaacatgccgcacaccagcagcaccttgatcagcaggatcagagcaaagccggacagcggcggtgtcggccacaactggccggtcagcacccgcacattgatcagcccgctgaggctcagcccggccaccagcccgtaaccgaccccactgaaacgccgcagcagttggcccagcggcaggccgtcgggctggcgcagaaccatcagcagcaccagcaaaccgcccagccacaggctgacgcagcccaggtggacgatctggttgaggatcagcaactggccgctgaggccgtcgagcatggcgccgtggcccaccggagccagggtggccagcagcagggcggcgaggatcagccgcagcgccagccgctcacccaggcgagtcagcagcagaaccagcagcgcgccattgagcagcagatgccagctccatacctggccgaaaaaagtcttgcccaataccagtcgcaaggtcgccgggtccagggccgcggcgccgctgccagccatgctggcggtgatcagcagcaaccagcagatgccggtggccagggcgattccggccagccagcggccgagtcgcgtcaggcggcgatccaaagcggcaacgggctcgcgccccaacagcaggggcctgaacacccaggccccgaacagcagcaggactgctgcgaaatgcacgaagcggcagagcaccaacagggtcgacatcggttactggccgaccttgaagctgtagctgccttcgctcttgtgggtatccaccgacaccgcgtgccactcgaccttgtaggcgcccgccgccagcggcgccggggtcacgaccagggtcttcttgtccgcgccttcggtggccagggccttgatggcgaccgctgcgccatccttgctcaggctgactttagtgaaggccgcctcgacgccttcggagaacaccaggcgcaactcgctcggcgcactcaccgtgctgtcggcggccgggacctggctttgcaggtgggcgtgggcgaaggccgaggaggcggcggcgagagaggccagcagggcgctggtggtcagcagttttttcagcatgggaaatacctgttcaatgagtggcgggtagtcgatgcgccgatgagtataaggaccgcggcagggtcgctggatgaaacatcggcgcggttttcaagcgcttttcaggcgcatatggatgattgggaacggccggccctggccgtcggttgccgagcggccgatgtcttcgaaaccgtagtgccgataaaaaccatgggcctgggggttctgttcgttgacgtcgacgctgagccgcggataccggctgcgtacatggtccagcagttgccggccgacgccctggccacggcgggtcggttcgataaacagcatttccaccttgtcgccggcggtggcgataaagccggccggggtgccgtcgggatcctccagcaaccaggcttcgagggccggtaggtaggtgtcgcgcaccagggggtagagcagctggatgtcgtcttcggcgataaagtcgtgggtggcccgtaccgagcgttcccacagggcggcgagttgcggatcgtccgtggcccggcgtttgcgaatgttcatggataagctccatagcggcgttgcaggatggccgaaacgctttgggttcggcggcgaaagtcctgcctgcatgtccgtgtcgcgaatcaacgcctggacggaacacttcaggtgcccggaaataaggcgggagggatcctaaccaatcggttttgccggggaaagccgggcgcaggaagtttcgtttttgtacgaaggccgatggtagtcttgcagcagactgttttcagggagcccttatgggcaatcacaagatcgagatccgtcgcagcaacgtcgaaaaaatcctcttggcggcggaaaaggtgttcgccgaaaaaggcttcagcggcacggccatggccgatatcgccgccgaggtgcaattgccgcgctccaacctgcattactacttcagcaccaagagcgagctgtacagcgcggtgctgctggagctgctggagctgtggaagcaggacgcgctgtgcttcgagatgttcgatgacccgcgggtggtgctcagcagttatatccgcgccaagatgaaccattcgcgcagccggccctatggctcgaaagtctgggccaacgaaatcatccacggtgcgccgaccctgggcgaggcgctggacgccagcctgtacgactgggcgaagatgaaggaagcgaagatccgccagtgggtcgaagaccagcgcatcctgccggtggaaccctcgagcctgctgtacatgatctgggcctcgacccagcactacgccgacttcgaccaccagatcatgatcatcaacgaacaccagccgctgtcggacatgcagttcgaaaaggccgtgcagacggtgaccagcgtgatcctgcgtgggatcgggctggagccctgatacgacgcccccctgagcgttggcgtgtagccgctgccgagcgcagcgaggctgcgaacggtcgcgaagcggccgcaacccggataacgcgcaagacctgacacaccgcggattcaggttttgcggcaactgcgttgccgatcgcagcctcgcaggctcggcagcggctacaggcaggtgtcaacgtttacctccatcgcgggcaagcctcgctcctacaggaccagaccaaccctgtaggagcgagcttgctcgcgatgacgtcagtccagccaatgctattttccccggcgaacctcacaccgcctcgcgatacggattgcgtggatcgtgctgccagtcgaggaacggcttgccggtgtcctggggcaccatctcgatgcagtcctgcaccgggcaggtgatctggcacaggttgcagcccacgcattcggcgtcgatcacttcgtatttatgcgtgccgtcggcctgcttgaggctggcaatggcctggtgcgaggtgtcttcgcaggcgatatggcagcggccgcagccgatgcaggcgtcctggtcgatcttggcgatcacctggtagttgatatccaggtacttccagtcggtggtgttgcccaccgcgcgcccggagaagtcctgcaggctgtgataaccctggctgtccatccaccgcgacaggccgtccttcatctcctcgacaatgcggaaaccatgcagcatcgccgccgtgcacacctgcaccgcgccgcagcccagggcgacgaattccgcggcgtcgcgccaggtgccgatgccgccgataccgcagatcggcaggccgtgggtctgcgggtcacgggcgatctcggcgaccatgttcagggcaatcggcttgaccgccgagccgcagtagccgccgtgggtgctctggctgccgaccatcgggttggccaccatgcgctcaagatccacgctggtgatcgagttgatggtgttgatcagcgacaccgcgtcggcgccgccgcgatgggccgcgcgggcggccatgcggatatcggtgatgttcggcgtcagcttgacgatcaccggcagcgagcaataagtcttgcaccagcgggtgacctgttccacgtactccggcacctggccgaccgccgcgcccatgccgcgttccggcatgccgtgggggcagccgaagttcagttcgatgccgtcggcgccggtggcttccaccagcggcaggatgtttttccatgactcctcgacgcagggcaccatcagcgacacgatcagtgcgcggtccggccagtccttcttgacctgggtgatttccctgaggttgatctccagggaacggtcggtgatcagttcgatattgttgatgcccagcacttcgcggttggcgccgaagtgcgccgagtagcgtgacgacacgttgaccgccgccgggtcctcgcccagggttttccagaccacgccaccccagccggcctcgaaggcgcggaccacgttgtaggccttgtcggtcggcggcgcggaggccagccagaacgggttgggggctttgataccggcgaacacaatcgacagatcggccatttacgcagcctccacgttgagcatgagttgggcatgcatggcttcggcggcccgcttgccgtgttgcaccgcctggacggtgaggtcttggccgaggctgacgcagtcgccgccggcatacaccccggggatgctggtgcgcagctgttcgtcgacttcgatgcgctcgccggcgcgcttgagctcgcgggccagcgggtcgctcagcgcggcaccgtcgaacgcctggccgatggccttgaagatcgcatcggcggccagctcgaaagtttccccggtggtttgcaggcggccctccaccagccgggtgcgggcgaagcgcatgccgcgcacccggccctgggcgtcgagcagcacctcttcgggcgcggcccaggtcagcaggcgcacctgattggccttggcgatgtcctgttcatggcgagtcgcgcccatgtcctcgatgccgcggcggtacaccaggttgacatcgtgggcgccgaggcgggccatctgcaccgccatgtcgatcgcggtgttgccggcgccgaggacgatgcagcggtcggccaggggcagtcgggtgaggtcgtcggcctggcgcagttcgcggatgtagtcggtggcggccagcaggccgggggcgtcctcatggggcaggcccagctgtttgctggcggccaggccgaggccgaggaacaccgcgtcgaattgctggtgcagctcggtgaggctcaggttgtcgccgagtctgtgcccgtggcggatttcgatgccgccgatctgcagcaggaaatccagctccttctgggcgaagtcgtccaccagcttgtacttggcgatcccgtattcgttgaggccgccggcttttttccgggcctcgaaaatcaccacctcatggccgtgcatggcgcagcggtgagcgcacgacagccccgccggcccggcgccgaccacggcgatgcgcttgccgctggcggcggcgcgctggaacgggtgctggctgaagtgcgcgttgtccaccgcgtagcgctgcaacaggccgatcagcaccggcgcgcactcctgggcgttgttacgcacgcaggcctgctggcacaggatctccgtcgggcacacccgggcgcagctgccgccgaggatattggccgagagaatcttctgcgccgcgccctggacgttgtcggtgtggatatggcggatgaacgagggaatgtcgatctcgctgggacaggcgttgacgcacggcgcgtcgtagcaatacaggcagcgcgaggcttccaggtgcgcctggcggtcgttgagcggcggcgccaggtcgctgaagtggccggcgagggtggcgccatcctcctggggatggggcaagtggttcagggtcttgatcacggttcaggcctcacggttttttgtcgattgcctctgacgggcattgttcttcaccagcgggacggacccccgctggattcgctgcaacgcttcctgtagccgctgccgagcgcagcgaggctgcgatcggcaacgcagttgccgcaaaacctgaattcgcggtgtgtcaggttttgcgtgttatccgggttgcggccgcttcgcgaccgatcgcagcctcgctgcgctcggcagcggctacggggatcgcgggtcgccgggctcagcgtttgacggcggtcggtttatgcaactcggcgcgcttgctcagcaggtcgaacaccgccgggtaggccgggcgctcgatgtagcggccggcaccgcgttcggcgcgcaggtcgccgtcggcccagaccagcttgccctggctgatggtgtggctgggcacgccgcgcacggtcttgccttcgaagatgttgaagtccacctgctggtggtgggtcgcagcggagatggtgcggctgccttgcggatcccagagcaccaggtcggcatcggcgccgacgcggatcgcgcccttgcgcgggtagaggttgaagatcttcgcggcgttggtggaggtcagggcgacgaagtcctgcatcgacaggcgaccgctgttcaccccttcgtcccagagcacggccatgcggtcttcgatgccggcggtgccgttggggatcttgctgaaatcgtcgcggccggcggctttctgttcggcgcagaaacagcagtggtcggtggcggtggtgtgcaggttgcccgattgcaggccgtgccacagcgcgtcctgatggccgcgagggcggaagggcgggctcatcacatagccggcggcggtctgccagtccgggtggcggtacacgctgtcgtccagcagcaggtgcccggccagcacttcgccgtacaccggctggcccttgccgcgggcgtaggtgatttcgtccatggcctcctgggtcgagacatgcaccagatacagcggcgtgcccagggtttcggcaatgcggatcgcccggctggcggcttcgccttcgacctgggaagggcgcgacagcgggtgcgcttccggcccggtgatgccctgggccagcagcttgcgttgcaggtgatagaccagctcgccgttctccgcgtgcaccgtcggcaccgcgccgagttccaggcaacgctcgaagctcgccaccagggtgtcgtcggcggccatgatcgcgttcttgtaggccatgaaatgcttgaagctgttgattccgtgctggttcaccagctcggccatctcctcgcgcacctgctcgctccaccaagtgatggcgacgtggaagccatagtccgaagctgacttctcggcccagccgcgccactggtgaaaggcttccagcagggactgctgcgggttgggaatcacgaaatcgatgatcgaggtggtgccaccggccaggcccgccgcggtgccgctgaagaagtcttcgctggccacggtgcccatgaagggcagttgcatatgggtgtggggatcgatgccgccgggcatcaggtattggccactgccatcgagcacttcgcagctggtatccagatggttatccagattctggccgatggccttgatcacgccgtcggcgcacaacacatcggctttataactttcatcatgggtaataacggtggcgccacggatcaacagagacattccgagttcctcgcaggcatgaccggcttatgccggttctagtgtttttgtaatacgcatgctgcggaatgtttattcctgtcagcgatgtcaggaataaaaactagctggtgttcaatcaatcggcaagattattttttataagcatatatctaagctaagttattgaaatgtaagggtttaaatcgtaaatccgcaaaatggtgcagcctttcaccattttgacgcacttgacaggatcgaaatatgagcaagatttcctatgtgaaatcagccgcttgaaggaggcctgtggcccatacaaaagtttgaaaaaagtttgcgtgcaccagattgagtcctgacctgatgggcaacttgcccggcattcggcctgagtgaaccggcaagttatccagagcaggaagttgttcagaataaaactgaagaaacatcagttgtttacatggattttaccgactgtggagcaccgtcgacgggcaagccggcacgcttattgagtgccgccgtcgacaggatggccggtcggtaaaagtcgtcagttctccggccatcgccgggctggcagcacgtctgccggcccgcctgatgagcaaaaataatcagaaaaaagtggagcggccatgcaacagaacagatcccaagtgaccgagcgtgccggcctgtatgagctggacgccggcagcgacgtgctcgacagcccccgttacaaccacgatatcgcgccgaccaaggtccatgagcgcacttggaacaaatggcacatcaccgcgctgtgggtcggcatgtcgatctgcgtgccgacctacaccctgggcggtgtgctcaccgcctatttcgggctgacggtgggcgaggcgctgctggcgatcctgctggccaatatcgtggtgctggtccccctgaccctcaacgcctttgccggcaccaagtacggcattccattcccggtgctgctgcgttcgtccttcggcgtcatcggctctaatgtgccgtgcctgatccgcgccctggtggcctgcggctggttcggcatccagacgatgttcggcggcctggcgatccacctgttcctcggctcgatcttcgagggctggaaggccctgggcggcaccggcgaggtgatcggcttcatgatcttctggaccctcaacctgtgggtggtgctgcgcggcgccgagtcgatcaagtggctggaaaccctgtcggcgccgctgctggtggcggtgggtgtcgggctgctggtgtgggccttgcccaatgtgtctctgagcgagttgctggcgattccgcccaagcgtccggaaggcgccagtgtctacagctacttcttcgccgggctcacggcgatggtcgggttctgggccaccctgtcgctgaatatcccggacttcagccgctacgcgaaaagccagaaggaccagatcctcgggcagatcttcggcctgccgctgaccatgttcctgttcgccgcgctgggggtggtgatgaccgccgcctcggtgaaactggtgggcgtgaccgtctccgacccggtgagcctgatcggccatatccagagccccggctgggtggccctggccatggcactgatcatcatcgccacgctctcgaccaataccgcggcgaacatcgtctcgccgaccaacgacttccagaacatcgcccccaagctgatcggccgcaccaaggcggtgatcctcaccgggctcgtcggcctggcgctgatggcccatgagctgctgaaaaaactcggcctgctggtctcggacgtgagcctggagaccgtgtattccaactggctgctgggttactccagcctgctggggcccatcgccgggatcatggtggtggactatttcatcatcaagaagcagcgcctggacctggccgggctgtaccgcgatgacgtctacccggcgtggaacggctacggctttatcgcctttggcgtgccggtggcgctgaccttgctgtccctgggcagcgatgtattcagctggttctacagctacggctggttcaccggctcagccctgggcggcttgctctactacgggctgtgcagcatggggcgcccgcagagcgtgaccgtcaagacgccggtatgacctttgaatggcgttatggcggccggcctgttcccctgtaggagcgagcttgctcgcgaaaaacgtgcaaacaacgcggtctatctggcgaatcgcgttatggctactggccaatcgcgagcaagctcgctcctacaggggggcgatccatcgaacaccgtaagactccagacgagcgcgcaacctcgtcaacgacaaccagaaaagcctgaggagatcaccatgaacgctgccgtcgacgttctgcaatccagccaccggcacatcaaccgcgaccgcctgtggcagtcgctcatggagctggcgaaactcggggccacggtcaagggcggggtctgtcgcctggccctgaccgacctcgaccgccaggcccgcgatctgttcgtgcagtggtgcgaggcggccggctgcacggtcacggtggatggcatcggcaatatcttcgcccgccgtcccgggcgtaacccgcagctgccgccggtgatgaccggcagccatatcgacacccagcccaccggcggcaagttcgacggctgcttcggcgtgctggccgggctcgaagtgctgcgtaccctcaacgacctcggggtggaaaccgaggcgccgctggaagtggtggtgtggaccaacgaagaaggctcgcgcttcccgccgtgcatgatgggctccggggtgttcgccgagaaattcaccctcgaggaaaccctggccaagaccgatgccgaaggcgtgagcgttggcgatgcgctgaacgccatcggctatgccggcagccgccaggtcagcgggcacgcggtgggggcctacttcgaagcccatatcgagcaggggccgatcctcgaggacgaaaagaaaaccataggcgtggtgctcggcgccctcggccagaagtggttcgacctgaagttgcgcggcgtcgaagcccacgccggcccgaccccgatgcacctgcgcaaggacgccctggtcggcgcggcggcggtggtggccgcggtcaaccgcgccgcccttggccatcaaccccatgcctgcggcaccgtgggttgcctgcaggcctatcccggttcgcgcaacgtgatccccggtgaggtgcgcatgaccctggacttccggcacctggaaccggcgcgcctggactcgatgatcgccgaggtgcgccaggtgatcgacagcacctgcgaagaacatggcctgagctacgaaatgctgccgaccgcggactttccgccgttgtatttcgacaagatctgcgtcgacgcggtgcgcgaggcggcgcaggggctgggcctgtcccatatggacatcgtcagcggcgccgggcacgacgcgatctttgtcgccgagctgggccctgcggggatgatcttcgtgccttgcgaaggcggcatcagccacaacgaaatcgaaaacgccgaccccgacgacctcgccgccggctgcgcggtgttgctgcgggcgatgctggcggcgtcccaggccgtcgccaaaggacagcgggtggcctgaggacatgcgcctgtagccgctgccgagcccgcgaggctgcgataaggccgaaggccttcagcggtcttgagatccccgcgccccctgcggggtcgatcgcagcctcgcgggctcggcagcggctacagggcgatgggtgatcggccatcgcatgcagcttgggatcgtccagccgaacctaagctaatgcttaaaaagtatttatatttgaattcttagatcgattagcttttagcgactttcctgtctcccagaaggtccgcccccatgcgcctgccctttgctttgcgtcgtagcttgtcgatcaccgccctggccggtctggcgctgggcatggccttcgatgcccaggccgctagcgacctgcgcatcggctaccagaaatcctcgaccctgctggcggtgctcaaggcccagggcaccctggaaaaacaactggcggggcagggcgtgaagatctcctggcatgaattcaccagcggcctgcccctggcggaatcgctgaacgtgggcaacgtcgacatcagcgccgatgtcgccgacaccgtgccggtgttcgcccaggccgccggggcccagctgacctacttcgccacggaaaccccgtcgcctgcggcccagtccatcgtcattcccaaggactccacgctcaagtccctggccgacctcaagggcaagcgtgtcgccgtgaccaaggccgccggcagccattacctgctgatcgccgcgttgcgcgaagccggcctgggtttcgccgatatccagccggtgtacctgaccccggccgatggtcgcgccgccctggaaaccgccaaggtcgatgcctgggtcacctgggaacccttcgtcgccagcgcccagcgccagcagggcgcgcgggtgctgcacgacggccagggcctggccagctaccggcgttattacctggcctccaacgattacgccaaggcccaccccgaggtgctgaaccaagtgttcgccgagctgcagaagaccggcacctgggtcaaggcgcacccgacggaggcggcaaaactgctcggcccgctgtggggcaacctggacgtgagcacggtggaactggccaacagtcgccgcacctacaaggtggaagcggtgcagccggaggccctgggcgagcagcagaaaatcgccgatgccttctaccaggaaaaactcctgcccaagccggtggatgcccgcgcggtgcagctgtggagccccaagcatttgtaactgagccttggctcgcctgtgtcggcgagcccatttcccggggtagccggctgaccggacccagccatttttcttctttatcactgccgatgacgcggttgcgcgtccggcatcaggagtgcccgtgtctgtcgtttatccccaagaggcctttgccgtcccagcctcgtccgcccggcaaccggccagcgccgaggtggtgctggagctgcgcaacctgaccaagggctacggccgcggctcgtccgcgccggcggtggagcaggtcagcctcagcgtgcgccgtggcgaagtgctgtgcctgatgggcacctccggcagcggcaagtccaccttgctgcggcacatcaaccggctgatcgaacccagcagcggcgaggtgctgatcgacggcgcggcgatcagccagctttcggccaaggacctgcgcaccctgcgttcgcggcgcatcggcatggtcttccagcacttcggcctgttgccccatcgcagcgtgcgcgacaacgtcgccttgcccctggaactgcgcggcgaacccgaggcccagcgccacgccgcggccgatgtgcagctgcgggccatgggcctggagggctggggcgagcactatccccatgagctgtccggtggcatgcagcagcgggtcggcctggcccgggcgctggtcagcgaaccggacatcctgctgatggacgaacccttcagcgcgctggacccgaccatccgccgcgacctgcaacgccacttcctgcgcctggtgcgcgagcgcggcatcaccaccttgctggtgacccacgacccggcggaagccctgcgcctggccgaccgcatcgcggtgctgcgccagggccagctgatccagctcggcacgcccggcgagttgctggagcagccggcggacgccgaggtggcggacttctttcaggagcacggcgcgcgcagcgacacgctggccgcggcgcccgtcgcttcggctaaaacaacaaccgctccggcgcccgtggccccggggttttccttctggcaggcgctgttgctggggccggcggccttggccgccagcggccgtggcgcgctgtattggttgggttttgccctggagttggcggcggccagtgccctgggccaatggttggccagcgccagcctcggttgggctgggttggcggtgctcggcctgttgctcagccgcctgctcagcgtgaccctggcccgtcgcccgagccgccagggccgttccgactggcgcctgccgtggctggtcctgctgctgtgccagggcctggtgttgtggcgggtgctggcggtggatgccagcggcccctggctgcaatttcccgccgaccgccaggcgctgctgggtaccgcggcggccatcgaccagttgatcggttggtcccaggtcaccttcgaaagcacctttgtcggcgtgatagtcgccgtgcgcacggtgatcgaaagcatcgaaagcctgctgggctggctgccctggccggtgccggcgctggccctggtgctgctggcctggcgcagtgccggcgcggcgctggccctgaccagcgcggcggccttgctctatatcggcctgttcggtttctgggagcggaccatcgccaccctggcgctggtgggttcctcggtgctgctgtcgctgctgatcggcgtgcccgccggcatcctcctggccaagcgcgccctggcgcggcgcctgatcacgcccttgctggacgtgatgcagaccctgccgaccttcgtgtacctgatcccggcggtcgccttcttctcggtgggcaagaccccggcggtgatcgccacggtgatcttcgccctggcgccgatgatccgcctcactgccttagggattcaggaagtgcccaagaccgccgtcgaagcggccctggcccatggcgccacgccgtggcagatcctgaccaaggtcgagctgcccctggccgccggctcgctgctgctggggatcaaccagaccctggtgatgagcctgtcgatggtggtggtcgcggcgctgatcggcgccggcggcctgggctacgacgtgatgaccgcgctgcgcaatatcaagggcggcgagggcatgttggccggcgcggcgatcgtgttctgcgcgttgattcccgaccgcatcattcaagcgaccctgcgccagcgggatcgcgctttccatcagcaatgaggtgtctcttgaacaagtcgttttcccgcaccctgggcgctgccgcgctgctcctggggctggctctgccagccctggccaaggacaagatcgtcatcggcgaacagaactggaccggcgccatcgccatccagaacatcctcggcgaggtgatcaaaagccgcctcgacggcgacgtgtcttacctagccggtgacataccggtgctgttcgccgccgcggccaagggcgacggctcggtggatgtgctgaccgatatctggctgcctaatcaatccgccgcctgggccaagtacgtcaccggcggcacccgctccctggtgccgaacaagcagccgtacctgggggtgcagggcttctatatccccggctacctgcaagaccaatacggcgtgaagtcggtctacgacctgcagaagcccgaagtggccaagctcttcgagcccctgggcggcggcaaggcgcaattgctggtgggcccggcgggttgggagtcgacctatatcggccagatcaaagccaaggacttcggctttgccgacaaattcgaatcggtgtccaccgaagcctcggtgacctacgccaagctcgccgcggcctacaaggcccagcgcggcgtggtgttctacgcctacaccccggactggatcttctccgccttcgacctgcgccgcctggacgaaccggcgttcgacggctacgcccaggacaacaagaagggcgacccgctgtacaaggccgacggctgctggaaattcatcagcccgacggtagacgccgactggctgaacaagagcaagatcacctgcgcctatccggacgcccgggtctatgtcctggcctccagcgccttgcagaaacgcgcgccacggatcgccgccttcctggaaaacttcagcatcgacccgcaggtgttgaacgacctgatcctcaggatcgagaaggaacaacagccggcggcggaagcggccaaagcctgggtccaggccaacccggcgatcgtcgatcaatggctgggcgccagcggcgagaaagtcggagcggtgcagtgagcgaggcgcgtcggaacatgagcgggatcaaacaggccaccttcggcgcgggctgtttctggggcgcggaagccgcgttccgggcactgccgggggtggtggagacacgggtgggctacgccgtggaggcgggcgatgagtcgttgcggatcgaggtggtgcaggtggatttcgatccgcgggtgttggcttattcgagcctgatcgagcacttctgggggctgcatgatccgacttcggtggatcggcagggggagcatggtggggggaaatatcgctcggcgatcttccacaccagcgccctacaggccgaacaggcacggcaggccaagacggccctgcaagactccggccgcctcaacaaacccgtggccacggtgatcgtgcccctgggtcggtttgaactggcggatgaagcgcaccagcgctacctggaaaagaatggcttgagcagttgccatatctgaggggttggccgcaggcggtttgctctcgctgcaggtcggcttctgtaggagcagccggtcgacgctcgattgctcgcgatggtgtcggctctggcactggactttttggacggggtacatatccgttcctgcggtaacggcggcttagggttccgcccttacggcgggtcactttggaagagcgccaaagtaaccaaaacgctttgccccaccattcggtgcctcgctaatgctcggcatgccctcactccggtcctgctccgggggccgccgcaatgggccatccctggcccagtgcggctacctcggcatccctgccgaggtgccccctgcgcaagacctgcgttcggcctctgggaaaaggggcgggtagatcaagagcaagatcaaaagccaaagccaaaacagagccaaagccaagccaaagcttgctgccttcgccacgctacaactcttctgcctgacacgctttgtgtagccgctgccgagcgcagcgaggctgcgatcggcccgcagggccgctaaacctgacgcctcgcaggatctggggcaacgcggtgtccgcctggcgagtccttcggcctcgatcgcagcctcgctgcgctcggcagcggctacagagaccgcattcccagccaggccggccggtaggccgcctcgcgttgtttttgatggtttgccccatcgggaggccgagtggaggttctgcgcagtgggcaactcggcagggatgccgagttagccgccccaggccatggatggcctgtggcggcggcccacggagcaggaccggagcgagggaatccgagccttagcgaggaccggacgccaggggcagggcgttttggttactttggcgcctttccaaagtgacccgccgtaagggcggaaccctaagtggccgtaaccacagaaacggatatgtacacaggagcatcgagctttctatagccctgcctctggcgtcaggctccagctttccaccccccacccaacgccaccatcaaccccacactcgcctgcaaccgccgcgtctgcagcgcctgcaacccccgctgcgcctgcaacgccgcggtctgggccgtcaccacctccagataactcaccgcccccgcctgataactgttcatcgccagggcctgcgtatgctcggcggcattcaccgccgcctgctggtccagcgcctcctgttgcaagtctcgcaactgccccaggttgtcctccacctcacgcaccgcccgcagcacctggccgcggtaatgggcggcggcttcctcgaattcggcgtgggcctggcgttcgttggcgctcaggcggccgccgtcgaagatcggcaggttgaccagaggccccagcgcccagtagcgattgcccgccgccagcaggttgccgctgccctgggtctgcccgccgagcaggccggtgaggctgaagtccgggtaccaggcggcccgggccacgccgatattggcgttggcggcgaacacccggcgttcggccgcggcgatgtccgggcggcgttgcagcagggcgctgggcagttgttgcggcacgctgggcacggccagggtctgctgggtggcgggcagctggaactggctggccggttcgcccactagttcgccgatcgcgtgttcggtgaggttgcgttgcccgcgcacttcgtccagttcggcctcggcgctggccagctggttttgcgcgcgggtcaggtccagctccgaggcgatctgcccctggtagcggctgcgggtcagttgcagggcctgggcgtaatcgtccagggactggctgaggatcgcgcgctgcgcatccaggccattgagctgcacatacaggctcgccaactgctgttgcaggctcaggcgcgccaccgccaggtcgtcggccgaggcttcggcctgggcatcgccggcggccacctggttacgaatccgcccccacaggtccgggtcgaagctcagcgagaaaccggcgctgttgctgttgtagaccgaaggctggctgccgccgcgcaacggccggtggtccgactggcgctggcgcagcgactggccgctggcgctgatctgcgggaacagcccggcatgcagctggctggcataggcctgggccgcgtcgaagtgcgccagtgccgccgcgaggtccgggttggccttgagcaggcattgttgcaggtcatccaggcgcgggtcctggtacagccgccaccactggctggccagctgatccgccggtcgggccggatgccaggggccgtcgctggtctgttcgcggtagtgggccggcagttccactggcggcacctgatagccgggcgccagggaacagccttgcagggccagcaccagcaacaccgcaagcggctcaagccttgggcgcatgttcacctccggcgtcggccagttgcaccaggtcgccttcgcgcagggcatcgggcgggttgtcgatcacccggtcggcggcttgcaggccctggtcgatcaccagccgcgcgccgaggtcgaggccgatatggatgtcccgcaggtgcacgtggttgtgctcgtccagcagcgccacctgggtgccctgggcgcggaagatcaaggcgctggccgggatgctcacgccccgggtgtcggcgggcagggccagggcggcctcggcatagtcgccgggcagcagcgcgccgtcggggttgtcggcgacgaactgggcgagcagggtgccggagcgctgatcgatggcggtggagtcgccgatcagccgcgcgctgaagtgctggccggggtgctccggcaccgtcagctcggcgctgaggccggggcggatcacgctggcgtagttctgcggcaccggcacgtagagccgcagcttgcgggtgtcggccagatcaaacagctgcggatcgctgtcgttgtcggccttgatcaactggccgatatcggtgtggcgcgcggtgatggtgccggcgaagggcgcgcggatggtcttgtagtcctccagggccgagagccgcgcgtaatcggcagcggctgcttcggcattggccttggcggccgcggcgttggaggttttttcatcggcctcctggcgcgacaccgagtggctggccagcaggttctgccagcgcacggcggtggtctgcgccaggcgtgcattggcctgttcctgcaccagccgggcatgggcctgggccagttgctggtcgaggtcggggctgtcgatttcggcgaggacttgcccggcctgaaccttggcgcctatgtcgctgttccagcttttcaggtagccgctgacccgggcgtggatcggcgccttgctccaggcttccaggtgcgccggcaggcgcagggtgtcgccctggcggttctgctgcggctggaacaccagcacctgaggcacggcggcggtttcggtccaggcggccaccgcgcgttcatggcgggtgcgcgcggccaggccgttggccaccagcagggcggccagggtcaggccgccgatgccgagccacagcaggcgtttgcgcgagggggtgtgttcaggcgacatgggtactttctccagcgacagcgcgagtggggtgacgcccgtggaccaggctgaacaccacgggaacgaacaacagggtggcggtggtggcgaggatcaggccgccgatcacggcgcggcccaggggcgcgttctgctcctcggacagggccaggggcagcatgccgatgatcatcgccagggcggtcatgcacaccgggcgaaagcgcgtatagccggcctccagcgcggccctcagggcatcgccgtgttccgccaggcgttcgcggcagaagctcaccaccaggatcgagttggccgtggccacgcccatgcagaggatggccccggtcagcgccggcaccgacagcgaggtgccactcaagaacagcatccagacgatgccggccagggccgccggtagcgcggtgatgatcacgaacgggtcgagccaggactggaagttgaccacgatcagcaggtagatcagcaccaccgcgcccagcaggcccaggctcaggccgctgaaggcttcgtgcagggcatcgatctgcccgtgcaggctgatggtcgcgcccttgggccgcagcgcctggctgtcgtcgaggatgtgctggatatcccgggccacgccgcccaggtcgcggccctggacgttggcgtagaggtccagggtcggctggatgttgtagtgggtgaccaccgccgggctgtcgacccgcgagatgctggccaggccgccgaggatctgcgactggccgttgctgccggtcaccggcagggcctccagggacggcaggctgtccaggcggtactgcggggtggcggcgacgatggaataggacacgccgttctgcgggttgagccagaaggtcggcgccacctgggagctaccggccaaggaggccaccatgctgttggtcacgtcacgctcggtgatccccaggccattggcccgcaggcggtcgaccttgaccgccagcgacgggtagccggtggactgctggatacgcaggtcggcgatgcccggcacatgttgcaggcgccgttgcagctccagggcataggcgcggttggcggcgctgtcgggcccggagattttcacgtccagcggcgccggcgcgccgaagttgaggatctggctgctgatgtccgccggcaggaaggcgaactggctgccgggaaaactttccggcagggcctcgcgcaatcgcttcacgtagtcggcggtcggcgcatggccgggcttgagggtgacctggatgtcgccatcctgcgggccgatggtgccgctgctgctgtaggccatgtcgatgccgctcaaggggatgccgatattgtcgatcacgctgtccagctgctccggcggaatcacctcgcgaatccgcgcttcgatgcggtcgaaggccgccgcgctttcctcgatccgcgtgcccaggggcaggcgcacatgcagggccagggcgccggcatcggtggccgggaagaagtcctggcccaggctcggcagcagggcgaaggaggccagcacgcaggcgagaaaacccagcaggaagcgcttgcggttggccagggccagggtcagcaggccgtggtaggtgtcgcgcacgttggagaagcgccgctcgaacccctgctggaagcccagcagcccgcgcaccaaggcatgccgtggccgggcgtgttgttcgccctcgtgatggttgatgaattcatcttccgggtgatgccccgggcccggctccggcacatggggcttgagcaggtacatggccagggtcggcaccagggtgcgcgagaggatgaacgagctggccatggcgaagatcaccgccagggccatggggcggaacaggtagccggcgatgccctgcaacaggaacatcggcacgaagacaatgcagatgcacagcagcgagacgaaggccgggccgacgatctgtttcgcgccgtcgaggattgcgtccttcaccgccttgccctgttccaggtgccagttgatgttctcgatggtcaccgtggcgtcgtccaccaaaatccccaccgccagcgccagcccgccgagggtcatgacattcagggtctggccgctggcggcgagcagggcgatggcggcgagcaccgccagggggatcgaggcggcgatgatcagggtcgagcgccagctgccgaggaacagcaggatcatcgcgctggtcagcagcgcggcgatgatgccttcccgggccacgctgcccaccgattgcttgacgaacaccgaggcgtcgcccaagagcgaagtcttcagcgccgggggcagggtttcatcgatgcgcggcagcatctggcggatgccatcgacgatcgacagggtggagatattgccgttcttcagtgccggcatcagcaccgcgcggtggccgtcgacccgcacgatattgctctgcggcggcgagccgtcacgcacatgggccacctggccgatggtgatcagcgcaccgtcgacggtcttgatcggcaggtcgttgagctcgtcgatggccgtcgggctgttgttcagcagcaccgtgtactcactggcgccgagcttggcggtgcccaccgggatgatctggttctgcgccgccagggcgttgcccacgtcctgcgccgacaggcccttggccgccagcgcctgcgggtccagatccagggtgatctgccgctgcttgccgcccatgggcgtcggcatcgccagccccggcacggagctcaggggcaggcggatattgttctgcgccaggtcgcggattttcgcttccgacagggtcgggctggaaaaggccatctgcaggatcggcaccgtcgaggcgctgtagttgaggatcagcggcggcgtgatgcccggcggcatctgcttgagcacggtttgcgacaccgccgtgacctgggcgttggcggtgcgtatatccacccccggctggaagaagatcttgacgatgcccatgcccggcaacgactgcgactcgatgtgctcgatgtcgttgaccgtggtgctcagggagcgctcgtaggtgtagatcacccggccggccatggcgtccggcgacaggccggtgtactgccagaccaccgccaccactggaatgccgatatcggggaacacatcggtgggggtacgcagggccgccagcggcccgatgatgcagataaaaatcgccagcacgataaacgtgtagggcttgagcagagcggtcttgaccagcccgagcatgcggtggacctccgaggggaaacgaacctcggcagcctgccgcgacccacctaacacgcggctttcagccaggtgaaggaagttttaggttgggcctgaatttcctttcacggggattcatttgtcctgtggcgggtgcctcgacaagctgaatggcaatcggcgcgagcgcttttttttcgctccgccctgtgtcgattttttactgccgaggtacctgccatgaacgccaaaccgctgctgctgattcccgccctgagcctggtgctgctgctctccgcctgcgccggcccgatgcccaaggccgatcccaacgaagcctggatcagcctggaagaagagggctccagcgacctgatggccgaacgcgtcgacggcaagaacgtcgacgacggccgctacttcgaagtccagcccggcgcccaccgcctggacgtgaccctgttcgaggaggttggcggcgactccaaccaggtcgattgccgcgggcaggtgagctacccgagcttcaaggcgggggagcattacaagttggtggagtcgaccctgggcactgaggtgcgggcgcggttgtatgacggggaggggaagcaggtggcgagcgtgcgggattttgagtgtatgccggggtgacagcgcttctcgcgctgcccaaaccaagacatttcgctcaatggaaagagaaccgcctgacagcaaatttatggtggggcgctcgatgatgaggatttgaatcttcaagcggagccttctttatgagccaacctgccggagcactaccgacgtccaccgatgcggccttcagcgaagtggcacagatgatcactgctgcgcgccaacgggcggtgcgggcggtgaataccgaattggtggagttgtattggcagatcggcgcctatatcagccgcaagatcgaggcggcggagtggggcgatggagtggttcagcaactggcggattatcttgcgcggcagcagccggggttgcggggttttacccggcgtaacctgttccgcatgcggcagttctatgaggtttatcgaggcgaggagaaagtgtcagcactgctgacacaattaccctggacccagaacctgatcattcttgcgcaaggcaagcggccagaagagcgcgagttctacctacgcatgacgatccaggaacaatggtcaacccgggaactggagcgccagatcaaatcggccctcttcgagcgctcactgacccaaccggcaaaagtctcgacagcgttgagacaaattcatcccgaggcgttgaaggtgttcaaggatgcctatgtggtggagtttctcgacctggccccggggcatagcgaagccgacctgcacagtgggttagtgcagcaactgaaagactttctgatcgaaatgggccgcgacttctgctttgtcgcttcgcgctatcccttgcaggttggcgggcgtgatttcgtgctggatctactgctgttccatcgcggcttgaattgcctggtggccatcgagctcaaggtcgggcgcttcgagccggaatacctgggcaagctggatttctacctggaagcgctggaccgccaggtgcgcaaaccccatgagaacccggccctgggcgtgctgctctgtgccagcaaggacgacgaggtggtcgagtacgccctcaaccgctcgctgtcgcccgccttgatcgccgagtatcagacccaactgccggacaagaagctgctgcaggccaagctgcatgagttttatgcgctgaatcctcagacggtttgagccgccttatcggagcccgaattatttttccgctcccccgtcacaaaccatccacctggcccgtcatgtcggtgtatccctcaattaacggagccaccccatgtcatccagccacccgacccaagccgtcaacctgctgcaaaccatccccgaaatcttcgaaagcctgggccaggtccacggcctgatcgacgcccacggcctggcgcgcaagctgcaccacctggtggtgttgcgcgcctcgcagatcaaccagtgcggcttctgcgtgaagatgcacacccgcgaagcccgtgaagacggcgaaagcaacgagcgcctggaccgcctggtggtctggcgccatgtcagcgatttcagcgccgccgaacgcgccgccctggcctggaccgaagccctcaccgtgctgcgcgaagacaccgacttcggcccgttgcgcgccgccctgcgcgaacatttcagcgacgcgcagatcgccgccttgacggccgatatcggcatgatcaacctgtggaatcgcttacaggtgtcgaggcactgaggatggatcgaatcgatgacacgacggtgttcgaaagccgtcgcagcttcctgctgggcctggcctaccgcctccttggctcgcgcgccgaagcggaggacgtggtgcaggacctgttcatcaaatggctggaggccgacaaggcctccatcgccaccccggccgcctggctgaccaccgcctgcactcggcactgcatcgacctgctgcgctcggcccagcgctcgcgcctggactacgtcggcacctggctgccggaaccgatccataccctgcatcaccactccccggaacagagccatgaactggcctcgtcgctgtccaccgccttcctgctcctgctcgaacgcctgacccccaaggaacgcgccgcctacctgctgtacgacatcttcgacctggactacccccaagtcgcacaaaccctcggcgtccaggaagccacctgccgcaaactggtgtcccgcgccaaagccagcctgggcaacacccaagcgcgctacctgccggaaccttcacgccagcaacaactgctgagcgccttccacagcgccatcaccagcggctcgacccaaggcctggccgccatgctgtccgaagacgtcgagctgtgtgcggatggtggcggcaaggcgagtgccattcgcgagaccttgtatgggctggaggcggtgttggcgtttgtgggggagtcgttgagccagtactggcgggagtatcagtggcaggaggtggagatcaatggtgggcgtggggtggtgttgcggggagacggggaggtggtggcggtggtgagttttgggtatgacgcagaggggcgggtgaaccgcgtctttatcatgcgtaatccggagaagttggggttgttggggagtggttcgttggcgtgatgtttgtatcgcgctgccctgagtgctgcgaattagcaaacctaggtcactaatgccgatcagctaggcgaaggtggtcccttgtaggagccgccggtcgacgctcgattgctcgcgatggtcgctaacgataaccgtgcattgattggatcaacacagcctttcaagcccgtcgcggacaatcgagcctcggccgatttcagccaaagcgaccaagtagcttgcctgctgcacgtcttggatagtgtgttgaccttaacccaatgatttttaatacttttagctctgagtactgtcccactagactccagaatgacttaagttttctcctgtcactgccagtgcgcctgcattaaactgcgccgctgttttcgccacgcgtgaaaaggcctggctcgaaatccaagcatttaccgtgccaattttttggcagagtgacggcaccctccggggagcttagacatctcccaaaaagtaaacgactaaagtcgcggtactcgctcattagtgatctggatagtggtaaaccatgaatgcagtagaaattgagtccgctatatcggacctggcccttgagccctttgacgcgtcggagtttccgttcactttcctggccgcattcggcaacaaggaaaccgcgctcaagcgcctgcgcgccggcaacaacaacgcctcggacatgcccggaggcgtactactgcgcaacaacattcatatcgcctcatgcgagcccggcaccgtgggcgaaacgctcaaggccttgcgcgccagcccggccaccataaaagccaaagccaagtttatcctcgctaccgacgggcaaaccctggaagccgaagagctgatcacgggtgaaactatcacctgcgactacccggacttccccaaccactttggtttcctcctgccgctggccggcatctccaccatcaaggagatcaaagacaaccccatcgacgtgcgcgccaccagccgcctgaacaagctgtacgtcgagctgctgaacgaaaacccggactgggcaaaggccgaacgccgtcatgacatgaaccactttatggcgcggctgattttctgcttctttgccgaagacaccgatatctttaatggcgatagcctgtttacacgcaccgtggaacgctggagcgagcgcgacggatctaacaccaatcaggtgctgtcggaaatcttccgtgccatgaacatcaagcaggccgagcgcgttactgctcagccgcgtctgcccagttgggccaacaccttcccttatgtgaacggcggtctgttctctggtagcaccgaagtgccacgcttcacgcggatggcgcgcacttacctgctgcacgctggcaacctgaactggcaaaaaattaatccagatatcttcggcagcatgatccaggcggtggccgatgatgaagagcgtggtgcattgggcatgcattacaccagcgtgcccaatatcctcaaggtgctgaacccgctgtttctggatgatctgcgcgctcatctggacgcagccggtgagaacagagccaagctgctcaacctacgcaagcgcatagcacatattcgtgtgtttgatccggcctgcggctccggtaatttcctggtcatcgcctacaagcagatgcgcgagatcgaggcggagatcaatcgccgtcgaggtgagccccatctgggcagtgagattcctctgaccaatttccgtggtatcgaactgcgtgactttccggcagagattgcccggctagcactgatcattgccgagtttcagtgcgatgttctgtatcgcgggcagatagacgcgctagcggaatttctaccgctggatgcgcagaattggatcatttgcggtaatgcgctatggctggactggctgagcatctgccctcctacaggcacgggcgtaaagttacttgcagatgacttatttagtacaccacgcaatcagacggagatcgaattcgcgaacgaaggtggagaaacatatatttgcgggaatccaccgtacgttggaacgaagtaccaaacaaaagagcaaaaagacgacattgcgacactatttaagagtgaaggtataaactccggaaacttagactacgttggttgctggttcctaaaagcagcacaatacacctctaaaattgagagatttgccttctcattcgtgacgacctccagcttgtttcaaggggagcaggctgaaatagttcttcatgttcttttgttttataatctgaaaatatactggtgccacccaagtttcatgtggtcgaacaatgcagctaataacgcgggcgttacatgcagcattgtgggctgtgctcgggacggtgctcgatccgaacgatatatatatggcaatgagtctaggcgcagcgttggaaacattggtccatatcttgttccaatgccagatattgttgtatcaaagcggcaggccccactgtcagaaacttctgtcatgagctatggcagcatgtctaacgataacggcgagttcacattcaccgatgacagatacagagctagcatcaaagccaatccaaaaaataaggatatcttcaagatcgctgtagggggggttgaattcatcagggggattgtacgcaggaatatatacatcgatgagggaaccacactgtcagacattcagcgcgaagagttctcaggtgtatttgattgcgtacaagaataccgcgcggcaagcagtcgagaggcaactcgcaaactaagtgcaactccaatgtattttgccgaaagaaggcatatagcggcgaagaagatatttatacctcaagttctatctgagcgaagagagtatgttacagcaggcttattggatgatgatgctctggttattgccccgcatatgcaaattgttgatggatgcaactatgagttcgcgctcatcagcagtagaattcatcatgtatggatttccacagtatgtggaaagctgaaaacggacattcgttactcaaatttacttggctggaacacttttcccgtgccactgctcaccgagcagaacaagatcgaccttacagcctgcgccgatgccattctgctggcccgcgaagcccattttcccgcaaccatcgcagacctgtacgacccagacacaatgccggataacctgcgcctcgcccatgagcgcaacgatgaagtactggagcgggtatacatcggtcgccgcttcaaaaacgatactgagcgactggaaaagctgtttgacctttatagcaagatggcggcaaatgcagtgaaggccgcgccgaaaaaaaagcgggggaagaaggcatgagcgacactcctgttagtctcgccatgctacccgaaggctacggtgattggctggtcgacctcaaaagccgcagccgcagccacagcgccaagcaacacgccgcgttagcgatgcagctgtactggcagatcgacaacgatattttgatccgccaggtacaaaaaggctggggggccaaggtgatcgagcggctggcacatgacttacgcaccgcctttcctaatatgaagggattttctcgtatcaatctgatgtatatgcgcgcctttaccgaggcaggcgacggcaccctcatggaggatgtatcacagtgactaacactaccaacccaaccaacagctacacggtgccgtcggtatccattgctacggcacacactggggcatccagcaaggccaatgagttgggcatgcgtaccatgcaagaacgcgcctattccaagcgcggcgagcagtatctgctgatcaaatcgccccctgcatcgggcaagtcccgtgctctgatgtttatcgctctggataaactgaataaccaggacctgcaacaggtcatcgtcgtggtacccgagcgctccattggtgggagctttgctgatgaaccgctgagccggcacggtttctactgggactggcaggtggccccacagtggaacctgtgcaatgccccaggcatcgatgagccgcgtgtggccaagtccaaggtggacgcagtgcgcacctttctggagagcagcgacaaggcgctggtctgtacccatgccacctttcgctttgccgtggaggaactgggtatcgacgccttcgacaatcgcttgattgccatcgatgagttccaccacgtttccgccaaccctgacaacaaactgggcagccaactgagcgcatttatcaaccgtgacaatgtgcacttggttgccatgactggctcctattttcgtggcgatagcgaggccgtactggccccggcggaggaagccaagtttgagacggtgacgtacacctactacgagcagctcaacggctaccgctggctcaagtcgctggacatcggttactttttctacaccggtcgttatgtggatgccgttgccaaggtgctggatcctgcgctgaaaaccatcgtccacatcccaaacgtaaatgcccgcgaaagccttaaagacaaggagcgcgaggtcaacgagatcatgagctcgctgggcgactggcagggcgttgaccctgccaccggcttccacctcatcaaagccaaggacggccgcacgctgaaagtggccgatctggtggatgacagcgacgcggccaggcgctccaaagtgcttggcgcactgaaagatccggcgcagaagaacaaccgcgacaacgtagatgtgattatcgcgctaggcatggcgaaggaaggctttgactggatctggtgcgagcatgcgctgaccataggctaccgttcgagcctgaccgaaatcgtgcagatcattgggcgagccacgcgtgatgccgagggtaaggagcgctcgcgcttcaccaacctgatcgccgagcctacagccgatcaagctgctgtagccgaagcggtgaacgacatgctcaaggctatttccgccagcctgctgatggaacaagtgctggccccacgctatgagttcaccccgaaaaaccacggggagaaagagggttttgtctacaacggtggtgaaggctatcaaccgggcggcatcaacctgggtgtgaatgaaaccacaggacagttccatgtcgagatcaacggcctgaccacgccgcaaagcacagaagcggcgcgcatctgcaaagaagacttgaacgaggtggtgaccagcttcctgcaggataaaaccgtgctggagcgcggcctgttcgacaaggaaaacaccctgccggaagagctgacccagctgcgcatgggcaagatcgtgcgcgagcgttaccccgacttgagcgacgtcgaccaggaagccatccgccagcacgccattgccgccatgaacattacccagcaggccaagttgatgttggctcaggccgacgtcaacgggagtgacactgtacaaggcagcacggcgctgctggatggtgtacgcaagttcgttaacgtgcgcgagctggacattgatctgatcgaccgcatcaaccccttcgatgccgcctacgcggtgctggcgaaagcgatggatgagaaatctctgcgccaagtacaggccagcattgcggccaagaaggtgagcattcccgaagacgaagcgcgagacctggcaaaacgtgcgttgcagttcaagaatgagcgtggccgcctacctgacatcaactccgccgatgcctgggaaaagcgcatggctgaaggcgtagccgcgttggcacgttaccgcgcccaagccaaagcggcgctgggagattccgccaatggctgaaatgaacgatgacgacctgctggatgcgctgggggtagaagtccccacgctcaagacagtcactcgaacccctcgcgaagaacgcatcatcgctggcttcgaggacattcagcgcttctatcagacccatggccgcgtcccactgcatggcgaggaccgcgacatctttgagcgcttgtatgccgtgcgtttggatcagctacgcaagttgccggaggcacaaaccctactggcagacgtggatagtcactgcctactgtcaggcactgccatcgccacagtaaatgtggatgacctggatgaggacgctttgctcgccgagttgggcatcggcagtgagtccgtcgaccaagacgacatcaccgtgctgcgccatgtgcgttccagtgcggcaataaaggcagcagaagaaattgccggtcggaacccatgtgaagacttcgagaggtttaagcctctgtttgatgaggtggaagcgggccttaagcaaaaattgtggataactaagcccttcggcaagaacgccagcatcgaggccggggatttcttcattctgagcggactcattgcctatgtcgccgaggtgggcgacacctacaagacgccgaatgcggagatgaatgggcgtttgcgcgtcatttactccaatgagacggaaagcgatctgctattacgatccttgcagagggcgctctacaaggacagtgaggggcgtgccggagctcggctcatcaaggtagattccggcccactgttcagcgacatagccgagcctgacgacatcgagactggcaccatttatgtgctacgtagtctgtccaaccatcccttcgtaaccgagcaccgtgagctgatccacaagatcggagtaactggcggccgagtggaaacccgcatcgcggcggcggcgaaggatgccacctacctgctggccgatgtggaagtggtcgccacttacaagttgcacaacctgagccgtacccggttggaaaacatcttccaccgtctattcggcgcggcacagctggacttaactatcgaagaccgcttcggtcacccagttaagccaagagagtggttcctggtgccgctgcatgtgattgatgaagcggttgagcgcattcgggatgggtctattactgatgtgatctatgacccccgtttggctcgcttagtcagttaagttatttgaaaaggggagtggtcaatatgatgattgatcaaggttgtaagtcgtactgctataaggcgatatacttgagatgtgtttttgtaaagtatttgaagtttgatttgaagtttgcccgagagtttttttaattttctagctgataaaaatggatgttgactcgcaatggaatatgcaattttaaaaaaatctaatgaaactttaggctatgttgctcaggtttctgctattgcggataaaaataagggggcttttggttttttatccaattcagcatacgaccaaatggcctcgaaggggcagttgtggattgccgttaattctgcgggagtgttaaaagggtatttgatgtttggtggtactatgccaaccctcaaggtctttcagatatatgcttgtgaaacgactaaaggacatggggttggcaaacagctaatagacgcattgaaagaatttgcaggtagtaaaaattatcactctattgtagcgagagttgcctcagatttacctgccaatagtttttgggaaaaagtagggttttcagtatatgggcaggttaaaggtggggagacaacgaagcgaataataaatattagggggtatgcgcttgaggataacgatctttttggtggggtaggtaaagagcacgcgggtgtccagcctatcgggccagtattagatcgcccaatttatgcattggatcttaatttattgcttgatgtgttcagggcaagacctggttataagaaagtcgtaaaaataatgcagattggttttcagggtggattctcaatttgtattacacctgaatttaaaaaagagcttgaacgtcaatcagctaatttttcagatgatcctattttgaggctggcggaggtttttcctgaactgaagaccgattttgatatagctgggattgccgagtctttaaagtccattgtgtttcccgcgcgagcaccgaaccgtaagtccgcacagaatgatgaatctgacctaatgcatttagggtattgtatatcggcaggcataggtggatttattacgcgagaaaaagccttattaagggcttgtgatgaaattaaagataagtatggtatggccattatttctcctgatgagattattttagatgatagtgagctgtcaggtgtttccagtccattaaattcggacttttcgtttgctatttcattattgacggatgaagtgaagggctttcttagtggcttctcgttgcaagatgctatcgctgacttgttagtttctgcctctcctattaagtcagcagctagtgtctatgaagcaaggttggatggtcgcctgtttggagtttatttctttcagaagccattaaaggtaaaaagtgttgcagtggctgctctatacatagacgaaagctgcccgcaatctattgccgctatagaccatttcttagaaatggctttgaggtataaatgtgggttttcttaccgtttggatctttatatagggaaaggtcaagacttaacagagggaactcttctaaaaaaaggtttttttaaatcctctgatcactttgtgaaagtaattagtagtgtgtttttagatggaaaaaactgggggcgctttacaagggatgtgaagtcgctttgtggtttttctatgccggaaaagcttccatcgaaaaaggagttgcaaaatactggtgtttgccttgctgactccaacaataaggttgaggtgttttcctggtttgattttgagagtgttattgggccaaggtttatattgacttctgatcgagattgtatattggttcccattcgggaaaattttgctaatggcttgattgggaatgtaaaaaatcagctgtctctactgtctagtcatgacaaagttcttttgcttgaaaaggcctactttcgctcatctatcaaagcgtcgagctttaaaaaaggggggattgttgctttttacgtttctggtaataaaagtattcaagaactcattgggttcgcgagaatcacttactcagatgtagttagtattgacgaggcaaccattaaattggataggcaaggtgttctatctcgttgtgagcttgctagtattgttgatggttctggtaaggtacatgtattcacgtttgataattttttagagtttgataaaagagtcccgttttttagagcaaagaaactcggattgattagtgatgcaaaccttgtttctcctgaaaaaataagctttgaaaagttaaaggttcttattggggaagcttttaatgattgatgcaattatatccatcaagcctaggcatgtggaaaatatactgtctggaaaaaaaacggtagaacttagggtgagaaacatgaatttacctgttggttctcgactatgggtttactctacgcttcctgttggcagggtggaaatgtttgcagaggtggatttcattgagttgctaccaccgaaggagatgtggaaaaaacatggaaaaaatatatgtataccaaaaaaagaattcgatgagtacacgaggtcgcgtgatcttgtggcggctatagggttgaagaatataaagccgctggagaaagatatttgtttggaaacgatgcgacaatatgagaaaggcttccagccgcctcagtttttctcaaagctttaccctggaagggctttatgttcagccttttatgcatagtctatgcttttatggctaatcaatcatctgggtactagcttattgattcatatgggctttcaaggtgattcttttgtttctatagagggctggttttgggttgattaatattcatcagttgagggtggtgcatgagggataattatttgactcagatgcttatggcagaagaaaaaagatgcagtttcttgtttagcttgatgagcggcttcttcagggaggagtaataatatcagagtgggctgcttttttgataagagatgcagatgtcgcttttgttaatgaggaaaatttatcatgtgtcattactttcctggctgcgatagaagcatgtctgcgatcggaagatgtttctggtggcaagcgatttgtagatttaattattaattccgatcttgatgaagagcttaaggcggaactgcatgggctgcgaaaatatagaaataaatgggttcatgtggctgccccgtgggaagatcaaatcttgcttgactcgcccgaattatttgagaaagaaatcgagcaaataactcgtcgtagtatagttgctcttcgtcgcgccctttattcaaatcccttcatgtaaggcctgagatatcttcgctgatgtgaggaaagataggtctggccagttgctgcgttctatctgtgagagagcgagcaattttttaactcttcactttctgaagttttgctggggtgttacagatgtaagggggatagttaaagatcagtacttaagagcctcagaataggcctgcggttagcaggtggtaatagtttgtcgacttctcaagtgtatgcccataacttaaacgatattttctctgcgatagtcatgaggcctagatgccactggggaattatgaatgtttggagacgcttggtgtgacatgtgttgcgataactttcaatagagcaaagaagccggctaagaggccggcttctttgtttctgattaggtgagaaaagcacgggtctcaatcaccgccaacacatcccgaacatcctgcagcaacaaccgggcggtattggtcacggtgctaatgtccttttcgctggagtctcgcaacgtagtgcaggccatcaaattcaggtagtcgagcgtggtgcgcaaacgctcgttggcacatgcatgcaaatccatcagaggcgcatggctgtctacaaacagcaccggcccatcgctagcaattggcgtaaggggaataaagcgttcggatgaatcttgagttttcatggtgtcgtccttttcaagaatgaaaaagttgccacctgactgctgcgaatcaattgggtggcagctgtacgcgggttcgcagaccgaggaaaagaagaaacccggcagacccggaggtctcccacgtacagccgccatgaagcgaaacgcaggcgggagtgtgcctgagttgtcattggcggtgtagttcgacttttctgttgggctgcgaaaccctgtcgctgaccggaatcagcagacctgaaaactataggtgtggggtgctttaggaacaacggcagggctgtaggaaaggtctcgattgtgggtagggcgaggctgagtcgttgatccttgccgcaggcagaatggttgctaacgctccgtagcggttaccgcaggtccaggtcgtggcgccattcagtcgttgaggtgtagctggataattggggtgtgccggtttgggggcgctgcgcgccccatcgcagcctcgcgggctcggcagcggctacagggcgtaagattttgctatcctgcgcgccttttacccattgcaaggagcgcaggcatgacccagtccgttggtggcgggaggcgagtcggggcagggaagtggggtggtgtgtctcgcttgcggcattttctattcccgttggcgccgacgcttttagtgggtttggcgctgggtgtgccgacggccagcgccaacccggtcaccacttatcgcggcacgctcggcgatacgccggtggagctagcgctggtgtatgactcgcaatacggcggcgggatgtccggctattggtttagcggggccgagcgtttgccgatgcctttggagctcacgccgttttggccggacagggggctgttgatcaatatcatggataacccgaccttgccggcggcggctgtgtcgttgcagccctttgccgagggggccgaggcgttgcagggggccttggtcgatttgcgcacaggcgtgcagcagccgttgcggttgcagcgggtgatgcgttttggcgggagtcagcgcgaggcctttgacggtgagttgttgcagccggcggccgaccagcagttctatttcagtgtgcatgccgtgcgcaatgccggggaggacacggggcgggtggacactatccgggggctgagccgggccaccggcgaggtggtgcaggaggtgggcgggcagtggtgcctggcgccgacggggacccgcaccctgaccttcgagcatttcgatgccgattccacccttgatttccaggtgcagggctacagcttgaatggcccgtacggcagtgtgctgtgcgcgccgacccagtattacctgtaccacccacagacccaggcgtatctgcgccatccgcagctggagcagttggccgccgagggcactgtgcgctttgccggcgggcagatggagttcagcaagcaggactttatcaacttcagtgcgggcacccagcgtagggactattaccgcgtgatcagccctgaccggctggaattcattcagtctctcgaggggcgtttctgatgcggcgggttaatgttttgcgtgggttggcggcggtgctgctggtgtcgtggctagtgccggcgcaggcggcccatggggtgtaccagggcaccttgggcaagcaggccattgtgctgacgctgggcagccagaatgcgctgtaccaggggacctatgcctaccagcgctatcgcacgccgatccgcctcaagccgaccttcagcttcagcaacaaggtgctggccatggacgagctggacgagcaggggttgccggtggcgcgcttgcagttcaacgacctgatggtcagccgccagagcgagcaggtgcgcggcagttggaccagctatcgcaccggcaagaccttgcccatcagcctgaagctggtggcgctggtggactcggaccgttcgtggccgcagccgaacaccacgctgttgcagagcgcatccaccaaacgttggtacttccaggtgccgatgcagggcaatgaccagcggataacggcgatcgaggtggtggacaaggccagcggcaaaccgctgcagaccctgacgctggcggcgccgggttgtctgtatcaaggggtggatatgttgcaggtgcaggccgaggggcagagcctgcggctcagtttgagcgactgcaagttgccggggtttcagtggaatgaggggagtgggcggtttgaggctttgccttgaggtgttgtcggtcggcctggtgtctattcagatagatcgtatttgcaggttttgcgactgctgcgcccgagcgcggaccggtgggcgcagcctcgcgggctcggcagcggctacggggtcggtgtcagcttgcgttgcatgatcagggtgcgttcctcgccgtggtgttgctcgcgcagggtgcgaaaacccaggttggcgtagaagccttcggcggtgatcgagacgggcacggtcagctgggtgaggccggcgcccagggcctggcgctcgagttcggccatcagttggcggccgacgccctggccttgcctatccggggcgacgaagaccgagcgcactacatggccgtcgaggctggcggtgccgacgatttcgccggccgcctgtgccacccagacctggcgtttgctcaatagctggcgcacggcgtgcgggctgaagttttcctgtacctgggcaatcaccgcggcggggtagtcccgggcattactggtctgcagggcggcgatgatcaggcggctgatggcgtcggcgtcctgcgtgtgggcggggcggatttcacagtccatgtggaggagtcctttgaggggtaggtctggacactagccttggtggggattgttcgctagggggggttaccaactgccatagggaattccgtatttctctatatagcgtttggacttctcgctgaccttataggcgtaacgcccattgttttttccttggtccggtcccaatggctcaacttctgcttgggcccgggctactttgacagggtgacggcattcatcccttacccacacctgaacgatgccgccaggggccaggcctaaatagactgatgccatatagcgggcagtctgatgcggagtctccgggcagcgtcggttagtcgaggtccacataacttttcgcgcttcttccgggatatcgacccaggcgcgataagtctgtggctctacgatggattgccaacgcacgtaaatacgcttgggaaggtctgcgccaactactgaccatccactgcctccaacgctatccccccagcctctggcccactctttttcgtaaccgaggtcgccacctgcagcggagccgccaccagtgcgagtgaatagtttgccgttgatgtcctcaacggcgctgtcctcgacccagaccttcatgtagtacggctcgatgaagccaagctcccaccagggatctttggggtcgttttttccggatagtgggtcggtctgacagccagtcaacagcagtgcgcccagcagggcgatgaatgctctcattaccaacgtgttcagccaggtaggtgggggaatgtgttcacgtagtagagggtgtcgataccaagagagttctgcctaccaactgccatagggaatgccgtacttctctatgtagcgcttggagctctcgggtagcgggtaatagtgcccatttgatttacccaggtgcggccccaacggttcaatttcagcttgtgcacgagctaccttgaccgtgttgcggcattcatctctgacccagacttgcacgatgccacccggagttagacctaaatagaccgatgccatatagcgagcggtctgatgcggagtttctgggcagcgtcggttagtcgaggtggtcattattttccgggcttcttccgggatatccacccatgctcgataggtctgtggctctacgaccgattgccagcgtacgaaaatgcgcttgggcaggtcagcgccaaccactgacttaccgctacctccaactcccttcccgccccatcctctggcccactctttgtcgtaacccatatcaccacccgcagcggagccaccgccagtgcgaaggaatagcttgccgttgatatcttcaactgcgctgtcttcgacccaaactttcatatagaacggctcgctgaagccaagttgccaccaaggtgccttggggtcgttttttccagatagcggatcactggtccagcaaccagtcaacagcagtgtgcccagcagggcgatgaatgctctcattaccaaagcgtccaatcaggtacgtgaggatgttgcacacgcacggcatccaccgtgggggcgttgatatagacgactttaaggctgccgccgtcctgtttgcccagcgggtggttccagtgggcagagatatggatataacgcagcttgagcatggtttcctcggctggcgtcgtactgtagtcaccagcgataaacctgtcacaaagggtttgcagctcttgcgggatggcgtagtccgcatcttgttcgtcgatggggttgaagctcactccattctgcctggccagttcatacatgacacgaaggtacaccctcgatagcctgttgctcatagggcgcttgagctgcaggccggcatacactcgcttttgtcgtacgccgaggcggtcctgtggatcttgcggcaatagcaatggctccggtgtgacgatctccagccattgcgcaggccaacccttggacagccagcgctttctcgtctgtaccgcttcccgataaatcgaggtttgggttacatcggcattgatcggcacctccagcgcttgcatcggactgaccagtacacactcctgcacctcattcagataaccgccgccgatatccgagtgtgcgccgggcagggtgatctctacgtgatcgggcttgacccggctcagggcaaagttggcgcggtactcgtcgcgggcgactagttgcactactgagcgaaagtaacggcggtcgagatgaagtttgaggcctggggcaatcgcgctgcggacattgcccagattactcagtccggcaactgacggcaccgtatcgaacaagccaataaaacccatgtcgacattgtggccgtactgccggttgaagttagggctgaaggcgtcggaatagctgtgcagaatcagctcaagcgggccaagccagcgcacgacttcattggcaaaatgtcgggccgatgccgcgcctcggctaaagccaaaagtatcgaagatcagtgaagtgatctcgccttcggggttctctttatggatatcgttgatatgttctttgatctcacggaaggccctttgcacacatcccaatactccggtgtcgccacgccctgtacccgaggtgatcaggctgtctttttcacccgtctgtgtgccgataccctcaacatagattgaacgaaacgctcgctttttcagttctccaccctcgatttctcggctggaatagtacaaatcactcaaccgcttaacattgctcacatcattcccataactactctccggatcgctcatatacggcttgcagctgccatcgagatccctggcttcaatggcgtgttgcgcgccgcaaacctggcccatggccgagttactggcgttgttgccagtgccgtcgaaaaacacgccgatacgcagcgccacctgggctttggccggcggcggggtgggttccttggcgtacttctcgtactgcgcccagagctgttcgccgtagctgggctcttcggtttcagcggcgcgttcggcagggcgctggttgggattggcgggccgtagaagattgggcatcggcccgggtccgttgctggccatgggtggtcctggttcaggcgaaaggggcgctggaaaccgtaccgggaatggcggggcagggatttaggaggattctgcaagcggcgacgcagtggctgatttggttgtagggacggtttattgccgggatgtttttgtcgtttgagtggacgctatcgcgagcaagctcgctcccacagtgggagcgagttcatgagctcagtgccaggcgccgagcgcgccgaggctgagcatgacggctgccagcatccccaccaaggcaaacagctgctgcaagcgcggcccggccaggtagcgggcgacctgccggccggcgatcaaccccagcaccgcgccaatggcgaagggcgcgcccaccgcccagtgcatcacgccgctgaggctggcggtgatcacgctgccggcggacaccagggcgatcaccgccagggaggtggcgacgatgcttttgctgtccaggttggtgtagcgggtcagcgccgggatgatcacgaagccgccgccgaccccgagcagcccggagagcagccccgagagcaggccggtgacggtcagcgcgcgggcgcagggcagggtccagcgcagccggccctgcaaggggttgagcacgcagggctggaaggccgcgcggggtgccggctggccgtggcgcagttcacgggtggccttgagcaggatgcgcccgcaggcgtacagcagcaccgcggaaaacagcagggccagcggcaggttcggcaggcggtgggccagccacaggcccacgggcgccatgaggatgccgatggcggcgacgaagccggcggctcggtaacgcacgatgccttcgcgcaaccccagtaccgcgcccacggcggccgccaggcccaccgcgagcaggccgatgggcgcggcctcgaccatgctcaggccgaggccgaacaccagcagcggcaccgcgagaatcccgccgccggccccggtcaacgccaggatcgcgccgatcagtgcgccgaggccggcgcccagcaagctgtactcactcatgattccggcaggtccgtcaccaggctcggccgcgccagccactcatggcccttgagcatgccgcgccagtacagcggcggcaggatgcgttccttcagccaccaggcgcggcgggtcggctggcgaccgtcgagcagccaggccggaaagctcggcgcgactttgccgccgtaggtgaattcggcgaggacgatcttgccgcgctccacggtcagcgggcaggagccgtagccgtcgtactgggcccgggtcggcaggcgcttgaggttcaccagcacgttggtggccaccaccggcgcctgcttgcgcgccgccgcggcggttttcgcgttgctggtattggtcccgtcgcccaggccgtggatgttgctgtagcgcttgtgccgcaggctgtgcgggtcgacgtcgatccagccggcggcgtcggccagcgggctgttgcggataaagtccggggcggtctgcggcggcaccacgtgcagcatatcgaagggcagttcgacgcgttcctgctggccatcggcaccgttgcgcacgaaggtcgcccgtttaccggggccgtccaccgccaccaggttgtggccgaaatccagggcgatgtcgtatttcttcacgtattccatcagcgccggcacatagtccggcacgccgaacagcacgccaccggcattcaagaaacgcgtgttgatctgccccagccggccgttgcgcagccagtgatcgcaggacaggtacatggccttctgcggcgcgccggcgcatttgatcggcatcggcggctggctgaacagcgcctggccctgcttgaggttctgcgccagctgccaggtgtagggcgccagatcgtagcggtagttggaggtcacgccatgcttgcccagggtttcgctcaggccgtcgatggcgttccagtcgagcttgaggcccgggcagaccaccaactggtcatagcccagcacacgaccgtcgttgagcagcagggcgttgtgctccggctcgaagctgctcaccgacgcctgaatccacttcacccccttggggatcagcgaggccatgctgcgcgcggtgtcttcggcgcggaacaccccggcgccgaccagggtccagccgggctggtaatagtgggtgtcggccgggtcgatgatggcgacgtccaggtgcggttcgcggctgatcaggctggacgcggtggcaatgccggccgcgccaccgccgacgatcagcacctggtggctgccgttgacggctcgtgggatgggggaaatggggcgcatggcagcgtctcctggtggagtggcgttataggttttaaagggcgttcagcgggatcttcaggtagctcacgccgttgtcgtcgggctcggggaactggccgctgcgcatgttgacctgcaccgacggcaggatcagcaccggcatttccagggtggcgtcgcgggcttcgcgcatgcgcacaaaggcgtcttcgtcgatcccttcgtggatatggatattgtgggcgcgctgttcggcgaccgtggtcatgtattgcagctcgcggccgttgggcaggtagtcgtggcacatgaacagccgggtctgcgccggcagggcgaggatcttgccgatggagcggtacagggtgcgtgcgtcggcgccggggaaatcgcagcgggcggtgccgtagtcgggcatgaacagggtgtcgccgacaaaggccacggtctcttcaccgacctgtaccaggtaggtcatgcacgccggggtatggccgggggtgtgcagggcgcgggcctggaggttgccgatggcgaagcggctgtcgtcttcgagcagcacgtcgaactggctgccgtcgcgggcaaagccctggccttcgttgaacagccggccgaacacctgctgcaccacggtgatctggttgccgatcgccactcgggcgccgagctgggccttgaggtaggccgcggcggacaggtgatcggcgtgcacgtgggtctcgaggatccagtcgacctgggcgtccagttcccgtacccgggcaatcagtttgtcggcggactcggtgcgggtgcggccggacttggggtcgtagtccagcacgctgtcgatcagcgcgcagcgccgggtgtcgaggtccatcaccaggtagctgatggtccacgtctggctgtcaaaaaaggcttctacgcacagcgatgcgccgatgatcatggggttctccgagcaatagggtgacggcggtcggggcgggcaatcgtccctaggctctgtacgaaaagtggctgcgctcggccatgctgcgttaaaaacaggctcggaatgctcatgtaggtccctacagtcgaacgcgaccccggccgttcctcgcctgcttttgccttgcctgaccttcgctcgccgacttttcgtacagacccttggactgtcaataagcgtgccaaccggcgcgcgctgcttttaccgcccatttattgaattcaaaggcctggggtgggcgttctggctgtcactgtcaattgtaggtggcagtcgattggcagtttctggcagaaaatggcagaagccgggcccatggtttaagctgccgcgcaacgcccaggagttgccatgccccagcccactaatgccctcgccaatcctgaaatgttagccctgatgtcctatctggagcatgacgcgcagccgacgatcctgttagacaccgactacaacatcctcgccgccaacaccgcctaccagcgccagttcggcgtcgagggcaaaccccatgtcggcgccaagtgctatcgggtgtcccaccagttcgcggtaccgtgcgaccaggccggcgaacattgcccgatgcgcaaggccttcgagacccgcctgccggagcgcctgctgcatatccatcacaccccgcgcgggccggagcatgtggacgtcgagttgcggccgatcctcggcgacacggggcaggtggtggcttatgtcgagcgcctgagttcggtggcggtggcctcggtgcaaccgcagcagaaggggttggtggggcgttcgccagccttcaatgcggccttgagtgccctgcagcgggcggcgccgtcgcagattccggtgctgctgcagggcgagtccggcaccggcaaggagctgttcgcccgcgccctgcatgacggcagcccgcgtgccggcgggccgttggtggtggtcgattgcaccggcctgactgagtcgctgctggagagcgaactgttcggttatgagaagggcgcctttaccggcgccctgcaacgcaagatcggcctggccgaggcggcccatggcggcaccctgtttctcgacgagatcggtgaggtgccgctggcgatgcaggtcaagctgctgcggctgatcgagtccggcagctttcgcccggtgggcagcctgcgcaccgtgcattcggacttccgcctggtctcggcgactcacaagccgctcaaggaaatggtcgccgccggcactttccgccaggacctgtactaccgcatcagcgccttcccgatccgcctgccggccctgcgcgagcgcagcgacgacctgccgctgctgatcgacagcctgctgcaacgcctggcgccgggcgcggtgccgcgggtcgcgccgcaggccctggagcgcctgggcctgtatgcctacccgggcaatatccgcgagctgcgtaatatcctcgaacgggcgcggctgttcagcgacgacggggtgatccgcgtcgaggacctacccgaggaattgcgcgccggcagcggcgccgccacaacgccgccgagccggcgccgcgcgggcaaggacctggaacaactggcccacgccctggaagtgttcgaaggctcgcgcagcgaactggccaaggccctgggcctgagcgagcgcactctgtatcgacgcctgaaagccctgggcatttcctgagccacgccatatcgccccccgcgatattccgctcccgcgcaatgcctgtgtagccgctgccgaaggctgcgatcgagcggcacgctcgtggcgatcctgccggcgctggagaccctgcgggtctatcgcaggctgcgccagcggctacagggatgctgcgatcccctcgatattccggccccgctcaatgcctgtgtagccgctgccgcaggctgcgatcgagcggcacgctcgcggcgatcctactgacgccggagaccctgcgggtctatcgcaggctgcgccagcggctacagggatacggcgatcccctcggtattccagccctgtgcaatgcctgtgtagccgctgccgaaggctgcgatcgagcggaacgctcgtggcgatcttgctggcattggagacccttcgggtctatcgcaggctgcgccagcggctacagggatgctgcgatccccctcgatattccggccttgctcaatgcctgtgtagccgctgccgaaggctgcgatcgagcggcacgctcgtggcgatcttgccggcgccggagacccttcggctctatcgcaggctgcgccagcggctacagggttgctgcgatcccctcgatattccggccctgctcaaggcctgtgtagccgctgccgtaggctgcgatcgagcggcacgctcgtggcgatcttgccggcgccggagacccttcgggtctatcgcaggctgcgccagcagctacagggttactgcaatcccctcgacattccggccctgctcaatgcctgtgtagccgctgccgaaggctgcgatcgagcggcacgctcgcggcgatcttgccggcgccggagacccttcgggtctatcgcaggctgcgccagcggctacaggggcgagcggggtgacaagcggttgctgcggccgggcaggtcgcaagccatcacccacatccctatctgctccaggtcggtgttgaagggcacctcgcctacctgacgcaggccggcgctggcataaaaacgctgggcgccaatgttgctcttgagcacgtccagccacaggcagggttcaccggcatcggtggcgcgctgcagcacatgctcaagcaagcggcgaccgtgccccttgccgacctgggatttgagcagatagatcttctgcaactcggcaccgggaatgccgctgcccggagtgggccgcgcccagttgagtttggcgaaacctatggggtgctgttgctcgtccagggccagcagccacagatgctcgctcttggcggcaagagagtctcgcagggtatggcgggagaagtcctggtcgagaaactgctgtatgccttcagcggtccagatcgaggagaaatgctcgcggtaggtggcgcatccgatggcttggagggcatcgatatcgcggctgtcagcttcacggatggtgatcatgcttcactccttgatggcattggcggattgggccgggtgcggcagcttagcctttgcgcaggcgaggctccagtactccgctgtcattggcgcatcggctccagggcacgatggcgatgcgccgtggtcgtagtttctgcccgccttttttcgacgtcacgccagtggcgccgggcctttgaggaattgccatgagccaggatctactcgccaccgaaaccaatcgccggcagttgcagcagatcatttccggactgtccgacggggtcatcctgctcgaggcggaccggcgcatcgtctgggccaacgaggcggcgctggccatgcacggggtcgaggagatcgccgagctgggcgccgacgaccagcaatacgccgagcgtttcgccctgcgttatcgcaacaaccacccgctggccctggacagctacccgatcaaccgggtcgccgccggggagactttcagcgatgtggtggtggaggtgcgcagcggcgagggcgaggaagaacgcacctgggtgcatcgggtgcgcagcatgatcctcaccgaccgcgccggcgaggtggaatccctggtgctgatcctcagcgacgccaccgagtgggccagcgccgaacagcgtttcgagaagaccttcaattccaacccggcgccggcggtgatctgccgcctcagcgacctgcgctacatcaaggtcaaccagggcttcctggaaatgaccggttatgcccgcgatcaggtgatcggccgctcggtgtacgaagtggatgtgctggagggcgccgagcgcaaggacctggccatcgaacgcctgaaccagggcgcgaccatcccgcagatgcaggccgagctgcgcctgcccgaaggcggcagcaagctggtgatagtcgctggccagccgctggacctcaatgaagaagactgcatgctgttttccttcatggacctggagccgcggcgcaaggccgagaccgccctgcgccagagcgaggagcgctttgccaaggcgtttcgcctgacgccggtgccgaccctggtctgcggcgccgacagccagcagatcgtcgacgtcaacgaggcctttctcgacagcaccggttatgccgccgaggagctgctgggcaagacagtggaggaggtcggtttcatcgccagccagcaggcctgtgccagcctgttcggcgccctggagaaaagcgccgatgtgcgcaacgtcgaccttcgggtggcgaagaagggcggcgaactgctcgactgcgtggtctcggccgacaccgtggatatccagggcaagcccagctacctgctggtgctgatggacatcaccgagcgcaagcgctccgagctggagctggtgtcggcgatcgaagaggtgatgcgcgatgcctcgtggttcagccagaccctgatcgaaaagctggccaatgtacgcagcgccaaccaggccgagcagcccagtgcgtcctttaccgacctgaccgcccgcgagcgcgatgtgctggggctgatctgcgagggcctggccgacaaggagatcgccgcgcgcctgcagctggcgcccagcacggtgcgcaatcacgtggccacggtgtattccaagctggcggtgcacagccgcgccgaggccattgtctgggcccgcgaacgcgggctgttcagcggcgatcgccgtggcaaggctcagcgctgacaggtgcaaatgcaccagtgccatcagtacaaatggcgcttttgcggcgtgacggggttttttaggctgggtgatgtacggtgccgtggctgacacgggccgtgcaccgaaaatcatcagctgaaggaatgcacgatgcgtagcgaacagatcaaaggtgcggtgggcaccgcggccggcaaggcccagggcgtggcaggcgagttgctggacgatcagcagatgcgcctggagggggcggcccgccaggccgccgggcaattgcaggaaacctatggcgatgcgctggacagcgtctcccgctttgtccgtgacaaacccatggccagcgtcgccatcctcgccgggatcggcctgctggccggcctgttgtggcgtcgccgctgaggaaggcctgggtgatttcccgggcgcagttgcgccgctacatcgaacagggcttcgcgcccctggcctgtgccttcagcaccggctccgactccaccttcaccctgcggatctacgaaccgcaaagcggccgggtcgacctggtggtcaccggcatcgacccgcggctgcttgagactgaagcggacgtgctggcgatgatcgaggagctgcggtacgagttgcgcagcaactccatcagcctggtgcatctgtccggaactttacccggccccctgtaggagcgagcttgctcgcgaaaaaactcaagacactgcggtgcttcagacatgctgcgttatcgttggcctccatcgcgagcaagctcgctcctacaggaggttgcgttcaacggagcagggcccgcgtttcaggtcttggcgatcaggctcggccggcaatcgaggctcaggcgcgcgccgccgcggtcgctgctgccgacgtcgagcttgaagccatgcaggctgacgatggcggcgacgatggacaggcccaggccaaagccgccgtgggagttgctgtcgtcgacccggtagaagcgctggaacaccgccttgcgctcggcctcgggaatgccggggccggagtcgaggacttccaggcgcgtacagccgccatcctcgaccccgcgcagaatcacttcgccgcccggcggggtgaacttgatcgagttgctcaacaggttggccagggcttcgaacagcagggcgcggtcgccggtcaggctcggcagcgcggcgggcacatccagggtcagggtcagctggccttcctcggccagcggcaaataaaagtcatacagttcgcgcagcaacggcagcgggtcgagttcgacaaagcccgagcgacgctggtgatcctcgatctcggaaatccgcagcaagccgcgaaaacgcgccatcaaccggtcggcctcggccagcacctggtccagctgcaaggcttccggcgtgccctcgaccgcctgttgctgcatgcggtacagctgggcgcgcaggcgggtcagcggggtgcgcaggtcgtgggcgatgttgtcgcacacgcccttgacctcgttcatcagccgctcgatgcggtcgagcatggcgttgacgatggccgccagcatgtccagctcgtcgcggcggttggacagcggcaggcggtgggtcatgtcgccggcgactatcgcctcggcgctggcctgcagggcgcgaatgcgccgcagcggccggcgccggagcaggtgccagccggcggccccgggaatgatggtcagcgacacgccccacagcagcgcgtggaggatgatccgcgtcaccgcgaacagcgagccgttgtcgcgcaccaggatcagccagcggccatcgcgggtataggtggccaccgcatcgcaactgtcgcggggcaggttggggtcgtcggagtcgatgcagctcttgagctcgtggatctgcccgtccagcggcaggtcgtcggggatctcgcggatcggcccgctgaggtagcggcggcgctcgtcgaacaggccgtaggcgtcgatggcgcgcatgtcgaaggtcatgctggtggtcagggcctcttccagctgttcgccctggaagcgcgcgaacaggtgctggcgctgcatcagcgagtgcttggcgaggctttccaggtagccggacacctcgtagtacatgacgcccatgaggatgcagctccaggccacgaacagcgaactgtagagcgccagcaggcggctgctggaggagcgccagcccttagaggggttcagcaatgacataacccgagcctcgcacggtgcggatcagcggggtcatgccaggcggatcgatttttttacgcagacggccgatatgcacgtcgatcaggttggtgcccgggtcgaagtgatagccccagacctcctcgaaaatcatcatccgcgagaggatctggccggtgttgcgcatgaggaattccagcagcttgtattcggtgggcaacaggctcagcaactggtcggcgcgggtcgcttcgcggctgatcaggttcagctccaggtcggcgacccgcaggcaggtctcgaattcttgcaccgtgctcttgcgccgcagcagcacttcgacccgggccgccatttcgtcggaggcgaagggtttggtcaggtagtcgtcgccgccggcgcgcaggccgcgcacgcgttcgtcgacgtcggacagggcgctgatcatcaggatcggcgtcgacacgccgatggtgcgcagggtggtgacgatcgccaggccgtccagctcgggcagcatgcggtcgagggtgatcaggtcgtagtcgccgctgacggcgcgcaccaggccttcgcgaccgttatcgacccaatccacgtccagcccgtggctgctcagttcggccacgatttcgcgggctgttacggcatcgtcttcgatggtcagaatgcgggtcataggggcttacctgattgggatttcatgacacaggccggcattttgccaagaaatggccgcgggctttctaaaaaatctttcatcttcgcgccagtgccctggccaacgcagggtagcaggcgcgccgggcggagcgatcgttgatatcatccagctattactggctggcagggacgctacgcaatgcaccgacctcatgacctcgactggaaagccctgggcgcctgcctgttgctgctggcggcggccccggcgttcgccgccaatcaaccctgctccggcaaaaagggtggaatcgccggttgcgactgcgagctgttcctgtgtaacgatggctccatcagcggctccaagaagaattgttccgcgcgctacggcgacccgggccaggcggcgcgtccacaaaccctgttgcgcagcagcgacggctgctcctgtggcagtggcagtttctgcaccggaccacggggcggggtctattgcctgaccccgagcggcagcaaaagctacaagcgcaaataacccacgcagacaccgattggacaggcccgggtgcctctactagcgttgccggcacggcgccgccgggggccactagcggggacaacacggatggacaaacagcaagccaagcgccaagtcatcgccagcctcgaggccgggcgctccaagggcgaaacctttgccgcgttcgccgacagcgggatcaaggagcggctgctggcgttctggatcgcggcctattccgaccccgcgctctatgcccggcaccggcgcaaaatccagctcctgctggcggtgatgctgctgcaggcggtggtcggcgtggtggccgggttcttcctcggctcggtcatcggccccaaggctgcctgggtattcgcgctcttgggtggcctggtgccgctgctgtttgcctggggcttccataaaccttcggcgaacgcctacaccttctatgcccttctgaccctgtcgcaatttccgcggttgttcgaaggttatgccgaggacccgttggggaccctgatcggcgcggccattaccttgggggtggtgtttttcgcgatgtacgtgcgcagcctgatctttccggatttcgctttcatcgggccgcgcaaggtcaagggccgctacgtgttctccagttagggcagggcggcgcaaggcgcattccagagccttgcgctttgcttggcccagatcaatgttgttgttcgacaaacctactagattggcccggtgttcagctccgaggagctggcgtcgcgcaaccgtgatccgggtcgaagtccaggttcacggcgatgcacagcaggacgctggcattcctcttcactccgttcaaggacgaatttcctgatgcgccataccgaacgaaccttcgatatccagccactgcaacaggcggatatgaccatcagcctcaatggccagccggtgacggcggcgattggtgaaaccgtactcagcgtcatccagtccctcgggctgcgtcaggtggcgcgcaacgaccacggccagctggccggcgcctattgcggcatgggcgtgtgccattgctgcctggtgcagatcgacggccggcacaagcgccgggcctgccagacccaggtacggccaggcatgcaggtacagaccgaggtcaaccgcatcattgccgcggaggaggtgctatgagcctcaatccactgatcgtcggcggcggccccgcgggcatggccgcggccatcgaactggccgagcacggggtgcgcagtaccctgatcgacgaggcctcgcgcctgggcggcgtggtctatcgcggaccgctgcgcgacggcgtgcagctggactatctggggccgcgttattgcgaggccctggcgaaactgcacggcgccttttccgactgcgaacagatgattgatgtgcgcctcaaccaccgggtggtgggggccgaaggcaagggcagcctggtcctgctggatgccgacgagcacttgcaggaagtggcctatccgcagttgctgctggccgccggttgccatgaacgcagcgtgccgtttcccggctggaccttgcccggggtgatgctgctgggcggcttgcagttgcagatcaagagcggcgtggtcaagccgcgcgggccggtggtgatcgccggcagcgggccgttgctgccgctggtggcctgccagctgcacgccagtggcgcgaatgtagcggcggtctacgaggcctgcacctttggccggatcgccaaggaaagcctggcgctgctgaacaagccgcagctgttcctcgacggcctgagcatgctcgcctacctcaagctgcaccgcatcccgatgcattacggctggggcgtggtcgaggcccagggcagcgacggcctggaaagcgtcagcgtggcgccgtactcggcgcgttgggagccggacctgagccgcctgcaacaggtcgccgcgcagaccctggcggtgggctacggctttattccgcgcacccagctcagccagcagatgggcctcaaccacggcttcagccatgacggctacctgcgggccacggccaacgtctggcagcaaagcagcgagccgcacattcacctggcgggcgacatgggcgggattcgcggcggcgaggcggcgatgctcaccggacgcatcgccgcgctgtcgatcctgatgcagcgcgatgtgctgagcaacgaggaggccctggcgcggcgccagaagtaccagaacaaactggcctccatcacccgtttccgcgcggcggtggaccgctacaccgaacgcggcaccgggcagatcgaactgccggccgccgacaccctgatctgccgttgcgaacacgccacccgtggcgatatcgaccgcgccctggagcagggcgtgcaggacatggccagcctgaagatgcgcacccgggtgagcatgggcgactgccagggccgcatgtgcgtgggctattgcagcgaccgcctgcgccaggccaccgggcgccaggacgtgggctggctgcgcccgcgtttccccctggacccgattcctttttccgctttccctcaaccgagcaaggatgctgtgaatcatgagtaagttctacgacgtggtcatcgccggcggcggtgtgatcggcgcttcctgcgcgtaccagttgtccaagcgcaagaacctgcgggtggcattgatcgacgccaagcgtccgggcaatgccacccgtgcctcggccggcggcctgtgggccatcggcgagtcggtgggattgggctgcggggtgatcttctttcgcatgatgtcggcgcgcaacaagcgccaggcccagggttcggcggtgctggtggattccagcacgccgcatatcctgccgcagtcgttcttcgactttgccctgcaatccaacggcctgtacccgcagttgcatgaagaactgcgcgaacgccacggcatggacttcaagttcgagcgcaccgggctgaagttcgtgatctacgacgacgaggaccggctctacgccgagcacatcgtggcctgcatcccgcacctggcccatcaggtgcgctggctcgaccaggcggcgctgcgccaggcggaaccgaacgtcagccatgccgcccagggcgccctggaatttctctgcgaccatcaggtcaacccgttccgcctggccgacgcctacaccgaaggcgcgcggcagaacggcgtggacatgtacttcaacaccaacgtcaccggggtgctgcaccagggcagccggatcagcggggtgcagacggcggaggcggggctgttccattgcgacaccctgatcaacgccgccggtgcctgggctgccgagctgagcctgcaagccaccggcgcgagcattccggtgaagccggtcaagggccagatcctgctcaccgagcgcatgccgcaactgctcaacggttgcctgaccaccagcgactgctacatggcgcagaaggacaacggcgagatcctgatcggtagcaccaccgaggacaagggcttcgacatcagcaccacctaccgggaaatccagggcctggtgcagggcgcggtgcgctgcgtgccgcagctcgaacaggtcaacctcaagcgctgctgggccggcctgcgcccgggctcgccggatgaactgccgatcctcgggccgatgtgcggggtagagggttacctcaatgcctgcgggcacttccgcaccggcatcctgacttcggcgatcaccggggtgctactggatcggttggtgaatgaggaggcgttgccgctggatatcacgccgttcctcgccgagcgtttcggcttgcaggcggtggcgccgttgcaggtggcgctggcctgaggcatcgcgtctccctgaagtttttacgatgaacctgaacggtgacgcggtgctgcgataacaccgcgtcgcctggtggcctcaaaccatcggcgtactgacaaacaacgccaacccctcggcgtattccgcaaacgccttgacccttggaaaccgcgcggcatccagatgctcggccaccagcagttgggtaaagctccaggccacggccaggctgataccggcctgatcgatatcgccatcggtggccagcgggcgtttctccaattctttttccagctcgccataggccgccgccagctgcccgcgaatccgctccagccacggttcgtgccgcttctcggcggggcgcagctggtactcgtagtagatctgcaccgacttctcgcacgccgccagcgccaggccgatcagccgcaggtcatgggcccgcgcctggggcgccgccggcaacaggctacggccggccagggcttccagatagtcgatgatcaggcacgaatccatcagcaccgtgccgtcgtcgcagatcagggtcggcgccttgaccaccgggttgatgcgctggaactgctcgaaggtgcgaaacaccgacaacgcctcatgctcgaacgggatatccaggcgcttgagggtaatggcgacacggcgaacatagggtgaatcgagcataccgatgagtttcattgagcatttccttgtgcggaacaacgagacagggggggccgcggctaatttagcgacaaatgtccggggttggctatcggggggcctggttattgctgtcaatcatcgatgacctgtgttccaggtgtcatgaggcgagggtgaatgttctcgggcagcctgtcgcagggggctgaaacaggcgagcggttatatgagtgcgaagttgtaaaaggcccgccaggcgctgctacctgtgtatcgtcgataacgattggaaacccgcagccgggtgttgcgctgcgggtttaagcgtgcgaagcgatatcggctgagttctatcgttgcggtatgacaggctcgccgtgcatctcactgcgcgtgtttatttctcactccaggcgattgccttattgaacgcctcataggtttccgactcggtaaactccgcggtcggaacgatcttgagggatttgagcaggtcctcgacatcgtcctgctgcccgacttgaacgaagaactgctggatactgctcatctcgctgttggtcaggctgcccaggaagttctttccctggtagttctcggctatataaaagctgtagttattgttgccaacccgggacttgtatatcgacgtcaagccgccggcgcccaaggtgattttaccgtcgctttcctctttcatctcccgggcgatagtgtcgtgatccgtttctcccgcattcttggtgccgccgaaaaactgcggcatgccgccataaacgagattgtttcgtttaatggggaagtaaaggtaaccattatcctggtcttcggaatggagaagaattgcgtatgctttgtcggtcatgatgcgctccttgcgtgagtttgaacctcaaacttccctggcactgcgagggacttgtcctgatgcccatgaccagcacttgattgaacggcgcaagcacgattgtgctgtggagcatccgttacccagcgtaggtgagcgacgtacccgctgccggtctttcggatgaaaagcatgtcatggcgcgggagccgccagacggcttcgtagccgggtgcgacagcgctattgtttagaaaacaatggccgaacatcggcaggagaagcgctatgcatcccacccgaactgcccttgtccttgccggtggcggcagcctcggggctgtccaggtggggatgctgcgggcgctgctcgaaaagcacgtggtgttcgacctggtggtcggtgcgtcggtcggtgccctcaatggcgcctactttgccgccaggcccaatgcccgcggtgtcgccgaactggccgatttctggcgcggcttgcgcaaggccgacgtgtttccgttttccttcattgatgcgctgtcttccttgctcaggcgtcgtggctgcctgttgccctcgtcggcgctggcgagcctggtgcgccgggcgctgccggtgacccgcatcgaagacaccgaactgcccctgtatatcgtcaccaccaacctgctcaccggggccgaggagctgttgtccagtggcagcgtcgagcaggccctgctggccagtgccgcgattccgctggtgtttccgtgggtgcagatcggcgacaagctgctggtcgacggtggcgtcgccagtaacaccccgatcgccgcggcggtgtcgctgggcgcgacccgggtcatcgtggtgccgacgggattcggctgcgcctgcccacgaccgccgagcgggttgatcgccctggctttgcacaccctgaacctgatgagcatgcgccagctggtgcgggacattgagctccattcgccacaggcggcgatccatgtggtcgcgcccttgtgtccgctgggtatttcggtgttcgacttcagccagaccgagcaactgctgcaacgggcccaccagcagaccctggcctgggtcgaggaaggcggcctgatccgtaccggcgtgccgggggcgttgcgggcgcatacgcacgcggcggggtgagggtcagtcctcgaaccccgcctgttcgtgaatctcgtcgaccttcagttccaggcggtaggccacggcgatgaacagcgcctggcacaggcacaaggtggcgctcagggagcggaaggcgaaggagctgccttcgttgaccagcagcacggtgttggcgcgcttggccaggggcgacaggttgctgtcggtgatgatcagcgtcttggcctgattgtgctgggcgatgcgcaggcagtgctgggtttccttggcatacggggtgaagctgatggcgatcaccaggtcgttggggcggatgctgcgcatctgttcgcggtagctgccgcccaggcccgacaccaggtgaatgcgcttgttggtgtgctgcaggttgtacaccaggtaatcggccacggcgaaggagcggcgcaccccgaccacgtagatgttgtcggcgttgaccaccaggtccacggccttgtcgaaggccgcgtcgtccagctccaggcccaggcgctcgatgcccgacagggtagcgttgatgcattcgcgcgccagatcgccgccgctggccttctgcgacttgttggcgatcatgctgcggatgcgctgctggtagttctgtacgggggtggtcttgtgggtataagcctcgcgaaacagcgcctgcatttcgctgaagccgctgaagccgaagcgctgggagaagcgcacgatggccgaggggtgcacctcgcattcgccggcgatgtcgctgatgcggtcgaccatgatccggtcgctctgctggctcatgtagctggcgatgcgcttgagctggcgcggcaggctttcgtattcctgggtgatcagctgcagcaggcgctcggcattgatcggggggctggcgaggtcgctgtcttgcgggctctcggtcgtggccggctgatcggtgcgggacataggcaatccttctgtgcttactggcttgtacttaatgggagcgggcgggttgatccactccctgacaataggtgggctgtgcgcagtctacagggtcggcgcggggaaaatcttgagccgcgcggccacggggcgcttgctgaaacgatgcaggctgcctggagcggccttgaaaaagtttattggaaaaaatattccacgtaaaaaatttatagaaaaaatattgattggtgccggtgaacgttttagtctgcatccaccaagagcgttcggcgccttcctcggtgccacgcgcaggctgataaaaataacaggagccagcatgggccagactcgttttgccagtgggcgtcaattggatctgatttgcctcggacgcctgggcgtcgacctttacgcacagcaggtcggggcccggctggaagatgtcgtaagcttcgccaaatacctcggcggctcctccgccaacatcgccttcggcaccgcgcgcctgggcttgcgctcggcgatgctgagccgggtcggcgacgatcacatggggcgttttttggtggagtccctggcccgcgaaggctgcgacgtcagcgcgatcaaggtcgacccgcagcgcctgaccgccctggtcctgctcgggctcaaggaccgcgagaccttccccctggtgttctaccgcgagaactgcgccgacatggccctgcgcgccgaggacgtcaatgaagcctttatcgcctccagcaaggccttgctgatcaccggcacccatttctccaccgacggcgtgtaccaggccagcctgcaggccctggaatacgccgagcggcacgacgtcaagcgcgtgctcgacatcgactaccgtccggtgctctggggcctggcgggcaaggccgacggcgagacccggtttgtcgccgaccagaacgtcagcgcccatgtgcagaagatcctgccgcgcttcgacctgatcgtcggcaccgaagaagagttcctcatcgctggcggcagcgacgacctgctcgacgccttgcgcaccgtgcgttcgctgaccgccgcgaccctggtggtcaagctcggtccccagggctgcacggtgatccacggggcgatcccggcgcgcctggaagacggcgcgatctaccccggggtgcgggtcgaagtgctcaatgtgctgggggcgggcgatgcctttatgtccggcttcctcagtggctggctggaggacgccagcgacgagcgctgctgccagctggccaatgcctgcggcgggctggtggtgtcgcgccatgcctgcgcgccggcgatgccgacccgcgccgagctggattacctgttcaacagcccggtgcccatcacccggccggaccaggacagcaccctgcagcgcctgcatcaggtcagcgtgccgcgcaaggcctggaagcagctgttcatcttcgccttcgaccatcgcgggcagttggtggaactggcgcagaagggcgggcgcgagctcaaggccatcggccagctcaagcagctgtttatccaggccgtggagcgggtcgaggccgacttgcgcaagcagggcatcgaagccgatgtcggcctgctggccgaccagcgtttcggccaggactcgttgaacgccgccaccggccgtggctggtgggtggcgcgaccggtggaagtccagggctcgcggccgttggctttcgaacacgggcgttcgatcggcagcaatctgatcgcctggccccaggagcagatcatcaagtgcctggtgcaataccacccggacgacgagccgctgctgcgcctggagcaggaagcgcagatcaagggcctgtaccaggcgtcccaggccagcggccatgaactgctgctggaaatcattccgcccaaggaccatccctcgactcacccggacgtgctctatcgcgccctcaagcgcctgtacaacctgggcatcttcccggcctggtggaagatcgaggcgcagagcgccgagcagtggacccggctcgacgagctgatcgaggagcgcgatccctattgccgtggcgtggtgctgctgggcctcaacgccccggcggcgaccctggccgaaggtttccgccaggccggcaacagccgcacctgccgcggcttcgccgtgggccgcacgattttccacgaaccgagccgggcctggctggccagcgagatcgacgatgaaaccctgatccgccgggtacaagcgaccttcgtcgagctgatcgacgcctggcgcgccgcccgaccccaaacgtaaaccaaatccctgtagccgctgccgagcctgcgaggctgcgatcggtggcgcagccaccgcaagcgttgtacctgacactacgcgttgtcaggttttgcgagcgctgcatcgggatgccgcccagctcgatcgcagcctcgcaggctcggcagcggctacagcagctacgggtggaatttttcagaactgctttagaaaacaataaaaggtgcagccatgcccgcaatccgaattggcatcaacccgatttcctggagcaacgacgacctgccgtccctcggcggcgaaacgcctttgagcaccgcgctgagcgagggcaaggcgatcggctacgaaggtttcgagctcaacggcaagttccccaaggatgccaagggcgtcggcgatgtgctgcgtccgtacgacctggcgctggtctcgggctggtattccagccgcctggcccggcgctcggtggccgaggagatcgacgccatcgccagccatgtgcagttgctggcgcagaacggcgccagcgtgctggtctacggcgaggtcgccgactcgatccagggccagcgcattgccctggtggagcgcccgcgttttcacagccagcaggcctggcaggaatacgccgacaagctcactgagcttgcgcgtttcaccctgtcccagggcgtgcgcctggcgtaccaccaccatatgggcgcctacgtcgaatcgccggcggacatcgaccagttgatgagcctgaccggcagcgaagtcggcctgctgttcgattcgggccactgctacatgggcggcggcgagccgctggaggtgctgcgcaagcacatcgggcgcatctgccacgtgcacttcaaggatgtgcgcaagccggtggtgcagctggcgcgcaaccacttgtggagtttccccgactgcatcatcaacggcaccttcaccgtgccgggggatggcgacatcgatttcgccgcgttgctggacgagctgctggccgccgattaccagggctggctggtggtggaggccgagcaggacccggcggtggcaccgagttatatctacgcgaagaagggttatgacaccttgcgcgcgctgcttgatgagaggactggacaatgagcctgctggtaaaaagcgcggccaagggccggaccatggtccagttggctgagggccgattgcagtacgttgggttcgccgcctaccgcctgagcctcggcgaaagcctgccggtcaatgccggcgaccgagagttgtgcctggtgctgctcagcgggcgcatcggcatccagggcgaggcgccggggcagggcgcgttcggctgggacaacctcggcgaccggcaatcggtgttcgaggacaagtcgcccttcgccgtctacctgccacccggcagccaggcccaggtcaccgccctgagcgatgtgcagatcgccgtctgcgccgcgcccggcgctgctgcaaaaagctccgccaccaacggcctcggcccccggctgatccttcccgagagcatgaagcgcagcgtgcgtggcaagggcgccaacacccgctatgtctgcgacatcctgccggacagcgagccggcccattcgctgctggtggtggaggtgcgcacgccgtccgggcattcctccagctacccgccgcacaagcacgacaccgacgacctgccgcaccagagctttctcgaagagacctattaccaccaggtcaatccgccccagggcttcgtgttccagcgggtctacaccgacgatcgcagcctcgacgaggccatggccgtggagcacggcgacctggtggtagtgcccaagggttaccacccggtcagcgtgccctatggctacgagtcctattacctgaacgtcatggccgggcccaagcgggtctggcagttccataacgatccgcggcacagctggctgctggatctgtgatttccagcctctgaattccaacattcgaacggagaacaagaacaatgagtgacgccccggtaatcggccattacatcgacggtcaggtgcaggacagcggcgagcgcttcgccaacgtgttcaacccggccaccggccgcgtgcaggcccgggtcgccctggccagccagaagaccgtggacgaggccgtcgcttcggcgatgaaagcctttccggcctgggccgagcagtcggcgctgcgccgttcgcgggtgatgttcaagttcaaggagctgctggaccagcaccacaacgaactggcgcagatcatcacccgcgagcacggcaaggtgctgtccgacgcccatggcgaagtgacccgcggcatcgagatcgtcgagttcgcctgtggcgcgccgagcctgctgaaaaccgacttcagcgacaacatcggcggcggcatcgacaactggaacctgcgccagcccctgggcgtgtgcgccggggtcaccccgttcaacttcccggtgatggtgccgctgtggatgatcccgctggccctggtcagcggtaactgcttcatcctcaagccgtccgagcgcgacccgtccgccagcctgctgatggcgcgcctgctgagcgaggccgggctgcccgatggcgtgttcaacgtggtccagggcgacaaggcggcggtggacgggctgttgcagcacccggacatcgaagcgatttcctttgtcggctcgacgccgatcgccgagtacatccaccgccaggccacgtcccgcggcaagcgcgtgcaggccctgggcggggcgaagaaccatatgatcgtgatgcccgatgccgacctggaccaggccgctgatgcgctgatcggcgcggcctacggctcggccggcgagcgctgcatggcgatctccatcgccgtggcggtgggcgaggtgggcgaccaactgatcgagaaactgcggccgcgcatcgaccagctgaagatcggcaacggcatgcagggcgacagcgacatggggccgctggtgaccgccgagcacaaggccaaggtcgaaggttttatcgaccagggcgtggcccagagcgcgcaactgctggtggacggccgcggcttcaaggtgccgggggcggagcagggcttttttgtcggcgccaccctgttcgatggcgtgacgaccgagatgagtatctaccaggaagaaatcttcggcccggtgctgggcatcgtccgggtgccggatttcgccagcgcggtggcgctgatcaacgcccatgaattcggcaacggcgtgtcctgcttcacccgcgacggcggcgtggcccgggccttcgcccgcggcatcaaggtcggcatggtcggcatcaacgtgccgatcccggtgcccatggcctggcactccttcggcggctggaagcgttcgctgttcggcgaccaccatgcctacggcgaggaaggcctgcgcttctacagccgctacaagagcgtgatgcaacgctggccggacagcatcgccaagggtcccgagttcagcatgccgaccgccaagtaacccccttcaacccgttgctctggagaacaagaataatgagccagcccctgcgtttcgccctgaatcgtatggttgccccgcgtttgagcctgccggcgttcatcgagctggcggtgaccctgaaagccgatgccatcgagatccgcaatgaccttgcgggcgtggaaatcgaagacggcacgccgccgcagcaggtgcgccagttgtgcgcggcccacggcatccaggtgctgtcgatcaatgcgctgtaccccttcgatgtctggaacgccgagcgtcgcgcccaggccctgaagcttgccgcctatgcccgcgattgcggcgcccgcggcctggtgatgtgcccactgaacgaccgcgccgatgcgcgcagcgacgccgagcgcagcgctggtttgcgcaccgccttgactgagctggcgccgatcctgcgcgagcacgggattctcggttttatcgagcccctgggtttcgaggagtgttccctgcggcgcaagcgcacggcggtggaggcgatccgcgccagcggcgggctggatgtgttccgcctggtgcacgacacctttcaccatcacctggccggtgagcaggagttcttccccgaactgaccgggctggtgcatatctccggggtcgaggaccgcgaggcgcccctggcgagcatccgcgacggccaccgggtgctggtgggcgagggcgacatcctcggcaacgcggcgcagatcgaggccctgctcgagcacggctacagcggccacctgtcgttcgagccgtttgccgatagcgtgcatgggctggcggatatccagcgggcgatcggcgcgagcatcgaccacctcaagcaggccctggcataacaccgttccctgtagccgctgccgcaggatgcgatcgaccgcgtagcgggcgcgctcttcaagatcgccgaaggtcccgcggaccttatcgcagcctgcggcagcggctacacaagcaggaggcaagagcagtaagaacagcaagggcggtcgcctcaagcaggccctggcccgacaccgcttcctgtagccgctgccgaaggctgcgatcgcgaccgaagggcgcgcaaggcctcgggttcgctgaaggcctccggccttatcgcagcctgcggcagcggctacaaaagcaggaagggcgcaaagcagtaaaagcggcaagggcaatagcagcaagggcggtaagcgcatcaaccttcaccgtattgatcaaggtgcaagcatgactacgacacgactgaccatggcccaggccctggtgaaattcctcgacaaccagtacgtcgagatcgatggggtgcagagcaagttcgtcgccgggatcttcaccattttcggccacggcaacgtgctcggcctgggccaggccctggagcaggacagtggcgagctgttggtgcatcagggccgcaacgagcagggcatggcccacgctgccatcggtttcgccaagcagcacctgcggcgcaagatctacgcctgcacctcgtcggtgggcccgggggcggcgaacatgctgaccgccgcggcgaccgccaccgccaaccgcattcccttgttgctgctgcccggcgatgtctacgccagccgccagcccgacccggtgctgcaacagatcgagcagttccacgacctgagcatcagcaccaacgatgccttcaaggcggtgagcaaatactgggaccgcattaaccgtcccgagcaactgatgaccgcggcgatccacgccatgcgcgtgctcaccgacccggcagaaaccggcgcggtgaccctggccttgcctcaggatgtgcaggccgaggcctacgattacccggattacttcctgcaaaaacgcgtgcaccgcatcgagcgccggccggccaccgcggccatgctcgaggatgccgtggcggcctttgccggcaggcgcaagccgctgatcgtctgtggcggcggggtcaagtattccggggccaacgaggcgctgctggccttcgccgaaagcttcggcattcccttcgccgagacccaggccggcaagagcgcggtggtctccagccacccgctgaatgtcggcggtatcggcgagaccggttgcctggcggccaacctgctggcgaaagaggcggacctgatcatcggcatcggcacccgctacagcgatttcaccactgcctcgaagtcgttgttccgcgccgatgcgcagtttctcaacctcaatatcagcccctgcgatgcgctgaagctcgacggcgtgcagttgctggcggatgcccgggaaggcctgaaccggttggccgaagccctggcgcgcagcgattaccaggccgcctggggcgaacagatcggccaggcgcgggcgcagctggacgcggaggtggaccgggtctatcaggtcgaataccacgccgacggttttgtcccggagattaacgaccatatggacccggcggtgctgcgcgaatttatcgagctgaccggttcctgcctgacccagagccaggtgctgggggtgctcaaccagaccctggccgacgacgcggtgatagtcgctgccgccggcagcctgcccggcgacctgcaacgcagctggcgcagcaagggggtcaacacctatcacgtcgagtacggctattcctgcatgggctacgaggtcaacgcggccctgggggtcaagctcgccgagccccagcgcgaggtctatgccctggtgggcgacggctcctacctgatgctgcattcggaactggccacctcgatccaggagcgacgcaagatcaacgtggtgctgctggacaacatgaccttcggctgcatcaacaacctgcagatggaacacggcatggacagcttcggcaccgagttccgtttccgcaaccccgagaccggcaagctcgacggcggcttcgtgccggtggacttcgccatgagcgcggcggcctatggctgcaagacctacaaggtcaagaccgtggcagagctgcgggcggccctggccgatgcgcggacccaaacggtgtcgaccctgatcgatatcaaggtcctgcccaagaccatgatccataagtacctgtcctggtggcgggtcggggtggcgcaggtgtccaccagcgcccgtaccgacgcggtggccaaacaactcaacgaacgcctggccaaggcccggcagtactgatcgctcgaataacaacaggctcgaacaacctattgctcgaacaaaaaacaggagtgcattcatgtctttgaaactgggcgtcatcggtaccggggccatcggccaggaccatatccgtcgttgcagccagaccctgctgggcagccaggtggtggcggtcaccgatatcaatcttgcgcaggcggcgaaggtggtggccgagctgaagatcgccgccgaggtgtatgccgacggccatgcgctgatcaaggcgccggaagtcgaggcggtgctggtcacctcctgggggccgagccatgaagagttcgtcctggccgccatcgccgccggcaagccggtgttctgcgagaagccgctggcggtgaccgccgccggctgccgcaagatcgtcgaggccgagatggcccatggcaagcgcctggtccaggtcggcttcatgcgcccctacgatgccggctaccgcgcgctgaaggcggtgatcgacagcggccggatcggcgagccgctgatgctgcactgcgcccaccgcaacccgcgggtcggcgagaactacaagaccgacatggcgatcaccgacaccctgatccatgagctggacgtgctgcgctggctgctggccgacgactatgtgtcggtgcaggtggtgttcccgcgcaagtcgaggaaggcgttggcgcacctgcgcgacccgcaggtggtgctgctggaaaccgccaagggcacgcgcatcgacgtcgaggtgttcgtcaactgccagtacggctacgacatccagtgcgaagtggtgggcgagaccggcatcgccaagttgccggagccgtcccaggtgcagctgcgcagcgaggccaagttgtccaacgcgatcctgatggactggaaggaccgctttatcgccgcctatgacgtcgagctgcaggcctttatcgacggcgtacgggccgggcaggtcggtggcccttcggcctgggacggttatgccgcggcggtggccgccgatgcctgcatcgaggcgcagaacagcgggcagatcgtcaaggtcgaacaaccgccgcgcccggcgttctatggctgattttcttttgtaggagcggccggtcgacgctcctacaggttacacagcaaccctgtagccgctgccgaaggctgcgatcgcgaccgaagggcgcgcaaggcctcaagatcgctgaaggccttcggccttatcgcagcctgcggcagcggctacaggtcaccacttcagattcggggagaacataaaaatgcgtatcgcactggacccctacatgtaccgccacctgccgctgggccagatgaccgacaaggctgccgaactgggctatgagtacatcgagctgtcgccgcgcgaggatttcctgccgttctacaaggcgccccgggtcgaccgggcgcggatcaaggcgtttcgcaaggccctcagcgacagcggcgtgcagctctcttcgctgttgccgatgtaccactgggccgccgccgacgaaggcttgcgcgtggcggcggtgcgcaactggaagcgggcgatccagatcgccgtggaaatggactgcgagctggtcaacagcgaattcaccggccagtcggacaacccgttggtgtgcgagaaccagttcatgcgctccatggacgagttgattccggagttcgagcgcgagggcatcaagctggatatccaggcccatccctatgatttctgcgagcgcaacaacgagtcggtggacatcattcgcggcttcgaccgggactggatcaactacctgtacgcggcgccgcacacctttttctacgacgacggcaagggcgacatcgcctcgatgctcaagtacgcgggcagcaagctcagccacctgatcatcgccgacacctacaaccacaaggcgtcttcgagcctgcgctatatcgtcaacccgccgggcgtcaccgccaccgtgcaccagcacctggacatcggccagggcgaggtggactggacggcgttcttcggtaccctgcgcgagatccagttcgacggcatcgccacgatctcggtgttcgcctgggaagaccgcccggacgagtccaaccggatgatgctggagcgggtcagcagcgaactgtgccgctgacacaaacgcagccgcctgtagccgctggcgcagcctgcgatcgaggacaacgtcctcgcaaaacctgccgacgcgtagggaactgaaagaccgcatgtgccgtgattgcgaccactgcgtggtcgatcgcaggctgcgccagcggctacagggctacagggctacagggctacatcgagttctatataaggagggctttgcgatgcgcattggtttggtggggtacggccatggtggccgacattttcacgcgccgctgattgccagcctgcccggcgcgaccttcgtcggcgtggtcaccctgtcggccgagcgccgacaactgctggcggcggagcaccccggggtgcgggccttcgacagcatcgagcaactggtcgcggccgggatcgacgggctggtgatttccaccccgctggagggccgtgcggcgctggtgctggaagccatcgagcgcggtgtcccggtggtcagcgacaaacccttcgccagcgacctcgaacaggccaaggcgctgatcgacgccgcgcaaacccgccgggtgccgctgagcgtgtacatgaaccggcgctgggattcggacttcctcaccctgcgcaagctgatcgccagcggtgccctgggcagcgtcagccgcttcgagtcgcgggtcgagcgctatgtgccgcaggccgtgggcaataccagcggcggcgggtttctgcgcgacctcggcagccatctggtggaccaggccttgcagctgttcggcccggtgacccgggtctacgccgagttgcaatacgccccccaggcgccgacctgcgaccacgggtttttcctcgccttgagccatgccaatggcgtggtttcacatttatccggtagttgtctgcagaactgccaggggccacggttccgggtcagcggttcggccggcagttatacggtcgagggcctggacggccaggagcaggcgctggtcgccggcctgtcgccgcagaccgagggcgagcgctggggcgtcgaggaacaccggcgttggggctggttcgagcagggcgaaatccgcgagcgggtggcttccgagcggggcgactggttgcagttctataaacagtggcaggcggcgctgcaagggcaggggccgctgccggtgaccgcggccgaggccctggccaccacccgcgtgctggacgccgcgcgcctgagctggcgccagcgccaggtggtggaaatggccgatttccggctgcagaatgaatttggaataaaattctaaaatgagttgatatagaaattattttccaataaagtcatttccaggttgccgactagcagggtttcgccagcgtcacaggccgatttcagatccgccttgaaccgagtgaaacccgccaacaaaaacaaaacaggtaccgtcgatgaaaaccttcagttccgttgtgcacctgcttcgccgcgcattgccgcgccgccatccattgtccagtcgaacaccccgccaaacaccccggcatacctttgtcgtccagtccctggtccgcctgctttgcgtcgaacgcaagggcgcgctggtgtgctgcatgcccggcgcgccgatcgtgcgtctgcctcactgagtggtttctgcgccttatccataaaacctacaagaatgtggagaaagacctttcatgaagaccaagacccgtttcgccacgcttgccctgtccctgctgctgggcagcggcacggcgttcgccgacctgaagatcggcgtgagcatgtcgcagttcgacgacacctggctgacttacctgcgtgaatccatggaccagaaagccaagtcgctgccggacggcgtcacgctgcagttcgaggacgcccgggccgatgtggtcaagcaactgagccaggtggaaagctttatcagccagaaggtcgacgccatcgtggtcaacccggtggacaccgcggcgacccgcaagatcaccgaagcggcggtcaaggccgggattcccctggtctacgtcaaccgccggccggacgacctgaacctgcccaagggcgtggtcaccgtggcctccaacgacctggaggccgggcagatgcagatgcagtacctggccgacaagatgggcggcaagggcgaggtggtgattctgctgggcgacctggcgaacaactccaccaccaaccgcaccaagggcgtcaaggaagtgctggccaagtacccggggatcaaggtcgagcaggaacagaccgggatctggctgcgggacaaggccatgaccctggtcaacgactggctgacccagggccgccagttcgatgcggtggtggccaacaacgatgaaatggccatcggcgccgccatggcgctgaaacaggccggggtggagaagggcagtgtgctgatcgccggggtcgacggcacgcccgatggcctgcgcgcggtgcagaagggcgacctggcggtctcggtgttccaggatgccaagggccaggccgacggctcgatcgacaccgcggtgaaaatggccaggcacgagccggtggagcaggcggtatgggtgccatatcgcctgatcaccccggaaaacgtcgcccagttcaaataagcctggttcaaaagagcccgcccgttccacaacaaccataagccggcggggtggcccagctgccccgcggatggagtacctgatcatgttcgcttcagcgactgcttcgagcatcccgacggcggctgcgcagcccgccgctcagtctgcccagtctgtgtccgagcagcagccctatctgctggaagtcatcaacgtcagcaagggtttccccggggttgtcgccctgtccgatgtgcagctgcgggtgcgtcccggcacggtgctggcgctgatgggggagaatggcgcgggcaagtcgaccctgatgaaaatcatcgccgggatctaccagccggacgccggcgagctgcgcctcaagggccagcgggtgaatttcgagacgccgctggcggccttgcaggcggggatcgcgatgatccaccaggaactcaacctgatgccgcacatgagcatcgccgagaacatctggatcggccgcgagcagctcaacggcctgcacatggtcgatcaccgcgagatgcaccgctgcaccgcgctgctgctggagcgcctgcggatcaacctcgaccccgaggagcaggtgggcaacctgagcatcgccgagcggcagatggtggagatcgccaaggcggtgtcctacgactccgacatcctgatcatggacgagccgacctcggccattaccgagaaagaggtggcgcacctgttctcgatcatcgcagacctcaaggcccagggtaagggcatcatctatatcacccacaagatgaacgaagtgttcgccatcgccgatgaagtggcagtgttccgcgacggcgcctacatcggcctgcaacgggccgacagcatggacggcgacagactgatctcgatgatggtcggccgcgaactgagccagctgttcccggtgcgcgagaagcccataggtgagctgctgatgtcggtgcgcgacctgcgcctggacggggtgttcgagggcgtgtccttcgacctgcacgccggggagatcctcggcatcgccgggctaatgggctcgggccgcaccaacgtggccgagacgattttcggcattacccccagcgacggcggcgagatccgcctcgacggccagccggtgcgcatcagcgatccgcacatggccatcgacaagggctttgccctgttgaccgaggaccgcaagctcagcggcctgtttccctgcctgtcggtcctggaaaacatggagatggcggtgctgccgcactatgccggcaacggtttcatccagcagaaagccctgcgcgccctgtgcgaggacatgtgcaagaagctgcgggtcaagaccccgtccctggagcagtgcatcgacaccctgtccggcggcaaccagcagaaggccttgctcgcccgttggctgatgaccaacccgcgggtgctgatcctcgacgaaccgacccgcggcatcgacgtcggcgccaaggccgagatctaccggctgatcgcctacctcgccggcgaaggcatggcggtgatcatgatttcctcggagctgccggaagtgctgggcatgagcgaccgggtgatggtcatgcacgagggcgagctgatgggcaccctcgaccgcggcgaagcgacccaggagaaggtcatgcaactggcttcggggatgtccctggtccactagccggtaaacgtatcaaggccatcggcgaggtgtgttcgccgccggccatacaagaagagggtgaaggcttatgaacgcgatactggaaaacaaacccgcggcggcgccagccagaacgcgccggcgcctgcccaccgagctgagcattttcctggtgctgatcggcatcggcctggtgttcgaactgttcggctggatcgtgcgcgaccagagcttcctgatgaactcccagcgcctggtgctgatgatcctgcaggtgtcgatcatcggcctgctggccatcggcgtgacccaggtgatcatcaccaccggcatcgatctgtcgtccggctcggtgctggcgctgtcggcgatgatcgccgccagcctggcgcagacctcggacttcacccgtgcggtgtttccgtcgctgaccgacctgccggtgtggatcccggtggtggccgggctgggggtagggctgctggcgggggcgatcaacggcagcatcattgccatcaccggtatcccgccctttatcgccaccctcggcatgatggtctcggcgcgtggcctggcgcgctattacaccgaaggccagccgatcagcatgctctcggattcctacacggccatcggccacggcgccatgccggtgatcatcttcctggtggtggcggtgatctttcatatcgccctgcgctacaccaagtacggcaagtacacctacgccatcggcggcaacatgcaggcggcgcggacctcggggatcaacgtcaagcgccacctggtgatcgtctacagcatcgccgggctgctggcggggctcgccggggtggtggcctcggcgcgggcggcgaccgggcaggcgggcatgggcatgtcctatgaactggacgccatcgccgcggcggtgatcggcggcaccagcctggccggcggcgtggggcgcatcaccggcaccgtgatcggcgcgctgatcctcggggtgatggccagcggtttcaccttcgtcggcgtcgatgcctacatccaggacatcatcaagggcctgatcatcgtggtggcggtggtcatcgaccagtaccgcaacaagcgcaagctcaagcgctgatccctctgttttactgtaggagcgagcttgctcgcgatggcggtcaacgataacgcgtagggtctgatggaaacgcggtgcattgacgcccatcgcgagcaagctcgctcctacagggaagcgtgcagaatcccggcagcggcaggcctttttcgggcctgccgctgccgtttgtcttctaaaagaccccggccgatggaatttcttgttataaacgcactccgataaccgccgccaaagccagccctggcgggctttcagggcttatcagacaaatctgatgtcatttcagttgctgacgcctcgaaccggccttagactgccgcccctcgtaaattgagtgccgggtggcgcttggaatgtatggcgcctttctgatgccccgaaagggggcacggaaaacagctttaattcgccttaatgcacgtattttttatagagaaatcaatgacaaaggaaaagttgctggccatgccggcggatgactacatgaacgccgagcagctggcttttttcactgagctgttgcaggccatgaaggtcgaaacccacgagcgcatcgaacagaaccgaatcgccattgagagcctggacaccccggccgaccctgccgacgcggcttccgtagaggaagagcggacctggctggtcaacgctatcgaccgcgaccagcgcatgctgccgcagctggagcaggccctgggccgtatcggcgacgacagcttcggctggtgcgatgacagcggcgagccgatcggcctgaaacgcctgctgatcagcccgaccaccaagtactgcatcgaagctcaggaacgtcacgagcagatcgacaagcaccagcgtcaggcctgatcgccaagacttctccccctcgcgggcaagccccatcccaaggtcgtcgagacgcctgggatcggcggcttgcccgcgagtcgtttgtgggcgtctttaaagcccgcgcctttctattgatctgctgcaaagctgcgactaatggaccatggataatggctttttagtggcgttcaatgcaggccaaataattagaaaagcgtggggtaatccagatgacgcaagacggatcttcgccgactgccatggcgcaaccgctgtcagtagtccaaagcacccggcgctggcaggttccaaccctgcaaagcagcgccttgctgctagtgctgtacgtcctgtcccaggggctgctttctttctacctcgccgtgccgctgatgctgctgatcgtctggctgccgctcttgcgcaggcccaaggccgcggcgccggcgagcagcgtcgataaccgcgagatcgccgcgctgacgcgcgacctgtcctgcagcaccagccataacgcgctgtcggccgccggcgtggcctattcggtccggcaattggccgggcgggtgcagtcgcaactggactcggcggcgcgcatcgtcagcagcgccgaggcgatgatccacaccgagcaactggccgcgcaactcagccagcaggccctgagcgccgccagcgaagcccaccgcagcagcgccgaaggcagcgcggtgctgggcgaatccatcacccgcatgcaccgtctcagccaaagcgccaatgacagccggcaactgatcgaagccctgagccagcgcagcgaagacatccagcgggtggcgctggtgatccagtcgatcgccagccagaccaacctgctggcgctgaatgccgccatcgaggcggcgcgggccggcgagcatgggcgtgggttcgccgtggtggccgatgaagtgcgcggcctggccgggcgcacggccaccgccaccgacgaggtcggggtgatggtcggcgatatccagcagcgcacggcccaggtggtggagcagatccgccagctgtccagcgacctgaacaccggggtcgagcaggtcgagtccaccggccagcacctgcagaacatcgcccggctggcggccggggtggaaagccaggtcggcgagatcgcccgcggcgccgagaccaaccgccagcaactggacagcctgttccatgccgtggagcaggtgcgcggcgatctggcggtgagcgaccagcagacccgccgcctggccgaggcggcggcgcagatggaagggcaggcggagatcatcagcgaacgcctggccgaggtcggcctggatgactaccaccagcgcatctacgacctggcccaggaaggcgcccggcgcatcgccgagcagttcgaggcggatcttgcggccaaccgcatcagcctcgacgacctgttcgaccgcagctaccagccgatcgccaatacccagccggtgaaataccagacccgcttcgaccgttacgccgatcaggtgctgccggcgatccaggagccgttgctggcgcgtcacgaaggcctggtgttcgccatcgcctgcacgccccagggctacgtgccgacccacaacaaggtgttctcgcagccgctgaccggcgacccgcaggtggataccctgcacaaccgcaccaagcgcaagttcgaggaccgcaccggcctgcgctgcggcagccaccagcagccgttgttgctgcaaacctacacccgcgataccggcgagctgatgcacgatttgtcggtgccgatcagggtcaagggccggcattggggcggcctgcgcctgggctacaaaccggagcaggccgccgcagccgcgcgcgattgaagccgggcagggccggtcattgttaccggccctgcaacgaagctgtgccagagatggctttttcccagcattggaactcattagtatgagcgacattgttagctagctaactagttaccaggagaagtcctcatgcaaagcaaagtcgatgtcgcagtgatgattggtagcggtgtaccggccacctttcgcgcagtcgggctgaatgtgtgctgggtcgtgctggtcaatggcgagcgccgcggcgcgccgttcgccagccgggaagaggccctggagtgccaggcgtcgtggctggcccagctggcgcgggacaaggccggacacccagtgttcagccgttcggcctaatggtgctgatgcaggcgcaggttgagctcgtcgaccacccgcgcccaatcggcgtcttcgcgcagttcttccttgagaaaggccgcctgccggggcgtccagaagtcggcgtcgatcatccgcacgtccgcgggcagtggtgaatgtcgctcgatgaacgcgtcgatggcgttggggctggagtccaggccgagttgatcgaacagccctttgaggtcgtgggtcggcgagtccatgttgatctccttgctgagggattatccgggcattgtcttgcatctgaggcgccgggcaaccaggagttcgatcggcttgccgggggctcagacctcgctgccgatcaccgcgctttcggcctggaacagcgccacctgggccatcgacaaggcgctgctggcggcctgcgcctgggcccgggcggcggacaatgcctgcatgtgcgcgtcggttgtgcgatgccgggcggcgctttgtaccatcgccaggcgctcgttggccttgcgcagcctttgctgcaattgttcgatctgtttgcgcagcagcttgatgcgtttctttttcgcttcgagcacaccgtcgggcgcggcattggttgcccgggtgatcgcggtgcgcaggtcaaacggatcgctcgccgggctttcgctggccgccgtgccgggcagggcgaactcggccagggacggcaggcgggcaggtgggttgaggtcgatcatcatggcgctctttatcggaaggctcgccaatatgtcggtcgggcgcggcaatcctttattgccgttcagaggttcagggcgccctggtcgacggcctgcttgagggcgcgggcggcttccttggcggcggcttcggccagttccgcggtcttgaaccagcggtccttttccacctggtggcagcgcacggtgcgcagcggtggcttggcgcgcatcacgatcacggcctggaactcgccctcgacatcccgggcctcgccatggatgaaaaactcgcctatatcgaattccgtcacgtccgactttcccctggaaattatgctggtgaagcctggccgctggccggcttcaaggtcgcggcagtatggcagttgttgccggtcgatggctgagttaagtcacgcaagtggctgaccggcagggtgaaagaggttttttcagcgatttgctaacgcatgggttgctctgaatacataaagttgctctagaattgccccggcagtcagagattgatgtttacctgcagcactcccgtcccattaagggtgacgaaaggatcgtgaggttttccgatcgacagtgagtgcgcagctttctcggcgagctggaatcacttcttctgcgcttgatgcgggccaaacggtccggtagtccttccggtctttctggggaggggtgctccggtgtttgcgcctacgcgttggcgggtggtgctttttcggattgttttcatgtggagtcacggcgccggttcggccgcctttttctgctgtccgtcgtttacgcgggcagagtcattttcagtttcggggatctttccttggcagtaagtaatcttgatatgcacgcgttgttcgtcctgggcgacttgcgcgcaaagttggtcaaacagttccagtcccgtttcgtctacatcaccgaacagacgccggaaggcatttacgtcgccgaaatcgataccgagacggcgctggtcgtggacgacaagccgcgcctggaactcaaggtcggcgaccatttccgcgccgcggtcctgcccagccgtgagggcggcaagttcgaaatccggtttcgcgagatcaagctggccgtctacggcctgggcgaatacgcctttgtcagcaccgccgacggccacgccatcctgttcaaggaaggccacagcgtggtgacggtattcgccgccaaccagcagttgcaggaaggcctgaccaagaccctgaaagccgtgaccggcaaggccgccaaatggcgcaagggtgaactggtgagcttcaaggccagcgagtgagccgcgccgaattccaccagcagcatcttgcgcgcgcccgcgccgaggcccagcgcctgttcgaacgcaaggccatgctgcaaggcgcctggctggcctgggtggcctcgcagctgtatgtcctgcagccggcggcatacgccagcatggtgcgccgcgagttgcagcgcctgcaggagcagggcgaaaactgaagtcccctcgaaagcaggaacctctactacagtcagatgactcaattagtcagaggcttgcggtccccgatcgcgagaccatcctgcaacgctgtgaacagctaaaggggcacaggcatgaaaggactgcggacactgctgggcggcacgctgcttggcttgggtattttgctggcgcccgccggcgcttcggcggcaccgtcggcacagccggcacaggcgccgatccacttcgccgacctgaactgggaaagcggcagcctgatcaccgatatcctgcgcaccatcgtcgagaagggttacggcctgccgaccgacaccttgccgggcaccaccatcaccctggaaaccgcgctggccaataacgatatccaggtcatcggcgaagagtgggccggacgcagcccggtgtgggtcaaggccgaggccgagggcaaggtggcggccctgggcgacaccgtgaagggcgcgaccgaaggctggtgggtgccggaatacgtggtcaagggcgacccggccaagggcatcaagccgctggcgccgggcctgcgcagcgtcaccgacctcaaacgctacaaggacgtgttcaaggacccggaaagcccgggcaaggggcgttttctcaacagccccatcggctggacctcggaagtggtgaacaagcagaagctcaaggcctatggcttgaccgacagctatgtgaatttccgcagcggttccggcgcggcgctggacgccgagatcacttcatcgatccgtcgcggccagccggtcctgttctactactggtcgccgaccccgttgctcggccgcttcaagctgatccagctggaggagccgccgttcgatgccgaggcctggaaaaccctgaccgacgccgagcaccccaatccacgccccacgcgttcgctggcctcgaagctgtcgattggcgtgtccacgccgttccagcggcagtacccgcagatcgccgagttctttagtaaggtcgatttgccgatcgaagcgctgaacaaggccctggccgagatgagcgagaaacacacgccaccccgggaggcggcgcgggcattcctcaaggcgcatccggacgtgtggcgggcgtggctgcccggggatgtggcggacaaggtgagtgccagcctggattgagagattgaggtgagagtgagatcgctatcgcgagcaagctcgctcctacagggttacgcgaactgtaggagcaagctggctcgcgatgcctttagaagcggctctgcaccgccagctcgaaggtccgcggcgtacccaggtagtaagccggcgacacatgggcgaactcggcgtagacctcgttggtcaggttgcgcacccgcccggtgatcgaggtgtggctgtcgagcttgtaggtcaggaaggtgccgtacagggtgtaggagggcacggtcagggtgttggccgtgtcggcgtacaccgaggccacataacgcgcatccaccccggtctgccactgcggcgccaagtcataggtcagccacaggttgccgacccggtccggcacgttggtcggggtattgcccttgcgggacaccaccacgcccgcggcgttcttctcggtgaacgcgtcgtactgcgcatcgacccaggcgaagttgccctcgagcagcagcttcggggtgacccgcagcgagctggccacctcgatgcccctggaggtctgctggcccaccgggatgctcagggtcgggtccagcgggtcggtcaccgcgaagtccttgcgctcgatacggtaggccgccagggtcgccgagcctcggccgtccaggtaatcgaacttgctgcccacttcccattgcttgcccgtggagacatcgaagtcctgggtggcgctgttgggctgttcggcggcagtgctgtattgcacgtagacgttggcgccgggcaggaactggtaggtcaggccgacccggccggtgaccggctcccagctgcgcttgaggtgccgcgggttgctcgccgtcacctggcggtggttggtcacgtccaggtcgatgtggtcgtagcgcaggccgctgagcagggtcagccggtcggtcagggccaggcgattctcgacgaacagcgcctgggtggtgacctcgttggtcttgtcggcgacaaagccctggcgggtgcccggcaggtcgtagaaatgccccggctggtagttgttcgggtcgacgctgttggcagccttgacgttcagcggcgagttggtggtgcggttgaccttgtactcgaagccgccggaccaggtgctgtcgaggccgaagagcgagctgtcgtggcgcagttcgaactggttgccgtcctgctcgccctggtgccgcacctgataggccgtggagcggttcaccgcgctgttgtcggcgttgtactggtaggtttccaggttgcggtaatcgcgctgactgtccaggtgatagagggtgttgcgcaggctggtgctgtcgttgatccggtagtcgacgatcgagcgcacccagatcgtgcgctgctcgtagcggccgtcctcgacgttgtagttgttgaagcggttgtgcttgtcgatcttcaactcgccggccttggggttgagcaccggggtgccccagtacgggctgtcctcgtgttcgtcctggtattccacggccagggtgtgggacaggttcggtgtcaggtcgctgagcagggaaaacgccaggctccaggcatcccgttcctggcggtcgatgtagccgttgctggtgttgtggctgacgtcgaggcgggcgtagtgctgcatctcgtcgccggcctcactgagggcgtggttgaggccgaaggcggtttgcgtggtgtcgtagctgccgtagctgacccggccctcgatggcccgctcctggcggtcggccagcttggtcacgtagttcagcgaaccacccacggagcctgcgccgttgaccagcgaagaggggccgccgagcagttcgacccggtcatagatccaggcgtccaccggtcgcgccagaccgctggacacgttgatgccgttgaacatctgggtgatctggctgttggtgaaccacggtacgaaataaagccgccgaaccccggcggggcgctggcattgaccccgggcaggctgttggcggcgtcctggaagttctgcgcgccgcgccgctcgatatcgttgcggttggccaccgccaccgaggccggggtttcgcggacgctcaggcccaggcgcgaggccatgccgctggactggtcgagggccaggccgggttcggcgggttgctcgccgtcgatggtgatcggcgccaggtcgacgctggattgcgcccaggcgctgacggacaggcagccgcacaggctggccagcaggggaatgtgtttcatcggtagatcctgaattcttggctaggaagcaacccacgaacaaccaccgtgggttaaggcacggggcgggctgatgacaaggacgaaagactcaggcgaaggcgggcggcgcgcgtgggtgggccgcgggccaggtgaagcgggtggggacatcggcggtggcgcgcggcgccagcggtgggctgtggtgctgcggcaggatcgccagggtcaggctggagttgaacgccgggcccatgccgccggtggagcacagcggacaaccgaaggccttggacagggtcggcagcgattcgtcgaccgggttggaggaggccggcgcctgggtgcgcgggtccaccgtacagaactggccgccgatcccgttgagctgctggccgaccatttgcccgtggccgatgctgcaggcgaacacgttgaacaggacgcagcaatagagcatccaggcaacgagcgagcgatcggttcgggctaatttcatggggcggcactttaccatcgcaggcgacgaacgtacttacaaaaacgtgcgggtgggtccattcttcagcgacatttttttgccatggacgtttgcatatgaatgttttgatcgcgcaagggatggccggagccttcctgctgatcagcctgatccacctgtactgggccgccggcggcaagcgcggcagcgacgcggcgattccccaggtgccgggcaggaggccgggcgagctggagccggcgttcaagccctcggggttcgccaccttgctggtggcggtgggcctgctgctgatcgcgatgctggtgtgcctgcgggtgggcctgtacctgccgacggtgagccacccggcgctgcaatgggtgatcagcgcgatggccttgctgatgttcgcccgggccatcggcgattcgaacctggtggggttcttcaaggaggtcagcggctcccggttcgcccggctcgacaccctgttctattcgccgctgtgcgtggtgctgggggcggggctgctggtggtggcctggaattgagtaccctgtaggagcagccggtcgacgctcgattgctcgcgatagcggcgcccctgacactccgcggggcctgcatcgccagcaagctggctcctacagatgtattgcgatctggcagtggatcagctgccgctttcgctgcgccggctgctgacctccgctggtacatcgtcgccggccatgcgcttgcggaacagcgccgcccgcgccagcagcagggtggtcaccggcacggtgatcgacagcaggatcgggatcagccaggcgtgcagcaccggccccgacttcatccccgagaaatacaggatcgacgccagggccacgcaccaggcgcccagggtcgaggccagggccggcgggtgcatgcgctggaagtaatccttcatgcgcagcatgcccagggcgccgatcagcgcgaagctgctgctgagcaccagcaggatcgccaccggtatctcgatccaccacgacagttcactgacggcattcattcgatcacctcgccacgcaggaggaatttggccagggcgaaggagccgacgaagccgaacagggcgatcagcagcgccgcctcgaagtaggtgtcgctggcgtagcggatgcccagcaccagcatcatcagcatcgccaggatgtacaggtagtccagggccaggacccggtcctgggccgaggggcccttgaacagccggaccagggtcaggaccatggccacggaaaacaggaacaggctgaacagaatcgcattcgcgagcagggcactcattcgaagatctccatcaacggacgctcataggtcgtcttgaagtgctggatgaaagccgcttcgtcgtccaggtcgaacacatgcagcagcaggatgctgcggtccagggacagctcggaccacaccgtgcccggcaccaccgtggtgatggtcgagagcgcggccaggccgttggcgtcgcgcagctccagggggatcttgacgaagcgcgagcgcggcgggcggcgcccggcgttgagtacgccccaggccacggccaggttcgacagcagcacatcgcggccgaccaccaggagcaggcgcaggatggtcgcggggcggcggatgcggatcggcaacgggcgcaacggccgcatcatcagcggcgcgcagaaccccagcagggcgccgagcagcaggttgccggggctgacggacaggttcagcaccagccacagcagccacagcgccagcgacaaccagggagcggggaacaggcgcttcatggctgcacctcctgcaacgccgcctgggcctcggggctggggaccgcccgggtgccgagcacggccatcacatactgctgcggatcgttgaggctgtcggcggcggcctgggtaaagcgcagcagcggctcggccttgacggtcagcagcatgcacagcccgagcagggcgatgatcggcacgcactcgaagcgccgcagcagcggcgacggccgttcttccggagtccagaagcgctggatgcccaggcgcgaaaaggcgatcagcgacgccaggccggaaaggatcagcaaggccagcaggccccaggcggcgccggacaacggcgcatccgtggcctggcccagccccagcgggttgagcagggcgccgatcaggctcagcttgccgatgaaacccgacagcggcggcatgccgatgatcagcagcgcgcaggcgatgaagctcaggccgaggaaggccatggtccagggaatcacctggccgaccacggccttctgctcgtcgtcgaggttggtacccggagggggttgcagcgactcctggggccggggcagggtttcgacttcatcctcgagggggatctcgttggccgagcgcgagcgttcgatcagctccgccaggaggaacagcgcgctcagggccagggtcgagctgaccaggtagaacagcgcgccggcaatcagcttgggctgggcaaaaccgatcgccgccaggaggatcccggccgagaccaggatgctcaggctggccatgcgttccaggcgttgcgcggcgaggatcgccagggccgcgccgacgatggtcgccatgccgccgtagatcagccagtcgccgccgaagtaggccgaggccccagcctggccggagaacagcagggtccacaggcgcagcagggtgtagacgccgaccttggtcatgatcgcgaacatcgccgccacaggcgcgctggccgcggagtaggccggcaccagccagaagttcagcggccacatgccggccttggccaggaacgcggtggccaggatcgccgcgccggcgtgcagcaggccacggtcggcttccggcaccagcgggatcttcagcgccaggtcggccatgttcagggtgccggtgacgccgtagatcagcgccgcgccgatcaggaacagcgacgaggccagcaggttgatcgccacgtagtgcaggccggcggacacccgcgcccgccccgagccgtgcagcatcaggccgtaggaggcggccagcagcacttcgaagaacacgaacaggttgaacaggtcggcggtcaggaaggcaccgtacaggcccatcagctggatctggaacagcgcgtggaagctggccccggcgcggtcccagcgggccatggcgaacagcagggcgctgacgccgatgatcccggtgagcaccagcatcagcgccgacaggcgatcgaccaccagcacgatgccgaatggcacctgccagttgcccggcaggtacacgccgacggagccgggcacgccggtctgcagggtccagcacagcaacagcacggaaatgcccaggccgagcatgctggagaacaggttgatcctggctttgagcgggcgatgtttctcgccgagcatcagcatcaccgcggcggtcagcagcggcagcaggatgggcgcgacgatcaggtgcggcatcaggttcattccttgggctcccggccatccacatgatcggtgccggtcaggcccctggacgccagcagcaccaccaggaacagcgcggtcatggcgaagctgatgacgatcgccgtgagcaccagcgcctggggcagcgggtcggtgtagtgcagcaggtcctggggcacgccgtccttgatgatcggctccttgccgatgaacaggctgcccatgctgaagatgaacaggttgaccccgtaggacagcaggcacagccccatcactacctggaaggtccgtggccgcagcaccagccagaccccggaggccgccagcacaccaatggcgattgcaatgacttcttccatcaggcggctcctggcttggcttggggtttgacttgggcacgcaccgactggtgcgccagcgcggtgaggatcagcagggtcgagccgactaccacggcgtacacgccgatgtcgaagaacagtgcgctggcgatatggatatcgcccagcagcggcaggtccaagtgcagggtatgggtggtcaggaacgggtagccgaacgccagggcgccgagcccggtcagggtggcgaacagcaggccggtgcccatccagcgcagcggccgcaggctcatctgggcctcgacccactgggtgcctgcgaccatgtattgcaggatgaacgccaccgacatcaccaggccggcgacgaaaccgccgcccggcaggttgtggccgcgcatgaacaggtagaacgacaccaccagggcgatcggcaacagcaggcgcaccagcaccgccggcaccatcatgaagcccagggcggtgtcgctggcgtggcgcgggttgaccaggtcggtgaccacgtcgggcgccagcaggcgctgctgggccggcagctgcatgctttccttcggcgggcggaagcgtcgcagcagggcgaacacggtcagggccacggccaccagcacggtgatctcgcccagggtatcgaagccgcggaagtccaccagcatcacattcaccacattgctgccgccgccttccggcagggcgcggctgaggtagaacgaggaaatgtcgttgggggtctggcgggtcagcatggcgtaggacagcacggccatgcccaggccgacggcgatcgacagcagcaggtcgcgcaggcggcgggcacgggccttgggcaggctgctgggcagcggcgaaacatcctcgatccgccggggcagccagcgcaggccgagcaggatcagcaccgtggtcaccacttccaccaccagctgggtcagggccaggtccggcgcggagaaccagacgaaggtcacgcaggtcatcagcccgcagacgctgaccatggtcagggccgccaggcggtggtacttggcttgccaggcggcgcccagggcgcaggcaatggccagcagccagagggtgacaaagacgatggagcccgggatcttcggccggtcgccccagctcaggctgctgtagagcatcgggatcaggccggccagcaccgccaccagcaccagcaggaacagctgggtctgcaggcgctgggtgctgatccgccgttccaggcgccgggccaggcgcatcatgctcaccaggctgcgctcgaacaggcgcttgccgttgaagcggccgatcagcggcggataggcaaaatcaccgcgcaccagcggggcacggaacagcaggtagagcacgatgccgcaggacatggcgatcaggctcatgatcatcggcgcattcaggccgtgccagatcgccaggctgtactccggcaacgtgccgccaaccaccggctgggcggccgcggccagcagcgggccgaccatctgcgccgggaagatccccaccagcaggcaggtgaacaccagcagttccaccggcgcgcgcatccagcgtggcggctcgtggggcgtgtgcggcaggtcttcggccggtttgccgaagaacacgtccacggtgaagcgcagggaataggcgacgctgaaggtcccggcgatggtggcgatcaccggcagggcggcctcgacccaggcggtggaattgatgaacaccgtctcggcgaagaacatctctttcgacaggaagccgttgagcagcggcacgccggccatggaggcgctggcgaccatggccagggtcgcggtgaacggcatcagcttgatcaggccgttgagcttgcggatgtcgcgggtgccgctttcgtggtcgatgatgccggcggccatgaacagcgaggccttgaaggtggcgtggttgaggatgtggaacaccgcggccaccgcggccagcgggctgttcaggcccagcagcagggtgatcaggcccaggtggctgatggtcgagtacgccagcaggcccttgaggtcgttctggaacatcgcgcagtaggcgcccagcaccagggtcgcggccccggcgccgccgacgatccagaaccattcttcgctgccggacagcgacggccagaggcgggcgagaaggaacaccccggccttgaccatggtcgccgagtgcaggtaggccgagaccggtgtcggcgcggccatggcgtggggcagccagaagtggaaggggaattgcgcgcttttgctgagggcgccgatcaggatcagcggcaggagaatggggtagagggcatgggctcggatgagatctccggcagccaggacctggtccaggtcgtagctgccgaccacatggccgagcagcatgacccccgccagcaggcacaagccccctgcgccggtgaccatcagcgccatgtaggccccgcgccgggcatcggagcggtggtgccagtagccgatcagcaggaaggagaacaggctggtcagttcccagaagaacacgatctggatcaggttgccggaaatcaccaggccgagcatggcgcccatgaaggccaggaaaaacgcgaagaagcgcggcaccgggtcttccggcgacatgtagtagcgcgcgtacagcgacaccagggtaccgatagccagcaccagcatggagaacagccaggcgaagccgtccatgcgcaggacgaagttcaggccgaggctgggcagccagttgaactcttcacggatcacgccgccatgggcgatctgcgggtacatcgaggccaccgccacgctaccggccaaggcgaccaggcctgccagcagggactcggtgttacgcgcgttgtgcggcagcaaggccgccagacagctgccgataaaaggcagaagcagtagaactatcagggacataggcttctaatctgcgggaaattgtgatgcatcatacgtgccgactctgtgatcaccaaccttgaagctgtggcaggatcctacaaaaccccttcggccagccttcaaggcaggggacaaaaagccggctggtgcgaaaatcatggcagtttgcccggggtgaatgacaacaaagcgctgcgcgcggtgttatggtcgcgccccttggcaacggacccgcttgaaaggaagcagacaggccctttatgaccctcggaacctttacccgcaaaaccctcgccagcctgctactgatggccctcggcggctggatcgtctggctgtggctgaccctggccgggcccactgccggcatgagccgcttcaagaccctggagcccttgtcgatcgaggggcaagcagcggcggccttgcccgtcggcaccgtgctctattacgacaccggctttgccgagggccatggccgttacctggcgtacttctattacaagggcgtgatcgcccaggaagccttgcccaaggccttctggccggggcaggagcggatcagccccttgtggttgtggaatatcgatcccgagcaggtcccggataaaaccatgacgcgagaggacattgtcgctgcggtacaggccggccagctctcccggcaggagctggcggccattgtcgaatcgttgccgcgctaggctctgtacgaaaagtggctgcgcgctgggcgccttcggcgctacgcaggccatgctagcgttgcgagtccgccgtttcatccagccgatccgcctcgaccacctcgccacctttacccttggtcttcaactcgctgacgatcaccgccgcgacgatcagcgcgccgcccagcagggccagggccggcaggcgttcgccggcgatgcgtccgaccagcccggcccacaccggttcgccggcgtagatcagggtggcgcgggtcggcgagacgcttttctgcgcccagttcatcgccacctggatcgccgcgctggcggcgcccaggcccagggcgctggccagcagcagccaggaaaagtccgggatggcttcctgggtcggcaccaccatcaggaacgacagcaccgaggtcgcggccagttgtactactgtgacccggcgcacatcgacctggccggcataggtgctgatcaggatgatttccgcagcgatggccacggtgctgatcagggtggcgatttcccccgggctgaagtccagcgcggcgccgctgggcccggagagcagcatcaggccggtgaaggccagcatgatgccgatgctcggcatcagccccgggcgcttgcccatgaacagccattgcagcagcggcacgaagggcacgtacagcgcggtgataaaggccgactggctgctgggaatgctttgcaggcccacggtctgcaggccgtagccgagcatgatggcggtgccgatgaagaccccggccttgagttcgaacagggtcagcccgcgcaggctgcgcagggagaacagcccgacgatgcaggccgccgcggcgaaccgcaggccgacaaagaacatcgggccgctgacggtcatggcgtgctgcaccgtgagaaaggtgccgccccagaccatggtgatcagcaccagcacgcactcggctttgctcagtttgaggaagaaggaggaggatttgctggagttcaccgacgtcatgcccttgcgtgctacccggggcggccgcacaatgcgccgcgaagttgggcagtatactgcgcaaatccatacagtgagcaatatagtgcacaaagatcctgggcagcgcgcttccgtgctgcagcatgtcagtcacaacgtccggcgcctgcgccacgccgccgagctgagccagagcgccctggcggaaaagtccggggtcagccggcgcatgctggtggccatcgaggccggtgagaagaatgtcagcctcagcaccctggaccgggtggccgaagccctggacgtggccttcagcgacctgatccaggcccccgatgcccgcgacccgagccggatcaacgagctggcctgggccgggctgattcccgggagcaaggcggtgctgctggccaaggccaacgcctgccgcgaagtggagctctgggaatggcgcctggagccgggcgagcaatacctgtcggaaccggatgccgaaggctggagcgagcagctgtatgtcttcgagggttgcctgaccctggtcctgggtgagcaggagcggcgcctggacagcggcgagttcttcatgttcgccagcaacctgccgcatgcctatcgcaacgatggggcggtggcggtgcgtttcgtgcgcaacgtggtgatctgagcactgttgcctgggcaacagtgcttgaacattttgcctgtttttagttgatgttgtttcttatgaatatcaatcaacttactgatttataagacttatagtcttcggcacgacttctgcaatctccaggtcagaacagatcttccgcattcgacaggacctggagtcggccatgacagccactgctcaacccacccgaaccgcccacatcatccactccgacgccgaggctatcgccgttgcccggaccctggccgaacgtttcgccgtcgaagccagcgtgcgcgatcgcgagcggcgcctgccgttcgccgagctggacgagttctccgccagcggcctgtggggcatcaccattcccaaggcctacgggggcgccggggtgtcctacgtgacggtggcgcaggtgatcaagatcatctccgccgccgactcgtccctcggccagctgccgcagaaccacctgggcgtgctcgatatcctgctgcagaccgccagcgaggagcagaaacgctactacttcgccaaggtgctgcagggttatcgcttcggcaatgcgttctccgaagccggcagcaagcatgccggcgccttcgagacccgcattcgtttcaacgccgacggcgcgcggatcgacggcgagaagttctactgcaccggcgccttgttcgcccatatcgtgccagcggtggcggtcgacgaagagaacaaggcgttcatcgcctttatcgagcgggacaaccccggcctgaccgtgatcgacagctgggatggtttcggccagcgcaccaccgccagcggcggggtcaccctcgatgcggtgcaggtgccgctgagcgcggtgatcccggcccatcgcgcattcgacgagcccaccgccgacgggccgatctcgcagatcatccaggcggcggtggacaccggcctggcagtcggcgccctggaagaagccaagcgccacgcgcgccagtcgcgcccctggatcgacagtggccaggatcatggctggcaggacccgttcactatcgccgccatcggcgacctggaatggcgagtgcacggcaccgaggcgatcctggaaaaagccggcctggccatcgaccaggcactgcgcgaacccaacgaagacaccgtggcccaggcctcggtggtggtggcgcaagccaaggtgctgtcggcggaaagtgccttgctcgccagcagcaagctgttcgagctggccggcactcgctcggtgctgggcaagtacaacctcgaccgctactggcgcaacgcgcgaacccacaccctgcacgacccggcacgctggaaataccacctgatcggcaacttcctgctcaacggcgtcaagccggcccgccacgcctggaactgaggaatcgcccatgaacgcattgagccaagccaccgcccatgaaacacccgccgatgaacagcccgagcacagccaggacgacctgcgacgcgcccgcgaactgctgcaatcgaccctcaagtttgtccgtgagcaggccaaaccctggcccggcagcggcctagccagggccagcgacgacccctatgtgatcagccgctttggcgacctgctgatccgcatcgaagtcgccgccgccttgcaggaacgggcgcaggccttgctcgccagggagcccgacgtcgccgaaatcggcgtggcccaggccgaggcggccatcgccagccgcgaggccttgctcgcggtgagcaacgccgagttcgagctgaccggccagcgcagcccgctgcccgccgcgcagggtgaacccttgcgctggaaatacccgttgatcggcaactaccgcctcaatggcgtggtgtcgcccagtttcaggagtgcggtttgatggcccgggaaatccgtctcaacgccttcgacatgaactgtgtcggccaccagtcgccgggactgtgggctcacccccgggatcgctcctggcaatacaaggacctcgaatactggaccgacctggcgcggatcctcgaacgcggcaagttcgacggcctgtttatcgccgatgtgctgggcatctacgacgtctaccagggcaacggcgaggcggcgatccgccaggcggcccaggtcccggtcaacgacccgctgcaactgatcccgcccatggccctggtcaccgagcacctgggcttcggcctgactgcgtcgctgtcgttcgagcatccctatcccttcgcccggcgtctttcgaccctcgaccacctgacccgcggccgcgccggctggaacatcgtcacctcctacctggaaagcggggcgaagaacctcgggcagaaagcccagaccgagcacgacgcccgctacgactacgccgaggaatacctggaggtctgttacaagctctgggaaggcagttgggaagagggcgcggtgctgcgcgaccgggaacggcggatcttcagcgacccgagcaagatccatgagatccgccacgtcggcccacacttccaggtgccgggcatccacctctgcgagccttcgccgcaacgcaccccggtgctttaccaggccggggcgtcgagccgtggcaagcagttcgccgccgaacaggccgagtgcgtgttcgtcgccgcgccgtccaaggtgctgctgaagaagaccgtggccgatatccgccgccgcgccgccgaggccgggcgcgatccggcgcagatcctgatcttcaacctgcagacggtgatcctcggcgagaccgacgccaaggccagggccaagttcgaggagtacaagtcctgggtcagctacgagggcgccatggcgctgatttccggctggaccggtatcgacttcagccagttcaagcccgatgagccgctcaagcatgtgcacaccaacgccatccagtcggcggtggaagccttctccacggccgacccgaacaaggtctggacgccccatgagctggcggactgggtcggtatcggcggcttcggcccgctgttcgtcggcagcccggaaaccgtggccgatctgctccaggagtgggtcgaggacaccgatgtggacggcttcaacctggcctatgcgttgacccacgagacctttgtcgacgccgtcgaactgctggtccccgagttgcagaagcgcggcgtgtacaagaccgaatacgcccccggcaccttgcgcgagaagctgttcggcgccgggccgcgcttgccgcagaaccatccgggcagcgcctatcgcgacctggcggcctggcatcgccaggagcagcaggtggcctccatccggataccgtccctgtagccgctgccgcaggctgcgataggtccgaaggaccttcagcgtcagtgtgatcgtcacgacctgtcggtcgatcgcagcctgcggcagcggctacaggtgcagtgcaaaccaaaaaacagccagcggaccgccgcacgcttttgcccaaggaatcgaggtcagtccatgagcgtgcatgaactcaagcgttcgcccccggcggacgcgcgaacagcggaacacactgtgctgctgcccgcggccctggagctgttgcagcactgggcgcaggtcagcccgctggccagcgcgttgcgtcacaagcgccacggccattggtacaactggcgctggatcgatgccgcgcgggatgtcgagcgcctggccgacggcctgcgccaacagggtttcgacgaaggctcgcgactggcgttgagcggcctgttcgagcccaacctgctgctcctggccctggccgcgcaacgggtgggcggccaggtgctgaccctgagcgacgagctcgacccgcaagccctgcgccaggccctgtggaacctgcgccccagccatgccttcgtgcattcgcgccagcaactgctgcgctgggtcgcggccggcgaaaacggcatggccccgcaattattgattgcccatcagcctgttccgcgcctgccggaaggttcgcgccagccggtgctggccttcagcgacctgctcggcagccgggaaaagccccagcgccagaaccactggcggcatccggcccatgccgcgcagctgtggagcgaggagggcacgcactggccggaaggcctgagggtcttgctgcaccagtggttgcacagcggccatagcctggccttcccggaaagccgcggttcggccagccgcgaccgccgcgatgtcgcccccagcggcctgctgctctcgggcccttgcctgcaacgcctggccgacgatatcgaaagccgcctggcgcccgtgggcagttggcgccgccgcctgtgcgactgggccattgcccagccgcaccgccccctgcaacggctgctgaagaaccgggtgcgccggctcctggggttccagcgcctggattacatctggcaggcccccggcaacccctcgacaccttcggcgccggtgtggctggccgaattcaaacggaatatcgcatgagcgccgccgaccccatcctgcaagtcaatgccatctccctgtcgttcaagggggtgaaggcgatcaaccagctgtccttcgcggtcgcgcgcggcgagatctgcgcgctgatcgggcccaacggcgccggcaagagttccttgctcaatatcctcaatggcgtctatcgcttcgacgccggctcgattgtcttcgaccgcgaagcgttccagcgcatcgaccccttgcaggccgcgcgccggggtatcggccggaccttccagaacaatgcgctgttcaagaagatgagcgtgatcgacaacctgctcagcggcctgtcgcggcacacccgcgccagctttatcgagcaggccctggggctgccccgggcgcggcgcgaggccgaggcccatcggcagctggcccagggcattctcgagttcctcgagttgcaggcgcagcgcgatgtgccggtgggcaacctgtcctacggcctgcaaaagcgcgtcgagctgggccgggccctgatcgccgggcccagcctgttgctgctggacgagcccatggccgggatgaacgccgaggaaaaacaggacatggcgcgtttcatcgccgacatcaaccgcgacctcggcaccacggtggtgctgatcgagcacgatatgaacgtggtcatggacctgtccgaccatgtggtggtgctggactacgggcgcaaggtcggcgacggcaccccggccgaagtgcaggccgaccccgaggtgatcgccgcctacctgggggcggtgcactgatgagctttttcttcgaaaccctgttgggcggcctgctggccggcaccctgtattcgctggtggccatcggcttcgtgctgatctacaaggccagcggtgtgttcaatttcgcccagggcgcgatgttgctgttcgccgcgctgaccttcgtcagcctgcacgaccagggcgtgccctttgtcctggcgctgctggcgacggtgctggtgatgatcgccggcgcctggctgatcgagcggctggtgctgcggccgctggtcaatcgttcgcagatcaccctgttcatggccaccctgggcctgtcgttcatcatcgaaggcctggcccaggggctgatgggctcccaggtcagggcgctggacctgggcatcgacgacgtgccgctgttcctcgggccattgatgttcagccagttcgacctgatcgccgcggccacggccgtggtgctggtgacggtgctggcgctgctgttcaacaagacccgcatcggcgtgtcgctgcgggcggtggccgacgacaccacggccgcgctgtcgatcggcatcaacctcaaccgcatctggcagatcgtctgggcggtggccggcattgtcgggctggtggccgggctgctctggggcgcgcgccagggcgtgcagttctcgctgtcgctggtggtgctcaaggctttgccggtgctgatcatcggcggcttcacctcgatcggcggggcgatagtcggcgggctgatcgtcggcgccgcggagaatctggccgaggtctacatcggcccgctgatcggcggcggcatcaccccctggttcgcctatgtgctggccctggccttcctttatatccgtcccgccggcctgttcggcgagcgcgccatcgagcgagtctgaacccatgtccattcccctgacccaggccaccgcgcctgtgctgttgatcccgcgccgcctgccctggggcctgggcggcctgctgttgctggccctggtcggcgtgcccctggtgggcaacgactattggctcaacgccattctgatcccgttcctggtgctgtccctggccgggctcggcctcaacctgctcaccggctacaccggccagacctcggtcggcgccgccggcttcatggcggtcggggccttcgccacctatggcttgctgctgcgcctgccggagctgggcctgcccctggcgctgctcggcggcggcttgatcagcgcggcggtgggctggctgttcggcctgcccagttcgcggatcaagggcttctacctgatggtcaccaccctggcggcgcaattcttcctggagtggctgttcgtcaagtttccctggttctacaactacggctcctcggggaccatctcggcgccccggctgagcctgttcggccatgacctcaataccccggtcgggcgttacctgctgaccctggcctgcgtgctgctgttgacctgggtcgcgctgaacctggtgcgcagccaggtcgggcgcaactggatggcgattcgcgacatggacaccgcggcggcggtgatcggcattccggtggcgcgctacaagcgcctggcgttcgccgtcagttccttctacctgggcatcgccggcgccctgtgggccttcgcctacctgggcaccgccagcgccagcagcttcgatatcaatcgttcgttccagatcctgttcatcatcattatcggcggcatgggcagcgtggccggcaacttcgtcggcgcggcctttatcagcctgctgccgatcctgttgagccacgccgggcaagccctggcgggcggtgcggtggatgccggacagttgcagaacctgcagaaaatcatcttcggcgtgctgatcatcctgttcctgatcaaggagccggagggcttgatccgcttgttgggcaatctccgtcaacggctggggcactggccgctgcgtttctgaattccactcctgagtagagagaagatatgcgtgcatccttgaaacgttccctggccggcgtcgcggtggcgctggcgatcctcggcggcgcggcgcccgtggcgcaggccgcggcggaccagcagttctttccgctggccacttaccgggtcggcgcctatgcctccagcggggtgcaggtgtgggccggcatgatcgactacctgaactacatcaatcaggtggaaggcgggatcaacggggtcaagctggtctggcaggagtgcgagaccgagtggacggcggagaagggcatcgagtgctacgagcgcttcaagaacggcctggatggcgcgccggtggcggtctaccagcccaacggcgcaccggcggcctatgccctgagcgagcgcgccgaggtcgacaagatcccgctgatcaccctgggttacggccgtaccgaagccaccgacggcacggtgtttccctataacttcccggtgatgctgaccttctacagcgaggcgtcgaccctggtgaactacatcgccgagcgcgagggcggcttcgacaagctcaagggcaagaagatcgccacggtctaccacgattcggcctatggccgggaaaccctcggcccgctgaagctgctggcggaaaaatacggcttcgagaacatccagatcccggtggccgatccgggtaacgagcagtcggcgcaatggcgccaggtgcgccagcagaatcccgactgggtgttcctgcgcacctggggcgtctcgaccccggtggcggtgaagaccgccgcgcgcttcggcttcccggtggaccacatcatcggcgacatctgggccagctccagcgaagacgtattgccggccggcgcggcggccaaaggctacctggcgctgacgccttatccggcgggaagcgatttcgacatccaccggcgcctcaagcaacacatcctcgaccagggcaagagcgaccttgcggacctgaagaacttcggcagcgtgtactacaactccgggctggtgaacgccgcggtggcggtcgaagcgatccgcaccgcccagggcaagttcggcaagcgcccgctcaatggcgaagaaggccgctggggcctggagcacctgaacatcgacgacgcccggctcaaggacatgggttacctggggttgatgcagaacctcaagctgtcctgccgcgatcacgagggcggcggttcggcgcgggtgcagcagtgggacggcgcccactggaccctgatcagcgactggatcgccgccgaccgcgccttgctgcggccgctgatcgacgagaagtcggcggccttcgccaaggaaaagaacctcacgccacgcagctgcaccggggatgaatgaagcatgagccagaccgctccggccgccacggccgacgacctgttgcaggtgcgcgatatcgaggtgatctacgacggtgcgattctcgcggtggccggggtctccttgagcgtgcccgagggcggcatagtcgccttgctgggggccaacggcgccggcaagagcaccagcctcaaggcgatctccgggctgctgcgcgccgagcgggccgaggtcagtcggggctcgatcgcctttctcggccaggacagcgccggcgtcgacccgagccagcgggtgcgccagggcatggtccatgtgctggaggggcgccatgtgttcccgcagttgacggtggaggacaacctgcgcagcggcggttttgtccgtggcttgagccgccgggaactggccgccgacctggagcgcatctacgcctggttcccgcgcctgaagaccaggcgcggcacccgcgccgggctgacctcgggcggcgagcagcagatggtcgccctcggccgcgcgctgatgacccggccgcgcctggtgctgctggacgaaccgtccatgggcctggcgccgatcatcgtccaggagattttcgaaatcgtcgcgcaactcaatcgcgaggcgcgggtgagcttcctgatcgccgaacaaaacattaatgtggcgctcaagtacgcctccagggcctacgtgctcgacaccgggcgcgtggcctggtccggcacgaccgatgaactgctggcccggggcgatctgcaggacttctacctaggcaggcactgacccgtgagaactccatgagccaaacacccaacggacaggcgagcggcgccacccgtgacgccgatgtgctgattgtcggcggcggcctgagtggcgccttgctcgccgcccaactgctgcgcctgccgggccggcgccaggtgctggtgatcgagccgcgcagcgaactggggcgtggcgaggcctacagcgccgtcgaactgggccacaccctgaacggcaacgccgcgcgcatgagtgtcgacccggacaacgccgatgacctgactcaatggctgaccgattacatcgccgccggcggctggccggaatcgaagcagcagcccgtgcccatcagcgagctgtttccaccgcgcggaatcttcggcctgtatgtccagcagcggctggccgaggcccaggcgatgggcgcctcgcagggctcgacggtggcgcatgtgcgcgccgaggtggtggacttgcaggccgacgccgagggtgcctggctgaccctcgacgacggccggcaactacgcggcgcctttgccgtgctggccaccggcatgttcccggcggcacgcacgccgcagacccagtccagcggcctcaatgccgccgcgctggacccctgggacgtttcggccatgagccggctcgacccgcaggccacggtgctgatcatcggctccgggctgaccatggtcgacgccgtggtgtccctggagcaggccgggcatcgcgggccgatcgaggtgttctcgcgccacggcctgttgccccatgtgcggcgccagccaccggcctggggcgacttcctcgccgaggatcccagcctgcgcagcccgcgccagttgctgcgcgagctgcgtcggcaatgtcgccaggccctggcggatggcgtggactggcaggcgccgctggacacggtgcgcgcccatatcgggcgcttgtggagccaggccacggacgtgcagcgccggcagttcgtgcgccatgtgcggccctggtgggaaagccatcaccaccgttcgccgccgctgagtgccgagctggtggcgcgtttgcacggggaagggcgcttgcgcatccaggcggcctcgttcaagggcctggagccttcggcggatggacgcctggcgatttgcatccgtcgccgtggcgaagcgcaaacccgctgggtcgcgggggatgcgctgatcaactccagcggcatcgaatacgactggcgccgggtcgcccggccgttgccgcagcaactgctggcccgtggcctgatcacgccggggccgctggccctggggatttgggccgacgccgctggcgcggtggtggatgccgaaggccaggtggcccgccggctgttcgccatgggcccgccgttgcgcggcatgtggtgggaaagcaccgcggtgaccgacgtggccagccaggccaaggctctggccgcacgcctggcggcattacccttgtagccgctgccgcaggctgcgaacggctgcgcagcagacgccgcgatcctgaggccgccagcggaccttttcgcagcttcgccttggctcaacagcggctacagggtcacccagcgctgttcggcggcggcaaggcgaatcgccgccgccaggcgctcgacctgccaggcctcggcgaaatccgtcccgtcttgtccctggccgctaagcgccatgatcagctcatggacctccagggtcttgagctcgttgtagcccagttgatgccccggggccgggctgaaggcggcgtagccgggcagggcaggcccggccagcaggcgctggaagccgctatcgccggcccggtacaggcgcagttcgttgaggcgctcctggtcgaaggccagggtgccgcgggtgccgctgatctcgaaactcaggtggttcttgtagccgtgtttgagccagctgctgctgaaggtgccgcgggcgccgctggcgaaacgcagcagggcatgggcctggtcgtccacggcgatcgggcgctgctcctggctaccggcgctggccgggcgctggtggtgcacggtctggctgtcggcgcagaccgcctcgacctcgcccagcagatagcgcgccatggccagcaggtggctgcccaggtcggccagggcgccaccggcgtgctgcggatcgcagcgccaggagaagggcgaggccgggtcggccatgaagtcttcgctgaactcgccctggaagctgacgatctgccccagttcgccgctgtcgatcagcgccttggtctgcacgatcatcgggttgtgctggtagttgtagccgacccgggtgaccaccccggcggcctgggccgcgtgctgcatttgctgcgcctgttcgacgctgaccgccaggggcttttcgcagtacaccgccttgccggccttcagcgcagccatggccatggggaagtgcaggtgattgggggtggtgatcgccaccaggtcgaccctggggtcgtcgatcaaccgttgccagtcgccgtgggcccgggcgaacccccaggctgcggcgcaatgttcggcgcgctggcggtcggcatcggccagcgccgccagatgcaggcgcaccggtaattcgaataccgcactgacattacgaaacgccagcgcatgggcccgccccatgaaaccggtgccgatcaagcctattccaagttcacccatagccggacctttcagaattcttattgtaaggagggctatttatggaataaaaattcgttaattgcaatccatagaataaattttcagtggcgcgccgctgctgctcgacaacccggccgggaaaagcgaagggtgcaagtaaaaaggctatgtcccaatagccttttttatgtctcggcctcggctccgcgtgccctggtcacctcaaaagagcctgttccacaggcgcttgagcgcattcggctgttccatccgctctccggtcgattgaggtgccgagggcggcggggaaggccgcgcagcggacgggcgcggcgcttggccactgcgtttgcgctgctcatgccggtcccggagtgcgagtagctcgggactgtccggacgggcttccaggccatgcttgatataggcccgcgccaggtcgtgatcgcccttggcatacgcgctttcgctcatctcggcgtagagcagcgccacctggttcaacccggccagcgcctgggcgttgctcggctccaggccgagtatctgccggtaatagaacaccgcgctgtcatcctcgggctccagcaggtgttcttcggcgatgcgctgctcggccagttgccggtagccggcgatccgcgccgcggctacccgttgcagtccttgccgggcctgcgcgctggcttcgtcgagctgcaaggcctggttgaagaaatactcggcattgtcctgcgccggctcgaccagctggcccgccgccaggcgctgttcgccacgcgccagcagctcggtgatctcgatccgctgctgcaggtacaggccggtgccgctggcagcaccgagcagcagcaggctgccgagtgcccacagcgccaggcgcctgttcgggctgcgccggcgggcgggttcgggctcggcctgggcctggagcggcgcaggatcgatcagggccggcgcgaagcgggtagattccagctccacctcgctgggctcgtccggttcgtccggttgctctggctggtccagctcatcgagtgcctgcagcagcgcccggcagtcggcgaagcgctggttggggtccttcgccagcatccgctcgagcaccgccttgtacgggctgatgtgcgccggcaagctcggcgccggcatctgcacgtggttcatcacggtctgggtatagctggcgccacggaacggattggtaccgatgagcatctccaggaagatcacgcccaggctgtagatgtcggtgcggatatccagcggctggcactgcgtctgttccgggctgctgtaggccgggctgccgaccgcgatgccgagcccggtgagctcgctgtccatctccagcgccttggcgatgccgaaatcggtgatcaccaccgtgccgtcgctgcggaagaggatgttcgccggcttgatatcgcggtggatcaggccctgctcatgcaccacggcgaggccggtggcgatctgccggacgatatccagggcgcgcctcgactcgaacacctcgcccttgtgccgggccaggtcgccgccgccgacgaactccatggccaggtagtagcggccatcggccagtctgttgatgtcgtggatggtgatgatcgtggggtggtgcaacgaggcgacgatatgcccctcgcggatgaagcgcttgctgaacgcctcgtcattggcgttgagcagtaccttcaccgccaccttgcggtgcagcgactcctgggttgccaggtagacttcggccatcccgccttggccaagccggctatgcacgctgtagccgggtatctcgggtaatcgttcgtccatgaaagaatccgtgagcagccgctgattgggggtatcgccgatactgtcgggccggatgtcacccgtcggatcgggtctctaattaatattaataagagcggggaacttttccgatagttcccggctcgccgtctgccgccgtcctggcgtttcgcgctgcgcaatgccggcatatgagcctatcctgggcgctgcaagcgaccgccggcggtcgttcagcagcgcttcgtagcccaactgaggtgagccacatgtcacgaatggtttcgctcctggcattgctcggcgccttgtacctggcgctctgcgtcgcggcgtgggggttgcagcgttcgctcatctacttcccccagccccgcgccatcgacagccccgccacgctgctcaggctgccggtcgccgacgctgaggtgctggtttccgtgaggccccacgacggcccgaaggcgttgctctacttcggtggtaacgccgaggacgtgtccctcaacctgccggagtttgcccgggcctttcccgagcatgcactctacctgctgcactaccgaggttatggcggcagttccggatcgccctccgaggcggccatcgcgcgcgatgccatggccttgttcgacaaggtgcaagccgcccacccgcgtatcgtggtggtcgggcgcagcctcggcgcggctgtcgccgtgcgcctggccagccagcgtccggcatcgcgcctggtgctgatcacgccgttccatagcctgcaggagttcgccgccagccagtttccctttcttccggtgaggtggctgctgcgggacaagttcgaatcctggaaatacgcaccgcgcatcgccgtgccgactttgctgatcgccgccgaacacgacgaagtcatcccgcgttcgagcaccgagacgctctatgcgcatttcgcccccggcgtggccaggctcgaggtcgtcccgggcgcggggcacaattcgatagacgcgagcccgcggttcctggaactgctccgcagcgggctgtgagcgcgccggccttccggcgaggcgccggcttatgccggctcctcgctcctgtcctgagacatagccaataaaaagggtgcaatgaacagtcattgcacccatgggccgatcgcctgagcagggtcagaactggaaggtgaaccccaggttgaccgtgctgccaccgccatggccggacaccagcccggtgtagttcagcgacaccagggtgtctttgctcatggccatttccgcagcggccttgaccaccgcgccatcgcgagataccggcacgccgttcaccgcaaaggccgccgcactgccggcaaatttcaatgaggtttcacgatccaggtcgccgtactggtgttcccagcccagctcgccacgcaaggttaccgagcgggtggcgctcaccggcaattgcgtatgacctcgcaggccaagggtcgagagcgtggcgtcctggctttgcttgctgccatgcaaggctgctgcaccgccgcgttccttgaacgagtcgttctggaagttgatgtagctgaggttggcgaagggctcgaaagccgcccaccgggtgtagccgatttcgccgaacacctgatcggtacgcgcgttgtagttggctttttcatggctcgactggttgccgtacgccacgtcacgggaagtgtcgaagcggtgccaggtggtggctccgccgaggcgcagggcgatgctgtcgaaacgtttgccgccatagatcgacaggtgatagttgtcgctgtcggcggaagtcctggaggctccgttcaggtcggttctggtgtagccggttgccgcaccgacgcgccagccatcgccgacctcggtgtccaggccgagcaggacgccggtggtggaagtgctgtagcgcgtggcgttgtgatcggcgtcgacttgcctgtggccgccgagcaattgcacccagccaccattgctgctggcctggacatccatatcggtatccagggcctgagcctgttgcaggcggccgttgactgcgtcacgcaggtaacggctgtcagcgatctgcgcagcggcgatgtcggagtgcacctggccatcgagctggttgaaggcttgtcgcgccagttccgccgagtcggaggccaggatgctctcgtacaccggattacctgcgctcaatgtgtcgatggcgctggcgacggcacgctcgttacgggtcaaggctacgctggcgaacgcggtctggttgcggtagatgcccaggttcagctggttcggctggtagttcagacgggtgtcgaggaacaagaaaccgggggcgacggaagcgaactggccgttgataccctggctggcgctgaggatgttgaactgctggcccaggtagctgctggcctgggccgcagacagcaggttggggctgttttccatggagagggtgacctgtccgccgttgagagtagccacgcccgtgctctggagggtgtcggtctgcccgttggcggcgacttccaccgcgtacaccgaacccgggttgaacgtgacgtcgccggtgtgcagggtgccgaccgaatggccgggggccacggtaccgccgttattcaccagcagggtgccgatgctgccgttacccgccagggtgccgccgatacgggtgaccacctggttattggcatcgacggtgcccacggcgctgccatcgaccgtcacgctggaggtcaagctgccgtccaccgagagcttgccgccacggacccaggtactgcccgaatagctgctctggccgtcgagtaccagttccccatccccggactttatcaggctgccgacataggtctggccggtcagcgggtccaggccgcgggtcagcgttgcctgttcccgggccatgccgatctcgtactggaattgatcgtccgccgaggccccggccggtagaccgttgccccaacctttgtgctgcttgatcgcgccccaggtggcctgttcggcggcgtcttcgctgcgtcgggcacggatcgctgcgtcggagatgtcgttggcccagatatcgcgggtgccggcgggcagcgccacggccagtgcaccgacgaactgtcccgggccctgcatggccttttccaggttgggcaggccccagccgttgaccacccctggcacctgcggggtgccgggagcggcgtcgtgcaccggttgcaggttgtcgtaggtgcgtccgcccgtccggtcgccgaccgcggtgtcggggccgtccggggtttgcagggtggaggtggtcagcaagacatcgcgggcctggctcgcggtcatgtagggaaagcgctggatcaccagggccagggcgccggaaacgctgggggcggccgccgaggtgccgttggcgttggggatgatctcgccttccggtcctgcggacggaatgccggaaacccccatgacgcaccaccacttggaggtgccgcagcggttgtagacctgggcgccgctctcgtcataaccggtgatggacagccacttggattccaggtccggcttgaaataggggaggttggcgttggtgtccgggttggcgccatggctgtcgttgccggcggagatgatctggatgaacgagtactgccggccggcgtcggccatggcatccatccaggtcttctggcccgcgtgggccttgtcccagaacggccggtaggcggcggtcatgtccctgaggatatcctgcgggctgtcgccgacagtgccgaagtggttctctatgtcattacgcgagttctgcccccagctctggttgacgatcgacacttttttcgccgccagcgcgtcgtagctggccatgaaggcgttgtagtcgaggtcgttggagccttgataacggtcgttgtcgctgccgccggtgttggccacgaacagattggcgtcgaaggcgatgccgtgcatgccggtaccattgcgactggccgccagtactccggacatttccgtgccgtggccgtcgttgaagctcgggtcgtactcgcccgcaatactgaagtgctcacctttgtggaactcgccggcaggcacctccagccgatagcgcggatgggttgcgtagtattcgccggtagaggtgactgcctgcacacggttttcgcctgcggcgttcttgtcctggaattccgaatgttcactgaggatgcccgagtccagcacgccgacgtttacccctttcccggtgatacccagggcataggcgtaataggcgttggtccggtccaggccggagttgacctgggcttccggagtcttccaggtttgcgcgttattgctccagttgccggtcgcggcggaccatgactgtccggcattgagttgtttgtgcaggtccgtggccacacccggctctatataggtataaggttgggccgccggcaggttggcaataatcgctttggcgaagtcgaatatgttttgggtataacggccggagttgctgaacaggcggcttttatagcgatccagattgttgttgtaatcaagtggcttgctcgtatcgccgagcattgcactgatcgacaggttttccgtctgcaactcgtagttctgctggagcaacgagtcgaactttgtcgattgtgcggcaaactctttggctgccaggtccagggtattgcctacaccaaaacgcaagttggtatacacggcgctgcccggcgcgaatgatgcagcggctttcctgaacgcagcctccaatacctggggtgtatagggcgagccggtgggcggattatctgccagagccatctggccctgacccagccacaaggcgatggccattgcgacagggctcagggaagctggttttaaacggttgctgcgtttgcctgaatcgatacctgctacgtccatgttccttttccttgagatatgtccttggtcgaaactgatgtttcgatctcttgtaataggcagggtgtaaatgctgggctgaaacaaaggtgctgtttagaagcacgtggtgtgtttattgtttttactgagcaatagggaattcagtcgcggttatcgttactgttcgcttgatactcactaggtggtacatattaagaagtcgacaatcaacgaatggtcagttgttgatcctcaagttgtttttctttaaggcgcacatcgccctccgctgttttaaaacaatggtttttcacatgagtggtgttgcagaaaaataactgcgagagggttatagcatgacaaatgagcatgtaacaaaatatttatagagtgttacgagcttgataccagaactgtgacaggtttggttttctgtttgagaaaggttggggcgaggtgtgggtgccgggcataaaaaggcagcccgcaggctgcctttgttgtattgcgaaggtcgatcaggaaaggaaaccgccgtccacattcagcgatacgcccgtggtgtagctcgaggcgtcgctggccaggtagagcacggcgccggccatttcgctcgggtcggccacgcgcttgagggggatctgcgccagggcggtcttgaggatggcgtcgttcttcaccagcgccgaggcgaacttggtgtcggtcaggcctggcagcagggcgttgcagcggatgccgaactgcgcgcattccttggcgaagaccttggtcatgttgatcaccgcggccttggtcaccgagtagatgccctggaagatgccgggggacacgccgttgatcgaggccacgttgatgatgctgccgccgccgttgtcgcgcatcagcttgccggcttccaccgacatgaagaagtagccgcggatgttgacgtcgacggttttctggaaggcgccgaggtcagtgtccagcacgttgcagaactgcgggttggtggcggcgttgttgaccaggatgtccaggcgcccgaactgttcgcggatgccggcgaacacctggctgatctgctccatctcgccgatatggcaggcgatggcggtggccttgccgccagcggcgacgatggcatcggccacgtgttggcagccttcgagcttgcggctcgagacgatcacatgggcgccttgctgggccagcagcttggcgatggcttcaccgatgccgcggctggcgccggagacgaaagcgatcttgccgtcgaggtcgaacaactgggtcttggacatggtttttccttattgtgtgcctggcgcgtcgggacgatcagaggctggatttcttgatgacctgcaggctcatctgctccagcagcttgttcatgtgaatgaactgcgcgaagcgtttgtcctgggtctggccatggaagaagcggtagtagatctgctgcacgatgccggccaggcggaacaggccgtaggtgtagtagaagtcgaaattgccgatctggatgccggcgcgttcggcgtagtagtcgacgaactgctggcgagtcagcatgcccggggcgttgctcggctggcggcgcatcagttgcaccggcgccgggtcgccggcttcgatccagtaggccagggtgttgcccaggtccatcagcggatcgccgagggtggtcagctcccagtccagcacgccgatgatctgcatcgggttggccgggtcgaggatcacgttgtcgaagcggtagtcgttgtgcacgatgctggaggtcgggtgatcggccggcatcttgtcgttgagccaggccttgaccgcttcccacttgggcgcatccggggtcagggctttctcgtagcggtcgctccagcccttgatctggcgttgcacataaccttcgggcttgcccaggtcgctcaggccgcaggccttgtagtcgacgcggtgcagctcgacgaacttgtcgatgaagctcttgcacagggcttcggtcctggccgcgtcgaaacccagctccggcggcaggtcggagcgcaggatgatgcccttgacccgctccatcacatagaactcggcgccgatcaccgattcgtcggtgcagtgcacataggctttcgggcaatacggaaagccgtccttgagctggttgaggatgcggtattcgcggcccatgtcgtgggccgacttggccttgtggccgaagggcgggcggcgcaggacgaattcctgccccgggtattccagcaggtaggtcaggttcgaagcgccgcccggaaactggctgatctgcggggtgccggtcaggcccggaatatgggccttgaggtacggatcgatcaggttggcatcgagttcctcgccggagcgagtacgggtggactggtcagtaagcgccatgcttatcccttctgcttattctggaggccagagattattggctaatctaatgcgcccacctgagcgccacaatcgccgcaggcctttataggtgagcgtgttgccgggcaatcattgcttttgatacaagcgtttgaatgggcccggcttgactctagtccagttcgtcgggcctgaatgagtattccgaccggagcggcgcacggcactgtttctgcgtagcgccgaaggcgcccagcgcggggcatggcctgcgtggcgtctgtggcgacgcctggttcagttcggggcaggcagggcgatgggggtcaacagcggttggccgctgaagtgggcgacgaggttcttgcccaccagctccacggtggcctgggtcgcttccggcgacagcccggcgacgtggggcgtcagcaccacattgttcagggtcttcaaggcatccggcacccgcggttcgtcgtcgaacacgtccagggccgcgccggcgatgctgcgttgctccagggcctgcagcaggtcggcggtgttcaccacgctggcgcgggcgatgttcaccaggaaaccctccggccccagggcctgcagcacggctttgtcgatcagctggcgagtgcctatgccgccgggcgtggcgaccaccaggaagtccgaatgccgcgccagttcggtcggggtcgggcagaaactgtagggcacgtcgctgcggatctgccggttgtggtagctgacgctcatgtcgaagccattggcgcagcgcttggcgatggccaggccgacggcgccgaggccgagcacgcccaggcgcttgccggccagggacgggcgcatgactttcggccattcgccacgccgcacggcggcgtcggcacgggggatgtcacgcaccagcgacaacagcagggccatggcatggtcggccaccgacgaggcgttgaccccggcgccgttgctcaccgctatgccacggttgctcgccgcctgcaggtcgacctgctcgtagccggcgccgatcacacagatgatttccaggtgcggcagggcggcgatttcttcggcgctcaggcccagcggaccacgggtgagcaccgcgttgatctgcccggcatgggccctgatggcgtccgcccgctcgctgggggttggcgcgaggatcaggtggaagccctggttttccaggatccacaggtagtcattgatggtttcgacgaggaccagaacggtggcgggcatgcgtgtctcctgaaggactgaagagggacggacggcgtacggcgcagcgatggcaaccggcgtacagcttctggagctgcggtaccgtgataaaccactcaagcgctcaagattgcggattgcagggcgctttggcaaggcgcggtcgcgggtttttcccgcgaccgcggcctggagagcgtcgccgccctcgagggccttatcgccagcaagcttggctcctgcagaagcaatctcaactctgcctcgcttctgcagagagggcattcagaagcggatatcggcggttttcactcgccggacaaaggcgccgtccagggttgcgttgtggtggtcgatgatggctttggccgagagcagcggcgtgtccatgcaggtatgggcgtcctccgccagcacggcggcgaaccccaggtccagggcggcgcggcaggtggcgtcgatgcagtactgggttttcatgccgacgatcaccagctcatcgacctgcgccgcgcgcaggtgttcggccagcccggtgccgacaaaacaattggggcgggttttgtccagccgttggtcgctggcctcgagttgcaattgcgccagcagttgccacggcgcactgccggcggcgatgggcgagccttgcgggctggtatggcgcacggcgatcaccggcgcgccggcctgccgggcgcggtggatcaactggttgatgttgtcgagcacgcgctgcccctcgaagggctgctctggcccgtgaaacaggccgacctgcatgtcgacgatcaatagggcggggcgctgggcctggggtgacggcatggtgtttctccttgtgagccagctggacggagaaacaaaaggccccgtccattgctggcggggccttgggttcgactgcgctgttgtcagctcatgcagcgaccacacgacccgccggaagcggtcgtggtggtagtgcgggtgagatggcgcgggaagagattcatggcgccgatcttggggctgggggtcaggtactgtcaatgcgctgtgcggcttgtctgcaaagcccagggatccaggcagcccacggcggtgcgcagactcaaacgatggagcgggttcatccggtgctcattttcggtttttcgacaagttggatgagcttgaggcaagaagcgtcattgcgtgcgcatgcgtggattgcattgtaagtattcattggatgcattggtcgaaacattctggtttatgaaatatttgtgacagctctggggtgagtcagaaggatttgtaatgcgcccgaagtggcttggatattcgaagtcgctgagctttgacagcaatgccttgctcgaccccctcccggtaaagcgtcttgagtggcaattcgaggagcgagagacgctgctcagcaagatccgagaggttgttgccagtgtatgacctcgtgctggtcgtcggtccttgtaggagcggaactacttttgtcttcaatgctttgtcgcacagcgacttcgtgggttttttccaacctttgaagcatcagatccgctgcgccctcagcgggacgtcgagcgagacgcgactggagcgttatgcagggaggcgcgttgtggtcaaggaggcatttggcccctactgcctggaggaggcggactacgacccggttcgcaaggctatcgatattttccaggctgaaaaagtcttgctcgtgctggtcttgcgttcgccggtgcaatgcctggcgtcatgggaaaaagccttttatcccgacagccctgtcaacgatcaagtgttcaaccaggcctatctgaacaccctgcgattgcagcgtaagtatgcgcaggtcttggacgttgaaaccctgatcctggagcaggaacaacccttcattcgcaccttgggcgagatcagggccaggctcggaggcacggatgcgagccagtgttatagcgactatgtgaaaccccgggacccgcgtcgatacgaggttcgtggcctgttggacaaggcgctgcagggcaaggactacaacgccgcttacgtctcgaaagaggcggcaagcgtggacatgtcgcgaatagccgtggcgttgcaatgctacggcaccgcccagcgtggctggaacgaaccgagcgagaactttcatgagctatgaagtgctgcataagctgtttcctgagcgtcgccaagggattcgtgagaacgaactgtttatctttgccggtccctgcgtggtcgaaaatgaaagcgtcacgttccggattgccgaagaactggcgcaagttcgccaggcctgcgggattgatatcgtattcaaggcgagtttcgtgaaggcgaaccgaacctccaaggacagtttcaccgggctggctctggaccagtcgctgagcatcctgcaggcggtcaagacccgctttggcttgaaggtcctgagcgacgtgcacgaatacaccaacctcgacgagatagccgacgtcgtcgatgtgttgcagaccccggcctttctggtgagacagaccgaattcctgaggcgggtagccgctgccggtaaaccgataaacatcaagaagggccagttcctgagtccgacggaaatgatcagtgccgtcgacaagatcctgtcctttggtaatagcgacttgttggtatgcgagcgcggcagctcatttggctacaactacctggtcaacgattttcgagggatgcagcaattgatgcagagggcgcaaccattggtattcgacgccacgcattccgttcagcgccccggcgctttgggtgacagttccggtggggacgccaggtacgcgccgaggctggccaaggcggcagtggcggcgggcgtggatggcatctttatggaaacccacccggaccccgccgcggcgctgagcgacggtcccaacatgatccctttggctctcgtcaagcgcttgctgggcgagttgaaggagcttcatcaagtggtcaaagggcaatctgcctatatctgatacaggtctgatcgtaccgatcaatccagcaaaaggagctcgctgtgaattggcaaagttggcatgagaactaccgggatttttcgccactgcaagcgcgacttgtggaagtcagtcggcaggtcgcggaggcgatcgactcgatggcgtcaccgcatgtgcagatattgagtctgtgcgcaggcgatgggcgtgatctattgcaggccttgtcgtcggtgcaggcgggcaaaacggtagacgcgaccttgatcgagttcgatcaggcgttggttgaccagggccgaagagcattcgccgctcaggggcggggcgacagcgtgcggtttcgctgcgcggacgcgacgttgttttccacctaccgggatttgcccaaggtcgagctggtcatggtgtgcggagtattcggcaatgtacgcaacgagcatgtgcagaggctgataggtgcgttgccggggttttgccgtcccggggcccgggtcgtgtggacccgaagcctcaatgaattcgacgatggggaagcggccgcagaccacataaggcgctgttttgtgcgctctggttttcgcgaggcggtgttcgcgcggaccccggaaggtacatttgccgtcggcagtttcatttatgaaggggagcaagaatgtctgccggctacggggcagatattcgagttttctgcattctgggatcggcactgatggcggatagacagatgctcgctcagaacttgacctggcacggcagctcggtaacgcccgagatgcgggcgatattgtcggcgcaacgccctttgacactgtggttcaccggattgagcgccgcgggcaagagcacgctggccttcaacctggagagcttgctggtcgccaaacgcattcattgctgcgtcctcgatggcgacaatgtccgtcatggcctgtgccgcgacctgggtttcgacagtcagggcaggactgaaaatatacggcgggtggcggaagtcgcgcggctgatgaacgacgccgggctggtcgtcatggcggctttcatttctccctatcggcgggatcgggaactggccaggagcattatcggggtggagcgctttcaggaagtgcatgtcagcgccccgcttcatgtctgcgaaagccgggacccgaaggggctttacaggaaagcacgcaggggcgagctaagtggctttaccggtgtcgatgcccctatgaagtaccggactgtccgcacgtttacctagacacctcccgtacttccttgtctgactgtctcgaacggctgtccgggttggtaacttcgtccgcaccacgacgcgcagggataaatgctgtggctgcgggcacttggccacggaatggggcaggcatctgattgattgcgttcgtattgttttgggctcagttcctggtcgttggcaatctcctcatcatgccggtgttattgctgggcgtgcgtgacgggttttccctggacgcctgttcaatggggctgttgctggctgcgtttcccttgatggcattgattggcaacctgttcgtcgggcggttcatcgataaagtcggtcggcccctgagcctgcaactggggctctgcatgagtgctgcctgctttctcctcatgttctttgccgagaacggcagcgtcgccattgtctcgcggggcctgacaggtctgtgcatgcctctgataggggcgagcctgtatgcggtgatcgcggatgtctatgccggccaggcgcgtcggcgagtcaccgcgctggtcagcaccgccgcttcattggcgggactggtcattctgccgctggggatagggttctctaccgcggcgagatggcattacgtttttctggcgtttgccatggccagccttggcctgggagtgatcagctacttttcatactatcgccgctatgcccccgcgcgggcggaggcggccggtgtcaggcaaggtgccgcgaggctttatctggatgatggggtattacgcagctatgccttgttgtactggtttcagggctttgcctatttcgcattgatttcatggatgccgtcatattttcaacggctgctggacgacggccagtcgtccatggcgctgtttttcggcggagccggggctgtgctgggggcatggtgcctgacggcgttggcaggcaggcgagcgaagacgttctacgtggtgcttgggatcaacggtatcgccgtcctgagtcttgcagcttccaccctgggcttgtgggccgcctgtgcggcctggttcgtctacaacgcctgccgccagttgttgtccgcgcatatcctctcgggagcgaacgcgcattgcggcaattccgaccgcgggaccttgaacgcgacgatgaacgtgggataccaggcggtgggagccgttgccgcattcgtcgtcgcgcaactgcctttcgtgcctgattccatttcgatcatttgcatcatggcgacactgatgttgttgccgggtttttacttttataaaagcctcggccgttcggatgcattgtgaatcatgaagggctgcatgtgagggggtgagagatatggcacccaaggcaacgggtgggaagaatacggaagtcgccggataaaacaggatggcccccaagaatactgggctttatgaggctattcggggggcgagtttctttcggtgccaaacacgttgcaggatgcatatttaagaagaatgagcggatggctcgtttctagtgggccgtttggcatttcgactacgcgctagtcgtttgcatgaagtagccggtttcaaaggattacatgtctatttggcgattcagtttgctatctggacgtggggcataggaaacgaacaaagaccgaagcgctcgccggtccggctcggcctattaaagcgctgcatcaacgagccgggcgggcgggtaatcgatggggcctgtggactacgctgagcttgcttgagtgtcttgaacgggggcgggtcagcgctcctgaccagcaggtcgctttcaggacacgatgggtcgcctgggtgcaatcgccggaccatggcgatgggcaagcttccaggatgccccggacccggtgcgccaagacacttggccggagagcaagaatggcgaccgacaatccacgcctccgtgacgtggccgggcgctgcagccgaagactccggacggctaccgctatgtagcgatgtcgttcgagatgccgaggtacgtttatgtctgatgacacgcttcacctgcctttgattcacagcgtgttggagcgcgaaaaggacacccccggtgccttgctgcccattctccacgccattcaggacggttgcgggtacatccccgacaccgccatccccgagattgcccatgccctcaacctcagcctggctgaagtgcacggcgtgatcagcttttaccacgatttccgtaccacgccgcccgcgcgccataccctgcgcctgtgccgggccgagtcctgccagagccggggcgccgaacgcctggctgcgcagctgcgcgaacaactgttgctggacgaccatggcaccaccgccgacggcagtatcaacctgcgaccggtctattgcctgggggcgtgcgcctgttcgccggccctggaactggacggtgagctgcacgcccggatcacccccgagcgcctgcgccagctggtgagtggctgcctggaggatggcgcatgctgaagctctatatcccccgcgattcggtggcccgtgccgtgggcgcggacaaggtggccgtggctctggtgcgtgaggccgaacgtcgacaattgccgttggagctgtgccgcaccagctcccgtggcctttattggctggagccgctgctggaagtggacagcgccgacggccgcctgggtttcggtcccctgactccggaggacgtgccgagcctgctcgacgccctggcgggcgaccccggcagccatccgttggccctggggccggtggagcagatcccttatctgcagagccagcagcgcctgctgttcgctcgggccggcatcactcaaccgctgtccctggacgactaccgcgcccacggcggtttccagggcctggcccgggccatccagatggagggcgcgcaggtggtcgccagcgtgctcgactccggcctgcgtggccgggggggggcggcctttccggcgggtatcaagtggcgcaccgtgcgcgaagccgcgggtgcccagaagtacgtggtctgtaacgccgatgaaggcgactccggcaccttcgccgaccgcatgctgatggaaggcgaccccttcctgttgatcgaaggcatgattatcgccggcatcgccgtgggcgccagcaagggctatatctacgtgcgctcggaatacccggacgccatcggcaccctgaacgaggccctgcgcatcgcccgcgaggccggttacctgggggcgaacgtcggcggtagcggccgtcccttcgagctggacgtgcgggtgggcgccggtgcctacatctgcggtgaggaaacggcgctgctggaatccctcgagggcaagcgcggcacggttcgcgccaagccgccgctgccggccctgcagggcctgttcggcttgccaacgctggtgcacaacgtgctgaccctggcctcggtgccgatcatcctggagaagggcgcgcagttctatcgcgacttcggcatggggcgttccctgggcaccatgccgttccagctggccggcaacgtccgccaggcgggcctggtggaacgcgccttcggcctgagcctgcgcgagctggtggaaggttatggcggcggtaccgccagcggccggccattgaaggcggtgcaagtgggtgggccgctgggggcctgggtgccccccgcgcagttcgatacgccgctggactacgaagcgttcgcggccatgggcgcgatgctcggccacggtggcgtggtggttgccgacgacagcctggacatggcccatatggcccgtttcgccttgcagttctgcgccgaggaatcctgcggcaagtgcacgccgtgccggatcggctcgacccgtggggtggaggtggtggaccgcttgatcgccagcaccgacgccgcggcccgtgaggaacaggcgctgctgctgcaagacctctgcgacaccctgcaatacggctcgctctgtgccctgggcgggatgacttcctaccccgtcgccagcgctctcaagcactttcccgccgacttcggtctggcgaccacggaggccgaccaatgatcaatatcttcgaccctaccaacgatatcgacctcggcaccccggcccgcgaaagcgcggtacaggtcagcctgaccatcgacggccgggaaatcagcgtcgcttccggcacctcagtgatgcgcgccgcggccttgctcggcaccactatccccaaactctgcgccaccgacagcctggaagccttcggctcctgccgcatgtgcctggtggagatcgagggcatgcgcggttatccggcctcctgcactacgcctgtgaccgagggcatggtcgtccacacccagacttccaagctcgccagcctgcggcgcaacgtgatggagctgtatatctccgaccacccgctggactgcctgacctgctcggccaacggcaactgcgagttgcagacggtggcggggcaggtgggcctgcgggaagtgcgctacggctacgagggcgccaaccacctggacgaacagaaggacgtctccaacccctatttcgactacgacccgagcaagtgcatcgtctgcaaccgctgcgtgcgtgcctgtgaggaaacccagggcaccttcgccctgaccatcagcgggcgcggcttcgattcccgggtggcggcggccggcggcgacaatttcctcgactccgagtgcgtgtcctgcggcgcctgcgtgcaggcctgcccgaccgccaccctgatggaaaagagcgtggtggaaatcggccagcccgagcgcagcgttatcaccacctgcgcctactgcggcgtgggttgctccttccgcgccgaaatgaaaggcgagcaactggtgcgcatggtcccggacaagaacggccaggccaaccacggccattcctgcgtcaagggccgcttcgcctggggctacgccacccacccggaccgcatcaccaagccgatgatccgcaagcacatcagcgatccgtggcaagaagtcagctgggaagaggcggtcacctacgcggccagcgagttgcgccgcatccagctgaaatacgggcgcgactccatcggcggtatcacctccagccgttgcaccaacgaagagacctacctggtgcagaagctggtgcgcaccgcctttggcaacaacaacgtcgacacctgcgcccgggtctgccattcgcccaccggctacggcctcaagcagacgctgggcgaatccgccggcacccagagtttcgactcggtgatgcaggccgacgtcatcctggtgatgggcgccaaccctaccgatgcgcacccggtattcggctcccagctcaagcgccgcctgcgccagggcgcgcggctgatcgtcatcgacccacgacgcatcgacctggtggattcgccccatgcccgtgccgacttgcatttgcagctgcgtccgggcaccaacgtggccatgctcaacgcattggcccatgtgatcgtcaccgagggcctggtcaaccagcctttcgtcgatcagcgctgcgaagcggcggacttcgcccgctggcgcgatttcgtcagcctggcggagaattcccccgaggtcctggggccgatttgcggggtgccggccagacagatccgcgacgccgcgcggctttacgccaccggcggcaacgcggccatctactacggcctgggcgtcaccgagcacagccagggcagcacctcggtgatgggcatcgccaacctggcgatggtcaccggcaacatcggccgcgagggtgtcggggtcaacccgctgcgcgggcagaacaacgtccagggctcctgcgacatgggttccttcccccacgagctgcctggctatcggcatatttccaacgaggcggtgcgcgccgagttcgaacaggcctggaacgtgaccctgcaacccgacccgggcctgcgcatccccaatatgttcgaggcggccctggacggcaccttcaaggcgctctactgccagggcgaggacattgcccagagcgaccccaacacccagcacgtgaccgccgccctgacggccatggagtgcgtggtggtgcaggacatcttcctcaacgagacggccaagttcgcccatgtgttcctgccgggcagctccttcctcgagaaggacggtactttcaccaacgccgagcgccgcatctcgcgggtgcgcaaggtaatggagccgctggccggcaaggccgactgggaggccaccatcgccctggccgaggccctgggctacaaaatgcagtacaaccacccgtcggagatcatggatgagatcgcgcgcctgacgccgaccttccaccgcgtcagctacgccgagctggaccggcacggcagcctgcaatggccatgcaacgatgccgcgccggacggtacgccgaccatgcacatcgatgagttcgtgcgcggcaagggccgcttcatgctcaccggctacgtgcccaccgaggagaaggtcaacagccgctacccgttgctgctgaccaccgggcgcatcctcagccagtacaacgtcggcgcccagacccggcgcaccgacaacgtggcctggcacgaggaggatcgcctggaaatccacccgaccgacgccgagaaccgcggcatcgtcgatggcgactgggtcggtatcggcagtcgcgccgggcagacggtgctgcgggccaaggtcagcgagcgggtggcaccgggggtggtctacaccaccttccacttcccggaatcgggcgccaacgtgatcaccaccgacaactccgactgggccaccaactgcccggaatacaaggtgacggcggtggaagtcgtgcgggtcaaccagccttccgaatggcagaagcgttatcaggcgttcagcgatgaacaggggcgcctgctgcgggagcgtcgtcacgccgagaaagccgaggtgcgccgatgagcagcgaaagcctgatcaagatggccaaccagattgcccagttcttcgctagcgaaccggacaaggcccaggcagcgcgtagcgtgcgccagcacctgaaaagcttctggacgccggccatgcgcagagagctgaccgcctgggaggtgacacaccccggcgcggcgctgcaccccctggtgcaggcggcgttgaaggaagaggaagcgcagacctagcgtttgccgatggcgggcacaccttgaaccggaccgcctcattgcaaccaaccagaagccagggccttgccctggcttctgcttttgatgggcacacctgctgtcttaggggcatgccgatggggatgatgatccgcgcgcccggcacgcaggccagccgaaacccggggccagcgcttgccacagatcaatgaaaccttgtgcccgaccccgcaaaaccgcgctccagacatctgcaccggcaaaccgttcctcagctaagtctttgcttctggtgagtaatcccggacaatcgcgcccctgtttcggcgagggctctgtctgtcgggtactccgacgcgccctggccgagtggcaaatgaccggaatgtggagatcccaccggatgaatgatcaggccaacagcgttgatcaacgctttgaagcggcagccccagcgaccctagctagctggaatcgccaagacactacctggatgctgggcctgttcggcaccgccatcggcgctggcaccctgtttttgccgatcaacgctggcctgggcggcttctggccgctgctggtcctggcgctgctggcctttccgatgaccttcttcgcccaccgcggcctgacccgcttcgtgctttccgggcgtgacggcgcggacatcaccgaagtggtggaggagcatttcgggatcaaggccggcgccctgatcaccttgctgtacttcttcgccatcttcccgatcctgctgatctacagcgtggccctgaccaacaccgtgggcagcttcatggagcaccagctgcacatcatgccgccgccgcgcgccgtgctatcgctggtgctgatcctcggcctgctggccgtggtgcgctgcggcgagcaggtgatcgtcaaggctatgagcctgatggtctacccgttcatcgtcgccttgctgttcctcgcggtgttcctgattccgcactggaacggcggcatcctcagcaccgccagtaccctgcctgagccttcggcgttcctgcacaccctgtggctggcgatcccggtcatggtgttctcgttcaaccactcgccgatcatctcggcctttgccgtggaccagaagcgccggtatggcgcccacgccgaagagcgcagctcgcagatcctgtcccgcgcccacctgctgatggtggcgatggtgctgttcttcgtcttcagctgcgtgctgaccctgtcgccggcccaactggccgaggccaaggcgcagaacctgtcgatcctgtcgtacctggccaaccacttcagcaacccgaccatcgcttttgccgcgccgttgatcgcgttcgtggccatcgccaagtcgttcctgggccactacatcggcgccagcgaaggcctcaaggggctgatcgtgaaaagcggccgccgcccgggcgccaaggccctggaccgcatgaccgcggccttcatgctggtggtgtgctggatagtcgccacgctcaacccgagcatcctcgggatgatcgaaaccctgggcggcccggtcatcgcggccatcctgttcctgatgccgatgtacgccatccgcaaggtgccggccatggcccgttaccgcggccaggcctccaatgtgttcgtcaccctggtcggcctggtggccatcaccgcgctggtctactccctgagcgcctgacccgccggcggcccaccgcgcgttggcggtgggttgccgcgcagaaatgcctgattcagcgaagccacggccgctgactgcgtataaagcgcggcgcggccgtttttctggtaggccgcaaagtccagggccagcaagtggtcgcggttgacccgttgcggctggccgagccgggtcagcgccacgccatggcgtaggaagtaacgctccagcgccggcgtggtcaccgccaccaccgagttcgcccccagggtccaggcggtgtgcagggtgtgccagaacacccgcatcggcagcttgccgccttccagcgccgaggcggcgaaacgcgagatttcccaggtgtcgtgctgccgtggcaagggccggtcgcagagaaaaccgaacacgtccgccagcagatagggttgggtggtcggtagcagtcgggcgcagccgtggaccttttcctcgctgtccagtgccagggtgtagcgggtgtcggcgtggtcgaactgatcgagctcctgcccgcactggttggcgctggagggcagtcgccaacccaattgcttgatgaagaccgcatggcgatagcggctgaggtcgtcgcgcagggccggcgaaagctggctttcatgccgtgaaatcacagtgatcatggggcgatatccttatcgtcgggtgaagcgtcagatcagccccaggacggcggcgtaggcggcggccagggtcttgttggccgcgccgaatttcttctggatgaccttggggtggaagttcacggtattcaccgagatgcccaggatcagggcaatctctccggaactcttgccgtcggccgtccattgcaggatttcccgctcgcgcgcgctcagctccagctgttcggcctggctgctggggtgcccgagttcgccgaggcgcatggtcgccagttcgatgatgcagcgcaggcgcaggcggatttcttccagttccacggcgctgatcgccgtgcattcacgggccaccgacaacacgctcagggcactgtcgggcgtgtggatgggcaaggtggcgcccacccgcaagccccattcccgggcctcgccccacaacaccgagcctttgccgaacaaggcgtcgctccagaccaccatttccgtggagcgcaggccattgaggatcgtcgggtcgatcgcggcgtagttctgttgctggtaacgctccacccaggcttgcggataagagccatagatgtcgattttcgggcgggtgaaggggatcgaatgcctgactccgtaagcgtaaaaatcaaaccccagggaccggacttcccgttccagcagcgcaaatacctgtgcgctctcctgttgcttgagcatctccatgcgcaggtcgttccaccagtgcatgaaatcctgtcgtttctccatggcgttcgccttgattccttgcacgtcagggaatctagtccagggcaatacgctgtcaatattcatgaaattcataggaaaccccgcaacggccctgatccggcgctctgcaccaggccacccgggtgcggggccggcaattcgggcggtggtaggcgtggagggggctcacggccgaggctggcctgcggcgctatgtcactgtgtggcggggtgccgcaaaggcactggccaggccgataagggcaaaagacgtccccggcaaaaccgctggcgagcatgcgcataactcttttccttgagtgttctggccgtctctggccaaggggcaggggacagcttcaggcaaagcgcaggcgggtgatgggttccacagcggtggctggctcgcgggctgcccgggtgctcggcagcaacggggcgagcagggcgcgatgcacgccgtcggcggcggttctcgattccaggtcgagaaaatgcccgcagtcctcgaccaccgcgaagcggcaatcgcgcacatgagtcttgcgctgcgggtcgttgcccggttgttcgacatgcccggggtagtcgttgaacgctttctcgatcacacaatggttacgccacatagcacacctccatttgttgcttttgacggggcgaaagaatccgcggcagctgagatccagctgtcgtgcgcggaatgtttttatagtcgtgtgagcgcttcgaacgatcggcgcgggttgacagctgtcatcccaaggcccgtggcaagcaggcagcgttcgacattcgggcgagcgtcgggcgccgttggcagtggcgtgatttttagcaagggcgggggagggctaacaactaccagatctggtaggtaaagacgcctggcgttctgccgccagagcgactagcgagcggatcgccgggataaaaaaacgccgcgtatcgtcgtgggatacgcggcgttcttcattgccttgcagccttaggcttgaaccaccggaatcttggcgttcgcggcagcctcacggaactcggcgatctggtcgaagctcaggtagcggtacacgtccgctgccatgctgtcgatcttgccggcgtattccatgtactcctcgacggtcggcaggcgacccaggatggacgcgacggacgccaactcggccgaagccaggtagacgttcgcgccgtcacccagacggttcgggaagttacgggtcgaagtcgaaaccacggtggagttcggctcgacgcgggcctggttacccatgcacagcgagcagcccggcatttccatgcgcgcgccagccttgccgtagatgccgtagtagccttcttcggtcagctggtgagcgtccatcttggtcggcggcgacagccacagacgggttggcagctggcccttgacctgatccagcagcttaccggcagcgcggaagtgaccgatgttggtcatgcaggaaccgatgaacacttcgtcgatcttctcgccagcgacgctggagagcaggcgagcgtcgtccgggtcgttcggcgcgcagagcacaggctccttgacgtcggccaggtcgatctcgatgacttcggcgtactcggcgtccttgtcggcttccagcagctcagggttggccagccaggcttccatcgcctgggcgcgacgctccagggtacgggcatcgccgtagccttcgccgatcatccagcgcagcagggtgatgttcgactgcaggtattcggcgatcgactctttggacagcttgatggtgcaaccggcagccgaacgttcggccgaggcgtcggacagttcgaaggcttgctcgacggtcagggtttccagaccttcgatctccaggatgcggccggagaaggcgttcttcttgcctttcttctcgacggtcagcaggcctttctggatcgcgtagtaagggatggcatggaccaggtcacgcagggtgacgccaggctgcagcttgcccttgaaacggaccaggatcgattccggcatgtccagcggcatgacgccagtggcggcggcgaaggccaccaggccggaaccggccgggaacgagatgccgatcgggaagcgggtgtgggagtcgccaccggtgccgacggtgtccggcagcagcatgcggttcagccagctgtggatgatgccgtcgcccggacgcagggacacgccgccacgggtcatgatgaagtcaggcagggtgtggtgggtggtgacgtcgatcggcttcggataggccgcggtgtggcagaacgactgcatcaccagatcggtggagaagcccaggcaagccaggtccttcagttcgtcacgggtcatcgggccagtggtgtcctgggagccgacggtggtcatcttcggttcgcagtaggtgcctggacgcacgcctttcacgccgcacgccttgccgaccattttctgcgccagggtgaagcccttggtgctttcggccggcgcttccggcttcttgaacaggtccgaaggtggcaggcccagttcggtacgggccttctcggtcaggccgcggccgatgatcagcgggatacgaccgccggcacggacttcgtcgagcaggaccggggtcttcatttcgaaggtggccaggacttcgtcgctgttgtgcttggtgactttaccggcgtgcgggtacaggtcgatcacgtcgcccatgttcatcttcgacacgtcgaattcgatcggcagggcgccggcgtcttccatggtgttgtagaagatcggtgcgatcttgctgccgaagcagaagccgcctgcgcgcttgttcggcacgtaaggaacgtcgtcgccgaagaaccacagcacggagttggtcgccgatttacgcgacgaaccggtaccgaccacgtcgccgacgtaggcgatcgggaagccctggccgcgcatttcctcgatctgcttcatcgggccggtcttgccttgctcgtccggaacgatgccgtcacgggccattttcagcatggccagggcgtgcagcgggatgtcgggacgggaccaggcatccggggcaggggacaggtcgtcggtgttggtttcgcccgtcaccttgaatacgcgcaggctgatcttgtcggccagtaccgggcggttcttgaaccactcgccgtcggcccaggattgcagtacgccctgggcgtgaacgttgccgttcttggctttttccgcgacgtcgtggaaggcatcgaacatcagcagggtgtgcttgagctgtgcggccgcgaccggcgccagctcggcgtcgtccagcagctcgaccagggtcacgatgttgtagccgccctgcatggtgcccagcagttcaacggcgcgcttcttgtccagcagaggggatttggcttcgcctttggccagcgcggagaggaaaccggccttcacataggcggcttcgtcgactcctggcggaacgcgattggtgatcaggtcaacgaggaaggcttcttcgccagcggggggattcttcagcagctcgaccaggcctgcagtttgttcggcgtttagcggctggggaacgatacccagggctgcacgctcttcgatatgtttgcggtaggcttcaagcacagtattaccctcatcagtggtcccaaatgggtgtccgggacgctcatcccgaaattgccgtactcatgcgctgcgtgacgttatgggtcgcttagccagaattaccggcaattccttacagaagctgctttcaaagttttacgcctgcagaacgggagctgatgagggttggcgctgggctttccccgctggaaagacccatcgccaacaccgctctgaaggaacgactgtgctcgtgacgctttgaaaacagcttctaacggacattggcgcctaaaaaggctggctgattctacggcaaaaaaaatttaaaggtaagacagggtctattggactttggtggcgagccgcgttgctgggccaacgtgtgcgaggcaaggcgcgggatgccgccaatggttgttcccttggcaaatcccgcaacgcagcctcgcgcacgttggcacgcaacccgaagggacggggcccgcttggtgcagggctgcgttgctcggaacttatttggaacaaccaaactgcgttcctcgcgccttgccctgcaccaagcgggcatccgtcgcggccgccaccaaagtccaatagaccctgatgcctcgaagtttgaggggtgatcaatgttagacaaagggctaacatgcgggcctgtttcgcttttttccgccaattgcctacttatgcccaatcagaccatcaagaccccctgcgtcggcctctgctccactgtctacggtgacctggtgtgccgtggctgcaagcgtttccaccatgaagtgatccactggaacggctacaacgaggaagaaaagcacgcggtgtggctgcgtctcgagcaattgctggtgcaggtgatggcggccaagctggaagtcttcgacccccagcggctgcgcgagcagctggagcagcgcaagatccgcttcgtgccgcaccagtcggaatattgctgggcctatcagctgatcgcccgcggggcgcgggtgatcaaccagctggaagcctatgggatggtgttgctgccggagtttcgcgactgggaactgccggaattgcgcgatgccatcgatcgggagtttttcctcctgtcggaagcccactaccagcgttatatcgccccggggttcctcaaggacgcctttggcgcctgaccgctaaaaaaaacatcgcgagcaatcgagcgccgaccggctgctcctacaaaggtgggtttctgtaggagcgagcttgctcgcgatggcgttctatcagtcaacccatccctcaatgcttgccggccagctcttccaggtggtccatgatgtcctccggcttgagcaccagcacgtcgctttccagggcatcgagcaccacttccgcggtattgccgatcagcgccccggaaatcccggtgcgcgccacggtgccgatgatggtcagcgccgcctgcagctcatgggcggtgtgcgggatcagcacgtccgccgggccttcctctatatgcaggtgggtatcgtcgatgtcgaattcggcctggaacgccttgcactgctcgcggtagcgcgcctcgatggtttccttgagctggaacactgggtcggacgccgacagcatcggcgacggatgggcgctgatcacatgcaactgcgccttggccaggctggcgatgtcgaaaccatggtcgatgatgctggcatgcagggtgcggtgctcgccgtcggtgttaccgacatcgatggccgccaggatcacgccgccggtccagggcttgacggttttcaccagcagcacggggcttgggcagtagcgcagcagtttccagtcggcgggggtgagcaaggcctttttcagcgggttgtcggcaaagtgctgcttgatcaccaggccacagccttcggcctgctgcacgtcgatgatggtgctgtgcaggctgtcgttccaggcctgctcggtggtcacgctgtagccctcgctcagcaggctgctcttgagcacgctcaacagcgccgaatgctcgtgtttcttgtcgcacaccagcaggtgcagatgggcctgggtcaccccggcgatcagcttggcgcgcttgagcgcgaggctttcggaatgctcgggctcgatgaccaccaggatgctgcggatggcttgcatggtcgggatctccagagagggatgaaggctatgttgcacaactatagttgctgcgcgccgccgtggctgttgacgcacatcaagcgccgcggctggtggtctgtggcgcggccggtataatcggcgcccttcgccgtgaacccttatgccgtgagccccatgttatcgatccctgaagtcgccaccgtcctgccttgcgcgctcattcccttgaaggctgccctgaaggacgaacgaccatgaacctgccagaaattcatgagttcctcggctgccgcacgccggatgcctgggtccgggcggccctggcggatcaggaaaccctgctgatcgaccacaagaactgcgagttcaaggcggccagcacggccctgagcctgatcgccaagtaccactcccatgtcgacctgatcaacatgatgtcgcgcctggcccgggaagagctggtgcaccacgaacaggtcatgcgcctgatgaagcggcgcaagatcgaactgcgccagctgtcggccgggcgttatgcctcgggcctgcgcaaggtggtgcgcagccacgaaccggtgaagctggtggacaccctggtggtcggcgcctttatcgaggcccgcagctgcgagcgtttcgaggcgctggtgccgcacctggacgaagagctgggcaagttctacttcggcctgctgaaaagcgaggcccggcacttccagggttacctgaagctggcctatcagtacggcgacgccaaggacatcgcccaggtgattgagaaggtgcgcgccgccgagcgcgagctgatcgagtcgccggacgtggagttccgcttccacagcggcgtgcctactctgtagaacggcccaagtcggttcaaaactacgggcaaattgtaaaaaactcttaaaagcatgaaacatcattgaaaaccggccatctgggccggtttttgctgtctgtcctggtctcagatttatccgatgccgcctataatgcgcgccccaattgtgcgcactcagactggtatttatggataacccgggtcttggcaaagtattgctggtggaggatgacgagaagctcgccgggctgatcgcgcacttcctgtcccaacacggttttgaggtcctgacggtacatcgtggcgatgtggcgctggcggcctttctcgagttcaagccgaaaatcgtcgtcctcgacctgatgctgccgggccagagcggcctgcacgtgtgccgggagatccgcaacgtggcggacacgcccatcgtcattctcaccgccaaggaagacgacctggaccatatcctcggtcttgagtccggcgccgacgactacgtgatcaaaccgatcaagccgccggtgctgctggcccgcctgcgcgccctgcaacggcgccaggtgccggagccgacggtgcgcggcgcgctggagttcggcagcctgaccctcgaccgcagttgccgggaagtacgcctggccggcgagctgatcgagctgaccaccatggagttcgagctgctgtggctgctggccagctcggcgggcaagatcctctcccgcgacgacatcctcaaccgtatgcgcggcatcgccttcgacggcctcaaccgcagcgtcgatgtctacatcagcaagctgcgcggcaaactccaggacaacccccgtgagccggtgtgcatcaagaccatctggggcaagggctatctgttcaatccgttcgcgtgggagctttagatgctgcggctgtttctgcgtctgtacatcatcctggccctggggctggcgggggccatctgggcggtcaactacaccttttccgagctgttgccggacgccaacgaaacctacaaccgcgaggccatgcgcgggccgggatacagcctggtcaaccaactgtcgccggtcacgggagcggcgcgcgagcagcggctggccgagctgcaacaacactacggcatgcgcctgaggctgttgcaggcggatgagctggacctgtccgagcgcgaacgccagctgctggccgagaacaagctggtggtgcgcggcgacttcagcgagttcatcgccaacctcgacggcggcccgcagttgctgagcatccgcctgccggaagaacccaagtggctgtacatctgggcctatgcctttctcggggccagcctggcgttggtcctgtatttctgggtgcgcccgcattggcgcgatctggaactgattcgcctggcggcccagcgtttcggcaataacgacctgggctcgcgcatccgcttgtcgcggcgctccagcgtgcgcgacctggcgcagcacttcaaccagatggccagccgcatcgaaggcctgatcgccaatcagcgcgagctgaccaacgcggtgtcccatgagttgcgcacgcccatcgcccgcttgtcgttcgagctcgaccagctcaagcagtccgacccgcggcagaaccgcgagctgatcgccgacatgtacgccgacctcggcgagctggaggaaatggtttccgaactgctgacctacgccagcctggaacacggcgccacggtgatcaaccgcgagaccatccaggcccgcaactggctcgacagcgtggtcggcagtgtcgccctggaggcggaagcggcgggggtgcagatggcgatccgggcctgtgaggtcgagtacatcagcatcgaaccgcggttcatggcgcgggcggtgatcaacctgctgcgcaatgccattcgctacgctgagcggcgcgtcgaggtgtccctggtgcagctcgggcagggctatgaggtccaggtcaacgacgacggtccgggcgtgccggtggcagggcggcgaagatcttcgagccgttctcccggctcgacgccagccgcgaccgccgcaccggcggcttcggccttggcctggcgctggtgcggcgggtgtcgcagtcccacggcggccaggtcgaggtgacggattcgcagtggggcggcgcgtcgtttcgcatgacctgggcgcagctcgaatagcccgggcagcttgcgcgcgataacgtcagaacggcctacgccgcttaaaagctgtactccagggtggtggccagtgacgtttgcagccgccgctcgacaatcgggctgtccgccgcttcccggcccaggtactgcagcgccagcaccgtcgacacgttcatctgttcactgaccggcactgtccaggtcaggtcgccgccccggctgagaaaaccgcctttgggccgataggcgccgaagcgggtcctgccagcctgggccgcgctgacgccataccaggtgcgcaggtagtcgccgtcgccgaactggctgttgaggctgccctcgaggcgcccgtaccggccctcatacagcgtgctgccgatactcagctgcaggtggttgtaggccgagccagtgtcgtgatcatcgttcttcttcagcgcgtgctgcagcgtggccccgagctccacggtgcccagggtgtagcccaggtgagcaccaaactgcgcgcgggacttgatcgagcccatgccagcgagatggtccgaacccttgtagccgtgcttgcggtccttgcgtgcctcgctggggccgacccaggtgctgaacgccaggtcgccccattcgttgccccagccaaggccctgttcggtgttgagaaacaccccgtaggggctgacgattgcgccgcccaggatcggcgcgactgtgcgttcgtcgctgccgctgtagcgcggcaggctggccacgccggcttgtagttggtattgccagtccgcggcgtagagcgggccgctggatgtcagcaggcacagcgaagccagaggcagtgcagcaagggacaggcacaaggttttcggacggatcgaggtcttcatcgcggctagaaactcagcagggtgtgggagtggtcgttggctttggaataggaactgcccaggccatcgcgcgggcgctgggcgaccttgcgcaccgaggcgacaggggctggcttggcgcggagggcggtctcgggtggcgtggcgatttcaggcggtggttcgacgctgggcgtcgggggcggcgtgccctggcaactgaggccgccgagcagcacaccaatgaagagcgtgaagaatcgaccgtacatggcgcacccgtggggaaatggatgcgctcatgctagggacgcgggcgcgggcaatctttggcagctttgtcgcaaaactgtcaaagactgtgaatgcccggcgcttagcgttgcaggtccaggcgttcatgccgctcatgtctttcatgccactgggcgatagattcctcggggtaatgggcgaattgcaggtctggggatgccagtcgatttccacccagggtgcccgggagtcgagcatcaggtgggtgtgctccggcggtatcggcaacggcgtgtcgatggccgaggcaaagggatggatcagttccggccactctgggctgaacagccacaacccggagccgcagcggctgcagaaatgccgttcggcgctgctgcgccgggcgcgtttgccgggttccctgagcagcgcgtggtagatcgagatgtgctggcggccgcggactttcaggctggcggcatcgccgccgaggttgatcgcatacccgccgccgccctgggtcttgcggcagatcgagcagtagcagcgctgataagggtaggggtgggcgctgttcaggctgaagtggacagcgccgcaatggcaggaaccttcgagttgcatgacgacctccgacgatccatggggcatgaccgtcagcctagccgcgtttttgccagcagtgcgggacctcgttgtagcccgccgcgtgccgccagtgcggcaacacgctggtcgccggcgcgcggttttgcgcgcagtgtggcggggcagcgggctgagaccggcctacagcgccaggtggtagcggacctgggtcgcgtcgtccgggtcgatggcgcggtggaaacccagggtcgcggccagttcgcgcatgcggtgattggccgggcaatccagggagtacatctgcttgaagccctggtccttggcgcggtcgaccagatggcgcatcagcaaggcgtccaggccctggtgctgccattcgtcggccacggtgacggcgaactcgcaggtgtccgcgtcggcgccgatggtggcatagcggctgatgccgatttcccgcagcgagccgttgtcgtggaccagggccacgtaagccacgcgctggctgccatcgacgtccatcaactggctgagcagggcctcgccgacttccttcacttcacccaggaagcggtggtgccgggtggtcggcgaaaggttctcgataaaggccttttcccgctcgcggtcttcggcgcgcaacgggcggatcagcaccgggctgccgtcgttgagggtgtctatccagtgttcgcctttgtaccgggcgaaggcggccagggcaggcgtgtggagggcggtgctggtcatgggcaagtctccgtgaaggtgcagaggtttgcctgaacattcacacctgtcaggcgcggggcccttgattcaggtcaacgggcggcggtgtcgcagagggttttgcgccagggggtagattggcccccgagcgatcaggcctcgggcatcagggtggcgatcagcgcccgcacggtgccgggcagggcctccagctcacggacgatgatgctgcgctcgcgcaccgcccaggcctcgtcgagtttcaccgtcaccagctgcatggtgcggctgtgccggatcgcggccgattcgggaatgatgccgatgcccacgccggcctcgaccatgcggcagatcgcttcgaagctcgacacctggatccgcagcgacaactgcttgccggtgcgctccacgtgttcgcgcaaaaaactcagcaaggtgctgccttcgtgcaggccgatgtgctggtaggccagggtctgctccagggtcaccgccggctgcgtcgccagcgggtggtcgaccggcaggatcagcaccaggtggtcggtgctgaaatgcaggacctgcaggccgctggcttccaccgggccggcgatgatgcccatgtcggcggtgccgtcgagcacgccacgcacgatgtcgcgggacaggcgctcctgcaggtccaccgtgacccccgggcgtttcgacagaaagccggcgaggatctccgggaggaattcggtcaccgccgtggtgttggcgaagatgcgcatatgcccggtggaatcaccgccgtattgggtgaactcgcttttcaggtagtccacctggcgcatgatcagccgcgcatgctgcaacagccgctcgccggccggggtgacttcgacgccgcggctgtcgcggtacagcaggcgggtctcgagctggctttccagggccttgatccgcgcgctggccgccgccggcgagagaaaggcgcgcttggcgccctgggtcaggctcggcgattcggcgatatggataaacaggcgcaggtcggccaggtcgaaatgcatgggcgggctcctgggagggaagaggggcaaagcggcgttcagcataaccgaacgccggtttattgaaatgcaaattctcagaacgcacagcggcttgcatgatcgggcgcaccaccaccgcaacaggacccgacccgatgagcgtgaccgaccccagcgcctggacaggccgtagccagcaagcccgagacctgctcagcgacaacctgctaaagcgcatcgccgcgacctttggcgaacccgtgccgccccctggcgaggccttgccgccgctgtggcaatggtgctttttccaggagcccctggccgaaagcgccctgggtggcgacggtcatccggcccgtggcggcttcctgccgccggcggccaatcgcaaccgcatgtgggccggtggccggctggagttcttcgagccgctgcgcgccgggttcgaggcgcaatgcgtgtcgaccatcagccaggtcgaggaaaagaccgggcgcaccggcgcgctgttgttcgttactgtgcgtcatgagtattcccaggacggtcgcctggcgattcgcgaggaacaggacatcgtctatcgcgagccgactccgcccaagcagggcagcggcgagccgctgatccagggcgactggcgcgaacccgtcgagcccagcccgaccctgctgtttcgctacagcgccgtgaccttcaacggccatcgcatccactacgactttccctatgtcaccgcgaccgaaggttatccggggctggtggtgcacggcccgctgatcgccaccctcagcctgcgcgccttctgccgcgcccatcccggggcccggttgcggcgcttcgcctatcgcggcctgcggcccttgatcgcgccgcagccgttcgaggtcggcgggcgcatcgtccgccccggcgtcgccgagctctgggccggcaacgacgccggcctggcccagcgcggcgaagtgctgttcgacgccatcccggaatgaccccatcccagcacaataaccacaggcggagagccgttcgatgaaccccaacagcaacgaagaattgaatgccatccgtgaaggcgtgcgcgccctgtgcgccgagttcgatgccgcctactggcgcaagatcgatgaagaaaaaggtttcccggaacgcttcgtcaaggccctgaccgacgccggctggctggcggcgatgatcccggccgaatacggcggctcgggcctgggcctggccgaagcctcggtgatcctggaagaagtgaaccgctgcggcggcaactccggcaccgtgcacgggcagatgtacaacatgttcaccctgctgcggcacggcagcgaagtgcagaagcgtttctacctgcccaagctcgccagcggcgaactgcgcctgcaatcgatgggcgtcaccgagcccaccaccggcaccgacaccaccaagatcaagaccaccgcgatcaagcgtggcgacaagtacgtgatcaacgggcagaaggtgtggatctcgcggatccagcattccgacctgatgatcctgctggcgcgcaccacgccgctggccgaggtcaagaagaagtccgaaggcatgtcgattttcctggtcgacctgcgcgaagccatcggccacggcctgaccgtgcagccgatcgccaacatggtcaaccacgagaccaacgagctgttcttcgacaacctggaaatccccgccgacagcctgatcggcgaggagggcaagggcttcaagtacatcctcgacggccttaacgccgagcgcacgctgattgccgccgagtgcatcggcgacggccgctggtttatcgaaaaggccagccagtacgcccgcgaccgcgtggtgttcggccggcccatcgggcagaaccagggcgtgcagttccccatcgccgaagcccatgtcgagatcgaggccgccgacctgatgcgctggcgcgcctgcgaggaatacgacagcggcggcaacgccggggccagcgccaacatggccaagtacctggcggccaaggcctcatgggaggcggccaacgcctgcctgcagacccatggcggtttcggcttcgcctgcgaatacgacgtcgagcgcaagttccgcgaaacccgcctgtaccaggtggcgccaatctccaccaacctgatcctgtcctatgtggccgagcacctgctcgaactgccgcgcagcttctgaggaaccgagcatgagccatacccaagccttggccgggttccttgccggcctgagttacccgcagttgcccgacagcgtgctggcgcgcaccgaagagctgttcctcgactggctcggctccgcgctggccagccagggcgcgcatccgatcccgttgttcgagcgttacgcccagcagatgggcccggccgatggcccggcgcggatcctggtcaacggccgcggcagctcggcctatttcgccgccctggtgaacgccgcgtcttcccatctggtggagcaggacgacctgcacaacagctcggtgctgcacccggccaccgtggtgttcccggccgcgttggcggcggcccaggatctgggcaagtccggccaggagctgctgctggcggcggtggccggctacgaggcggggattcgcattggcgagttcatgggccgttcccattaccggatcttccacaccacggccactgtcggcacccttgctgcggcggtggcggtgggcaagctgatggacttcgaccaggcgcagttcatcaacctgctgggcagcgccgggacccaggccgccggcctctgggagtttctgcgcgacgccgcggactccaagcaactgcacacggccaaggccgcggccgacgggctgctcgccgcctacctgacccgcgacgggctgagcggcgcgcgcaatattctcgaaggcgagcagggcatggccgcgggcatgtcctgggatgccgagccgacgcgcctgtccgaccgtctgggcagtcgctgggccttgctggaaacctcgttcaagttccacgcctcctgccgtcatacccatccggccgccgacgccttgctggcgttgatgcaacgcgaaggcctcagccatgggcggatcgccagcgtggaaacccgcgtgcaccagggcgccatcgatgtgctggggcgggtgagcgtgccgcagaccgtgcaccaggccaagttctccatgggcaccgtgctcggcctgatcgccgtgcatggcaaggccgggctgccggagttccaggagctggcgctgaacgacccggcggtggcggcgtttcgcgacaaggtgtcgatggtcctcgaccccgaggtggaccgcgcctatccgcagcgttggctgggccgtgtagtggtcagcaccgacgacggtcgtaccttgcacggtgccatcgacgagcccaagggcgatccgggcaacggcctgtcgcgggccgagttggcggacaagttccagcgcctgctgcgcttctccggcgcccgcaccccggagcagggcgcggccctgatccgccaggtgtggaacctgcgcgacaccgcgcgactgaacgaattgctctgagcccgccccgaggacgccttatgacacttaataccgcacaaccccggccgctggacggcatcaccgtggtcagcctggaacacgccatcgccgcgccgttctgcacccgccaactggccgacctgggcgcccgggtgatcaaggtcgagcgccccggcagcggcgactttgcccgtggctacgacgagcgcgtgcgcggcctggcctcgcatttcgtctggaccaaccgctccaaggaaagcctgaccctggacctcaagcaggacgccgccggcgacattcttgaacgcctgctggcccaggccgacgtgctggtgcagaaccttgcgccgggcgcggcggcgcgcatgggcctgtcgttcgaggcgctgcatgaacgctttccgcggctgatcgtctgcgacatttccggttatggcgagggcggcccctatgagaagaaaaaggcctatgacctgctgatccagagcgagggcgggttcctgtcggtgaccggcggcccgggtgacgatcaactggccaaggccggctgctcgattgccgacatcgccgctggcatgtacgcctacagcggcatcctctcggcgctgttgctgcgcggcaggaccgggcagggcagccgcatcgacgtgagcatgctggaaagcctggtggagtggatgggctacccgatgtactacgccttcgacggcgcgccgccaccaccccgggccggcgcggcgcactcgaccatctacccctacggaccgttcccggcgggggatggcggcacggtgatgctcggcctgcagaacgagcgcgagtgggcggcgttctgcgacaaggtgctgctgatgcccgagctggccggagacgaacgcttctcggccaacttcaagcgctcggccaatcgccaggcgctgcggcagatcatcgtcgacagcttcgcccggctgaccgtggaggcggtgatcgagcggctggaacaggcgcagatcgccagcgcccgggtcaacgacatgcagggcgtgtggcagcacccgcagctcaaggcccgcgacggctggcgcgaggtcgacagcccggccggcaagctgccgtcgctgctgccgccggcgcgcaatgccgcgttcgagccgcgcatggacggcgtccccgggctgggccagcacagcggcgcgatcctcgccgaactggggctgtccagcgatgccatcgagcagttgcgaagcaatggcgtgatctgaaaccgacctgccggcttgcatggcccccctgtaggagcgagctcgctcgcgatacgcccgaaaggtcgatgcaaatctcgagggcctcatcgccagcaagctggctcctacaggggaaatcggggataccccacagggcctgcggaccccacatcacttacaaggaattcaacatgcccaaccctattgtccgctctgccttgttcgtcccgggcagccgtcccgagcgtttcggcaaggccctggccagcggcgccgatgcggtgatcgtcgatttcgaggacgccgtggaagagccgctcaagcgccaggcccgggacaacctcgagcagttcctcagcagccagccccagacgcggctgtgggtgcgggtcaatgccccggaacatgccgaacatgccgccgacctggcgttctgcaaagcccgggccggggtggtcggcatcctgctgcccaaggtcgaaagcgccgcccaggtggcgaccgtggcggccaccggcaagcagatctggccgatcatcgaaagcgcgcgcgggctcttggctttggcggaaatcgcccgggctcctgcggtgcagcgcctgtccttcggcggcctggacctggcgctggacctcaacctgtgcagcggttcggcggcagcgcagtttgccctcgaccaggcgcggctggcgctgatcctgcattcgcgcgccgccggcctggtgccgccattggatggcgtgcacccggcgatcgatgaccccgaaggtttacgccagtccattcgccacgcctatgaaatgggttttgccggtgccttgtgcatccacccgaaacaggtgccggtgatccaccaggccctaacccccagcgccgaagacctggcctgggcgcaacgggtggtggacgccggcagccacggcgccggcgcctatcagatcgacggccagatggtcgacgcgccagtgctgctgcgggcccagcgcctgttggcgctgagtccctgaatactgcaatcgcgcaggagcgcgttaccaactgccatagggaatgccgtatcgctctatgtagcgcttggcgttttcggacagggggtaatagtggccgttggacttgcccaggtgtgggcccagtggctcgatttcaccctgggcgcgggcgactttgaccgggtgatggcattcgtccctgacccagacttggacgatgccgccaggagcaaggcccagatagaccgatgccatgtagcgggcagtctggtgtggggtttccgggcagcgtcgattcgtcgaggtggtcatgattttccgggcttcttccgggatatctatccatgctcgataagtttggggttccacaactgattgccagcgcacataaatacgcttaggcaggtcggcccccaccactgaccatccactggctccaactttatccccccagcctctggcccattctttgtcataaccgaggtcgccacctgcagcggagcctttacccgtgcgaaggaatagcttgccgttgatgtcttcaacggcgctgtcttcgacccagacctccatgtagaacggctcgataaagccaagctgccaccaaggggcttttgggtcgttttttccagaaagcggatcagcgtgacagccacttaacagcagtgtgcccagcagggcgatgaatgctctcattaccaaagcgtccaatcaggtacgtgaggatgttgcacacgcacggcatccaccgtgggggcgttgatatagacgactttaaggctgccgccgtcctgtttgcccagcgggtggttccaatgggccgaaagatggatatagcgcagtttgagcatcgtatcttcagcaggcgtcgtactgtagtcgccggcgacaaacctgtcacaaagagcttgaagctcttgcgggatggcgtagtccggatcctgttcgtcaatccccttaaagcgcacgccattctccttcgccaattcatacatgacccgcagatacaccctcgacagtttgttgctcattggcctcttgagcagcaggccggcatacacccgttttcttcgtggtccgaggcggtcttgtggctcctggggcatcaacagcggctctggtgtgacgatttccagccattgcgcaggccaacccttggcgagccagcgtgttcttgcctggatcgcatcccggtaaatcgaggtacgggtcacgtcggtattgataggcacctccagtgcttgcatagggctgatcagcacacactcttgcacctcatccagatagccgccgccgatatccgaatgcgcgccgggcagggcaatctcgaggtggtcgggcttgacctggctcagggcgaagttggcccgatactcgtcgcgggcgaccagttgcaccaccgagcgaaagtagcggcggtcgaggtggagcttgataccgggagcaatggcgctgcgcacattgcccagattgctcaagccggcaatcgaaggcacggtgtcgaacagaccgataaaacccatatcgacatcgtggccgtactgccggttgaagttgggactgagggcctcgcaatggctatgcaaaatcagttgcagcggtccgagccagcgcacgacctcattggcaaagtgccgggctgctgccgcgcctcggctaaagccaaaggcatcgaaggtcagtgaagtgatttcactttcgagattctcttcatgggtttcacgtataagttcctcaatttcacgaaatgccctttgtacacaccccaagacacctctttctccacgtccggttcctgaggtgatcacactgtctttctcgcgtgtctttgtgccgatgccctcgatataaattgagcgaaaggcttgcttgtgcagaccttcgctttcagcttttcgagggaagtagtacagctctctcaacagctttatgttgctcaccccattcccgtaactactctgcggatcactcatatacggcttgcaactggcatcgatgtctttgggctcgatggcatgctgggccccgcaaatctcgcccatcgccgagttgccggcattgttgccggtaccatcgaagaacacgccaatgcgcagcgccacctgaatcttttcaggcggtggcgcaggctctttggcgtatttctcgtattgggcccagagctgttcgccgtagctgggttggtcggtttcggcggcgcgttcggcgggtggttggttggggctctgattgggaatggcgggccgtagaaggcggggcatcggcccgggtccgttgttggccatgggtggtcctggtgcggtcgaagagggtgctggagaccgtaccgggaatggcggggcagggatttaggaggaatctgcaacaggctcggttgcggctgattccatcgtagggggatggaacttcaggcgcctatcgccggtagcgcgcggcgttcggcccaggcgaacgcaggtatcaaaaattcaaaattctcaatacgcgtgcccttaggcactctgcgatcaaccacaacaataagaaggtgaagtccatgttcaagctctcccgggcgttgttctgtgccgtcgcattgctgggcgccggtcttgcgcaggccgccgaccctatcgtgatcaagttcgcccacgtggtggcggaaaacacccccaagggccagggcgccctgctgttcaagaagctcgccgaggagcgcctgccgggccgggtcaaggtcgaggtgtatccgaactcctcgctgttcggcgacggcaaggaaatggaggcgctgctgctgggcgatgtgcagttgctcgcgccgtccctggccaagttcgagcagtacaccaagaaggtgcagatctacgacctgccattcctgttcgataacctcgccgccgtcgaccgcttccagcaggccgagggcaagcagctgctgaccgccatgcaggacaagggcatcctcggcctggcctattggcacaacggcctcaagcagctgtcggccaacaagaagctggtggaacccaaggacgcccgcggcctgaagttccgcgtgcaggcttccagcgtgctcgaggaacagttcaaggcggtgcgcgccaacccgcgcaagatgagcttcgccgaggtctaccagggcctgcagaccggcgtggtcaatggcaccgagaacacctggtcgaactatgaaagccagaaggtccacgaggtgcagaagtacttcaccgagaccgaccacggcctgatcgactacatggtgatcaccaacgccaggttctggagcggcctgccggcggatgtgcgcggcgagctggaaaaaatcatggccgaggtctcggtggaagtgaacaagcaggccgaagccctgaaccagacctcccggcagaagatcatcgacgccaagaccagcgaaatcgtcgccctgactcccgagcagcgcaacgagtggcgcgaagccatgcgcccggtgtggaagaagttcgagggcgatatcggcgccgacctgatccaggccgccgaagccgccaaccaggcgcaataaccacctgcatcccggccgctgcgctcgcagcggcccatcggcagccgctatcgggctgcactccactggcactttcgcggagaacctcaatgcacaggctgaggcggttctgggaacattttgaagaggcgttcatcgccttcctgctggcggccatgacgctggtgacttttgtctacgtggtgctcaacaacctgtacccgctgttctacgccatcggcgatgcctgggaagggggcagcgcgctgttcctggggatcggcgacttcctcatggagctggcccaggacatggtctggagcgtggcgctgaccaagatgctgtttggctggctgatcttcttcggcatttcctacggcgtgcgcaccgccggccacctgggggtggacgcgctggtcaagctggcctcgcgcccggcccagcgcctgctggcggtgatcgcctgcctgtgctgcatggtctacgccgggctgttcatggtcgccagcttcaagtggctgatggcgctgatccaggccggcatcgaagccgaggacctggaccagttcggcattcacctgtcgcacatcgcgatgatcgtgcccttcggttttgccctggtgctgatccgctacctggaaatcatgtggcggatcctcatgcgcgggcagatcaacctgggcctggccgatgaggcggccgaggccagcaagcttgccagtcaccacgaggatcagcactgatggccattctctgcctgtttctgatgctgttcgtgttcatgttcctcggcgtgccgatcgccatttccctggggctggccggcgccacttcgatcctgctgttcagcccggactccctgagctccctggcgatcaagctgttcgaaacctccgaggcctataccttgttggcgatcccgttcttcctgctgtccgggccttcatgaccaccggcggggtggcgcaacgcctgatcgatttcgccaacgcctgcgtcggccacatccgtggcggcctggcgattgccgcggtgctggcctgcatgctgttcgcggcgctgtccggttcgtcgccggcgaccgtggcggcggtgggttcgatcgcggtggccggcatggtgcgttccggctacccacgggagttcggcgccgggatcatctgcaacgccgggaccctgggcatcctgatcccgccgtcgatcgtgatggtggtgtactcggcggccaccgaaacctcggtcggcaagctgttcatggccggggtcgtaccgggcttgctgctgggcgtgatcctgatggtggtgatctacatcgtcgcgcggatcaagaagctgccggcgcaaccgcgggtgtccttccgtcaatggctgagcaccgcgcgccgcgccttctggggcctgctgttgctggtgatcatcctcggcggcatctacagcggcctgttcaccccgaccgaagcggcggcggtggcggcggtgtattcggccttcgtcgcgctgttcgtctacaaggacatgcgtctgcgcgactgcccgaaagtgctggtggagtcggggcggctgtcgatcatgctgatgttcatcatcgccaacgccatgctcttcgcccatgtgctgaccaccgagcagatcccgcagcagatcaccaccttcgtcatggacgccgggctgtcgcccatcggtttcctgctgatggtcaacgtggtgctgctggtggcgggcagtttcatggagcttcggccatcgtgctgatcctggcgccgatcttcttcccgatcgccatgaagctgggcatcgacccgatccacctggggatcgtcatggtggtcaacatggagattggcctggtgcatccgccggtgggcctgaacctgttcgtcacctcggcggtgaccggcctgacgcttggccagaccatccgcgcggcgttgccgtggctgatgatcctgctggcgttcctgatcctggtgacctacgtgccgttcatttccctggcgctgccgaactggctggggatgaactgacgcaacgctgttacttgcaggagaggcggtttgcacgatccttgtaggagccggcttgctggcgatggggccttgagatttgcagcgctcttgcgggcttatcgcaggcaagcctcgctcctacggggcgctggacgctggcgctgcgtcgcggcagcatggatgccttcatttcgggggcttggatatgcgacgtctgccttccctggcggcattacggactttcgagtgcgcggcgcggcatgcgcattttggtcgggcggcggccgagctgtgtgtcaccgacagcgcggtgagccatcagatccgccagctcgaagagcaactgggggtgtcgttgttcgtccgcgagggccggcagatccgcccgaccccagcggccgggcggctgatgcagagcctgcagcaggctttcgagctgatcggcgaagcctgcgacgagctgcgcgatccgtcttccctggcggtgctgcgcctggcggtgaccgccgagctggcgcagaaatggctgatgagccggctggcggacttttccgcgcgttacccgcatatcaccctgcatctctatgaacagccgatcgacgccagcgtgccgggcgaagacatcgacctggcgatcacctatggcagcggcccgcaggacagcagcgcctacttcgtgcggccgttgccgagcctgcagttcttccctgtgtgcagtcccgggctgttcaaccagggcaccctgaaaagcccgcgggacctggcccgccattgcctgttgcacgacgatcaggatggcaagacctggaccgcctggctgaccagccacgccggcgatttgcgcccggcgcgccagttgtatttcgcccacgccgggctggcgctggaagcggcggcgcaagggcagggcgtggccatgggcgataatctcacggcccaggaagacttgctcaatggccgtctggtccggcccttcaacgccgccagcatgaccgccctgggacagtacgccctggtgtgcgagcgggtgcgcctggagcgcccggcgctgatgcagttgctggactggttcagcgatcagttgagcgattgatgagttgaattcaactgttgcgcaatattcatcgttggtgccttgacccggcgcggcgctagtttgatggccattctccagcaccgacgaggtttgcccccatggcccgattgctcgacaccattcccaaacacgatggtttccgcctgcccggcgaattcgaagccaaggccggttgctggctcggctggccggagcgcaccgacgtctggcgcaacggcgccaagccggcgcagaaggtttgggtgcggatcgttaccgcgattgcccagagcgagccggtcaccgtctgtgcttccgccgcccagttcgccaatgcccgccggctgttgccgccgcaggtgcgggtggtggaaatgacctgcaacgacacctggttccgcgacagcgggccgtgcttcgtggtcaacgaccagagcggcgaagtgcgcggcgtcgacttcgagttcaacgcctatggcggccttgacggcggcctgtattacccctgggacaaggacgaccagatcgccgccaagatcctcgaaatcgaaaacctcgaccgctatcgcgcgccgctgatcgccgaactgggcggcatccagagcgatggtcagggcagcatcctcaccaccgagcagtgcctgctcaaccgcaatcgcaaccagcacctgggcaaggccgaggtcacccgacggctcaccgactacctgggcgcggaacaggtgatctggctgccgcggggctgcaagttcgacgagaccgacggccatgtcgacgacctggcgtgtttcgtgcgccccggcgaagtggtgctgcaatggaccgacaaccgcgacgacccgcagtgggaaatctatcaggaggcctacgacatcctgcgcagcacccgcgacagccgtggccgcgagctggtggtgcacaagctgccgcagccggacgtgctggaatggaccgccgccgaagccgaaggcctggaccagctggacagcacccatgcgcgccaggccggcacgcggatctgtgcctcgtacatcaactactacgccggcaacagcgcgatcgtggtgccgctgttcggcgaccgtaacgacaaaacagcgttggccaccctggccgaactctttccccggcaccgcatcgtcggcatcgacaattcacgggaaatcctcctcggcggcggcaacgtcgcctgcatcaccatgccgcaatacgcggctccccggcgcaccggcgaagagggctgaacatgaacctgcacaggctgggcggcgcgttgctgctggtgctggcgccgttgtgcgcccaggcggccgacgaggccgaacccacggtcaatctgtatatctggggcgagtacctggccccggacaccctggacaacttcgagcgccagaccggcatccgcgtggtggtcgatcacttcgattccctggaaaccgtggagaccaagctgctgaccgggcgcagcggctatgacctggtgctgaccgccggccagcacctgtcccgggccatcgccagcggcgcgctccagcccctggacaagcagcgcctgccgcacctggccggggtcggcgaggagttccgccagcatatggcggtgttcgacccgggcaaccgttatgccgggatctatgcctggggcaccaccggtgtcggttatcaggagcaagcggtcagccagcgcctggccgatgcgccgcgggacagctgggcgatgctgttcgatccggcggtggtggcgaaattcgccgactgcggggtcagcctgctcaacgatcccaacgaggtgttcgccgcggtgatgaagtacctgggcctggacatcaaccggcagaacctcgacgacctgaaactcgccgagcagcaactggcgaagatccggccctatatccgctacttcgacaacgacctgaacatcagcgacctggccaacggcaacacctgcgtggccatgtcgtggaacggcaacgtggcgatcgccgccgggcaggccgaggcggcgcacaagcccttcaccttgcgctatcgcattcccagggagggcacgctgatctggttcgacgccatggtcatccccaaggacgccccgcaccccgaggccgggctggcgttgatggattacctgatgaccccgcaggtgatcgcgccgatcaccgacaccatccattacgccaacgccatcagcgccgcggatgccctggtcgatccggcgatccgcaacgaccccggcacctatccgacccccgaggtgcgggcctcgctgtacagcaagaacgacaacggcaaggccttcaaccgcgcgttgatccgcgccttcagccgcctcaagtcggggctgtgagtacgcgccaggcggcgtaggctggcgccaggcagcgggcgcagggccgataaccggcgctgcgggcgctggcctcgtcggcaaagaacacccgctggcggacatacccgccgcgggcgatggcgcgcagggcggccgggcaatccagccgcccgtagatccgactgccacggtggccgccgagggtgcccggttgttcgctgagaaaggtattgccctgggcatcgagcaaccgccagcttttttcggcgttcatccgtccctcctgcatccgtccctcctatagccgctgccgagcctgcgaggctgcgatcgaccgcgtagcggtcgccaggccaacgccaactgcatcgccaggtttacggggctgcgccccgatcgcaacctcgcgggctcggcagcggctacaagtgttggcatccgctgtacctgcgcgatgaacacacccgtcagcgcgcgggcacccgccacagataccaggccgccaccgtgcgatgcgggcgccaggacaggccgatctcgatcatctgcctgcgcgttggctgctgttccaggcccttcaggcggcggtagtgttcatccctcctgtagccgctgccgagcttgcgaggctgcgatcgaccgcgtagcggtcgccaggccaacgccaactgcatcgctaggtttacggggctgcgccccgatcgcagcctcgcgggctcggcagcggctacaagtgttggcatccgctgtacctgcgcaatgaacacacccgtcagcgcgcgggcacccgccacagataccaggccgccaccgtgcgatgcgggcgcaaggacaggccgatctcgatcatctgcctgcgggtcggctgctgttccaggcccttcaggcgccggtagtgttcatccctcctgtagccgctgacgagcctgcgaggctgcgatcgaccgcgtagcggtcgccaggccaacgccaactgcatcgccaggtttacggggctgcgccccgatcgcagcctcgcgggctcggcagcggctacaagtgttggcatccgctgtgcctgcaatgaacacacccgtcagcgcgcgggcacccgccacagataccaggccgccaccgtgcgatgcgggcgcaaggacaggctgatctcgatcatctgcctgcgggtcggccgctgttccaggcccttcaggcgccggtagccctcgcgcacgccgaagtcgtcggcgggcaggatgtccaggcgttccaggctgtagatcagcagcatctccacggtccagcgaccgatgccgcgcaggcgggtcaggcgctcgatcagcgcctcgtcgtccatggcccgggccgcctggtaatccggcaccacaccgctcagggtcgcttcggcgatgccgcggagggtggcgatcttgccggcggaaaagccacaggcgcgcaatggctcgaagtcagtggcgaggatctgctcgggggaggggaaggtttgcccatacaaccccaggaaacgcccgagaatcgcatcgccggcgcgagcgtgcagttgctgataggcaatcgcccgcaccagcgcctcgcagggctcgcgggccggcttggcctggtgcaggcacgggccgaccgcctcgacgtgacgggcccagtcggggtcgagcccggccagaaaggcgcgggcctcaagaaacggatcgggcatggagagtcctggaccaagggcgttgccagagattaaccagcaatgcctggcgctgcactcggtctcttgcgctggaattccgtgaccctagatcgaacgctgattgacccggctggacagcgccgcggcgctttccttgcgttccgagtagcggtccaccagcaggtcggcgcggccgcgcagcagcagggtgaacttcatcagttcctccatcacatccaccacccggtcgtagaagggcgaggccttcatgcggtcgttgtcatcgaactcgagaaaggccttgggcaccgaggactggttggggatggtgaacatgcgcatccagcggcccagcacgcgcagctggttgaccgtgttgaacgactgcgaaccgccgcagacctgcatcaccgccagggtcttgccctgggtcgggcgtaccgcgccgagggccaggggaatccagtcgatctgcgccttgaacaccgccgacatggcgccatggcgttccggcgagcaccagacctggccctcggaccacagcacccgttcgcgcagttcccggaccttggggtgatccaccggcgcatcgtccggcaggggcaggccgctagggtcgaagatgtaggtttcggcgccgaggaactcgagaatgcgcgccgcttcccgggtcagcaggcggctgaacgagcgctcgcgggtggagccgtagagcagcaggatgcgcggtttgtgcgcggctgttgccggggtttccagatgctccggcgccaaggcttgcagcagttcaaggtcaagggcggacagcggttcttcgctgtgcttgcggtcgtcgctcatcacagcgctccgatgcggtcgagggcatttttcagctcggtgggtgagaggtggtcgaggtccagggcgaagaaggcggcgcagcgctggcggattttctccacggtctgctcgaaggcggcctggattgcctgctcatcgccctggacctcggaagggtcctccagcccccagtggcttttcagcgccgggccgaaatacaccgggcagggctcgccaccggccttgtcgcagacggtgatgacgatatcgggcgggctgtcggcgaagacgtccgaacctttgctgtacaggccggcggtgctgacaccggcctgttccagggtggccagggcgcgagcgttgagcgtgccgctggggaagctgcccgaactcaccgcctgatgagcggccggcgccaggtgattgaacagggcttcggaaagaatgctgcggcagctgttggcggtgcacatgaagaggattttcatcgggggcttccgggcagagggggagccatgacgttaaacagtcactggcttgaatatatggttattcgaatatacggatgtgaaagagcgttgccaagccgccgataggggggagcgaccgagcgcagttgcgcgtctcggtgccggattgggcaggggggctgcgcgcgcagccgcttccaggcgggcacccaaaactgggacaaaaaactgctggcgctggctcccgccgcgctggcagcggcgctgctggtcctgcgcacgtcatgggaggacccgctgttgcaggccgagttgcccggttatgccgactattgccagcgggtgcgctggcgcttggttcccggcctctggtgagcctcgggagcgattacgcccggacgaaatggcgctggcgcaaaagccgctttgctacagcaactggtcgatcagcaccgcgttgctgtagatcaggctgccatcgctggctcggtgccccaccagatggaactggccgcgaccgtgctgcaggtagacgcgcatccggcagtcggacagggggctgtacccctgggcatgatcagctccatggtgtccatgtcgacgtcgaccatggcgtcctgttcatgggttttctgcaggcgttcctcggcttcttccaggcgcaggtgcaggggaccatcgacgtagaaatggatctctcccagcggcgtggatttttgcccatcgccggccttgcaccagccttcgattgtcagggcgctcatgacgagacctccagtgtgaatagcggggcgttgtggcgcggccccattctcaatgccatcactgttcagaccgttgcgagggttggttcgtttccttggcgggtgcctggcgggctaccgcgggtcgcgtcaggtcttcgcgctccgatggtcgcaaacgccaggcttttgccagcttgcgcgccaccttgcccggcagcaccgtggatccgctatgccgcaccgtcctggcatgctcggccagcccctcgaccagcacggcccattccggccgcgggtcgttgacatagtcccagcccagccccagccaggggcaacgcccaccgatccaggcctgcaccgcgggtgtcgcgcgccggacataatcaggggccttggccgccttgggccggagcgcgcgcgccttgacggccggtatctgcaagcgtggggtgccgtctgcctcctgggtcacccgcatcgccccgagcaaggcaatgtcgaaaggcaccggctggccctgggcggcataaaaatacgccaggcgccggatgctgtcgtagtcggcaacggcgcggtacaggtaggcgcagatcacccccagcatggggtcggcatgctttttatggcacacgccagcggcgaaccggtcgatgtcttcggcctgtagccggccagcggcgaaatcgtcgatcgcgccaagcatcgccaggtatctgtcgggggccttgggcattccataggcctggaaaatatcgccgagggggctgggcatcaccacggcgtactgacccgcataaggcaccaccggggtggaggtgccatcggccagttccaccaggaccggcattccctggggatcgctggtggcgcggaacgtctcgaaccgcgaggagctgtccagtcgctcgatccgggcccgggacaggagcttcgcgcccctgccatagacgatcagattagcctcgccggggtcgccgatctgtttcatccggcggcgaacttcggtggccgcggacttgcgcatatcggcggcggcatccgcttccaggcgctggaccagcgccttgaccttctgtttcttctcgggaaaacgcgggctctgctggcggagcaccaccagatcctgcagcagctccttgctcgagtcgggaatgctgatcatctggtcggcgggaaccgccaggttatgctgcttgagcccgaaatcggcgccgagcatgcgctcgcgaaaggccgcgtcgctgtggacccgctcaaggttgcgctcggcggaatccgccgggccagccgccggggacgggcccatggtggcggcgttgcccgcggccggccagggctgcaacccggcggggcccggcaacggctgggcggtgttgtagagcacggccggttccggatcgaccaggcactgcgggttgagcttgaggcgatactctttcgcccgctcggtggtgcgcgagcgcacgcacataccgagggtcgcggtggtgatcaggccattgctgatggcggtcggctcgatgccccacaatgcatcggcgatcaccccggagaacacgcatttgcccggaacgccggacatcggttcggacaccatgtaacccagctgcccgtcctggcaggcggccaggcggtcgaacctggggttttccacttgcgtgccttgcacgacgattccgcgcaccggatccagtcgcgtcaggtcaagatttttcggcgcctcgcggcaggcatcggtgatcagggtgatgcgctgcacgccgtgcagcagcaactcggtgtagaacgagtcggccaggacgcggtacttctggcgcagcgaatcgctgaacagccaggagatcgagccgatattcgcatcggtcaggccgtggccgcaaaacgccaggatcaattgctcgaccacttcggcgcccgagggaaacagctcatccaccgcttgttgcacccgttcgcgggtgaccggattgccctggccgtctatgggaccgtcgtcgacgatcctgacgttgtcggcgccgaagcccgagcgcagcgcccagtcgccgatcgaacgggcggcgagcacggcgccgtccaggtaggcgaagcgcagcgtctggtttggcaacggcgtcagcgtgctcacgccgatcgccaggcaggtccgtctagtcatgggagtgcgccaccttgcgcgtagtcaggagccagagatcgattcgggggaacatcaccggccagtgccagcgcggccgatcgcccggtgccaggcgttcgaccagcatgatggccccggccaccagcatcagcggaatgtgccaggccccgcccagcagcggcaccagcatccaggcccagcatgaggcgatacaccaggccccatggcttgcgccgaagaccaggcaatcgcggtcggcggcccagccgaagaggccgatccggcgcgtgcggtggccgcggttgagcgccgcgcgttgccacgggctggcactccacagcagggcaaccagcagcgccgtggccagcgccgcgtcggcgacactcagttgcagcaacaaggcgagcaccatcagcagcggaccggcggccagccataaggcgctgtagccgagcaggaaaccgagcgccgcgcgaatgcgccggcgcggcaggctggaacgccagacatgcatgagtggcatcgccagcagcggcggcatcatcgccagcagcatcagggcccagtcggccagcatctgctgcaccgggttcagggccagctcggcctccagcacggcgggccaactggcaacgatggacagcgcggaaccgcagaaggcgggcagggtgctgtgcccggcggtgtagagacacagggccaggcccagcccggccgtcgcgaacagcaacggccagggcgcccgggtgaagctgagcaagaccggtccgggttgcatgaggcgttactcagctgacgataccgctgcgcttgagcacgctgatccgttccacggtcaccggtttatccgccgatacctgctcgcctgggaccagggtcacccgcagatagtcgggatcgaaatcgccggcatcggtcagccgttgggccaggtcggtgatgtcgatcgtatagccgagcccgtggccgccatggccaccgtctggccgcgaggcgacgttcagcccgaacagcgtcaggctgccggcatggcactcgggatgctgctgcggatcgctgtctttcggcaggttgatgtacaccgcaagctgcggcgagggcgcggagccgcgcaccgattccagcgccaggtagagccgggtcaccggctggcccaggtccgtcgcgcccatcgcggcgatgccggtgctggtggcctggcggtcgaggtcgacctgggtgcgcaccggcgcgccgccgaccgtgaccaccgaacggttggcaccgatcggttcgatgttctgttgttccggcgcgcccatcttgacccgtgtcacggcttctactcctggtttcacgcccgtgccgatgctcaagtcggcatagcgcgggtgcaatttgccatccttcaacgtgtcgcggccggtgaatttcatgccagggtcactgccaccgaccgtcggcatgatgaaacggcggtcggccggaccgtcgagccagcgcggatcgcggaccatggtcttgcccggggtgttcatccaggcctcccagagccggtcgacgttgcaatggtgcaaccagaagatcgggtccagggcggcgaggtacgggtcggccatgaagccttcgcccccgccgatcagacgatgcacggtgttgtgcgggttgttctccaggtcgccggtccagcgggcgaactgggcgaaattgccggtgaccccgccgccgaagccgatgctgccgtcattgccgacctggaaatcgttctcctgcatcgccgccaggctgaaggcatcgagggagttcggccgcagcgtggtaaagccctgccggcgagggtatttcttcagcgggttggggctgccgtcaggcagggtgtcggccaggaacgcctccggggcccgccgcgcatcggggtttttgctattgaggtagttccagtacggcagcgcccagtcgtcgcccgtcagttccttgaccttggccgcgacaatcgcctcgaaggccgccaggtagccgcggtgccaggacaggaagtaccagctgccgtgctggcactggctgccgtaggtaaagttggtcaggtccttgggaaccggatcggcatcgcccaggacattcacctcgacccacaactgccgatcgaagccgtggatggcgccgaggaacttccagctgttgcggttggtgatcggcagtttgtccagctcgcgcatggccagcgcgtagttgagcaagaccttgttgtcccatccggagccgagtgttgccacatcctgtcggatcgtgttcatgaatgcaccttccttgcagcatcaggccaggtgacgcgtatggcgccacacccctcgcaatcctttgccgctggcgacttcatgttcacggcggaactgcgctcaggaggcccgcagtgccggtgcgcgcctcgtcgaaaatgagtatagaggcctggcaaaaacgccatggccgattcccattatcccgatgaacgacacgggttccgggggcttgggcggacggacgggggattggcccgggtgtaatgaaggtgggtcacaacgcctgcagcaggcgctgcaattgctggtgttcccagatgctcagcagtttgaccgggtcggtgccgtagcgctgccaggcgtcgagcgtttcgacccggccatccggcgagcggcactgctcgcagtggctcagggtctggccatggttgaccaggatcagggtccagccttcgatgttgagccgcacgtgccagctatcgtccgccgccaatacgcgctggctcgatgggcccagggtacgggtgccgagggccagctctctgagcacctggcagatttcgcgggcggtgagggtgggggtggctggcatgggaatgatctcagggcagggacggcggctattttgccattgttgcgggcttggaaagtgccatcgagcgcgtcgattttccgggcgtgaggggctgtggaaatatatgtgctcgcgcattgtaaatgcgaactgttatctttaaagtctccagcctttccgtcgcatgacactgcagcgaatgtcgagcatgaccaccgaagagttggaattggccttcaaggcccatgcgggagagttgcgctcgtttttgtatcggcacctgagaaacaacgagactgccgccgacctggcccaggaaacctacttgcgcatgctgcgccagccgccgcgcaaaccggtgctgaacctgcgcagcttcatctttcgcgtggcccataacctggccatcgaccacgcccgcagccgcggtacgcgggaccagcacgaccagggcatggcctatctctacgaggtcaccggggaaagccccgaactgttcgacgtggtcgcttcccagcgcgaactggaatccctgggcgaagcgttgcagcggctgccggcgcagtgtcagcagatctttctgttgtgccgcctgcaggggttgccgcacaaggaggtggcggggcaattgggcgtctcggtcagcaccgtggaaaaacaattggccactgccctcgactttctccgccaatgcctgcaacgttaaccgttatgcacgatcaaccatccatccacacccctgaatccgatattcatcgcgttgcccatgcctgggtgattcgcctgacctcgggcgatgtgctgcccgccgatattgccgcagcccgcgcctggtgcgagcaggacccggcccatcagcaggctttcgtcgacgcccggcacctgtggcgactgagcggccagctggccgcggcggtgccagccaggcccaggcgttccgctccccggcgctgggcgctggcgagcgcggcggtgctgctgctcggagtcggcctgttactggtgcgccagaacgcctgggatgcggattaccacaccgcccagggcgagcagaaacagatccagctggccgacggctcgcgggtcaccctcgattcgaattccgcgctggatgtgctgttgacgcccaacggacggcagatcgtgttgcgcaagggcgaagcgctgttcgacgtggcccatgacccggcgcgccctttcaccgtgcaagcggcccagctgcgcgccaccgcgctgggaacggtgtacgcggtgcgccgcgaagggccgcaagcggaggtcatagtcgcccgcggccgggttgcggtcagcgacgcggccgggcaggtggtgctgcaggccggcgaggcggtcacctggcaggccgccggcctgggcgccaagcacccgctcgacaccgatagcgccctggcctggcagcacgggcggctggtgttcgaccaggcgccgctggcccaggtgctggaacaactcgggcgttatcgcccggggttcatgctgatcggcgacgaccgcctgcgcgaactcaaggtcagcggcaccttccagctcggccgcctcgatgaaggcctggccaccctggagcaggttttccctttgaagatcgagcgctacaccgactacctgatggttttcagcacccgcggctgaattatttttacgggtctgtccggttcgcccgtctttcttctctaaaacgataatgcttcgcatttattagagaggaaccccgatgcagcgtctgcttcccccaggttttcagggtcaatccctggttccggccctgagccgaatctcgttgctgtgcgccctgattccggggctggccctggccgagcccatgcagttcgatatcggcgcccagccgctgggtaacgcgctcaatcgcctggcggcgcaaagcggtttgcaggtgatctacgacggcaacatggtgcagggcaaatcgagccgcgcggtcagcggtcgccaggaaccccaggacgctctcgggcaaatgctccagggcagcggcctgacctggcgcgcgacaggcagcggcagcgtgatgctggaaaaactgccggagcagggcggccccctggaactgggcgcgaccaccatcggtggccagcaactgggcgagaccaccgaaggcaccggttcctacaccaccgccatcacgcagacggcgaccaagctgccgctgtcgattcgcgagaccccgcaatcggtgaccgtggtcacccgccagcagatggacgatcacggcgccctggcggtcggtgatgtgctgcgtaacgtccccggcatcacccagcaggcctacgacagtgaccgcatggagttctccgcccgcggcttcgccatcaccaactaccagtacgatggcatcaaccgcatctacgacggtgtctatggcgaggcgccgacccacgtcgacaccgccaccttcgaccgcatcgaggtcatcaagggctctaccggcctgatgactggctcgggcgacccgtccgccaccgtcaacctggtgcgcaagaagccgaccaaggaattcaaggcctcggtcagcggcaccgtcggttcctgggacaactaccgcagcgagggcgatatctccggcccactgaacgattccggcagcgtgcgcgggcgttttgtcggcgcctatcaggaccgcaattcctacctggaccactacaaccagaagaaggacctgttctacggcatcctcgaagccgacctgacgccggataccctgctgaccctgggcatcgacaagcaaagcgtgacgccgcgcggcacgtcctggaccggcaccccgacctacttcgccgacggcggccgcaccgatctctcgcgcagcttcaacccgggggcggactggagccgtcgcgatttcgactccgtgacctatttcgccgcgctcgagcaggcgctggccaacgactggaaactcaaggtcagcctcgaccagaaaaccaccgatcacgatacccgcctggcctcggccagcggcggcaacccggaccgcgccaccggcgaaggcatgttcctgtattggggccgctgggaaggccatcgcgtgcagaacaccgccgatgtgaatgtctccggcccctttaccctgggcggtcgccagcatgacctggtggcgggggtcatggcttcccattcccggcagaccggttccacctacgacaccagtgccttcagcctggtcccggggagcatctacgactggaacggcaaactgccggagcaggagttcccgaaaaacggcaagtatgagcgcacccagggccagaacgcggtctatctggcgacccgcctgcggccgaccgacgacctgtcgttcatcctcggcagccgcctgagcaccttcaagtacaacgaggactaccgctacaacgccggcgccggcctcgacgatacccacgccagctacaaggaacacggggtgctcacgccctatgccggggtggtctacgacctgaacgatgtctactcggtctacgccagctacacctcgatctaccagccgcagatctacaaggacgactccggcacgaccctggcgccggtcgaaggcaagagctacgaaaccggcctcaaggcggcttacctggacggcgcgctgaacgccagcctggcctttttccgcatcgagcaggacaacgtcgccgagtccatcggcaccgacccgatcaccaacgaaggtatctacaaggccatcgacggcactaccaccaagggggtggagctggagctggccggcgaactgcaaaaaggctggaacctgtccgccggctacacctacgcccgcacccgggatgccgacgagcaacggatcttcggttacccgctgtccaccacccggccggaacacgcggtgcgggttttcagcacctaccgcctgcccggcgtactggacaaggtcacggtcggtggcggcatcagctggcagagcggctactacggcaagatctacagcgccagcgtgggcgactacacgcggatccgccagggcggctacagcctcgtcgacctgatgtcgcgctaccagtacaacgagcacctgagcttcaccgtgaatgccaacaatgtcttcgacaaaaagtacctgacgggcctgggcaactttgacaccacctactacggcgagccgcgcaacctgatgctcaccagcaagtgggatttctgattccctgaaccggaaaatctcgagctgaaaaaaatgcccgtatcgcgagatacgggcattttctatggacctccacctggtccaggcggggccggccgggaggccatcagcggtattcaggggcgggggcaaggcttacttggcggactttcgcacactggacgagcgccaggccttttcttccccgggatgctgcagggtcaggtaggccctcacgcccagtccggccagacaaaagaccatgcctgcgatgaattgaaatgtagtcatgacatgcctccaaaacaatcaacaggagaccatctcatttaagcgctgcctgggccagccggagttgttacaggttgtcttaaggacgagctcatccggctgatgcaggagggcgtaacggcaacggtgccggctcgtggttcaactggtcggcacgcgggccggttccgcgctggcgaccttcgccggccgggcatgcaacaaggtgttcagggcctggcggtagcgctcgccggccaggcgcatgctgttgttgtgggtggctccgggaaccagcagcagttgcttgggctgtcgcgcggcgtcgaacaattgctggctgaagcgcgccggcacgtagcggtcgtccaggccgtggacgatcagcagcggcatgccgatatgggcgatcttgtccagggagtcgaacttctgcgacagcagccagcgcaccggcagcgaggtattgcccagctcggcggcgatagcggccagggaggtgaacgaggattcgacgatcaagccacgggccgggatcggtgagccgtcgctggccgcctgttgccccagttgcgcggccagttccaccgccaccgcgccacccagggaatggccgtagatcaggcgtttgccggcgtcgggttgcagcctttgcaactgctcccaggcgatccgcgcgtcctcatagacgctggtttccgacggtggctcgcccaggctctggccgaagccgcggtagtcgatggccagcaccgagaaccccagggcgtgcagttgctcgatgcggaacagttgcccggtgagattccagcgcaccccatgcagataaaggacggccggcgcatcggcgcgctgggccggccaccaccaggcatgaatgttctgctcgggcttgaggctgtcgcccttgaactgcagctcgcgcaccccggccggcaggccgcgataccaactggcgttgcccggctcgacgcgaaacaccagttcgcgttccttgtgttccagcacctggcagcccaccggcaggcctatcaacagggcagccatgccaagcagcgaccaccagcgaggtcgccagcgcgagagaaatgaggaggacatgggctgtggcaccgcgtacggataaaaaccgcgttttagcagatgtcccaccggcacagtaatcatttcgccaatccgtggccggggatgctttacaaaatgtggcggccgagccggaggcgggggctctgaaagataaggtcacaacccttgaggtggactgtcggtccatggatgaaaagctgtgcgtttgccttgaggattttgatttattggatccattgttcctgagtcctgtagccattcacagccacaggatcctcaacagtctgcgccttctgagtctggtcgataatcgcccgcaaatatcagtcaatggctgtttgattaagtcattgattttcatattttaaattaaaacacctaagcgtttctccagatatttcagccacttttccaggggttccctagatttcacctcttgttaatggatccactgggtggttgattagccacctggcgatggcgggtccctcccgaccgtcccccgataaaaactacaagaagggtctcgtcatgaatggcttatcaagggcgcggaactgcctgggttccgtccgctgtctgtctgtgtgcacgccgctgttttccctctcgccgtcgccggtaggcggtgtggaggtgcgctcatgacgctcgacctgaagagccgcatggacagcggcccgatgagtgccttccagtgcctggccatcggcatctgcatggtcttgaacatgatcgacggtttcgacgtgctggtgatggccttcaccgcggcctcggtctcggccgagtgggggctgaacggggcgcaggtcggcctgctgctcagcgccgggctgttcggcatggcggcgggttcgctgtttatcgcgccctgggccgaccggtttggcaggcgcccattgatcctgttctgcctggcgctgtccgggctcggcatgctgctctcggccctgagccagacacccctgcaactggcgctgctgcgcggcctgacgggtctggggatcggcggcatcctggccagcagcaacgtgatcgccagcgaatattcgagcaagcgctggcgcggcctggcggtcagcctgcaatccaccggttatgccctgggcgccaccctgggcgggctgctggcggtgtggttgctgagccattggggctggcgctcggtgttcctgttcggcggcgcggtgacctggctggtgatcccgctggtgctgctgtggctgcccgaatccctggacttcctgcttgcccgccgcccgggcaatgccctggtgcggatcaatcgcctggcccggcgcctggagcagcctgagcttgcacagttgccgccagaggtgcccaggcagcccggtgcgcccagcggtttcggccagttgctggcgccggccatgcgccgcaccaccttgctgatctggctgctgtttttcctggtgatgttcggcttctacttcgtcatgagctggaccccgaaactgctggtggccgccgggctgtcggcgcagcaggggatcactggcggggtgctgctcagcgtcggcgggatcttcggcgcggcgctggtcggcggcctggcctcgcgctggccgctgggccgggtgctggcgctgttcatgctgatcaccgccggcctgctggtgctgttcgtcggctcggcctcgtcgatcaccgcggcgctcggcctgggcctgctgatcgggctgtttgccaacggctgcgtggccggcctctatgcgctgtcgccggtggtctacgacgcctcggtgcgcgccacgggtgtcggctggggcatcggcatcggccgcatcggcgcgattctttcgccgaccgtggccggctttctgctggatggcggctggcagccgctgcatctgtacggggtgtttgccagcgtgttcgtgatcgccgccggctgcctgttgctgctcaagccggcccgggcccgggcgcagccggcgatggccagcgtctagccctggccctggccgctgatgatggcgtcggcgacggtgtcgcagaaccagcgcagggcggcggagctgtcgctgttggggtgccagttcagggacacggcgaactcggccaccgggaacggcagttcgagcatcttcagctcgccctcgtggatgaacagccgggcgatctgcgccggcagcaccgccagcaggtcggtgccgggaatgattttcggcagcaccgagaagtgcggcacatgcaggctgatgcgccgttccacattcatgtttttcagcacgtcttcgacattgccgtggccgctggtgcgggtcacggcgacgtgccgttcggcgaggaactgttcgaggctcaactgctggtcgatgcgcggatggccggtgctcagcaggcacacataacgctcgtgcatcagcacccggctgcggataccggggactggctggcggcagatcgcggcatcgaccttgccgctggccagccattcgccgacctggtccacctgcagcggcaggacctcgacttcggccagcggcgcgtcctggttcaggcgcgccaggatcagcggcaaaaagccgatttcgccgaggtcggagagggcgatgcgaaagcgccgctcggtgctcgccgggtcgaactggcggcagccctgcacggtgctttcgatgcgggtcagggattcgcgcaagggaccgtacaactgctcggcgacaaaggtcggctggatgccgtcgcgggtgcggctgaacagcgcgtcgtcgaacagttcgcgtagacgcgccaggccatagctgaccgagggctgggtgacgaacaggcgctcggccgccagggtcacgctgcgggcttcgtagagggtgacgaaggtgcggatcaggttcagatcgatgtggctcataccgcctctgctgccgttatgaacatagataggttttatttttgatagagatagtatcgatttgatcaatttcgtagcggctgcaagagtaacccgaaatccaataacaagggtccttatgaaaaccgttcactctgcgtcctacgagattcttcgcgaacaaggcctgaccactatcttcggcaatcctggctccaacgagctgccgtttctcaaggggtttcccgaggacttccgctacatcctcggcctgcacgaaggcgcggtggtcggcatggccgacggttacgccctggccaccggcaagccgaccttcgtcaacctgcatgccgccgccggcaccggcaacggcatgggcgcgctgaccaatgcctggtattcccacagcccgctggtgatcaccgccggccagcaggtgcgctcgatggtcggcgtggaagcgatgctggccaatgtcgatgcgacgcagctgcccaagcccctggtcaagtggagccacgagccggcctcggcccaggacgtgccgcgcaccctgagccaggcgatccatatggccagcctggcgccacgcgggccggtgtatgtgtcgattccctatgacgactgggcctgcgcggcgccggccggggtcgagcatctggcgcggcgccaggtggccagcgccggcttgccttcggcggcgcaactgcaagcgctggccgagcgcctggcggcggcacgtagcccggtgctggtgctcggcccggatgtcgacggcagtggcagcaacggcctggcggtgcaactggcggaaaagctgcgcatgccggcctgggtcgcgccttccgcttcgcgctgcccgttccccacccgccacccgtgtttccgtggcgtgctgccggcggccatcgccgggatcagccgctgcctggccgagcacgatttgatcctggtggtgggcgccccggtgttccgctaccaccaatacgccccgggcgattacctgccggcggactgcgaactggtgcacctgacctgcgacccgggcgaggcggcgcgggcgcccatgggcgatgcgctggtgggcgatatcgccctgaccctcgaagccctggtcggcgcgctggcacagagcgaacggtcactgccgagcgccttgccgctgccggcgccggtgcgcgaggagggtggcctgctgcgcccggaaacagtcttcgacctgatcaaccagctggcgccgcgggatgcgatctacgtcaaggaatccacctccacggtgagcgcgttctggcagcgggtggagatgagccagcccggcagctacttctttcccgccgccggtggcctgggtttcggcttgccggccgcggtcggcgtgcaattggcgacgcccgggcggcgggtggtggcgatcatcggcgacggctcggccaactacggcatcaccgcgttgtggaccgccgcccagtacggcattccggtggtgttcatcatcctcaagaacggcacctacggcgcgctgcgctggttcgccgatgtgctgcaggtcagcgatgcgccggggctggacgttcccggcctggacttctgcgccatcggccagggttatggcgtgcattcggtgcatgccgcgacccgcgccgagttcgccgccgccttcagcgcggccctggccggcaatcgcccggtattgatcgaggtgccgaccctgaccatcgagccctgactctcaaggtccgggctcccggcgccgggcagaagacccggcaatgccaagcgcgccttgcgcgtacaccacaacaataaaaagaggtggctatgaacacgacttcggtcagtgaagtgatggaggctgggccccagcggtcgagcccggtttccggcagtgccgacatcggcaccttgctcgacgacgggccctacaccgggatgcagaaaatcgtggtgttgctggccgcgctgtccattgtgatggacggtttcgacggccagctcatcggtttcgccataccgctgatgatcaaggagtgggggatcacccgcgaggccttcgcccccgcggtggccgccgggctgatcggcatgggcatcggcagcgcttgcgcgggcctgttcgccgaccgtttcggccggcgtatggcggtcatcgccagcgtgatcctgttcggcaccgcgacctgcgccatcggcctggcgccggatgcgttgaccgtggcggcgctgcgttttatcgccgggctcggcatcggtggcgcgctgcccagcgccaccaccatgaccgccgagttcaccccggcgcgccgccgcaccctggcggtcaccgcgaccattgtctgtgtgcccctgggcgggatgctggcggggttgttcgcctcccatgtactgccgctgtacggctggcgcacgctgttctttatcggcggcagcctgcccatcgtgctgggcctgttgctgttggcgacgctgcctgagtcgccgcgtttcctggcgcgccggccgcagcgttgggccgagttgactgcgttgctgggacgcatgggccgaccgatgcccgagggcgtgcgctacaccgatgcgctggagcagaagagcgagcagcagggcggctttcgcgccttgttcgcccccggctacgggcgcgataccgtggcggtctgggtggcgttcttcatgtgcctgaccgcggtctacagcgccttcagctggctgccgaccatgctcttgtccgaaggcctgtcgctggcggtggccggttccggcctcaccgcctacaacctgggtggggtgatcggcgcgctgctctgcgcggtcgccatgacgcgctggggctcgttctggccgctgctgatctgctgcgcgggtggcgcggccagtgccttcgccatgcaggcggtggacgtcaaccagaacgccatcctgctgatcttcggctttggcgtgcatggcctgttcgtcaacgccgtgcagtccaccctctatgcgctgtgcgcctttatctatcccaccgccgtgcgcgccacaggcaccgcatcggccctggccttcgggcgcatgggcgcgatcctcagcgccttcgtcggcgccacggtgatcacccagggcggcgcccacggttatctgacgctgctgggaacggtgatggtgctggcgctgatcgccctggtgctggtgcgccgccatattccccggcgggtgcctggatcagcccgggccgacaagcagcaactcgccgatcaaccctcacagccataaggaggttcgatgaacatcagtattctcggggccggcgccatgggctcgctgttcggcggcctgctggcggaaagcgggcagagcgtcacgctgctggacatcaacgacacgcacctggaggcgatccgccgccagggcttgcgcctggacaccgacagcggcgagcggcgcgtcggcggcctgagcgcctgccggccggagcaggtgacgggccagcccgacctgctgctggtcttcaccaaggcccagcacaccgacagcgcgctgcgcagtattgccggccatatcggcgagcacacgcgggtgctgaccttgcagaacggcctgggcaacgccgaagcgttgtgccgccacgtcgccccgcagcgggtgatgatcggcatgaccacctggcccgccgacatggtcgggccggcccatgttcgctcccatggccagggcgtggtccggctgctgtcgctggatggcatcgagcgccaggccagcacccaggtggccgcggtgctggaggcggcggggctgcactgcgcggaggacccgcaggtctggacctcgatctgggagaaggtggcgttcaacgcggccttgaacagcctgtgcgccgtcaccggctgcacggtggggcaactggatgccgcgccgcaaggcccggcgctggcccgggccatcgtgctggaggtgctcagtgtcgcgcagtcgctgggggtggccacggatgcgcggcgctgcctggacagcgtggcctatgccatcgcccaccaccgggcgcacaagccgtccatgttgcaagacgtgctggccggccggcccacggaaatcggcgcgatcaatggcgaggtcctggccagggcgcgccaggccggcatcgccgtgccgcacaccgaaaccctgctggggctgctgcgcctgatcgaggcgcgagcagccaccggaggcagtcatgcatagccacgtaaacccggttcggcgccctgagtcgcgagcccatttttcctgtgaatcctgtcctcaaggagttttgtcatgagtgagtccccagctgtctacagcgacctgcacctgcaacccatcgccggggagtggcgcgccggcgcggccggtaaaaccctggcggtgagcaacccgttcgacggcgcgctgttgctggaagtggcccaggccaaccgcgccgacctggatgccgcctatgccaaggccgccgcggtgcagccgcactgggcggcgctcgggccgtcggcgcgggcggcggtgctgcatcaggtggtggcggtgttcgaccggcgccgcgaggaaatcgtcgactggatcattcgcgagtccggcagtacccggctcaaggcgcaattggagtggggcgcggcgcgggccatcgccctggagtcggcgtcgttcccggcgcgggtccacggccgcatcgtcgagtccgatgtgccgggcaaggagagccgggtctaccgcagcgccctgggggtggtcggggtcatcagcccgtggaacttcccgctgcacctgacccagcgttcgatagccccggcgctggccctgggcaacgcggtggtggtcaagccggccagcgatacgccggtgtgtggcggcctgctgctggcgaagatcttcgaggaggccggcctgccggcgggcgtgctcagcgtggtggtgggggcgggcagcgagattggcgatgcctttgtcgagcacccggtgccttcgctgatcacctttaccggatcgaccccggtgggccgcggtatcggccggatcgccagcggcggcgcgcacctcaagcatgtggccctggagttgggcggcaacagcccgttcgtggtcctggccgacgccgacctcgaacaggcggtgaacgcggcggtgttcggcaagttcctgcaccaggggcagatatgcatggcggtcaaccggatcattgtcgacgacagtctctacgacgccttcgccgcgcgcttcgtcgaacgggtcaaggggctcaaggtcggcgatccgcaatcgatcgagacggtgattggcccggtgatcaatgtgcggcagttgcagggcctgcgggagaagatcgaactggctcgccgcgaaggcgccgagccgctctacgagggcggggcccagggcaacctgctggcgccccatgtctacggcgaggtcacagtcgacatggacctggcgcgcaacgaaatcttcggcccgctggtggggctgctgcgcgcgcgggacgaggcccacgccctggagctggccaacgccagcgaattcggcctgtccagcgcggtgttcactggcaacctggagcgcggggtgaacttcgcccggcggattcgcgcgggcatgacccatatcaacgacatcccggtgaacgacgaggccaacgcgcccttcggtggggaaaagaactcggggctcgggcgcttcaacggcgactgggcgatcgacgagttcacccgtgatcactggatcagcgtgcagcactcggcgcgtcgttatcccttctgatgccttgagctgaggatatcgcccggcctcaaacaggccgggcatttttgcagccgatagcaggcgggcctggagcggcctgtcggggaacggctgcgcctatgcaaagcggagaacaataataatgaacacccctcactgcatcctcgcgcgctcgctggccgcggcttcactggcactgggtaccggtctgccggcctgggccgaagaaggcggttttttcaaagacgcgaagaccgatttgctgctgcgcaactactacttcaatcgggattttcgcgacccgggggcggccaagagcaaggtcgaggaatgggcccagggttttatcctcaagttcaattccggctacaccccgggcctggtcgggttcggcctggatggtatcgccatgttcggcgtcaagctcgacagcgggcgtggcaccagtggttccgagctgctgccggtacatgacgacgggcgcgcggcggacaactacggccgcgccggcgtggcggcgaaaatgcgcatttccgccactgagctgaaggtcggcgagttgctgccggacatcccgctgctgcgctacgacgatggccggctgctgccgcagaccttccgtggggcgatgctcgattcgcgggaaatcgccgggctgggcctgcaggccgggcagtaccgttcggtgagcctgcgcaactcctcggacatgcaggacctctcggcctgggccgcgcccggggtcacgtccgatggcttcacctatgccggcgccgagtaccgcttcaatcagcagcgcaccttgatcggcgcctggcatgcgcaactggaagacatctaccagcagagttacttcaacctgctgcacaagcagccggtgggcgactgggtgctgggggcgaacctcgggtatttcatcgacaaggatgacggccaggcacgtatcggcgagatccggagccgcaccgcctatgccttgctctcggcctctaccgctggccataccctgtacctgggtttgcagaaggtcagtggcgacagcccgtggatgtcggtgtacggcagcagcggccggaccctgggcaacgatatgttcaacggtaatttcagcaacgccgacgagcgttcctggcaggtgcgttatgactacaacttcgccgccatgggcgtgccggggctgttggccatggtgcgctatgggcatggtgagaatgcgacgaccaaggctgggagcaatggcaaggagtgggagcgggatacggaggtggggtatacctttcagagtgggagtttgaagaaccttagtgtgcgggtgaataacgctaccaatcggcgcagctttaatggtgattttgatcagactcgggtgattgtgagttatccgttgtcgttttgagttttgcggcgttgtcgcgggcgggagcggtcggtcgatgctcgattgcttgcgatggcggtggtggtttcgctgtctgttttggacggggtacatatccgtttctgcggtaacggccacttagggtttcgcccttacggcgactcacttttttcaaacgccaaaaaagtaagcaaaaacgctttgccccaccactcggtgcctcgctaaggctcggcatgcccgaacgaaggcattgatccgcgggccgccgccacaggccatccatggcctggggcggctaacccggcatccctgccgggttacccacggctcaatgcctgcgttcggccatcgtggttaacggggcgttcagatcaaaagcaaaagcaagacggcggcctgccggccggcctgggggtgggggtgggggtgcttcctgtagccgctgccgagcctgcgaggctgcgatcgaccccgaagggggcgcacggtcttgagatcgctgaaggcctgcggccttatcgcagcctgcggcagcggctacagggaggtggatcttccgtgggagcgaggcttgtccgcgatgaggtccgtgaggtcgccagtgtcgccacggcgctatccgcatgccgccggcgcaaggcttgcggtactatggccgcccacgttttctggaagttgcctggatgagtaagcccggtcaattggtgctggtcgcgttgcgcaagatgatcgcttcgggcgagctggcggccggtgaacggctgatggagattccgaccgcggagttgttcggggtgtcgcggatgccggtgcgcatggcgttccgtaccctggagcaggaaggcctgctggtgcggtttggcgggcgggggttccaggtgcgttcggtgagtgccgaggacatcgccggcgcggttgaggtgcggggtgtgctcgaagggctggcggcgcgccagaccgccgagcgcggcttgtcggaggcggcgcgggcggccctggagttgtgcctggcccagggtgaccagttgttcgccaagggttatgtgaccgaggacgacctggaggtctatcacgacctcaacatgcgttttcaccaggtgattgtcgaaggcagccacaacccggcgatcgccgatgccctggcgcgcaacgatcatctgccgttcgcctcggtcaccgcgctggcggtggatcgccaggacatggcccgcgaataccggcgcttcaactacgcccatatgcagcaccattcggtgttcgatgccctggtcaatcgccagggcgcgcgggccgaggcgatcatgcgcgagcatgccaacgcgaccctgcgttatgccgagatcttcagcagcgcggcggcggacgagcggatgaaggtcatcctccgtcccgcctgactcccttcagatatccagcaccagcagcggcgttttcgagcgtgagcagcagggggtgaactggtcgttgcgcgcctgttcgtcctcggtgaggaacaggtcgcggtgctccggcacgccctccagcacccgggtcaggcaggtgccgcaaatcccttgttcgcaggacatggcaatgtcgatgccatggctttccaggacctgcaccacgctctggtcggccggcacctcgaagacctggccgctgctggcgaccttgaccgagaagctgccatcggcgcgggtatcgacgggggcggcggcgaagtactcgcggtgcaggcagtcctcccgccagcccgcggccttggccgtgtccagcacgtgctgcataaaaccgccggggccgcacacatagacatgaacatcgttgcgcggcgtggccaggaccttggccgcgtccagcgccgtctcgggttcctggtcgaaatgcaggaacacccgatcggcaaaagacgagctacatagacgctggacaaaggccgcgcgctcgctggagcgggcgcagtaatgcagttcgaaatcggcgccgctgtgggcgaggcgctcggccatgcacaggattggagtgatgccgatgccgccggcgaacagcaggctgcgccgggcttcatgggccagcgcaaacaggttgcgcggttcgctgatgtgcagccgcgtgccggggtggatctgctcgtgcatggccagcgagccgccgcgggaggccgggtccttgagcacgccgatcaagtagcgatggcgttcttcggggtggttgcacagggagtattggcggatcaagccgccgggcaggtgcacatcgatatgcgcgccggcgctgaaggccggcagcgggcggtcatcggcactggccagttcatagctgcagatgtcctgggcttcgtcgttacgggataccaccaccacatcgatcatcgtcggttctccgagtgctgccgcccggggcggtcacttctgtttctcttttgttggataaggctgggtaaagggcagggcgcggcacgggtgcactaccggcgtagtgccgcgcagggctcaggccgtggccgtggcgatcagttgtgcttcgccggcgcgttccttggcgatcaggcgctccagcacccgccgcgactgcacgccgccggcgtcgatattcagcttgagcaggttgcgcgtggggtgggccagcaggttctgttgctggcgttcgagcatctccaggtcttcgctgaaaatcttgccctggccctcgcgaatgctcgcggtcagcgcctcgtcccgcgggttgaagttgcgcgccatgccccagaagtaccagatcgaggtgtcgctctccggggtgatgaaatccaccactatgctcgatgccttgaactgcgccggcgcgttgtagccgccctggccggcgtgggccactccgacttcgatcagcacatggctgggcggggtgaagcggcagatctgccagcggtccaccggcacgtcgtcggccaggccgttgccgcgcagggccatgcgccagaacggcggggccatgatgttttccatatgccgcgcggtgaccacctcgtcgccttcgaccgtggtcaccggcggcgcctcgtcgatttccttctggccgatgctggaagcgtggacgtaggtttcgtgggtcaggtccatcaggttgtcgatcatcagccggtagtcgcaggcgatatggaacagcccgccgccgtaggcccacccatcgctgaccgcccattccagatgatggatctgcgccgggtcggccaacgcctggtcgccgggccagacccagataaaaccgtagcgctcgaccacggcaaaggtcttgttgcacgggaagccgcgcacccgttgcccgggcattgccacggtcttgccatcgcagcccatcaccagcccgtgataaccgcacaccaggttgccgttttccacataccccaacgacagcggcgcgccacgatgggggcagaagtcctcgaccgccgcgacccggccttccaggccacggtaaaacaccatcttctccccacagatctgccggcccaggggcttgtcggcgatttcatcgggggtgcaggcaacgtaccaagtgttcttggggtacatggaaggctctcctgggggagtcattgtttttatttaatggatccattagatgggctgcggtgtttgagtgtcaacaatgaggttcaggttataggctgatttatgggcgattatcggacttaaagctgttgacttgtttttaatggatccattggcaagtgttgttaaacaccccccccaatgacagaaaaaacgtcagcgatgaaggagggggtgtcgacgttcgtcggcctgagccagcgagggggaagccgcctatgcggcggctctttttggggctgtggctggagtcgttcgggggatggaaagacatccgttccgaggacgaactttcaattatttcgtgtggctgaagccgaatgcctgctcttccaggttggcctggatcaacccggccaattgccgggtggccggcgtgaggtccttgccgccgcgatgaagcacataacccagggtcggcaccgcgggtagaccgggcatgagagcgaggtggcccggcagcccgatgcgggtgcgcaaggtcacgcccagcccggccgccacggccgcccagatgccggcgacgctggggctggtcagggcgatgcgccagggcatgcgtgcctcgtccagcgcctgggtggcagcgctgcgcagcacgcatggggcgtcgaacaggatcagcggcagcggcgagtccgccgacagcgacggcatgtcgcgcgcgccgatccagtgcatctgggtttcgcccaggcgcgtggcatagggcgatggctgcccggtgtcccaggccagtgccaggtccaggctgtcgctgtcgatcagggcaagcagttcggcattgcgcgcgatccggacttcgagattcacccgcgggtaggtcctgacgaagcgtcggaggatatcgctgaggaagtgttccccgaagtcctcctgcagccccaggcgtaccgtcccggccgtctgctgttcatgcagggtctggaaaatgctgtcgttcagttccaggagccggcgggcatggctgagcagcgattcgccggttggcgtcaggaccagccctcgaccggacctggccagcagcggggtaccgatctgctcttccagtttcttcaactgcgcactcaccgcggaggtcgagcggccgagccgatccgccgccctggcaaagctgttgaattccacgccggtgacaaaggtacgcagtacatcgagatcgaaggtcgggcggcgcattccaatagtccacttattcgggattgtggcttccattaaatccaatattcgggatggtttcgagttgatatttttctcccgtcattgggttattcaacggggaagcagcatgaatacaacgatggagcgagagcctgaatacgcgcaaaaatttgccgacctgaccagggaggtactgttcggcgatatctggcagcgcacccagttgtcggctcgggaacgcagcctggtgacggtggtggtgctggtggcgctgtaccgcctggagcagctgccgtttcatttacagcgagcgctggacaacggtctggggcgcgacgaactggctgaagtcattacccatctggcgttctattccggttggccgacggccgcctcggcgctgaaggtgctcagcgagctgcagggttcccacgtcggtttacaggagtaagcgttatgccgtttgcccgtatttccttgcaccgcggaaagtccgccgagtatctgcaggccttgtcgcaagggctgcacgaggcgctggtcgagcgttttgaagtgccggtggcggatcgcttccagatcattcaccagcatgaagtgggcgagctgatattcgaccccgactatctgggcggcccgcgcagccatgactttgtgctgatcgcgatcactgccggccgtcctcgatcggtcgagaccaaacggcgcttctatcgcgacctggtcgagcggctgggccgggcgccaggcatcgatgccgaggatgtgatggttgtgattaccaccaccgaggcagaggaatggtcgtttggcggtgggcggggcaattagcctacctatgcgtttctggtatcagtcctatccaatccaacggatcgaagcgctcggtggtgtccatccggatattgcgcaaacccagggtttccaggtgcgacgcatagagcggttcggaaaaatagctgatcagcagcgagcgacggcgtgcgccgctcgggttcaggctgcccgcgtgcagcagatcgacatcgaacaccaggatgtccccggcggagcctgaaagctgcacggaccgcgactcgtcggtgaagtcgagtggcggctctcccggcccggggcgatggctgccggggacgatacgggtggcgccgttctcggggccgtagtcgtcgaaaaaagccagggcgttggctatgtcgcctggccgctgggccgacaggtcgcggtgcagctgctgctgaccgcccccggcaaggggttcgcggccttccacctgggagaggaagaagcgctccccgatcaactcgcccaccaccgccagcacctgcggcaggcgacacaccgcctgaaccgtcgaatccgagtccagcagcgaatggcgccagtccatgccacggggcacaggccattggttcgacggcatcacgcccgcgtcgaacacggcacgcagctcacccagccactcggcagggatcgcttggcgcagcagcacgtaaccctgtcgatggagttgctcgcggtcggtcatggtccctacgcctggaagaatcgctcggggcggcagggagcaagggcaggagagccctggccgtcgataatttcctcgctggccagacggccgactattgccgcgagcgtgacgccagggtgcatcgcacacacatacacgccgccgatatcgggcagatagccgatgatgggcgtgccatcgaccggcatgggcctgagcccgacacaggccgattccagctcgatggacgcaaccccgtggagttcgttccggatggcctgggcggtgcgtagcgctatcgcggctggctggttttccagcgcgtcgtccaggtagtcttccgccgccagcagcgtgccgtccgggccttgccgcacttccatttccgggctggagataagggtgcgcacgaggtcgggtggtgaggcgtagcggatcaagatggctggggaggccgctattggcaggggcaggttcagcagctcggtcagctgcttgatgcccgtcccggcggccagcacgacaacgtcggcctcgatacggccccttgcggtttcgacggccgtcacctgcgctccctgggtggtaaagccgagcacccgcgtctgggtgagcacctgcgcgccatgagcctgggcaccggcgatcaacgcctgggttgcttgcacggcgtccagcgcgccttcttcggcggcgtacatggcctgctgcgggggatgcttgaggtttggctcaaggtcgaggacctgtgagcgcgacagctgggttgccgaaggcgggtgacccgaggcgtgcagcgcttcactctggtttgtgccgtaagacagtgcgccgctccagcgcactttcaggccagatagctcggtttcgagccggcggtattcctggatcgccgcaccgcgcaatgacgcgatgggatcgggcccgtcgtgggaggtgttgatccaggcgaatgagcgtcccgtcaccccggacgctatgtcttcggcctccaccagaatgacctgcgcgcctctgcccgccaggtgatacgccagggacgcgcccactatgcccgcgccaatgaccacgacgcgtttgtttgccgcgttccccatatcaacctccatgttgtcgacctgatgagggtagggcatccagataaacgtacagcctgagaaccgagcggcctgcttcgctggctgcctgttatttcttttgcactgctatttcttgcactccgccaacaccactttgcaggtgccgggcgtgccgccggagcggccggcataacggatgcagttattcagggatttctggcgcgccatgctcagggtggagccccaggccaggccgccctcgccggaagtgggcagcgctttggcgtaacagttcgagccgatgctggcggtcgaataacgatacttggcggctttgcttgaacatcccgcgatcagcgccaggttgatggcgagcagggaaaacaggatccatgacgagtagtggcgtgctgcttttctggtcattccggttcccctgtatcaagacggtagaggcgtgttcgcagtgctgctctattcagcttagagggtatcgcgcctggtcctggagccgtctggcggagtggatgcgtttgggtgtgccttgcgtcggttgccatccgtgtttgccttgttgcagtcatggttcttgcggccaattgtcctggatttcgtaccacgaagccttgaacgccacctgaatgtgtttctgtttatctgcggtgaagggcgtatccagagtgcccagggcgatcgagatccagtcggcgtattcaccctggtccctggaccagaacagtgacgaaccgcactggccgcaaaactggcgcaacaccgattcggacgatcgataggaccggaggctcccggccccttgcacgatgcacagatcgctgcgcaacacactgccatagctggcgaatgccgccccatggcttttccggcactggctgcaatggcaatgggaaagcgccttggggcgggataagagctggtatttgacggcgccgcacaggcagctgccctggaaggtgtcggtcatttaagggcgcaccttgaacgaaagggcgcccatttaagcagtcggtgtcggggatgtcgaacggctgactattgctgttcgttaacactggctttcgcccagaagcgacgctcaccacgggttgctcgaagccgagagagtgtaaaagcgcttcctcgaacccttgttgtgattcctgagggtttcatagtaaggattgtccgtgaagcgctttattcaaggtgctaggcgccacttgtcagcataaagctcaaggcgcccgggcaagtagagtcagccacagcgcaataccgaaatcgcccctgatcgtattgcgactgcccgcgacacttgcataaccgtagtccttggccagagcataaagcgcttccggacttacgttgccgccaaaaacagaaattgcatttgagaatgcttgcgcaggaaagaatattcttccgaaccaggatgctctcacgcctgcaatctccaggattacatcctcatttgcagcagcaagttcgttaatactgcgatcagagaccgactctagacctgtatcaaggcttttccctctcagagcgagtacggacgcgccgtatatatgattggtaagctggccgaactttctgccagggactttgaaggtggaaaagttcttgcttttcttgtagatcagctgcgcaacttggtaatccaactcgaatgcttctgaaaccgcagaaagatcagtgcgatttatcgggaagatgaatccaaagtaagcatccctggtcgcatcgattttctcatgaagatgcctcgccttttccttgtatagcaattcaacgtcttcgcacgtcacgctactcaagtgaacaacatccaatgatctgttcatagcaattcccttcgactatcccgagagatgatatatagctaacgattgaactcagggacgggctttagctcgtccctgcgaacgaagcgagcaatttaagcgcatggttatgttttttattaacgatcaagttcctccgtgaaagtgattgcgaatgtattacatatagttcgaaaatggcgtttcataatatcgatgtgcgtttatttatatagccaatccctccaagggggcagcaagggatattccctcgtttggcaagtcaaatgttgaatcgtccctgatttcctgggcaccagcgaacgattgcaaagggtggtaagccgtcaggcgtgactggccgctatcggctacgggttcaaccggacgtggtgccgggagggcgaccccgcattcattccaggcaggcttcaggcgtcgccggcaagctatcgagaaacgcggcaatctgccgggcaccgcgcaggtgcagggtaggaatctgcgggcctatggccaggcgcaccgcttcgatccccgggcggtagccgcgatcgaaagtccacacgaagttcaggaaggtcaggaacgcccgatcgagcttttccgtgcagcctgcggcaaggtcaggccggggagggttcaggaggctgcgtatgatcacccgggtgaaacaggtgagccgtggcgtatcgagccagatgatcaggtcggcacggggcaggcggcatagttgccttcacacacccaggctgccggtgcgaccgctgcgcggacccgttcgcggaactgctcggcgtcgggttcgacccaaccgggctcccagaacagcgtgtccaggtggaccacaggcagattccggcgcttgccgagggcacgggcgagggtggatttgccgctcccggcattacccagaattacaatccgttgcatgggcgcttcctgtcgcgaaaaaagccggcgattgtgcaggttttgcatcgccagtcaaaggcgaatggcgggggcgacggctccgggaatgaaatgtgtgttgccagtgtggggcttgaagcccagagcgggatgtcgatccatccttgtccccattgaacacccgcttccggtcctgccatgaaagccgcttccgaccctttgtcgcctgtcggcagcgctcgccttttcggggtgtctactgctagtgaagccctgtaggtacagggaggagagcagcatgagcaatgaacaggtggcaccggaaaccaaaggggttgcagtgcaggtactggcaaccattgacctgggtcccgaaatcgagggcatggccgggcgccaactcagaatgcgcctggtgaccatcgagcctggaggcgtattcgggccgatccacaaccataaagaccggcctggcgtcgtctacatactggaaggcaccatcactgaccatcgcgagggcggcgacacggactatggcccgggagtggggtggcccgaggaccgggacaccacgcactggcttgagaacaaagggccgattccggcgcgggagatctcggtcgatattatccgccaagagtgagcccgggccgaacatcgatacgggcgagcccgccgtgcggttcgcccaacgcccatcattcccccgcacccgccgcgccattggtcgggtcgccctcggccagcaggcgcatcaggatttcccgctccttcggccccggtgccaggccgcgggtctggcctttgcccgaggttgcacctcatcacccgtgacctgccggccttccagctgctttatgatgaccgcctgtccaaactgcccaacgtccagcgcttgacctcgaccccggtgatgaagcggctgattcaggcccgctcgctgccgctgtgaggcacgtcgacaaaacaacacttcagggagataccgatgcgtgaacgaaaatcggcaagattgctggtcatcaacccttcgcgaaaggtcctgctgttccggttcctgcacaaggaaggggcgctggcgggggatgactattgggccacgcccggtggcgggcttgaaggggacgaaacctttcaggtcgcggcgattcgtgagttgcacgaggaaaccggtattcaggtcagcgcgatgggagagccggtggccggtcgccggttccccatgcaactgcccagcggcgagtgggtgacctctgtcgagcagtattttgtggtgcatgcgccagatcagccgctttctcgtgcaggctggacctcggccgaggcccaggtgatggccgatcatcattggtggtccgccgatgatctgcgagccaccgaggccatcgtctggccggaagcgttggtggagatgctggaagaggcgggggtattcgagccgtccttgtagcgttttttcccgcgggctgatcccggcttgatgcggggctgccgataccccgcgcagccgggattttccggttggcggcttatgccgtcgatccagattcgccatcgacattcacaacggcgccgtcggttcgttcctctctctaccaaccattagagggaacgcccgatgaaaaacaccgaactcagccacatcatcctcagtgaccactcgcgcatcgaggccgccatcagtaccggcgcagcctgggaagtctggttccaggtcgagtttctgatgctgctgcgcgcagcccacctgggggtcgcccgcgaagtgccttacccatcgccgaacgacaccctgcacctggatgtactggccagccagggtgtcgagagatatgccatcgaagtgaaagtcgagagcgccaccaacgccggcaacaaactgctggcggaaacccgcaaggacatcgagaaaatcgccaaatacactaggcccgtcgaggcacgctgggtggttgccctggcctatagcgacgtggcaaaacactctttgcggggattcgcaacagagcacaatgcgcgggccatttaccatgagtctggcgcgatcggctgcatgatcttctcggtctgacccgcacaggcgccagcagggcatgaggtcttcctggcgcctggcggctttcgacagttcgcgcccttagtgagagaacaactgccggtcgccctgtttctgcgagcctgcgacgtagtacgcctcgaaccaggcgggctggcccgagatcgccgtgggttttttcagcaccagtggcggtggctgtctcccctgggtctcatcggcgctggtgaaggttttttgcatcacgctgcgaaaatgcaggtgatcgaatatcagcagggcctggatggcatagaccacggcgattctctggtcctcgatcaggatcaggtgatcgccgtttttttcttccccccgggtctagaaccagctgaccgtcgttggccatgtgcatcatccggccccggtaggtgaaggtgccttgctcgacctcatggggaacgtgaacccagcgaaacttctggaagggcgcttccagcgaggagaacttgcgctggccatcgaccgcgctgtgggtgggctcgtcgtaggcaaaggcgatgcggttgagcaggggcttgaacgcgtcggtgccggggaacctgcattcgatggcaaagcccacgaggtccgcgggaggactctcgacatcgaaaccgatcaggcacatgcgttcgccgcgccacagtttcatggtgaaaccatcgatcgtctgtgcgttctggaaagcggacatgagcagcgctccttgctgtggcatgtgggtcaagaggggatccggcattctgtagcctggagcaaaacgccagctccctcatggcggggggctggcagcagacccctggtcaaagacaatccgcatcgatcactgcctgggcgaacgcccgagggtcttcctgcggcaggttgtggccgatgccgccgctgatcaggcggaactggtatttgccggtgaagcgcttggcgtaatccgcggggttcgggtgcggcgcgccgttggcatcgccttcgagggtgatggtcggcacgctgatggttggggccgtggccagtttctgctccagggtggcgtagcggctttcgccttgaaccagccccaggcgccagcggtagttgaacaccgtgatgtcgacgtggtcggggttgtccagggccttggcgctgcgctcgaaggtggcgtcgtcgaacgtccattgcggcgaggccagttgccagatcagcttggcgaagtcgtgagtgtttttctcatagccggcgcgaccgcgatcggtggcgaaatagaactggtaccaccactgcaattccgccttgggcggcagcggattctggccggccgcctggttgccgatcaggtagccgctgaccgacaccagcgccttgacccgctccggccatagcgccgagacgatgtccgccgaacgcgcgccccagtcatagccgccgagcactgcttgcttgatcttcagcgcatccatgaagtcgatgacgtcactggccagcgcggccggttggccattgcgcagggttttcgccgacaggaaacgggtatcgccatagccgcgggcatagggcatcagcacccgataacccttggcggccagcaagggcgcgacctcatcaaagctgtgaatgtcgtacggccagccgtgcagcagaatcaccaccgggccatcggtcgggccggtttcggcgtatgccacgtccagcagcccggcgttgacatgcttcaacgggccgaactgcgagggggcggcataagtggtgccggcgctgcccgcgtcggcttgcgccgccgtgttcgtctgcgcctgggccgtgccgaggatgccgaacagggtgagggccaggaccgacgcgccgattgtgtggttgcgcagtgtcatcttcatgctgatctctccattggattgcaagccgggggtgaggatctggccgatccccttcaacctgggttgcatttgacggccgcgacgtatctggcctgtgtccgaatcccggggcggatgcaagcttatgtagcgggaggtgatgtagatacactgcgatacataggggatgggcagaagggctggggcgttccattcccgcctcccgggctgcgcaaagctcgaggcaaaagtggcttttgccccggcttgccttggcgccgatacgcgagcgacggggcggggcgaagcagggggccggtcgcataaatttgaaatgcacggcattgcccgacagaatcgcgccccgatccggccaaaggcgccggatgttcgtggtgaaaaggggcgacagttgaaccaacagacattgtccatgcgcctggagcgcgtggcggcgcatgtgccagtgggtgcgcgcctggccgatatcggctcggaccacggctacctgccggtggcattgctgcgccggggcctcatcgccgcggcggtggccggcgaggtggcggtgacgccgttccacgcggcccagcgcagcgtgcgcgaaaacgcgctggattcgggcatcagtgtgcgcctggccaacggcctggcggcgatcgagccgggcgacggaatcacggcaatcagcctttgcggcatgggcggcgagaccatccgcgacatcctcgacagcggcaaggcccgcctgaatggccaggaacgcctgatcctgcagcccaacggcggcgagcagcccctgcgccaatggctgatggagcatggctaccgcatcctcgacgaggaagtgctgcgggaaaaccgctttttctacgaaatcattgtcgccgagcgcgccgggtccgtgagctacaccgccgaggaactgtacttcggcccgctgcagctgcaggcccgcagcccggccttcctggccaagtggcagcgcatgctgcgcctgaaacacaagaccctggcccacttcgcccgggcacggcaggccgtgcccgaggagaaggtccaggacatcgtccggcaggcccggtggatcagcgagttgctggcttgagcgcggtaaactggaagcaggctgcaacttccgtttcccagaggctgacggttcagttggaagcgttgttcagctgctgaagctcaagttgcttggcagcactggcttcgagggttgcacgctcttcatccagataccgatagatgctttggaagttggcgattttctgtttgatttctgccatcttcttttcaattagcttggcgccgtcagcacaatcgatcagcttgttgcgctgcgcatccagaatctcgcctatttcccccagggaaaaccccatgctttgcgcgcgctggataaagtccaggtcctgcagagtttgcattgtgtaaacgcgatagttgttagtttgccgcagcggtgagatcaggccgatttgctcgtagtaacgcagcgtatggcggctggcgccgctgcgggcttcgagttcgccgatcttcatgaaaacaccgcttgaccatagagttgggtcgatagtttacgctcgatttctcaccttaaacaaggaacagggaaatgagcgtggagtgttttgtcaccgggggtaccggcttcatcggtcaacatctggtggcgtacctgagtgccaaaggtcacacagttcgggtgttgatgcgtcgcccggagcgactggctgcactgcgcgagcaagtcgataatttgggagggtgcgcaacccgggtatttgccgtagctggcgatctggaacgggacaacctcgggctgagtcttgctgaccgagaagtgctaaggcacgccagagtcatattccacctgggcgcccacttcgcctgggggctttcagtggagcagtctcgtgcggtgaatgtggaaggggcaaagcgcgtggcgctgttggcggctgagcaaaaaagccggttagtgatgatcggcggctacatgctgaaaaatcatgaacatctgcaacgcatcggaattgatcctcgttatccgcagctgacgaattggcctgccgtctaccgacaggtcggtggttacgaggggagcaagctggaggcgcattttgcgaccctggaggtcatgtccgccaagggcggggagatgaccgttgtccaccctgcgacggtctgtggccacagccgcacagggcatatccttgacggccagccgctggtggagctgatacgcaaccttgtgcagggaaagctgacggcagtgcccggtaccgccgagcactggctgccgctggtcaccgtggattacctggttgaggtggtggcggtgtgtgctttcgatcccgccatggtaggccaggaactgctggcgcttgatgaccagactcccaacttgcgagaactcctggtacaggcggcacaacctctgggcttaaagtctcccaagcattacattccactccgcttgctgaagtggctactgagtattgctcccgtcgcgcggtttttgaacacaaaacccgaagccttggactttatccagaccacgcgttttgatacggccgcggccgagcaatttgccaacaggcatggaatagccaaaccggatatacgtcagtctttgcagcacactgcaacgttcgtcaactcatattgcctagccaagggccaggccctctgacttcttccttgggggcgacaaagtcgttagtcccgattaaatggactttcctaaggtaagtgttggtgggatcttcgtatcctcaaactttgcgccgtcgatgtagggcggcattctatcgaacgacaattcagcgacagggatcgtcatcaatgctatctactttcagcaaaggcgtcatatttgcactctccgctgcggcactgaacgcaacgatcggtgtactcagcaaagtcctcatgagtaatggttttaccgctagcagtgtcgctgtcatcaagaccgtactgggttgcgtgcttctctcgatcttgctgtttttcctcaagcgcccggcgacgtcgaccaagtgggctcaggcggctatctgcgcattccttggcatctttgtgctgttccatttcgaaacgtccgcctatcgacactacgctgccgcaggtgtggtggtggtgctgatggccagtgcctcaatttcctcgatcattctggggcgcgttttcctcaaggatgccatcaccgcgaacgctaccgttggcgccgcactggctatcgctgggatctcggtgatcttcggcggcgacctgcagcagggctttaccctgcaaggtgctgcgctcgcctccatggccggctgtggctatggggccttttcggttgccatgaagcgcatgggggtgtcgggagggctgcacttcactcgacaattgttgttctttggcagcctgtacctgctgatgccggcggcggccgatggtttcgcgatgggcgagctgtcgcctctggcgatcgccgcgctgctggcgctggccacgctgccgacaatcctgggcttcttctgcaccaccaaggccatcgagtatctcaaaccatcccaagtgcaagcgctggagctgaccgagccactgttcgccgcgctgctggcgtttgtggtgctcaatgaagtaccgcgcgaaagcctgtacgcgggagcggcactgatcatcgtcggcctgtgtttctccaatgaactcatccgcttgggcagcaaagcatccgtcccttcgaccgagtgagctattttcggagcctgatgactttggcaatcagtggtttttaggtgttttgagcgattggaccgctcctggccggagcggatattcgataccttccagccaagcggaaccgagcgagatctcgcctgttgacccgttctatccagtaatatgcaacccccatcctccgacgagtctgaaaatggaccctcactcgattctggcttttaccctggtcgccgcgattgccatcgccagcccggggcctgcgacattgatggcgatcaacaacagcctcgcccatggccaacgcagcgcggtgtggtcctcgttgggcaatgccagtggcctgttctgcctgtcggcggctgcgatgctggggctgggggcgttgcttgccagttccgagttgctgttcaacgcagtgaagatcatcggcgccggttatctgttctatctggggatcaggcagttgttcaaaaagagcccgatgctcgcggacggtatccaggatgacgtgaagaagagcaggcccactcgcgtgaagctgtacaagtcggccttcctgacggcggtgaccaaccccaaggcgacgatgttcttcaccgcgctgttcccgcaattcattgatcagggcgcgcagctgctgccgcagttcctgatcctcacttcgatcttcatggggctgtcggtggcgtccttgagcctgtatgccgcactggcctcccgggccaagggcgtgctgacccggcccgagctgtcccgctgggtcagtcgggtggtgggctcgaccttcatctgtttcggagcggccatcctgaccatgcgtcgacaggctgcataagaggagtgtggctatccatggatggttggttctggccggaaccaaccattcccatgcaaccgctaacgaccaaaagcgctcatcttgcggcctttgggaaacccgtggctccaaggttatgcattcagtgcgcggcacaggaatccggcccgatatcgttagctgatatcatccgaaaccttaccggccgagtagaaagaccatgaaccgtcgtaaaaaaatcaatcagctattgaaggctaacgcgaaaaaggccagtgccaagctggcgccgcgcagcaagcccaaatacatcagcaaggccgaccgcttgaagctggctgccgaatccactgcggagtccgtggtgtccaccgagagctgatagcgcgtcttttccgggtggcttcaggctgcccgccaaaccggatcgcctgcccacgcctggccgccctggccttaacgcaggctccacgacaccccgagatacatcgccatgccttcccccggcgtcgagcgcgcggcatccaggcctttgtcgtcgtagcccggggtgacggtggcggcgtagtgctggtcggtcaggttgcgcaggtcgagccaggtctgccagtcgcccttgggtgcgttgtagcccagggtggcgccgaacagcgcgtagggatcggcgtaatagctgttggcgtaatccaccgccaccttggacaccagttgcgtgttgagcgcggcgaagaagcccaggggccagtcgtagcgcaattcgccctggtagtagtgcatcggcaggcccggcaggcggttgtcgccgaaacgttcatcgtcgcggtagtggaagtcgctgaaggtgtagctctggcgcaggctcagctggccgccgtctttccctgaccacagcttgctctgcaggctggcttccacgccctggtgcacggtggggctggcgttgagctcatagggggtggtggcgttggcgtccggcaataccgagagcagttcgtggcgtacctgggcgtagtaccaggccaggctccattggccgatggcgctgtcgccccggccgccgagttccagggtggtggcggtctggttgcgtagcttgatcgggtcgcgctgggtgccggtggcggcgccgctgccggccgggaagcgaatgttggagctgtagatcagcgaccaggggtggggcgcctcgaccgagcggctgaggttgccgaacagttgcaggtcggggctcagctggtagcgcaggcccaggcgcggcgcgtagtcccagtcgccgaggctggtcttgccaccgccgtcggggtaggtcacggcgctttcgcggcgggtatagatggcggccagaccggtggtcagccacaggtcgtcggcgatctccaggtcattacccagatgcaggacgctgtccgagccctggtaagtgaagttgcgcatatgagtacccggcgcataaccggcggtgttgccgccggggatgcgcaccaactcgctggcccctgagttgggcaggtgcttggtcacgcgcaggcccagggtgctgtggctttccaggccccagagggtgtcgcggcgcttgtagtcgaaggtgccgctgacgtcggtgtaggccaccttcaggcggttggggccttcgcgcaggtccatggggtagtcgtggtagaccaggccggtctggatacttgagtcgtcgtcgatataccaggtggtcttgttgccgataaaggtgctgcccggctggtcgcggctgtcgttacgcgtcacgtaggccgggttggccgcccgcgggtcgtgctcgatggagcctttggtgacccgcccggcgaggtcgttgtcggtctggcgatggcggatgtagaagcgggtttccaggttcgggttgaagcgatagccgaagttggcgacgaccccctggctcttgctggcgctgtggtcctggtagccgtctgagtgggcgtcggtcagggacaggtagtagtcgaagtcgcccagcacctgcccggagctgacctggcgctgctgataaccgtggctgccggtggcgtagcgcacctgcaacttcggcgcgtcgtagccggtgtggctgatgtagtcgatggcgccgcccagggccagggcgccgcggtcgaaaccgttggcgccgcgcagcacttccacacgctccagccacagcggctcgagcaactcatagggcgtgccgcccgggccgctcagcggcaggccgtcgagcatcgtgtacagccccgaggcatgggcgcccggcgcgcggttgatgcccgaaccgcggatcgaaatcttcaccccttcgttgcccgcggactgggcatagacccccggctgatacgccaacacatcctggttgctggccacacggccctgtagcgggcggcgcaggtcgaccacattgctgccgccgggcacctgggccagccgcgccttggcctcctcgatcgatgcgtcttcgccactgcgctcctcggcgccgatcagcacctgccccagctccaggccctgggcttcggccagggtcggacagacaagggccaggcccagcaaggcagcgggcaggggacggggcgagggcattggggggaactccaggcatgggcaacgggcagtgagaactgcgacgtatgaaagaacgaaggaaacacatggcaattttgtcttttgccaggcaggcgcagatcggcgggagtccagcgtccatgcccgtgcgctatcaaggctgttcgcaatggatatatccgcgcatcggcgttcggctatcgtcaccctatatgactcgatcgcgcagctgctgtgcttttgcgttgacgctatgtcggccgctgctgcgattcacacagcgctctcaaacgcgaggacatcacgatgggcgtccacaaagctgttgctgtttcgctggccctgctcggcgcaaccttcctggcatccgccgctctggccgagggccaagggttgattgccgccacccccgccgaactgaaatggacacccgcgccctcggtagggcccggcgtgatgattgcggtgatcgaaggcgacctgaaagccgcggagcccttcaccctgcgcctgaaactgccggccaacacgaaaattggcgtgcatacccaccccgtgaccgaacgtgtcaccgtgatctcgggcaccttctacttcgccaccggcgacacctttgatgcggccaaggccaaggcctatcacccgggcgacaccctgatcattcccgtcggcatgccgatgtacgccgccacgcaaaaacaggaaaccgtgctccagctccacggcacgggcccctggggcatcacctacctcaacccggcggacgaccccaggaacagcaaaaaataggcaatggctgaaggctggattcgatctgatatgtgtcaggcaaggcctgacacatatccctcttaatgattaacaggctacggatttggccacccggatgtactcttcaacgaagttgttggcagagtgaacccttacgcctttgagcttatccagtggtgggttttcccaatactccgatgcggtgatggggcagatggggaatatggaaattccttggggtgggtcagcgacgaagtcaaagtcttgaatcccgtctctcgggaaatcaatgtaaaaccgcggttgcaatcttgggttggtccagccggtagagcccaccaggccatgggccaatatatgcaactgcggtgggttggacttgagcagtgacaggtgaatgtccaaaactttcaatatgctagccatcttcgatctcctttcgatgagtgcgcctcttttcacctcggcgctcgggtgtaaaaccctctagctgaaagcctgatacgtttcagaatgtcccttggcaggcaagaagtgtcacgtgcacttcctggatggttctctccttgagtaccgggaggaacgagtaggcgaacacgctactgttcgagaaggagtacggcatggacagtgaactcaggccagttagaaccggttcggctgctgttgggtagacactagtaaaggagcctgccggctgccaggcccgatcatcggataccgcagagggctggacgcctcccgcgcaagcgttttaccaggaggcaaccacggtgcctgctaaaccaggggaggctcgatacgtcgctattttattgaaaagaaaaccgactctgcttacctctcatccagggcccgacgtttcgcgcccgccatcacccttcgtcaaagccctcgatcaaaggtgcctccatgctgcttgcccgctggctgccaggcttggccaatctcctgcaataccgccgcgaatggttcaggtacgacctgcaggccggtttgtcggtggccgccgtgcagatcccgattgccatcgcctatgcacagatcgtcgggctgccgccccagtacggcttgtatgcctgcgtcttgccgatgatggtctatgccctggtgggcagttcgcggcagttgatggtcgggccggatgcggccacctgcgccatggtcgccggcgcgatcgcccccctggcgctgggcgatcccgagcgcctggcgcagttggcggtgattgtcacggtgctggtcggcctgatgctgatcggcgccggcatcgcccgggcggggtttattgccagctttttctcgcggccgatcctgatcggctatctgaacggcatcggcctgagcctgctggccgggcaactgggcaaggtgctgggctacaagatcgaaggcgacgggttcattctcagcctgctgaacatgctgcagcggcttggcgaaacccatctaccgaccctggccatcggggcgggcgctctggcgctgctgatctggctgccgcgacgctttgccaggttgccgacagcgctggtgacggtggccatcgctaccttatgcgtcggggtgctgcgcctggaccgctacggggtctccgtactggggccgatcccttcgggcatgccgcagttgagctggcccgagaccgacctgagcgaattgaaacggctgctgcgcgatgcgctggcgatcgccacggtgagtttttgcagcgcgatgctgacggcccgcagcttcgccgcgaggaacggctacacggtcaacgccaaccatgagttcctggcgctgggggtgtccaatatcgccgccggggtctccagcggtttcgccatcagcggcgccgattcgcgtacggcggtcaacaacatggtgggcggcaagagccagttggtggggatcatcgccgccctggtgattgccctgatcctgctgttcttcaccgcgcccatggcctggatcccccaggcggcgctgggggcggtactgttgatggccggctgggggttgatcgatatccaggcgatgcgggtcatccgcaagctcagccgtttcgaattctggctgtgtgtgctgaccaccctgggggtgattggcgtgggggtgctgccggggatcatcgtcgcggtgctgctggcgatcctgcggctgctcaaaagcatctatcagcccaccgacgcggtgctgggctgggtgcgcgggatcgaaggccaggtcgatatcagccaatacccacaggcgcgcacgctggcggggctggtggtgtatcgcttcgatgacgcgatcctgtttttcaacgccgactacttcaaggcgcgcctgctggaggcggtcgaacgcgagcccgagccccgcgccgtgctgttggtcgccgaggcggtgacttcgatcgacgtcagcggcatcgtggccctcagggagctgcgcgacaccctgctggcccgaggcatcatcctgggcattgcccggccgcacgggacattcctgcggatgctggtgcgttcaggcctggcgcgcgagctggagcagggattgttgttcccctcggtacgcgccggcatccgcgcttatcgggtctggcgcaatcagttgcagcgcaaggcgcagacagaggagcttcgggccggcaccccgcaagcgccggccaagccgacgccataacgggacgcggccttggccggccaccatcaatgcttgactcaaaaaggaggtacggcatgcaacgattcaccggcggttgcctgtgcggcaaggtgcggctcgtggcgtcggggccgccataccgggtcggtttgtgccactgcctcgactgccgcaagcaccatggcgcgctgttccatgcctcggcgatcttccccgaggacgcggtgaccgtcgagggcgagacccgcgactacgccgggcggtttttctgcccgcgctgcggctcgtcggtattcgcccgcagcgccgacgaaatcgaagtgaacctgggcgccctggacgcccccgaccaactcaagcccagctatgaaagctggactattcgtcgcgagtcctggttgccggcgtttccactctccaggcgctatgagcgcgaccgtgatgccagcagtcgcttcgaggaatagcaggcgcccaggcttatgaccagggcgtctcgggcgccaccccgcgcgggcgtttcgccaggagcttgcgggtggtctcgacgaagggcgtgacgatcaggctgtagaccgtcaggtaacgttgcgggtcctgctcgccggtgccgaagcgcagcggctcgggtgtcgaggaggtgacgtagagcgtgccgaacatccagtcccagagcgacaggttggtgccgaagttacggttgaagtggcggggcgcgtcactgtgatggatctggtgctgggccgggctgttcaacacatgctccagccgcgggccgaacgacagccagacatggctgtggcgcaggttggccgccaggctgttgaagatgaatatcaggtaggtcacgccgaacagggtgtagcggccgatctcgccgccgcaggcgtaccagaagcagccggcgtagaggcccaggccgaggctgatgctcagcttctcgacgatcttttccacgaagtgcacccggctcgccgtcgccggcaccagcaccggcgccgagtgatggaccttgtggaaggcccacagccagcgcgagtgaaacgcccggtgcgcccagtaatggatgaagtccttgagcaggaacacccccagcccgtagagcagcgccagccccaggttctgccccaggcgcgggcgctcgccccagaggttgctgaaaaaggccaggtagtccccggagcgcaggatgtaagggtcgaccagatggacgatgggcaacaccagcgcgaccttgaggatggcgcgcacgaagtagtagcggtaatccagcagcgccgaggaatgcaggtgcacccggccgccgccgaggaattgccagaacgaccgggcgtggctcaggccgcggcgctttcggaaacggaacaggccataggcgacgccgtaggacacgcacaggaacaagaccccgaggcggccgttcagattgaaaatgccgagaaactgcgcggtgacaggggcgatcacccactcggtcaggtgcttgtagacaagcgacagggcatccacgaatcgccagcctctgagccagaaaaaaagaatggcattgtaaatcagttcggtttggccgggcagggtggcgcgacaagcaggcaggtgcgcagcgcgccatccgcctggaaccggccgcggctgttggagtacgctggctgctcgctgtattccggaggtgcctggctcatgaccctgttacgggaatccgcaaaccggttgctgcaacctcgggtgggcgcgggttgcatccgcgcgcgcggcgccgagggcgcggtcctgcagtcggcgtcgctgttcgacggcctggtgaccatcgatcatcgtcgctgggcctgccgcgaagccgagctcagctggacggcgccgcagcacgtggtgattctcacggagcgcggggcaacggcaaagactcatatccgcagcagttcaacgctcaattacgagggctgcgaccgccccgggtcgatcagcttcgtgccggccggcgtcgagcgccagggctattttcgcgacgccgacctgatctacaccgccctgtggatcgacacggccctggattttcccggctgcccgcggctggccgaattgcccatgcgtatcaacagcggcgatggggtgatccattcgctgctcgccgccctcagcgccgagatggccggcgggcatgtcccggaggccagctacatagagcacctggtggcgctggtggggttgcgcctgggccgggtcgatactggcagcgctggcagcggacgcctggggccgcaactgctcaagcgcttgagcgactacgtcgaggcacgaatcgacggcagtatctcgctgaccgaactggcgcggatcgccggcatgcccgtggacaccttcgcccggcatttcaaggccgaaaccggcatggcgccctatgcctatgtgatcgagcgccgggtgcgccgcgccgaaaacctgctgcgggccggtagcatgccgatcagcgccatggcgctggagctggggttctccagccagagccacttcacctcgaccttccggcggatcaccgggaccaccccgaacagctaccgccagcaggcgtccagaatcctgacaagctcgtcctgatacctgaaagaacggcgccgcgcccttggcgatactcgcgtccagccgttcatttcaggagagcaccatggaagacctggattctccgcgtccgtcgcgccgcgcgctgctgcaagccggggccgccgtcagcctgctttgggtggggggcagcggcgcgctggcccaacccgccccgacgccgcccagcccctcccgcccattgccgtcccaggcgatcaccctacgcatcaatgccagcgaccagctgctggacctcgacccacgcaccaccttgctcgacgcgctgcgccatcaactgggcatgaccggctcgaagaagggttgcgaccacggccagtgcggcgcctgcacggtgctggtgaatggccgccggatcaacgcctgcctgagcctggcggtgatgcatgacggcgacgagatcaccaccatcgaggggctggccaatggcgacctgctgcaccccctgcaggccgcctttatcgcccgtgacgctttccagtgcgggtactgcacgccggggcagatctgctcggcgctgggcatgctgcaggaggtgcgcgccggctggccgagccatgtcactgaagacctggcgtcccattccgtcagcctgagcgacagggagatcggtgagcgcatgagcggcaacctgtgtcgctgcgccgcctatcccaacattgtcgccgccatccgcgacgccgccgaggaggcctgagcccatgatgcctttcagctatgcgcgtgcgagcgatgtgcagcaggcggtcagcctgatggccgcgcagccacgggcgcgctttatcgccggtggtaccaatctgatcgacctgatgaagctgggcatcgagcggcccagccacctgatcgatatcagccgcttgcccctggccatgatcgaggacagcgccgagggtggcctgcgtatcggtgcccaggtacgcaacagcgacctggccgccgaccgccgtgtgcgcgagcgctacccgctgctgtcccaggcgttgctggctggcgcttcggggcagatccgcaacaaggcgtcgaccgccggcaacctgctgcaacgcacgcgctgcccgtacttctacgacccgggcatggcctgcaacaagcgcgagcccggcagcggctgttcggctctgcaggggcacaaccgcatgcatgcgattctcggcgccagcgagtcgtgcatcgcggtgcatccctcggacatggcagtggccatggtcgccttggaggcgcgggtggagaccctcctgcccgacggcaagcgccgctccctggccctggatgagctgtaccgcttgcccgggaccacgcccgagctcgaaacccggctggcccatggcgagatgattgaggccatcacgctgccgccgccacccccggggcggcagctgtatcgcaaggtgcgcgatcgcgcttcctatgccttcgctttggtcgccgtggcgctggtgctcgaagtccgcgcggggcaggtgcgcacggtccgcgtggccttgggcggcgtcgcgcccaagccgtggcgggctacgacgaccgagcaggtgttgctcgggcagccgccggcccaggcgctttacgagcaggctgcggacgccgccctggccggcgcgcgcgggcaaggcggcaacgatttcaagatccccctggccaagcagaccctgtaccagatgctggcccagaccgcccaggagcaagcatgagcacatccatgcaaaccggcccgatcggccaaccgctggaccgcgtcgacggccggctgaaagtcaccggccgcgcgacctacgcctacgagcagcgggacatgggcgacactctttatggctatatcctcggcgcgagcatcgcccgcggccgcatcgacgagatcgacagccgcgaggccgaacgcacgccgggtgtgctgtatgtcatgacccaccgcaacgcaccggcccaaacggccttcggcccagcgctgacacccaccccgggcgaggtgttcagccgagcgcgcccggtgctggccagtgatcgtgtgcgttaccacgacgaaccggtggcgctggtggttgcctcgaccttcgaggccgcgcgcgcggcggcccggctgattcgcgtgcgctactcggcggagcagggcgacttcgaccttgcttcccgcctggcccaggcctacatcccgccgcggaccaacgccggcttccagaccgacagtgccatcggcgattttgaatcggggttcgccaatgcgccggtcaagctcgacagcacctacagcaccccgtaccaaagccacgtgccaatggagccccatgcctctatcgccgtctggtccggggaagagctgaccctctacacctcggcgcaaaccctggcgaacttccgtggcgggctggccaacaccctgggcatcgagccggcgcgtgtgcgcatcgtcagtccttatattggcggcggctttggcgccaagctgatcatccaccccgacgcggtgctggcggcgctggccgcgcgggtgctcaagcgcccggtgaaggtggccctgacccgccagcagatgttcgccaacgctggttaccgcccggccatgcagcaccgggtgcggctggcggcggacagcagcggcaagctgacggccctggggcacgacgtctggtcgagcacttcgcgcttcgaagagttctgcgagcagaccgcggtgtttgcccgttcgctgtatgccgcgccaaatcgcctgacccgccatcgactggtgccggtggacctcaatcgcggcgagtggatgcgctcgccgggcgaggcgccgggcatgctcgccttcgaaagcgccatggacgagctggccgaacgcctgggcctggaccccatcgatttgcgggtgcgcaacgagccggcgctggaccccgaactcggcgtaccgttcgcctcgcgcaacctgctggcctgcatgcagaccggtgccgaacgcttcggctggagccgccgcaagcccaggcccggcagcgtgcgcgagggccgcaagttgatcggcatgggcatggccgcggcgatccgccccaactacctggggctgtccagggcccaggtgagcctgggccctaccgggcgggtgctggtgcgcctggacatgaccgatatcggcaccggcacctacaccatcctgacccaggtcgccgcccacagcctgggggtgccgatgtcggcggtgcaggtacaactgggtgacagccgcttcccgcagacctcgggctccggcggttcttggggggcggccagttcctgctcggcggtggaggccgcttgccaggccctgaagcggcagctgatccaggccgccggcgcgccttacaaccaagcgccggtgcagttcgccgatggccgtatcagcacgggcgagcgctcggagcgcctcgttgacctgatgctgcgggtggctcccgccgggttgcaggccgaaggtagcgtcgggcctatgggggaggactataagcagttttcccagcattccaacggcgcgcacttcgtcgaagtcgcggtggacatcgacactggcgaagtccgcctgcgccgcatgctcgcggtgatcggtgccgggcgcattctcaaccccaagaccgcgcgctcgcagatcctcggcggcatggcctggggcgtcggcgcggcccagatggagcagaccctgctggacacccgccacggccatttcgtcaaccacgacctggccgagtacctgataccggtcaatggcgatatcgcggcgatggaggtgctgttcctcgaagagcccgatcccagggccaacaccctgggcatcaagggccttggcgagctgggtgtgtgcggggccggggcggcggtagccaatgccgtctacaacgccaccggcatccgggtgcgcgagttcccgctgaccctggacaagctgctgcccgggctggcggccctggaggagtaggcgcagcctgcatcgacaaaaaatctcgacggcatgccctggattgggcaggcttgtgggctcgcacccgcccggttggcgggtgtggaattcaagccatcagtcgacggactcctccatgaaccttgccaccctggtgctgtttctcccagcctgtttcgccctcaacatggcgcccgggccgaacaacctgctgtcgatccgcaatgccaccacctatggcttccgcgcctcctgcctggcgggagtagggcggctggccgcctttgccctgatgatcgccctggcggcggccgggctggcggtggtgctgcaagcttcggaactgctgttccacgggatcaagattctcggcgctggctacctgctgtacctggcgtatcagctgtggacggcggatacccaggtcgagaccgagaacaagactgcgccattgggcctgctggccttggcccggcaggaattcctgatcgctatcggcaatccgaaagcgatattgatcttcaccgccttcctgccgcagttcgtcgacccgcaagccccggttcccgcccagttcctggtgctcggcgcactgttcctggccctggaatggatcgccatcagcgcctacgcctacatgggcctgcacctgcgccgctggtttgccgagccacggggcaagagaatcttcaaccgctgctgcgcggcgctgttgtcggcggcggcttcggtgctgctgttggcgcggcgggcgtgagccggttggtaagcatcgttgggactacgggcgctcggttgaatacacagccagaagctgcctttcacgctatccacagaaacacactcaccgtgcgctgctgaaagacaacattgaaaaggagttcgaatgaaaacggattggcaacaaaaatttgagagcgcatatgactaccgccatcaggcaggcaaaaaacaatctgacgcttagattcacgggcaatcacccggcggagacggatttgtcacctctggtttgaacgtctcctatggggcgggagccgctccatggccgaaacgaacaatggaggttagaacccatgcttcgtgagggatcacaaaggaaaacttatgcctatcgacaactgtcttcatacatttgaagagcttgcctcaacggtgttgcctagccattttgcaaggctaaaggctgccctggagactccaatgcctgctgcaacctttgttggcttcaagagcgcatcaaaaaaagctctgtccaaggtgggtagaaccacagatttcccagggtgctacgtcttcagcgatcaaggtaagccggtctatgtaggtatttcgagaggggtagtaaagaggctcgtccagcatttaaatttcgagtcgcacaacaccgcaagcctcgtctacaaaatggctgcagaagactatccgcacgaaatgaagcgtgatcaagcgatgaaagacgaacaattcaaggaagtctttctttcagctcaggggcgcctccgacaaacaacggtggcctttatcgaagtcaacaatgaccttgagttgtacgccttcgaagtacttgcggccatgaagctagacacagatgtatggaacacattccgcacacattgaagctgatagctaacctttccataaagcggactctgctacgcaaacaggtcgccgccgttcattacaaacgttaagtcgcgtccgcgctgaatcgaatgtggtctgaaatgagcgtccgcttccggccgattctgttgaaaaagtcggccatggtttgcgcatcagaaaagtacgcgtccgagattgaaatctttacttttggcagggcttcccggactcggatttcacgtagcagcgtgcaaaaaaggcgttttcaccagtcaatgatcaggcagtttgggcagaccgactttttcaacagaatcggccacaagcgaacatctcgatagccaatctcaaagaggctgaacactgaggccgtcggttatttaagccgcagctccctagaacttttctctatttatcggtctatgtggataggctcatccgctcggtaagcgcggcctcgcaggcttaccgcagccggatggccacacgtccgattgtccagcagaggttgtcttcgctcatgaaattccctgacccacggatggtgctcttcggcctgttcgcgttcgcggcattgggctcggcatcagcaacacagatgaagacctcaacccctgttttagcaactgaagtcccagccgttcaggctcctgcccaggccgccggcaacccttggccgaccttggccagcatggctggcaagcagcccgggccattgcttgcccatgacgaccgatactggcatgacggccgttggcacgatcgtcgagacgattggcgccggcacgactggcgtagggaacagtggcgtagagagcaagcccgccgagaagctgaacgccatcgcgattgggagcgccaccacgatcgcgccatgcggcaccgctacgaagacaatcaccgctactatcgtcgctagcgcggcgccacgagattaatccagctgcaacagggctgtccgcgccgatgagtcaggcgcagtgccaaagcaaacacaaggatctcgagtggttatgtcaacggacgaactggcgatacgccagatttcagcgcttgctccgcaagtcctgctcctggaagcggaggcagttacggagggtttcaggtttctcacgcgcttggttgcagagtggcagaacgggtcgagtcggttcgatcaaccgggtgaatgcctgttgggcgcctttcgcaacgggcaactgattgccatcggtggccttactcgtgacccctatgccgggccggatatcggcaggctaaggcgcttgtacgttgcacgtgcagcacggggacggaatgtgggtaaagccctggtgcagcggcttttggaacacgcggctcagcaattttgtgtggtacgcctatccacggatacaccagagggcgccgcgttttacctgcgctgcggcttccagcagatacaggatgattttgctactcacgccaagtcattggccgatgccactgacgaacatagtaattatcgaattcaccgctttcgatgaattgaaaaccgtggcgggtatagaaacgattcgaagcgctgcctttgagggcacccactctaatagggagcccagccacatccgcctctttgaaaatccgggcgagaacagcagagcctatccctgatccctgcgcgctcggtctcacatacaagtggtcgagcaagagtgaatcgccccgggtttcgtggaggcctcaactcttgagaagatgaggccatgagaaagactacgacctattcccctgaagtccgtgaacgtgccgtgcgcatggttctggagcacctgaacgactacccgtccgagtgggcggccattgaggccattgccccgaagatcggctgtgcagcgcaaacgttgcatggctggattcgccgtcatccaaccgatgccggtcagcgtccggggccgaccaccgaagagcgcgagcgcatcaaggctctggagcgtgagaaccgcgaactgcgcaaagccaacgagatcctgcgtctggccagtgcgtattttgcccaggcggaactcgaccgccgtaccaagtcctgagggcctttgtcgaccagtaccgtgaccgtctcggggtcgagtcgatctgccgtgttttgcagatcgccccgtccggttaccgcaggcatgcggcccaactacgtaaccctgacttgcgttgttgccgtgctcaacgcgatgaggtgttgagtctggagatcaccagcgtgtatgggataccaacatgcagtgctatggcgcggtgaaggtctggaagcagctacagcgagagggcattgggatcgccagatgcacggtggagcggctaatgcggcaggcgggattgcagggtataaggcgcggacaggttgtgcggacgacggtggccagcgacaaatcgctgtgtccactggatcgtgttcaacgccagttccatgccgaccgtccgaaccagctctgggtctcggactttacctatgtctcgacctggcaagggtggctgtacgtggcgttcgtgattgacgtctttgcgcggcgcatcgtcggctggcgagtcagtaccagcatgaagaccgacttcgtactggatgccctggagcaagccctgtatgcccgccagccacaccgtgccgatggactgattcatcacagcgaccgtggcagccagtacgtctctattcgctacaccgagcggctggcagaggccggcattgagccctcggttggcagcaagggtgacagctacgacaatgccttggccgaaaccatcaacgggctgtacaaggccgagctgatttaccgtcaatcatggaagagccgcgaagctgttgagatggcgactttgaaatgggtgcactggtacaaccaccaacgcctgctgagctcaatcggatatatcccgcccgcggaggctgaggcaaacttccaccagcaacaagcaggtcaggccatggcggcctgacttaaacgaaacggcctccacaaaagccggggcgattcaggcagcgcgattcggcgaacctcgcgatcttcaagagccatgcctcaatggtgacatcgattgctgagagcaccgcaattcgaagtaatggtcacgcctggtggaccgccgatgatgatcgttgtgtcggcaacaccatggagcgaacgcgctgcggcgactgcaacaacgccgtaatttggaggtgcacaggttggtatctaccagcgcctttacgacaacctgaagaggttgttggagtgcaacgacattggtgacggtggccgacagcgcgtattgcgtgatttgggtcgctgtcgtgacgtgcttatgcagcttgggtacgacccggaggagaacgtagcatgaccattaaacgcaagccctcggacgctcgcgagcgggatttgcaactcgcacttgcacgtatcctgcacggtcgggcacatagcggcgaatccaaggtcacgatcgccgcggtggcgcgtgaagctggtgtttcaaccgctctgattcacaatcactacccaactgtcgccgaggcgatccgcgaagctcaggggcgttcaagtcgtgctcagcgagatgtgaaacaccaagattgtttggcggagcgcgagaaaaatcgaacgctccgccaagagaatgaggaactacgcgaaaaaattgccaacctcgcctcgattaacgaagtattgatggcagaaactcgtactctaaaagcaaaacagggcgaccttaaggtagtagatctgccctcggggaaattgtaattcagaaatttctcgctttttatatttgtttctgacttttactatagcaatttttgcattaagagaatttatatattccagcactgtctgaaatatagagcatttctgggaattccacgcgtacttgaatacccattcaacgaacacttgggcagcgattccacgctgaccatcgttcacgctcttctttcctgtacgatgaccaagctaaattagccagcatatctgcgcagcattaacgtaagttgcttcagcaagctgtttgcgcagccgcataaggtaaaataattaattatcaaaactatcagcctctctcttttaatcgtttttgattagtaatagtttggtgtaatgtatatgatctactggatgaaatttaagaaatctccgaacaagtcttcaaatgtgctgaaatacgcctgacaacctaatccgagccgcccatgagccagatgagcttttccgattttgaatacgccggtaagcgcaagcagacacgccgcgaacgcttcctcgccgagatggatcaggtcgtgccctggacaggcctgctggggctgatcgagccgttctaccccaaggccggtggcggtagaaagccctacccgctagaaaccatgctgcgcattcatctgttgcagaactggttctccctgagcgatccggccatggaagaagcgctctaaatcacgcccatgcgccagttcgcacgcctgacgctgagcgcgccgaaccccgaagacaccacgatcatgaacttccggcacttgctggagaagcatcagctcgcacctgcgatcctcgcggttatcaacggttatttgcaggaaaatggtctgtcgctgcgtcaaggtaccatcgtcgatgcgacgatcattcacgcgcccagctcgaccaagaatcaagacggcaagcgcgatcccgagatgcatcagacgaagaaaggtaaccagtatttcttcgggatgaaggcccatattggcgccgatgcagaatcggggctggttcatcacgtccatggcacggcggcgaatgtagcggatgtcacacaggtcgccgaactgctgcatggcgaagaaaacgccgtgtatgcagacgccggatacactggtgtcgaaaagcgcgaagagcatgaaaatcgtgaagtaatctggcaaatcgctgcgcgccgcagcacctattccaagtggaataaacgcagtgtgctctataaggccaaacgcaagatcgagtactgcaaagctcagacacgagccaaggtagagcacccgtttcgggtaatcaagcggcagtttggttccgtgaaagtacgctttcatggactgatgaaaaacacagctcagctgaccacgctgttcgccctgtgaaacctatggatggctcgaaagcagctgatgggtatgggcgagttgcgcgcttaacacgcaaggccggtcaaaaaggccttcaatacacgaggcatcggccgtgttttggcaaatagcggtgcgggtcgggggagttttcgacttgccaccgccgtgcggcaagttgaaaaaaaccacgacgatcagcgctaactatcgcgaaacgccctgtgcgcaacgattggttgggcttgtcagcccatttctgcgtgttacacgcgtaacttacccatacccatcagctgctttcgagccatccataggtttgacagagcaaacagcgtggtcagttgggcggtgtttttcatcagcccgcgaaagcgcactttcacataaccgaactgacgtttaatcacccgaaatggatgttcaaccttggcccgcgtctgggctttgagggactcgattttgcgcttggccttgtaaagcacgctacgtttactcagcctggaataggtgctgcggcgcgcggcgatctgccaaatcacttcgcgattctcatgctcttcgcgcttttcgataccggtgtagcccgcatcggcatagaccgcgttttcttcgccatgcagcagttcggcgacctgtgtgacatccgctacattcgccgccgtgccatgaacgtgatgaaccagccccgactccacatccgcgccgatatgggccttcattccaaagtagaattggttgccttttttgtctgatgcatctcgggatcgcgcttgccgtcttgattcttggtcgagctgggcgcgtggatgatcgtcgcatcgacgatggtgccctggcgcagggagagacctttttcctgcaagtaaccgttgataaccgcgaggattgcgggcgctaatttatgcttttccagcaagtgccggaagttcatgatcgtggtgtcttcggggatcggcgcgctcagggtcaggcgcgcgaactggcgtatcggcgtgatttcataccgcgcctcttccatcgccgggtcgctcagggagaaccagttttgcagcaggtgaatgcgcaacatggtttctagcgggtagggctttctaccgccaccggccttggggtagaacggctcgatcagccccagcaggcctgtccagggcacgacctgatccatctcggcgaggaatcgttcacggcgtgtttgcttgcgcttgccggcgtattcgaagtcggaaaagctcatttggctcatgggcggctcggatcaagtagtcaggcgtatttcagcacatctgcggacttgatcggagaatccctaaggctggcgccgagatgagttaaataatattaatagtgatggtgaagtttacagataatgcgcccggaaccagcggcgctccatttttgtaatagcgaaacgagagcggaatgggtgtgttgggcccaccgacacccaccgtcggggtcacccacgaaccgccatcatcctgagagaactgaccactgttactgacgcccagcggggtccaaggcatatttccatatttctgcccgaacgtgaccggtgtgcccttcatcagcaactgaatgccgatggggctaccgctcgcgggcaaaccgacgccgtcagctacgccaggaaagcttgcgttaaaactaacctggggttggttcaagttcgtcccctcgcaactgaactgccaattcgttgagagctggttggttgaaatagcgccggtgccggccaccccgtcaaagtcagcaaggttgacgctgtttaacgtaaagacataaggactggttgtttgagagccgatcttgaatacggagcagttaggggacgcgatggatatcgtattggatgatgcgctaacatccacgacaactggatttccatcgaccggcgacgcggtgttgtcttctgcgtaatagcgaaaagcacctgccgaaggaaagcttaccttcctgatcaccgccgaaggcggaatcggccccgtccgaatgattgatatcctgatgctaaacgccggagaggttgcaatgccgccagcagtgctgacgacgtcctgcgatgtggagatcaataaactattggctatcggtccagaaactgcgccgggaaattgaagccgaaggccgacgcccggaatgctactcggcaagatgaatccatttccagtcggtgtcgcatttgccggggccacatataccgttttcaacctcttgcccttgaggggcgatcccagctgcaggcagttgttggtacgcgccgtcgtctggtaggtaccatcactcatcaagctattggcgggcaagtttccgacttcccaccaggtggccgcagaaaaaacgctggccaatttgaaattctgagtatagctgggcgatccatctatcgcgttaagctgcatgatacatccgcccgcatgagcaacactgaaagccccccaagagatgacaatcaaagtcgcctttataacggcatgattcaagttaagatttataatgaaccgatacatgtgtgcatcactcaataggtttgcagacaccggtcgcctgggccattgacgacaaattgccaggtgatggtgcctgcggggaaagttgataggcgatggcgcacttctttgtccctgtcaggctcacccacagcacacctttcgccgggataccgcgcgtgtaaatacggccaccctggccaacaaaccccgcgattacactactttgagcttcctgtacttgtgcgccaaatggtaagggcgaaccgtccatcatcgcggccttaaccagcgcggcgctttctttggacgtcgcgaaattggctttgacaatagcccctgcccggggaatggtgtctgtaattgagctgtcaagctgcacatcgtccgatagcccgccaggatcgagttctatactgtttcgagtatagggggacagtaccggcaccaagccataaccgtggctgtcgacggtggcacccacactgttggtgatgtgcgcgcccacggcgtcatcggcctcaaccaaggcgaccgtctcgccaagggtttgcccaaaggtaacgccaccgtcatggacgacaatgccccctgcgactcctaagttcgcttgtttgaaattctgcccagaggtgaggccggcagtgacattggccgccgagccttgatagccccctgtgaccccgtagctgctctgcgtactggcacttccaaacgcttgtgtggtggaaatgtcataagaatattgttgctgggctccggcgacgcctgaaacagaagcttgcgtttgactccctgcgacgctgtcatgccaggtgcgtgcggagagataacgacggctgcctgtgtcggacggaaagagtggcagggtgaaactaacgtacacctgattatcacgagtcccgttggcattgatgctgcggtctgcagaaatactatagtttaggcttttgaatacattgctgtaggtcaattggtagagcgtatcggtacctggacggttccagaaatcgcgcgtctcaccgctgacataaatattgccccatcccgcccccaagttttggttaaggtttatattgaaacggcttttctgccggtcattaaacgaaaagcgcgatccgtagacattggtattgcctcccaggcgggcgttttcggtctggaccaaatcattgaatgaccagaaaccctgggtcgaataccgatagctggacacggtgatgttggtgttcgtggggttaataaaagtagagtaaatcagtcgcgcactggtgccgttactggcagcagcgttgtccagcaggttctgtgcgtaggtaatatctgccgaaatgccccccaacggcgtactgatggcgttgccgacagcgaccgagcggtaatcactgccggccgtcacccctccgtaagccgtcagaaagttgctcagcccatagaaacctgaaaactgagcgacggaaggtgtataccggttctgatagggggtccatgcctgaccaatgtccgcgtaataacgaacttgatggggccgcaataactgagccgatgccgcgtatggaaccgtgaaggttttgcttgagccatcggcctcagtgaccgtgacaatcaagtcggtcccataaccaatagggtcaagatccttgatttcaaaagggcccggggcaacggaccgctgataaagaacgataccgccttgactgatcgtcactttggcattggtgttggccatcccccggacaacgggggcataacctctctgcgataccggtaacattcgatcgtccgtggcgaggagaaccccgcgaatgccgaatgagtcaaatacttggccatccgtataattctcccccagcgttaaggtggaaagcaggtttgtgatatccgtctgggcatagctacgctgacgctgatacgtctgctcttgattgtttctgctcagggtcgacaattgtcggaatcgccaacctcccgcgttaaagccggtatccagttgaacaaaaccctgcgtgtcttgttggccaagaatgctcgactgaaacacatcgagcgagtagttcatgcgacccgctgtaatcccactgtcccatagagcaggatctacgtaatccttaggccggtccagtaaataagcctgcggaatatatacatcgaggcgctggtcgcttgagtcgtagcgcgccgacgaggaggggacaaccgcggtgatcgtctgacaggcaggggcggatttgccggtcacccggatgatccactcaacctgtgcaggatcaagcttctctaagttcagccccagtgcactgattttatctgccgacaggcacggaacagcattactatcactctttgctgaaacgaaggttacattaagctcccgagaaaacgtgttgttaatataaagctgtaccgcatagacacctggaaagaccggattgccttttgcaaaacgagacaaatcaacttgacttcgatctttttcagatccccacagcatattcttatcgaactgcagatctgcaaccaatgcattcgaatcgctgaatgcgacgggtgaaaaaataaacaagacaacagcgccaatccatcggttacgtttaatgcatgcagagtttaagacattcattagaatatttcacggctgagaatcactggcaaagttcgcttgcactgcagtacttttgagctcgggcgtaccgccgtaatcattaaccggatagaacactacctgagggttggaaagttcggctttcgaatctctcaatgcaatataagccgtcgaaaacggggcaaccataacgccttcagcactgccaccctgtgaggcattacccacgttgatgcgcttgatggatacgttgaacgccgtggggtttgtggcttgcaaagccccggggtgatatttccaggtcaattgctcagcagctgacgccgcggtacctggcagccccgcgggacgaagaaacaacttgattcgcgtacgaaaggaaaactgcaggtaattctctgcctgcttttcagtattgggttttgccggtatttccagcacattcagccaaaaaactgattcgcggtctttgggtaaaggcttggtttttgtgtaacgtatgcgcaagacttgacccttattggcttccatacggaaaatcggcgtcaagattgcaaatggcacgtcgatcttttccgggctggacttttcatcgccgtcgtcaatccaggtttgaacgagtctcggcagctcgcctttattcgtcaggcgcactgaaacttcagcagactgctccggataaatcacgcgcgtaccgtcaataatgatagaagcctgtgctacgccagcaacggccaagagcagcatcgaaacacaaatgaatcggatgctgcgcacaggaaagcctgacaagttagttcgcataaatgcctcgacgaagcgtagttttggctatatgtaatttatgatatacgttaatgtgctgctgaccggcccggctgtggtttgctgcgtggcataatattgaatggaaaagtttaatgttgccgagcctgtggcatccacttttgccgacccggtgttctgtgccaacacggcactattaagattaatgacgccatgggtagcgtttaatagttgaagctccacaaacagagcgggtgtgccagtggccgtattgatcaatcgtccagccgcattaaccgttgcctgattgttttgaaagtagggagcgacacttcccgctggatcacaaccggttagattgatggtgaagggcgtattaccggcgacctgggttgcggaggccagtaacgatgtggctacggtggggagtgtgacagtaccgtcggcggtgccgttgttaaccttggcatcacacgtcggtgactttaaagccccattaattgtaatggtgccggtgtcatcagcatgcacttggctcgccaacagcatcccgaccaccgacatcagacgtaatctataacgaatgctcatattaagctcaataaaaatgacatcactaaaacagcgatgtcattagtttttttcaaaaatatcagttgtagctcaacacgtattccagttgcgattttaccaagcctggggtcgatgcaccggtggcatagtactgagcataatgagtcagctcggctgtgcccgcacccgctgcgccagtaattgttgcgactgtcgaattttgtgagttatccggttttgaaagatcgatcggcagcaaggtgtcattcaacatttggatgtcaacgtttttagcaccggcggtggtattgtcggtgttaatcagtcgcccacctacattgatcagcggcgaagcctgccagaatgcatgaactttagtcgccgtggctgcgccgccggaaaccaaaccgcaattggaaaggctcatgcgcacaaatactcgcccggttacatcaccggattttgccaaggttttggaagaaactcgaggcagggtaatggttgcatctgcggcgccaccattgacgacaacatcacaggtgttatccgtcacttctcccgagaaggtcagagtgccagcgtcggccgccatcgcgccttgtgtcatcagacccgctgccattgcacaaccgagggccagcacagtttttctaaattcaagcatagttacatctcgcatatatctaaaggaaggctactctaaacaaagagcgggctcatgctatgcgggctgcccaaggcaagcccaattaatatttctcaatagttatcaattggcagagtgaacacatcaaagctatcagtcagaattagagcttctccaatattgtcattttttttgctttaggctggataaggcagaaggcttctgttttattatagttgaagtaagccggaagtgcggctgtgcggacccgcgcagcacatgaacaactgtggaaactattcaacgtgtttaactattttagaaagtcccgttccagcacagtggaatcggttggctggagggggctggtggccttaattcttgccagtccgttgtacgccacctctgcagatttacccaccagttcgcctggtatacgcgagcaaaacttacaaaacacgctccggctgaaagaccagattgatcgcacgattgaggagcaccgccagaaaatcgaaatggaatctgcaccgacagtgtctccatcggtggatgtcccgccttctgacttaggggccaaatttcagattaaccggattgacattgattccgggaaatttgcccggttggcggtcgatgtttccgatattcttgcctcctaccaagggcgcttgttagggcagcatgatttatttgctttgattcgtgatattaccaatcgatacgccagtcgcggatattccacgacgacaattggtttgaacccgagcaatatgcgcgaaggggtgatcacgcttcgggtggactggggggtggtggaaggctggcaagtaaatggccatgaacctgacactgtccgcgaacgaatcatgacgtcgttgacgttactcgatgttgtggataaacccttaaatattttcgatcttgatcaggccattgaaaacctcaataacggcgccaaaagcgccaccattgaagtggtaccgtcggaaaagttgggttattcgctgctcaatattcatacttcgccctcgtcgctgcctacgatttcgttcggcatggacaactctggtgtgaactctcccagtgagggccgaaatcgcttcagtctctcctcctctattagcgatgtctggcttggcaatgatacgctgacggccaatggcagtacccgccacttccgagacgatcagcataattctgagtacacactcggcggtagttacagcgtgccgtttggcagcagtaaactggacctgcgctacagtgatgtatcgagcgcgaacagggtctccgggtattacggtcactacgacctcgatggcgatttgaaaacatacgccatcaatctttcacgggtgatgtggcgtaacggcgcgagcaagttttcgctattctccgaagtggagcgcagagagagtgaaaactacattgagaatacttatttggaggctaacagcaaacgctataactctctgacggtgggagcccagatcgtcacacagttatggggtggttccctctattctgatttgagtttggcccgtggcctgtcagcgtttggcggtgcgcaaggcgcttttgatgacaataaacctgttaattacaaaaaggtcacatccaataccgcatggttacgtccattcagtatcagccatcacaacttcgagttatcaacgcgcctcggcggccaatacgccagacgcagcatggtctcttcctttaagcaggccatcggtgatgaatataccgtacgtggatttaacggcccagcactttggggggatcgtgccttatttgtcaacaacacattaagcatgcctattcaaggcccattgggcaagtttactccctttgtaggattggatgcgggctatgtaaatcagattgttacctccccaaataccgcaaaaagttccactatcgccggggtggccgcaggtgctcgagtatcatggaataagtttgatattggcgtgaccctggcgcgccccttgtggtttcctaatgagattgaatcctccacttcgccttacatcacctatttaaacttcggcttatctatatagagtagcgcatgacacgcgtgatgtttcatgtgtctgcgctgcaacaccataacgcaagagactattatgaatagaaaatgttttcgtctgattttcagtaaagtattgggttttctaattccggtcgccgagatcacgacttcccaaggcaagaagagtcaaggtaccggcctgcacgccgaagtggcgcagcctcccttgtggccgctcttgccggtggttgcggtgctgcgaaccctgcaacagtcgttcattgaagtacgcctcgtggccaaaacgggtggtcgggtattgatgacggccctggtctttgcgcccggctttgccagcgcccaaatggtggtcgacccggcagccggaatcaataaacccaacgtcgtggcggccgcgaatggcgtgccggtgattgaaattgtcaatcccaacaccgccggcctgtcgcataacaaattccagagcttcgatgtggcggcgcctggggcggtgttcaataacagcatggtgaatggcgccaccagtatcggcggcttcaccatgaagaaccccaagctcgctcaggaggccaagggcattctggtcgatgtcactggtaccaatcccagtagcctgggcggcacccttgaagtctttggtaaaaaagcggacctgttcatctcgaaccagaacgggatcacgctcaatggagtgaccactctcaacgccaacagtttgaccgcgaccacgggcaagccgattgtgagccctaccgggttgcagttctccgtcaataatgggcgcgtcaccgtgggacccgcaggcgtggataccacgggcttgtcgtattttgacattgtcgcccgcaccatcgcgctgcagggacctgtcgggtcgacggcacaagcgacggacatcaaggctattgccggtctcaacacctacgatgtggcgtcgcggcatgcggacaccaatagcagttcagcgccaggtacgcccgccgttgccattgacggcacgttggccggtgcgatgtatggccgcaatatttcgttggtcagtactgaaacgggggccggtgttcgtcatgccggtttgatccgtgccgcccaggacatttcgatttcagcgcaaggtgacatcagcgtggccaccttgcaggctggtaatcaagcccgcctcaatagcgccggatccattcaggtgggcagcggtgtggccggtcagggtatcaccgccggtcaggccgtgacgctcaacgctgccaaaaccatgaccatcagcaacccggtccagggggataccttgtccttgaccgccaccagcttgctggtacaggccgccaagctgatcgcgacctcgacggcggccccgggcccggtcaagtcagtcaatatcaaggtgggtgactttaccctctccggtacgctggtggcgcataacctggatggctcgcctgttgccgccaatcagccgctggtcatctctgatggcaagctgcaggttcagcgcggagaaggtaactacgatgaaaacttcagactcgacacgaccgcgatggtcatttcccacaatggcgtcaatatccaggccgacacggtggtcaacgatggcggcatcgtccaagacctcagcacgggcgggatcaaccttctgaccacccagctcaccaacaaggggatcatcaacacccacggtgacatgaagctggtcagcgaggttctaaataacctgtgcactgggatgacgcagcagatctgcgctggcatcctggccgatggcaaggctgatcttcaggccgggaaattgactaaccaagcggggttggttgccgggaacaacctggacctcaccctgaaagatcaaagcaccaacggtgatttgggtgccattaccgccaaaggccagctcaatatcaaacaagcggctggcaatacagcgacgctggtcagcaccggccagattgtcagtggcggcgacctcctgatcatcctggatgccttatccaatgccagtagcaacgctaaaatccatgccggcggcaaggccacctttcaaatttcggccagcctgaccaacgccgggatggtggaagccgcccaggatatcgacatcgcggcgggggacttttccaaccgtgcggattcgaccgtcatgacggatcagaatttgcaaatcgtgacgaaaaagaaactcgagttggggaaaaacagtaacgttcatgccggggtgacgagcaagttgtcggcggggacggtgctgcagaacgcagcggttgtgacggccggaacgacgttggacatgcatgccgatgatcagctcatcaacgatgccggcacctcgctggccagccaagtgttgaacatcagtggtgatcaactgacgaacaaagcaggttcgttgatcagcgttgacgatcagctgaacatcaacgtgaaaggggatgtgagcaacgccgggcagtcgttcatgctcagcggcggcgatatcagcatcgttgccggtggcaacgtctccaacctggaaggctcggttgtctccgcgaccaagaatgtggtggtcaatgccaacaacgtcaccaacagcggtaaagccctgggcgccgatgccactgaaaatgatgtctcgaccattactggcgccgacgtgaccatcaaggcgcatagcgatgtgcgtaacgctgccaaggccaacatccttgccacgggcaagctggatgttcaggctgacggttccgtgtccaacgtcgatgcgcagatgacaggttccgaggtgcagctgacggcgggtactgacgttaccaaccataatgcttccatcgttgcaaccaccggaaagatcgccgttcaggctggcggcgatgtcctcaacaataccttgtcggtcatttctgccaaagatgcgttgagcgttaacgccaaaggcgccgtcatcaacaaaaactcggagttgctgggcagccagatcgccgttcagactggcggcgatgtcctcaacgacgccttggcggtcatttctgccaaggatgcgttgagcgttaacgcaaaaggctccgtcaccaacaaaaactcggatttggaaggcagcagcatcaccattgatgcgggtactgacgtcattaaccaagcggctggcttgatcaaaactgacggaaatctggatattaaagcgcaaggcgcggtgactaacctttcttcacaggtacagggcaacgagattgctatcgatgcgggcagtgatgtacgcagcgaagcaggtgcttggatccagtcgatgagcaacctgggcattaaggccgggaaagtgatttccaacctggcttcgcaactgatcggcaccgcggtgcagcttgatgccggcagtgatgtccataacaaagccgatagtgcgattgtcgcaagggacacgctggatattcagagcggtggctctgtgaccaaccaggcttcgaaggttcagggtggccacgtcaagatggatacccagggagcagtaacaaatgctgacaaggccaccatcgtcagtgacaccgatctgtctatctccagcatagacgccctgcgaaatgacaatggctcgacgattgtcgccgcgggggatgtcgatttggtcgcaggtagcctggctaaccacgcggggagtgaaatcctcgggaataagattggtgttctggcgcacggggatatcagtaatgaagctgccgcgttaatcaaagcaacaggcgctctcgatatcaaaacagacggtgcactcatcaacacccaatctgggctgcagggtcgcacggtcgtcgccgaggttaaaggcgatgccagcaatgccagtggtgcattgattcaaggcgtcgaaggggtgaccctgaccacggccagtaacgtgagcaatgaccaatcgcaggttcaagggggctccgttgtgattaccgctagtcaggtgaccaacagtcatcaagcggtgattgccggtaagacgattcttgtcaacgccgcaggcgcggtgagcaacgataacggcagtgatatcaaggccaccacctccgttgctatcggtgcacaaggggcgctgaccaacgatgccagtaccatcaccggttcgaccgttgttctggatgcgttacaagtcactaacaccaacgcctctattgccggtgatacccttcacatcaactcgctaagcagcgtgttaaacacggtcaagtcgactattgtggccacggccgaagtggtggtggcagcggtcaccggcgtgttgaacgatgattcgctcatcaagggtcccgtcgtgaagatgggtgcggagaccattgataacgcggcaggggccaatattctgggcgacagcgtaaccctgacttcaggtcagggcatcaagaaccgtgactccgcgattatcaagggcgatacccaggtgacgctggacgctcaaggcgatgtcatcaactcgggcaacgctaccatcacgacgccgaagttgacggtggacggcaccaatgtcagtaacattcagggtggcaaggtcctggccgacaccattgcgattcaggcaaaaaatgactttgtcagcgactctttggggtcgatgaaaggtaataaaattgccattgacacgacccatttccgtggggcgaatagtgagatattggccgacgatgatatcgacattcacactgcggactatgccaataccgccaatatcagctctagcaacaccgcgaccctgaccatcaagaatgacggtaacctcaacattgacgaaggtcaccgagcgcctttggcaaaacagctgctgaccttgaatgcccatgatgtcacgaccaatgccgagttgaacaaccccggcagtattcacatcaatgcggcaggtagcgtgcacaataaccaaggtattgtgaccggcaaaagcctagtcgtgaaagccgccgatgcgatcgaaaacgccatcgcgcaaaccgtgttcgccgcgcaggacatcacgctggaggcgggctccagtatttccaatttgaaagatgcgctgatcatggccttgggcaatgtgtccttgaccgccacagaagtcaaaaatgacctcgggcgcattacatccggtgagtcgatgtcgattgatgccgacaaaatcaccaaccagggcaccacccgtggaggccctgttattacgggttactcatcggctagcaccaaatatgaatgggagcactcagcacgctcaacgtggatttctattgacatgatgctaccggtctatatcagtaacatgaccgtgacacaggcagtgattgaaagtggcggtgacctgaacatcaatcagggcgccaagcgtggtaaaggcggccaggtgatcaacgccgacagtttgatgacggccgcgggcaatatcaacgtcgatgggaatcttctcaacaagtcgacagtggtttcaaagtccatttatgaattattgaatgaacctgctggtatcgtgctaaaggccaaagacagcctcgccgcgaaagttgtaaaaaaggtatataataacctgtgggagttattggctgaaacgtaccaaggtgacgacaaccatcacaccatctttgccgcctataagtataccgatgggaatacctcggcggcccttcagacaatcgacaacccggtgttcaaccagctcatgagcgcggcctttggcgctgactggaaagggctgtctcgcgatgagatgagccagcggtttaataacatccgttctgcctcgctctccttttcgggtgataaaccagccgaaattgcggcgggcggcaagtttacgcaaaccggcggcgcctttaataacggcggactaaaaaaggaacagcaaaccgttcaggtaaaggtcggtgataaaacaatctcgacgattcagggcgactttaaccgacaatttaacaacagcctgttattcgacgacagcaagacgccacgccttgtcgagttaacagcggcaatgaacccacagaatgtcattgatcgactgaccaacaccgcatcgttgtttacaacacgtacctctcccccgccgttggtactggaattgtcagacacgccactgatcccacgtgtgagaaaaggtggtccttcagtggctgcagccaaattgggcaacgcagtaatgcgggtcaatactgagattgacacggccaccgttgcggctcctgtacaggtcgcgtacacgccaatctatccgctgtacgaaacacgcattgagtatatcgaccagagccagttctttggctcgcaatacttcttcgacaatattggataccacagtgatcgtaccgttcccgtgatcggcgatgcgttcttcgataaccaactgatcacgcaaacgatccaggatacggtgggcggctactttgcagccaaagatggggtatccggcgccacgctggtgaagatgctcatggacaatgccgccgatgcggtggttgcgcagggccttcatttcggtgttccgctgacggaaacgcagtatgccaagctcacccgcgatatcatctggtatgagccggtggtgattaatgggcagacggtgttaagccccaaagtctacctgagcaaggccacactggctgatgtagcgaacaacaaagaaaccaccgcgctggtcgcgtcgaaagacgcaacgtccattgatgcgaccaatgtgagcaacgtcgacggaaccattcgtggtggctcggttgacattaagtcggccggcagcattcacaaccaaaatacgggcgggggcacgggggggatctttgcgggctccacgggtacggttgcactggatgccaagggggatgtcagcaatatcgggagcactgtctcgggtaaagatgtcgctatccacaccgaaggttcgtttaccgactcggcccgaatgggttatgacgatcatggcagtttggttctcaaagaccggggaaggatcgatggcggtgagaacggcagtgtctccattggcgccgccggtgatgtcaacctgacggcggcgggcatatctgccaagcatgtgagtgtgcaggccggggggaatctgaactccaacgacgtgcatgaagtgagttcaaacttcaagcagaccgttgagactaatggttttaacatggggaagctaaaggtagttttggggaaaacgatcaacaatgacaaagaagtcagtgcgacctctgtcgggagtcagttgcaaggcggagcagaggatggctcgctgaccctgcgcgcaggcaagaacatcaccctcaaaggcggcgactatagcgccgaccagggcctgatcgaagccaaaggtgatgtgaaagtgctcactgggcaggactttaattacagcgaacaaacgatgctcagccagggtctgaacctgggcgtaaacgcgggtatcgccggaaagggcgtagtcgccgaatacggaccgcaaggggcatcggccagggtggtgggtggcgataaggccaataataaggatgctggcccgatggatggcggaaagccagtactcgatggtcccctgggggctaaagttggctaccagcgagtggaaaccaaggacactcgcctgcaggttcagaatcagaacgcccagctcaacttcggctcgtcggccacactgcagggcgctggcacggtggacattggcggtgcggatatccaggccgtcaaggacggcaaagccggtgacctgtcaatcgtcggcagcgacgtgatcagcaccaaatatgaagatgaagatgttcagacccactcgcgtaaagagctttttgtgggggggagcgtcacggggtcaagctctgtcgccgatacggttaaccactccaccaccttggcggacaaggccaagcaagggatgacggtggatgccggcatgaccgctctgcaggctgccggcgatgccaccaacctgatcttcaacgacataggggccattaccgccaaaaggggcatcaagatcaccgatagcacctcctcaagccgcagcaccagcgaaaacatcaataccctcaagggtaatatcaagatcacctccacccaaggggacatcaagctggcaggcgttacgctggacggtaccggagcgggtgtggaactggattcggcgcgaaatgtgtcgctttctgccgccaagagcaccagtaaaagccagtccagtactctgacccatgaggtctcggagagtatcagtgcttcggcggccccgacgggtgcagggattggcgtttcggtgggttacagcggcagtctggatgaaaccaaggcaacgggggttgcctaccaaaatgctcaggtcttgggtgacaaggtagtcatcaaagccaagaaagacctcgagctgacaggggcgaaagttaccggtaatgatgtcggcctggatattgccggcaacacccgtgtgacgtccgtgcaggatacgtccgacatgaagcataccgtcggcaactgggggggcagcgcaggcgtggcactcaccaccaccagtatcgtggcccccacgggcggcgctaacggtggcgggggcaaggatactgaccacggtgcactgacggccgagcagtccggtatcaccgcgaaaaacacgctgaatgccaacatcggcggtgatttgaatttgaagggcgcgcacctgatttcgcaaagcggccaaggcgagctcaatgtcgccggcaaaatcaaggccgaacagctgcaggatagccgtaacaaagatgggggtagcggtggcggtggcggtggtttgagtaaaaccggcctggcctctgtcagcctgaacgtcacgcgggtggaccaggtgcattacgacgccacccaaaacgccaccattgccggactgcagatcaagagtggccaaggggtcgaaggcccgctcaaccgcgatgcggacaagacactgaatgtcactcgtgataagcatattgccggtaacgacgtgtccatcactgccggtattgccgatgtcaaagggatggcagccaaggccaagaccaaaaagcccgtcccacccgctcaaaagtaccctaagggtattgcttggtacattccgaacgagcccgttaaacctaagccgaagccttttgtacctgatttgagtctggaggtcgtaggcaaaggcatcaaaaagccttcatttgagccgactcctaagccgactcctaagtcgactccaggtgccggtcgtaacttcgactcggtcgagttcagtcaggtcaaaaatgcgctggccaaggtgaacgttaacgataaacagggcttggtcgatctgaaaaacaatcccattcgtatcgaactggacagtaaagggtatctgggagccaatggtaagccacgagaccccattatcatcaaagagcctaaagacatcataaagttacacggccagaccattgacaccggggcacgcgccaaaggactcgagttgcctaaaggcgtgggtgagtcgacgaaggtgtatgtgcacgtcaaagacgagggtaatggcaaatattcggtcaagtatgacagtcgagagcctggaccttctgtcccggacacctcggctcagccgtttaaagcatcgccggcaccgaaggctccggccaaagcggctccgggcgagcctcaacgcacgacgaaggttaccccggcagacacggcagtggttaaaccgccggtagcggcggcggatagccaggctcaaaaaaaaaccaataccaatggaccgctggaaacaaagccagctgataagtacgacagccgggtgatcgtgaagctggagtcagatccggctacagatcgggccgcgcaacgtatccatgacaagcacccggagaacagcgtcctgcgccagcgggacgctcagggccaacacagcgtggtggctggcgacccacaaagcatcgggggcaaaaccaaggttgagctggtggggcacggcgatggtacgccagatggatcccggactctgggtaggctagatgccgacgggcttgctcaggaggtaggtaagttgcgtgagggcgccggcgctccggttgaggtgaaaaaagtgacggtggtgggttgtgacaccgggaattgcgctgacggcccgagcttggccagtcacgtaggtgatgcgttgcacgtgcagggtattgacgcccctattaaggggtatgacggcaagatcgacctgacggccgatgggcacaagcggccggtggacgcaggtggcttaatgatgagcgccgatgatggtgcatcagacggcaatgcaacaccaaatctagaattaagattaggtaagcctttaacgccgaaaaatttaacgaagcgttatggaatgttgtctctagaagaaccttcagaggggaatgcgatcactcatgaagcgaaccagccagttactgatgcagtatcaaaaatagagttaagatcgcacaagtatttaacgttagaggaggctaccaaacgttatgcggtgctgcacgagcagcagctgaagaccgaccataagcggcgcagaggcgaaggtagctccataaaggacaacaatcccatcgagtcatcaaagaatttagtggaaattatacctgaagagtttaaggcgctgaataagtggacatataacgcagaaataaatgaagcaataagatcgggcaaacctttgagctcggaacatataaagcagcgtgataacttggtatctctcttgcacagacttccaagttcagacagtctggttttatggagaggggtatctaatattgacacccctaaaaaaggagcgattatttctgacaagggttttgtgtcgacatcgactgacccaataacggcagaggtgtacgcggggctcgccgatccagatggagggattccttataatccgatcatatacaagattaaagaatcagtaagcgggaaggatatttctgagttaagcgctagtaaatacttcagtttaaaagaggttttgtttgagcctgaaataccttttaaagttacaaaaattaagcccagagagcttactggtctgaaatatacggaggttacgataaaggaagtctcgaaaaagcccagtaaataggccaccgcaactgaaggcaacaccggatcttttcggtacggtgttgccattccagcccagcagcgcatgcggccagtcatagcttgatccagtcggcacggggttggggggggcggcaaaaaacttggactggttatgccgcgaggcccaggctctcacgatactcaatgggactgagagcgccgaggaaatcttgattcgtttctcgttgtaccagcgaatgtatgaatccagggcctgaatgaactgctcgctgctcgttgactggcagttgcgaggatagatcagttccgttttcagccggccgaagaggccttcacaagccgcgtgtcaggcgagcatcctttgcgtgatatcgaacgaatcagcttcgcatcagcgatgcgcgataaccagctgggccagcggtagtgagcgccacgacctgagtgaacatgggccacagcaggtatcgaacagttcggaggagggacacataccccataatcaggtccgattgtgggtcttttggcgctcacagagccgctattcagcaatttactgcgcagtggtaaatgcgtggccgccacgatttgaaaccagccagcacttacaacctgaactgtgtatctatttgaaaacatcctcgctactggcagacgtattgggcgatcaaaaatgccgctattttgctgaatgagtgagcgtcagcttaatcacgtgaacagcgcaaaataatgccaaatggttataagtgttaagttattgatttatatgtataaaatcaaaggtaacggttctctagggtccagaactgttcaaggcgaacatgtggtccggcaggccgttgacgtccagcggcaggatgaaaaaaccgtcggtgccggggccgatattgtcgaccccggattcgctggccggtgctagggcgggcagggtggcgaggcaggccaggctggcggcgaggcgccgggagagaggggggcgggtcgaattcatgttcgggctcttattattgtcagtgggcgcgcagtgggccggtttccggccgccccataggaataagccttcggcacccgggcaggcagggtattggcggccactgagggggactttcgcggccagcctgcaatgacttgttacatccttgcgtgagcgcgtgcggaaaacgctatgctgagcgggcgctcgcctcgccctggcggtgtccgggagcggggcgcataaccagaataagcattgcagccgaaccggctcgggacccgatgcccatgcagatgaaagccgtcgatccacagtaccaactggccctggtgtccccctttctgttgcagaccctggccgaagtcgcgggcagccacggcgtcgacccgcacgccctgtgccgcggcctgggctttaccctcgacgacctgcaggaccccgcgcaacgcatctcctaccgccaggccgtggcgatgatccagcgcgcgctcaaggccttgccccggcagggcctgggcctgtgggtcgggcatcagaacgtgctcggcaccctgggcctgctggggcatgtgctgtcgctgtgcaagaccctgcgcgatgccttcgacatcggcatccgccaccagcacacctcgggcggcatcgtcagttgcacggtgcggcagcagggcgatgaatttttcgtcgaggccgaatgccggctgccctacagcgacgtgcagatctttgccgtcgaagagttcttcgccagcctgccggtctatggccgtgccctggtcggcgccgatttccaggcgctgcgggtcgagttcatgcacgccgccccggcttaccaggacgagtacctgcgcctgctggggcccgacgtgcacttcggctgcctgcacaaccgcatggtcatcgccggcgaatggcttgatacgcgcctgcccaaccaccacgccgtggccctgcgccaggcgctcaagttgctggaactggaaagcgcccaggtgcaccgcaagctggacctgatccaggcggtggagcgggccatttcccgcgacctgacccagggcagccatatcgagcaggtcgccagcgatctgaacatgagcgggcgcaccctgcgccggcgcctgagcgagcacgacctgaccttcgacgcgttgctggagcaggtgcgccgggcgcgcaccctgagcctgctggccaacccgcagctgtccatcgagcgcatcaccgaggcggtgggctatagcgacgtgcgcagttttcgccgggcgttcaagcgttggaccggcctcagccccagtgcctatcgggaggagggcggccaggcgtaggacaggggcgtggcccttcaccgcgtcacttcatgggtgtctaaacccccacaaattgtggtgctccgggtaaacttcgcgctttcttcaaggagtcgctatgagttactaccagccgggcattcttgccacccccgttccgagccaggctcgtcacctgtttttcgccctcgaatccatcgaggcgctgccggcggcgatcgatcgtctgctgacgctggtggacgggaaaacggcggtagcagggtttggcgcgtcgctggtcaaggcgctgggcgcccgcgtgcaggggctcaaggccttcccggcgctgaccggggtcggcgtcgacaacccttcgacccagcatgcgctgtgggtctggctgcatggcgaagaccgcggcgagctgctgcaccgcggcaacgccctggcggccgccctggccccggcgctgcgcctggtgcagatgaacgaagccttccgccacaagaccggccacgacctgaccggttacgaggacggcaccgaaaacccccacgatgaagcagccatcgccgcggccctggccgacggcagcgacggcctgcgcggtggcagcttcgccgcgatccagcagtggcagcatgacttcaagggctttgccgcgatgcatcaggaggagcgcgacaacatcatcggccgccgcctgagcgacaacgaagagctggacgacgcgccggcctcggcccacgtcaagcgcaccgcccaggagagcttcacccccgaggcctttatggtgcgccgttcgatgccgtggatcgaaggcgacaagggcggcctgatgttcctcgccttcggccacagcctccaggccttcgaagtccagctgcgacgcatgagcggcctggaagacggcatcgtcgatggcctgtaccgcatgagccggccgatcactggcggctactactggtgcccgccgctgcaggagggccgcctcgacctgcgcgccctgcaggcggtctgatccgcgctcatcgctggcaaaccttgctcttacagaagtgtgctttcctctgtaggagcgaggaggacacctgctcctggcacgcgacgccgacagactcacttgtggcgttattaaggtaaatacaaggcaccggtaacgttgaaaatatctggttttattgcctgaaggccattgtcatatcttatatacagggttgatgcttggcgttatgcaaggtgagcggagttattaagacgtttcttaaatttttgtgtttttctttggcgaaaatgcggggggtgatataaaggtcggcaaattttcttgtcggtctttactgtatgtctgtttgttctggaaggttgttgttttgtatatcgtctgtcttcttgtttgcttgttttaaggttaatgcaagttgcaccgtcacgaggtcggatggcgctgttgttaattcgcttatcgtgacacttccactggcggcatctcagccttttgatccgaatgttcctgacggtacggttatatacagctcttcaggagcgggaacagggctgggaggtagggccaaatgtaccagcgtagtgggtgatgtccaatacaggggtatcgggcctgtagggaagttcaatacttattcaactccggttgctggtatcggcatccgcattcgaggaggtatcaacacaagtcaatggtggcctcaacaaatgacaagccctaatattgactatagcctagggacgggatcagacttcacagtggagttggtgaaaacggggccggtcacggcgtcaggacaattgacggggcttattggcacaactacggctattgctcatggctcggattttcgcaggatttcaattagtggctccctgcagatcaaaccgaaagttccctcttgttctcttttgactcctaatatctcggtgagccttggaaaagtctcgatcagttcgatgacggggccaggtgttactacttcatcatctccgctggagattcgcttgaaatgttcagggggtaatgaaggcagtaccacaagaatgttcttgaccctgaccgatgctgtcagtccgggtaacaggtccagtaatttatcgctgctgccggggcccgccacggcctcaggggtgagtgtgcagatattgcgcggtgatggcacaccggtcagctatggcccggactcggcggaaaccggcaatccgaaccaatggcaagtgggtgagtttggcaacgtcatggtgatcatcccgttcaaggcgcgttatatccagacggccactagcgtccgcccggggtcagccaatgcggcggcgacctttaccatgagttatcagtagacggatgacttctgccgggcttgcccgcgataaacgatgatgcggtgtgccaggcaaaccgcgcctaggccttcgcgggcaagtcggatcgccgcccgttcgctcctacagcagccaaacgctatccagcggcgctagtgcgccgcggtcatgttcggccggcatgaatggaagatgtccagccgcggctggtacaggctggtcttgatctcgaacagcccgagcaccgagtggaacaggttgtcgtggctcaggtccggctcgccgctcttgccttgcaggcagtcgcgctggatgcccaggtcattcagggcctgctggccgaaccacatcagcatcggcacatgggtctgcgcctgcggcgccagggcgtagggcgcggcgtgcaggtacaggccgttttcgccgagggactcgccatggtcggagacgtacagcatcgaggtgtcgaagcgttgctggttgtgctcgagcaactcgatgacccgggccaggaagtggtcggtgtagaggatggtgttgtcgtagacgttcaccagttcctcgctgctgcaactgcccagctggttggtgtggcagatcggggtgaagcgctccaggctcttcggatagcgctcgtagtactccgggccgtggctgccgtcggcgtgcaggacgatgatcgcgttgtcgccgaggcgatcgatgtactgctgcaggtccaccagcagggcttcgtccaggcagttcttgccgtcgcagaaggggctcggctgggtcttgggaatgtcgcggttcggcacccgcaggcaggtgcccttgcagtcgctgttgttgtccagccacagcacctgcacgccggcccgttgcagcacatccagcaggccttcgtaggtcttgcccttcttgtcgctgtagtcctcgcggggaaacatcgagaacatgcacggcaccgagaccgcggtcgaggtgccgcaggagtgcacctgggtgaagttgaggatgtccagcctggccagctccgggttggtgtcccgggcatagccgttgagggagaaatggtcggcgcgggcggtctcgccgaccaccaggatcatcagcgacttcttctcccgggcgctggcctgggcactcatcgccgcgtcctggccgatcggttggatcaccaggtgttgcttgatccccaggctctgcttggcgtatttgccgagggcgtagatgtagttggtcgggttgatgaagtgggtcagcttgtcttcttcgcgaaagatcggcgcgtaggtggaatagaaggcgccgaccgagaccgcgatcaccagcacacagccggcgatcaccagcagcttgttcagcaggccgcgaaagaacggccggtagcgcaccggggtgcgccagatcagcaccaccggcagcaggcccagcaccagcaggtagcccagcagcttgaagttgaacagcgcggcggcttcgtccgggttggtctcgaacacgttctgcaccatcaccgtgtcgatggtgatgccgtactggttcatgaaatacgcggcggcggccgaggtcagggccaccaggctcagcgccggtttcagggtccagcggaaggacaccagggtcagcagcagggtgatggcggcccacaggaacagcccgaaggaggcaaagaacgccagtttgtgcaggccttgcaggctgatcaggttgcccagcgcgtgccaggtggcgaagttgtagagcagcaccagcgccagggaaaacagcagcaccaggcgagtcgatgtgattgacgcgaatcgcagtcttttgcccaagaccatttcagttcgttcctccagggagagatcaagacaccagcagtggccctgctgactgtataccggcattggtaaaaaaactgtcgaaagggcgctgcttttcgtatcggctcacgccgaccagcgcccgccggattcagaaggtcttcctggcactggcgacccaggtcgcgccacacaggtcgctgaatccgtaattgccggtgcactggcttttcgacaggtcggtatcgatatagctcaggcccagcaccacgcccgccacttcgcgggtcaatctggcctcccattcgtggtaggcatcctcgccctggcccgaggccgagatcaatcgtgggtccttgaagtccatctcgccgtaacgcagcgccagccccaagcccaggggcagctcggtttcgtagccgaggtagcggtacagggtgctctgccggctgtcgatgcccggcgcatcgttggagtaataggccgccagcgtgatcccgtaggcgctgaaaatcccgtagacctcgctctggttgaattgcccttccctggggtagctgtacttgaggtagcccaggtcgaggctgaccgcgtcgctggcctgccacagccagccggcgtagtagtcgacttcctggcgggtcttcaggccgccgccgaaatcgacgttggaggtccaggcacccaggtacaggccgctgctgtgcagcagggtcgccgcggcctgggcggcggggtcgttctgggtctgggaaatgccgcgggtgcggtagtcgctggccagggtcagttccagttccacggcaaagtcatcgttcaagggcagggcctggctgcccaggggcaacaggctcaaggcaccgatggcgaacaggctgagggtcttcatgtgggcgtcccgtattgttgtgattgttatgggcaggtttcgggcaaggctgcgccggcccacacgcgcaaggacgtggggcggggcagtggatcggtttttttagatgggccggtttagcgagatcgggttagatgcatcggattagatgcatcgggttagagaggccgggcgtagacttcgcggccggcgaaccaggtctgcagcacctgggtttcgtgcagggccttttcgtcgaccttgaacacgtcacggtccagcacgatgaaatcggcctgtttgccggcgctcagcgagccgatccgttgctccaggccgatggcgcgggcggcgttgagggtgtaggcgtagaacatggtttcgcggtccaggcgctcgtcggcgttgagcacccccagcggccccttgcgggtgatggcctgggcgatggcgttccacgggttgggcgaggacaccggccagtcgctggccccggcgagagtcgcgccctgcttgagcagggaatgcgccgggtattggtaacggaaggccagggcgctgacgtagggcttgatcatgtccagggtgtagtcgtccgccgaggcccacagcagttgcatcgaggcaatgaccccgagcggcttgaagcgggcgaactctttcgggttgaccatctgcaggtgggtgatggagtgggcgatgccgctctggcggtccttgcgcgcctgggcgatgccgttgagggattcgcgtaccgcgcggtcgccgatcgcgtggatgtgcacccgccagccgcgctggtcgatggcgctgaccagttcgccgaaatgctcgggatcgatcagcagttcgccctgtttgtgcgagttgctgtagggatcgatcatcgccgcgctctgggccgggtactcgatcaccccgtcggcgaagatcttgacgccgggcagggtcaggttggggatgccctggaattgctggcgcacctgctccaggacgtcgaggtcggcaggaaggcttttcgggttggccaccagcagcgcggcgacatgcgcgctcatgccgccgctctcggccagggccttgtaagccggcagcacaccgacggtctgggcggtgggcttgagggcgaacaccgcctcgccgggagccgcgttggccgccgggtccatccaggcggtgatgcccaggctgttgttgtagcgcaccgccgattgcgccgcgttgagcagggcggcggcgctgggcaccggcattttcgccgcgacccgatcccagccggcgtccaccaggaagccgttggggcggccgtcggcgagcttgccgatggtgtcgcgctcggcctgcggcaggttcttgagcagggcggcgtcgatgccggcgcgctcgagcatcgcgtcattggcccaggcggtatggtgatcgctgccggtgaacaccaccggcaccctggcccattcgccggcgttgaagcgctggcccagggcttcggcctgggcccagtaggccgagctcatgccggcgatgctgagcacatcgccatgcctggccttgccatcgtcgcgccaggcacgcagctttttctccagctcgtcgaggccgaccacctcgtcctgcaggttggccgaggtcatttccaggccgccgaagatcgcgtgggaatggctgtcgatcaggccgggcatcagggtcttgccgcccaggtcgatgacccgggtgccggtttcgatcagggccttgatctgcgcgtcgctgcccacttgcagcaccttgccgtcggccaccgccagggcctgggccttgggttgggcgcggtcggcggtgaacacctggccgttgaacagcaccagatcggtggcggccatggcttccattgaggcaaaactcactgcaatcgtcagcagattcggaatgaatcttttcattgagtatttccttgttattgcgtctgatggccagcttattggcttgccagagccgacagaacgcctcgctgacgaaaaacgtttttgcctgaatggaaaaagcatggacaagttgagtgcactgaaaatgttcgtggccaccgcgcagctgggcagtttcagccgcgccgccgagcagttgggcaagaccccctcggccctgaccaaggcggtcaatcacctggaggtcgagctgggcgcgcgcttgttcgagcgcagcacccggcggatcttgctgacggaagtggggcggctctacctggacaccgcgcgccaggtcctgcagcggctggaggaggccggcgaggaaatcgagcagttgcagcatggcctgcgcggcaacctgaagatcaccgcgccgctggcctatgggcaggcctttctcgaccaggtgtgtggcggtttcctcgagcagtacccgcagatcgacctgcaggtggacctgtgcgacgagttcgtcaacctgctggaaagcggctacgacctggccctgcgcgaaggccatgacgacctgccggggctgatcgcccgggtggtcggcagcaattgcctggccctgtgcgccagcccggcctacctggcgcgcaagggtgtggcggtgacgccgcagaccctcgacgaacacgaatggctgctctatcgccatcccttgctcagccgcgagttctggtgggtcgaacgggacgggcagcgcctgagcttgctgcaaccccgggcgccgaggctgcgcagcgacaattacgacctgctgctggccaatgccctggccgggcgcgggctgctgcacaccccgttgtggagcgccgcgccttacctggccgacggccgcctggtgcgggtgatggccgactacgccatcgaccccgactgtttcgggccgcacatcctcgcggtctaccccagccatcggcgggccacggccaaggtgctggcgttcatcgattacatcagcgcgttcctggcgagccgcgggttgggctgactggcggttcttgtcaggaaaatccgggaggagtacaaatgtactccatgaccactttatctccccgccgcagtgccatcctgacctttatcagcgagcgcatcgccgaatatggccagcccccgagcctcgctgaaatcagcgaggccttcggcttcgcctcgcgcagcgtggcgcgcaagcatgtcgtggccttgaccgaagccggcttcatcgaggtcaaccccaaccaggcccggggcatccgcctgctcaaccagccgccgcgccccgaactgctcgacatcccggtgctcggccgggtcgccgccggcctgccgatcggcgccgatgccgaggtgcacagccgcttgctactcgacccggcgctgttttcccgtacccccgactacctgctgcgggtccagggcgactcgatgatcgaggacggcatcctcgacggcgacctggtggcggtgcgccgcgacagcgaggtgcgcaacggccagatcgtggtggcgcggctggatggcgaagtcaccatcaagcgtttcgagcgcctggccgatggcgtgcgcctgctgccgcgcaacccggcctatgcgccgatcctgatcggcgaggaccgcgacctggccatcgaaggggtgttctgtggcctggtgaggcaaggctgatgggcgccgtcgtggcactggagacgctgttcaatgccggccgggtgtggaagggccgcccgacggcgcccgccgccagcccgcagcccaccggccacgccatgctggacgcggccttgcccggcggcggctggccggaagcggcgctgacggaaatcctcatcgccgcccagggtgtcggcgagctgcaactgctgtggccgaccctggcccggctctcggccgccggcgaacgcatcgtgctggtggcgccgccccatgtgccgtacccccaggcctggcagagcgccggggtcgacctgcgccagctggcggtgatccaggccggcgaacgggatgccctgtgggccgccgagcagtgcctgcgttcgggcagttgcggggctgtgctgtgctggccgcaacaggccgacgaccgtgccttgcggcgtttgcaggtggcggccgagaccggccagaccctggcctttgcctaccgctccctcaaggacgccctcaacccttcgccggcggccctgcgccttgccgtggaggcgcggccggcgcagttgcgggtgctcaagtgccgtggtggcctggcccattcggcgccgatcgccttcgccccgggggcctgaggttgccatgcgctgggtctgtattctgttcccgcaattggcgctggacgcggcgctgcgccagcgccccgaaccggaggccgcgctggcgctgctcagcgggacgccgcagcgccgggtgatccaggcggtgaatgccgcgggccgcgagctggggttgcgccccgggcagtcgttgaccgccgcccaggccctgagcaaggacttcgccagcgccgagtacgacgccgaggaaatcgcccgttggcagcagtttctcgcggcctgggcctaccgcttcagctcccaggtcagcgtgttttacccgcgcaccctggtgttcgagatcgagtcgagcctgagcctgttcggcccctggccgcagctggaggcgcgcctgcgccaggaactgacggtgctgggttttcgccaccgcatcgtcagcgcgccgaatccggcggcggcccgggtgctggccaatgcctacgacgggctggcggtgaccgacctggagcaattgcgccaggccctggggcgcatgcccgtggagcgtctcggcctgccgtcgggcacggccacagccttgtcgcgcatgggcctgcgcaccttcgtccaggtgcgtgggctgccgcgggacaccctggcccggcgtttcgacgcgggcctgctcaagcacctggacactcttttgggcgagcgctccctggcgctggcgttctatcagccgccggaccgtttcgatctgcgcatcgaattgaatttcgacgtgctgtcccatcaggccctgctgtttcccctgcgccgcctggcctgcgatctggcggcgtttctctgtggccgtgacagcggggtgcagcgcttcgagctgcacctggagcatgtcgagctgcccgacaccctggtcaaggtcggcctgctcagcgccgagcgcgagccggggatgctgttcgaactggcgcgcgggcgcctggagcaggtccaggtgccggcgccggtgcgtggcgtgcgcctggtggccgaggatttgccgcgcttcgtgccgcagcaccgcgagctgttcgacgagcgtccgcagcaatccctgccctgggagcagctgcgcgagcgcctgcgcgcccgcctgggggacgaggcggtgcatggcttgcgcttccactcggaccaccgccccgaatgcagctggcagccggtcggcgacagccaggcctgcccgctgttgcccgggccccggcgcccgggctggctgctgcgcgagccgctggtgctggcggagggggcggcgcgcatccttatggggccggagcgcatcgagtccggctggtgggacggcggcgacgtgcgccgcgattactacctgatcgaaacccgcggcggccagcagggctgggcgtatcgcccggtgggcgaggcggggcccttgctgttgcagggctggttcgcatgaagggctacgccgaactgcactgcctgtcgaacttcagtttccagcgcggtgcctccagtgcccgtgagctgttcgagcgggcggcggcccagggctaccaggccctggcgattaccgacgaatgcagcctggccggtatcgtccgggcctggcaggcctccagggacagcaacctgccgctgatcgtcggcagcgaaatgcgcctcgacgacggccccaggctggtgctgctggtggagagcctggagggttaccagggcctgtgtcggctgatcacccgtggccggcgccgggcgcagaagggccagtaccagttgttgcgcgaagacttcgaacaacccttgccggggttgttggccctgtggctggcggacgagcagccacaggagcaacagcaggaaaccggacgctggttgcaacaggtgttcgccgaccggttgtggctggcggtggagctgcactgcggccaggacgatcagcggcgcctgggcgaactgctggagctggcccgcgggctgggcattgccgccgtggcctgcggcgatgtgcatatgcatgtgcgtgggcggcgggccttgcaggacaccatgaccgcgatccgccatcacgtgcgggtggccgaggccggccagcgcctgcaccccaatggcgaacggcatttgcgcagcctcgaggcgttgcaggggctgtatccgccggccctgttggaggagtcgctgaagatcgccgagcgctgccatttcgaccttgggcaactgcactaccaatatccccgggagctggtgcctcaagggcagacgcccgccagctggctgcgcgagctgaccgagcgcggcatcgtcaagcgctggcccgggggcgccaagcccaaggtgctcaaacagatcgacgatgagttgaagctgatcaccgagctggggtacgagagctatttcctcacggtgcacgacatcgtcaactttgcccgcggccagtcgatcctctgccagggccggggctcggcggccaactcggtggtgtgtttcgccctgggcatcaccgagatcgacccggaccgctcgaccctgctgttcgagcgttttctttcccgcgagcgcaacgagccaccggatatcgacgtggacttcgagcacgatcgccgcgaggaagtcctgcagtacgtgttccagcgttacggccgccatcgcgccgcgctgaccgcggtggtcagcacctaccacggcgccggcgcggtgcgcgatgtggccaaggccctgggcctgccgccggaccaggtcaacgccctggccgattgctgcggccactggagcgacacgccgccggccgtcgagcgcctgcgggaggccggcttcgacccggacagcccggtgctgcgccgggtcctgagcctgaccgggcaactgatcggctttccccggcacctgtcccagcaccccggcggcttcgtgatttccgagcagccgctggacaccctggtgccggtggaaaacgcggccatggccgagcgcaccatcatccagtgggacaaggacgacctggacgcggtcgggctgctcaaggtggacgtgctggcgctgggcatgctcagcgcgattcgccgctgtttcgatctggtgcgcggttatcgtggccagcagtggaccctggcgactattccgccggatgacccggccacctacgaaatgatcggccgcgccgacaccatcggcgtgttccagatcgagtcgcgggcgcagatgtcgatgctgccccggctcaagccgaagaacttctatgacttggtgatcgaggtggccatcgtccggccggggccgatccagggcggcatggtccatccgtacctgcgccggcgtgacaaaaaggagaaggtgacctatccctcggcggcgctcaaagaggtgctgcagcgaaccctgggcgtgccgctgttccaggagcaggtgatgcagatcgctatcgtcgccgccgattacacccccggcgaggccgaccagttgcgccgctccatggccgcctggaaacgccatggcggcctggaaccccatcgcctgcgcctgcgcgacggcatgcgcgccaatggctacagcgacgagttcgccgcgcagatcttcgagcagatcaagggcttcggcagctatggtttccccgagtcccacgccgccagtttcgccttgctgacctatgccagctgctggctcaaatgccacgagccggcggccttcgcctgcgccctgatcaacagctggcccatgggtttctacagccccgaccagattctccaggacgcgcgccggcatcagttggcgattcgtccggtggacgtgcgcgccagcacctgggattgcagcctggaaccgttggccggcgcgcagccggcgttgcgcctggggctgcggatgatcaagggctttcgcgaagacgacgcgcggcggatcgaggcggcgcgtgggcatggcccgtttgtcgacatcgccgacctcgggcaacgggcgcgcctggacagccgcgcccaggaactgctggccgatgccggcgccctgcgcgggctggccgggcaccggcatcgggcgcgctgggaagtggcgggggtgcagcaacagctcggcctgttcgccggcctgccgcgccaggaagaagcgccggtggtcttgccgcgcccgacggtcggcgaagacctgcaggccgattacctgagcgtcggtaccaccctggggccgcatccgctggccttgttgcggggcgagctcaaggcccggcgctgtcgcagttcccgcgagctgctggaggtcgagcacgggcgcccggtgagcgtcgccgggctggtcaccgggcgccagcgaccgggcaccgccagcggcgtgaccttcgtcaccctggaagacgagttcggcaacgtcaacgtggtggtctggcgcgacctggccgaacgccagcgcaaggtcctggtgggcgcgcagttgctcaaggtcgacggcaccctggaaaccgaaggcgaggtccgccacctgatcgccgggcgcctgagcgacctcagcgacctgctgagcggtatcaccgtgcgtagccgcgatttccgctgatgtagccactgccgcaggttgcgacaaggccgcaggccttcagcgatcttgagacttttacggccgttccggccgatcgcagcctgcggcagcggctacggggctgagttgtctgaccggcgtcatggcgactggtccgacaatcgcgaaaatgcggtgaaaccatccgcgtggcccgtgctccaaacttgagtacctgtccgtggcgttcggggcgcggccgggaatgccgtcattcaatcgtgttcactgggtcaagcgatgtcgttcttatccgatcctcatggttgccagggctggagaggcgaaatggccgggcgcatccaggcgttcgactggtccgtcaccgagctgggcgcgctggagcactggtcgtcgagcctgtgcagcgccgtgcagttgctgctggcctcgccggtgccgctggtcatgctctggggccgttcgggctacatgatctacaacgatgcctacgccgaattcgccggcggccggcatccgtacctgctcggccgccaggtggagctgggctggccggaagtggcggatttcaaccgccatgtgctggacacctgcctggcgggcgggaccctatcgtaccgcaacaaggagctggtcctgctgcgcaacggccagccggaacatgtctggatggacctctactacagcccggtggccggcgacgaccaggcgccggccggggtcatggcgatcgtggtcgagaccaccgcccacgtgctgtccgagcagcgccgccaggaagtcgagaacgcctaccgcgcggaaaacgagcgggtgcaactggcgctcaatgccggggcgctgctgggttcctttgtctgggacatcaaggccgaccgcctgtcgggcgacgagcgttttgcccggaccttttcctacccgctggagcagccgctggacgacctgtcgatggcggtcgccgacagtcgggtgcaccccgaggacttggcgcggatcaaggaacaggccgcctacagcgtgaaaaagggcgtgccctataacgccgaataccgcatccgccgggaggacggcagttacctgtgggtcatgggctgtggccgttgcgagttcgacgacgcagggcaggccttgcgctttcccggcgtgttgatcgatatccacgaacgcaagatggccgaagaatctctgctgcaactgacgcgcaacctcgagcagcgggtggccgaggaggtcaacgcgcgggtctcggccgaggagcagctgcgccaggcgcagaagctcgaagccattggcggcatgaccggtggcgtggcccacgacttcaacaacctgctgcaagtgatcgccggcaacctgcacctgctggtgcgccatgagccggacaataccaatgtgcagcggcgggtcggcgcggccattaccgcggtcgagcgcggcgccaagctgtccgcgcaattgctcgcgttcgcccggcgccagccgctgtcgcccgaggtctacaacccccgccggatacccgacagcctgagtgagctgctgcaacgggccctcggcgaaaccatcgacatcgatgtgcaactgccggcgaagccctggtgcatcaaggtcgatcgcagccagttggaaaacgccttgctcaacctggcgatcaacgcccgcgacgccatgaagggcgagggtaccatcggcatccgtggcgaaaacctggtgctcgaccgcggtttctgtgccggcaagggcatcagtcccggtgactacctgtgcctgtcggtggccgataccggcgatggcatgccccccgaggtgctcaagcaggcgttcgaaccgttcttcaccaccaagcgcgacggccagggcaccgggctgggactgagcatggtgttcggtttcgtcaagcagagcggcggtcatatcgagatgctcagcacgccggggcagggcaccacggtgcgcatgtattttgtccgcagcaccgaaccggaaccgggagaggcgccccggcgcggacagcggcctggccatggccaggaaaccatcctggtggtggaggacaacgaggacgtccgcgcggcggcggtcgagctgctggagagcgctgggtacaaggtgctggtggcggccaatggcgatgcggccatgcaactgctgctgagcggcgcccgggtcgagctgatcttcaccgatgtggtgatgcccggcctgatcaaaagcaccgaccttgcgctctgggccaagacccagtcgccggtcgtggcagtgctgttcacctcggggcatacccgcgacatcatttcctgcaatcaccagctcagcccggacacccacctgctgagcaagccctacagcccggacgccctgaccgccatggtcaggtcggtgctggaggcgtaaggccataagcgggaaaaagtccgccgaacgttcgacatccgcggttgctcaaaaccccgggcccatgcaccctgcatctcggtcgggtggctgcctgtcgccggtgctggcgccgtggggctttctgacttgacctctgttccgacacctccgatacaaggctgtcccatgacttcagcgcgcaacacgccttcgccccaggttttgtcttccttgcccgcgaacagctcgggttttgtcagggtgcgcggcgcccgcgaacacaacctgcgcaacgtcgacgtggatattccccgcgatgcgctggtggtgttcaccggggtctccggctccggcaaatcgtccctggcgttctcgaccctgtatgccgaggcccagcgccgctacttcgaatcggtggcgccctacgcccggcgcctgatcgatcaggtcggggtgccggatgtcgacgccatcgaaggcctgccgccggcggtggccctgcaacagcagcgcggcacgccgagcacccgctcttcggtgggcagcgtcaccaccttgtccagcctgatccgcatgctctattcccgggccggcagctacccgccggggcagccgatgctctacgccgaagacttctcgcccaacaccccgcaaggggcctgccccaactgtcacggcctgggccgggtctacgaggtcagcgaggcgtccatggtcccggacccttcgctgaccatccgccagcgcgcggtggcgtcctggccgctggcctggcaggggcagaaccagcgcgacatcctcgtgaccctgggctacgacgtcgatattccctggcgcgacctgccgcaagaacagcgcgactggatcctgttcaccgaagaaaccccgaccgtgccggtgtacgccgggctgaccccggagcagacccgcgaggccctcaagcgcaagcaggaaccgagctacatgggcaccttcagcggggcccggcgctatgtgctgcacaccttcacccattcgcaaagtgcgctgatgaaaaagcgcgtgtcgcagttcatgctcggcagcccgtgcccgctgtgcgagggcaagcgcctgaagcgcgaggcgctgtcggtgaccttcgccggcctcgacatcggcgagctgtcgcagatgcccctgctgcaactggccgaggtgctcaagccggtggccgcccaggcttacctggaacaggccgaggaggccggcgaggtctggagccacgaacagacccaggccgcgcgccaacaacggatcgcccaaggcgcgccggggcatgtcggagggccggatgtgcggcacacgccgaacctgtccctggaaaaacgcctggccgcgcaacgcatcgcccaggacctgctggagcgggtcagcaccctgactggcctgggcctgggttacctggccctggagcgcagcacgccgaccctgtcgtccggcgagttgcagcgtctgcgcctggcgacccagctgggttcgcaactgttcggggtgatctacgtgctcgacgagccttcggccggcctgcacccggcggacgccgaggcgttgttcgaggccctgcagcagctcaaggcttcgggcaattcgctgttcgtggtcgagcacgacctgcagaccatgcgccgcgccgactggctgatcgatgtcggcccggcggcgggcgagcagggcggccaggtgctgtacagcggtccgccggcggggttggcccaggtcgcgcagtcgcagacccgcgcctacctgttcgccgaacaggcgccggctcgccgcaccgcgcgccaggcccagggctggctgcgcctggagggcatcagccgcaacaacctgaaggacctgagcgcggagttccccctcggttgcttcaccgcggtgaccggagtttcaggttccggcaagtcgagcctggtcagccaggccttgctggaactggtgggcgcgcacctcgggcggccgcagggcaacgaagagccagaggagctgaacctggaggacgacgccccgcaggccagcagcggcgaagtcaccgccgggctggagcggatcaagcgcctggtacaggtggaccagaagcccatcggccgcaccccgcgctcgaacctggcgacctacaccgggctgttcgaccacgtgcgcaagctgttcgccgccacccccgaggcacgggcgctgggctacgacgccgggcagttctccttcaacgtcgccaagggccgctgcccggcctgcgaaggcgaaggttttgtcagcgtcgaattgctgtttatgcccagcgtctatgctccgtgcccaacctgccacggcgcgcgttacaacccgcagaccctggctatccagtggcagggcctggacatcgcccaggtcctgcaactgacggtgcaggaggcggtcgaggtgttcgccggacaggcgagcatccgccgttccctggaagtcttgcgcgatatcggcctgggctacctgcgcctcggccagcccgctaccgaactgtccggcggcgaagcgcagcggatcaagctggccaccgagctgcagcgcaacccccgcggcgccaccctgtatgtgctggacgagccgaccaccggcctgcatccgcgggatgtcgatcgcctgctggaacaattggacaacctggtgcgggccggccatagcgtggtggtggtcgagcatgaaatgcgcgtggtggcccaggccgactgggtgatcgatatcggcccgggcgctggcgaccagggcggtaaagtggtggtcagcgggacgccacaacaggtggccaggcaccgcaagagccgcaccgcgccattcctggcccaggccctggggtgagccttcgttgagccgtcggccatggcgggttgttggggctggcggtgggtctcgggcagtgccgctgtaggcgacgaacggttaccgctggtctgattggcggtcgacagacagcggtggtcgaggtcattctggtaactggcaagcgcgtgtaaatgggcttgctaccgatcaacaaacggaggtgtttcatgccggtgccccatgacctgtatcaggacctgagctacagcaaagaagacattcaacagcgtcgggccaatgacccgcacttgaatgccttgttcgataaatactccagcattgatgatcaggtgctcaaagcggaggccgcggcggccgctgacgaggagctgaaacgactcaaggaaaagcggctgctgatcaaggacgaaatctccgagaagctgaccgcccgcttctgaccccgaccctgtcctgagcgagatgtcccgaggcttcgggcgtctcgccaggttctacgcaatccagagcattggctgctctttccgctatttgcccgtttactcccctgtatcgacccgcacccttggcgagacgcgcccgagtcgggcgcgcctgtttcagcgcctgcctgcctcaagggcactcgcaggtgctcgggccgaataccgggcctgcgcagggatcttcggacggtccgaacaccgggcacgcggccagcgccgacagggatgaagtgagcagcagggaagccaggaggattttgattttcatggggggatccactctcaatgtgatgggaatcaatcggattcgattgtttgtctttccttggtgggcgcctgtgacggcgccgcgcgggacagcttagatcagaatctggcgagcgtgccggtgcccatgccgttatcgcatcaaggcgcctttgacagcgcgacgctcagcggcaggcgtgccatatgcgtggccttgatcgagccgaagtacagggcgtcggcgtattcgcgcaccgtggtgatcggcgcgtagttgccggcgctggcgtcctgcaggttggagatgacctggccctgggtatccaggccgaggacgaagccgcgtttttccaccggcttgggcagcacggtcatggcccgcacgatcatcttgcgcacccgcgggtagggcgcggtgccgtccagcaggacattgcgcggggcgtagagcgccacccagaaacgcccctggccgttgaagctgaggttgtccggcagccccggcaggttgtcgatgaacaggtcgtgggtgccggccttggcgccgctgagccagtagcggctgatccggtaggccccggtttcgttgaccagcacataggcttcctggggcccgagggcgacgccgttggcgaactccaggccgtccagcaactgttcggtctggccggtctggaagtcatagcgcagcaggcgcccgtcgccgccgtgctcgatcaccgcctcgccatcctggccgtagccccagcggctggtggcgtcgctgaagtaggcataacgcccggcggcgtccaccgccacatcgtcggtaaagccgaagggcaggccgttggcggaggtggtgagggtgctcagctggcccttggcgtccagcgccagcaggcccttgaccgcgtcggcgatgatcagccggccatccggatgccgggccaggcccagggggcgtccgccggtactggccagtacctgcagggtgctgccgtccagggcggtgcggatcacccgcccgtcatgcaggccgctgatcaacgaaccgtcttccagcaacagggcttccggcccgtcgatattcagcgcgcccaccgtctgcacgcccttgagtttctggttttcggcgtacaggccgctcttcagcgaaggcgccaccggcggggtccaggccaatggctggaccttggtcggcatcagcagcagaaaggcgccgatggcgatgaccacgaccaacagcagatggcgaaacttgatccgacggggtgcgacgggcttcatcgagggcggctcctgggtgatgggttcaggtcgcgctctgcggcgcgacgtcggcgcccaggggaattgcccgttgcgccatttcgcacaaggctagcagggagtcggcggactcccgttctatccgccttctgaatagcaggcgattgcccaggcgcatcagcaggccggtaaagcggtattccagggtgcggataaaccgcgtgcggtgggcgtccagcgcctggcactcgtaggtcaccaccagctccaggccatgatcgcccttggccgcagcgctccagcgctgcccgggcaggtactcgtcgacctgccagctcaggtgcccgctgcgcccgccggcgtggatgtcttcctcgaagcgcgcgccggcgggcagggccccggccggaccctggaccttcaatgaagacgggtgccactccggccagcggctggaggcacaggcatagtcgagcagggccaccgggttgcgcggaatatcgatctgatgctgcatgcgggtcatggacgaggaccttgtcgatagagaggaggtagcgggttccggctcccagtacagggtgccgaacaggtaatccatcagcggcaggacgatgttgaaattgcgctcctgcatcagctcgcgacggtgatgcagctcatgcaggcggcgcatctggcggatccatggcagccgtgccagcgggtgttcgggcggcaagtgttcgcaggcatggaacacctcgtaggccaggtaaccgatcagggtgcagctggcgaacagcgccgcgacattggcattccagaacttcagcagccaccacagcggcagggcgaacagcaggctgtggaccacgatcagccaggccggaaacaggatcacccgccagtcccgggggccgtcgtaggtcatgtacccgggcacgaagaaactgtggtgatcgccgctgtggcgggcgtagaacatccgcgcgaaggcctgcttgtggtggcccagccagcggtgcacgacatagatgcacaggttgaagaacagcagcgccaccggcaccgccagccactccaggggctgtacctggtgcagggtgctccacagcagggcgatgcacgccatgccataggccagcacgaaaccgccgtgcagccacgggttgtagcgcggatgaaccgcggcgcggtaacgctcgcgaaatgccagggtggtttgcctcaaggccgttctcctgtgggttttattgttcttgttgacagcagattagtcctgctcgaattatccagctaatggatattcggaatgggcattattcatgaagctgaatttgcggcacctggatctcaacctgctcttggtgttcgacgcgctgatgcaggagcagaacctgtctcgcgcggcggtgcgcctgaacctcagccagccggccgtgagcaacgccctggcgcgcctgcgcagccagctcgacgagccgctgttcatccgcaccgcgcggggcatgcagcccacgccgcgggcccatgtgctgcacggttcggtgcgccaggccctgcgcctgctgcaggaaggcctggacccgggcagcgagttcgacccggcggcggctgaccagacctttagcctgtcgatgaacgactacgcccaggcgcgcctgttgccggcgctatcacgccgtttgcaaagcgccgcgcccaaggtccgcctggcggtgcgcagcgatgccgccgactccctgccggcctggctgaccaccgggatgctcgacctggcggtggactacctgtacttcgacgatcccgacctctgctaccagccgctgctggaagaacagctggtggtgatcggccgtatcggccacccggccttcgagccacagctcggcctcaaggcctatgaacagagccagcacgtggcgatcccggaccggggcgggcgcggctcgccgctggagatcgtcctcggttcggccaaggtccagcgccatgtgcagctgttcgtcccgcattacctgagcattcccttgatcgtcgcccagtcggatttgctgggcacggtgccgcggcgcctggcggagcacttctgcgcgctgatgccgatccgcatcgccgagctgccgttggtggcgccaccggtgcaggtcagcctgatctggcatcgccagcaggagcgggtgccggggcatcgctggctgcgcgaggagatcatcgccctggccgcccggttcgtgcagcagccggagctgtccgggcgctgatgacaaaaaaccaacaaaagattaagacgagtctgattggcaccgcggacaccgcctgtatcctttggggcccgcttgacgagcagccgtgctgactcagaggcgccaacccattggagattgcatgcgtcactcgattctgaacattgccctggcagccagttgcctctttggcctggccgggcagaccgccatggcggcggtggatgccagccagtacgtggaactcaaggatgccgtgccgcaggtcgtgcccggcaagatcgaagtggtggagctgttttcctacggctgcggccactgctacaacctcgaagcctcgatcaacccctgggccgcccagcttcccgaagacgtgaacttcgtcaagctgccggccatgttcggcgggatctgggatgtctacggccagctgtacctgaccctggcgaccatggacgccaagcccgaggtgcaccacgcggtattcgaggcgatccacggcggcaaccgcctgaaaacccccgaggccatggccgagctgctcaaaggccagggcatcgagccggcgaagttcctcgccacctacaactccttcgccgtgcaggccaaggtgatggacgcgaaaaaacgcaccgcggcctaccaggccaccggcgtgccgtcgctggtggtggacggcaagtaccgcttcggcatgaccaacgacggcgccaagggcctgttcgcggtggcggaccagttgatcgcccaggtgcgggcggcaaaataagccctcgatcccctggccgctgtccagccggcgaggctcggcagcggcccaagggcatcgagcggcagtcaaaaagggcatcgctagcgatgcccctcacaagcgctgtcagtccttgatccgcggcgcctgcggatgcgggctcgggaacgcctgctcataagcgcggcacaggcgcagcacctgatcatcggcaaaccgcgcccccaccacctgcaggcccaccggcaagccgtcctcggcgaagccgcacggcaccgacgcggccggttgctgggtgaggttgaaggggtagctgaagggcgtccactccatccattcgcccaggccggaacccggtggcacgttgtgcccggcggcgaaggcggtgagcggcagcatgggcgaaaccagcaggtcgtagcgcctgtggaacccggccatgtgcgccaccagcgccgcgcgggcttccagggccagggtgtagtcgtgaaggctgatgccttggccctgccgggcaatacgcagcaggcccgggtcgagctgctggcgttgctcctggctcagttgcccggccagccgcgcggcgccggcgaaccacagggtattgaacagttccagcgggtcgctgaaccccgggtcgacctgctcgacgtcggcgcccagttgcgccaggcgttccaccgcccgggccaccacccgtgctacctgtggctgcaccttcacgtagccgaaatcggcgctgtaggcgatacgcaggcctttgaggtcagtgctctgcggcagccagggcgtgctgcgtggggccccggcaaggccgtcgcgggcatccgggcgggcgacggtttgcagcatcagcaccgcatcgtcgacggtgcgggtcatcggcccgaggtgcgagaggatagtcatggcgctggccggccactgcggcacgtagccgaaggtcggcttgatcccgaaggtgccggtgaaggcgcagggaatgcggatcgaaccaccggcatcgctgccctggtgcagcacgccgaggttcagcgaggccgcggcggccgcgccaccggaggaaccgccggcggtggtgcgggtgtcccaggggttgcgggtgatgccgtacagcgggttgtcggtcacgcccttccagccgaattccggggtggtggtcttgcccagcagcaccgcgccggcgttgcgcataaaggccgggaagggcgcatcgacgtcccaggggccgctggcggaggtggttttcgagcccttgcgggtgggcatgccacgggtcagggtcaggtccttgatcgaggccggcacaccgtccagcgcaccgcagggctggcccttgaaccagcgctgctcggaggcttttgccgcgtccagcgcgccttgcgggtcgacatggcaataggcgttgacctgcgggttgaagcgctcgatgcgcgccagggcgtcctcggtcgcttccaccggcgacaggcgcttgtcacggtaatgggcgagcagttcgacgccgctcatctcggcgatttcgcggtgtcgggtcatgccgtcgctcctgcttgcgccgcgttgaccatggcccgcagcaacacggcgcaaccgtcggccaggtcctggggcgcggcgttttcgatttcgttgtggctgatgccgccttcgcagggcacgaagatcattgcggccgggcccagctcggcgatgaagatcgcgtcgtgcccggcgccgctgacgatgtccatatggctcaggcccagctgttcggcgccctggcgtaccgcggcgacgcaggcggggtcgaagtccagtggcgggaagtcggcggtgggggtcagctcgaagcccaggccgtgttgctggcaggtgtcctcgatcacctggcgcacctcgtcgaccatggcttgcagtttgtcggcatgcaggtggcgcaggtcgagggtcatctgcacctggccgggaatcacgttgcgcgagcccgggtgcaggctcaggcagccgaccgtgccacaggcgtggggctgttgctcgtgggcgatgcggttgaccgcgctgaccacctgggcggcgcccaccagggcatccttgcgcaggtgcatcggcgtcggcccggcatgggcctcgaccccggtcagggtcaggtcgaaccacttctggccgaggcagcccatgaccacgcctatggtggtctggcggtcttccagcaccgggccctgttcgatgtgcgcctcgaaatacgcgcccaccggatggccgagcaccgcccgcgagccggcataaccgatgcgccgcaactcgctgcccaccgacagcccctgttcgtcctgcttgcgcagggtgtcgtcgaggtcgaacttaccggcgaacaccccggagcccatcatgcacggcgggaagcgcgagccttcttcgttggtccagaccaccacctcgagcggcgcctcggtctgcaggccgaggtcgttgagggtgcggatcacctccaggccggccatcaccccgtagcaaccgtcgaacttgccgccggtgggctgggtgtcgatatggctgccggtcatcactggcggcagctgcgggttacgcccggcgcggcgggcgaagatattgccgatgccgtcgatgctgacgctgcacccggcctcttcgcaccagcgcacgaacaggtcgcgggcctggcggtcgaggtcggtcagggccaggcggcacacgccgcccttggcggtggcgcccagctgcgcgaggtccatcagcgattgccagaggcgttcgcggttgaccagcggggtggcgtcttgcaacgggggtacggacacaatcggacggttcatttcatctctcccctcaggcgctcagggccaggtagcggttcttgatgctcgggtcggcgcgaaagtccgcggcgctgccctggtagaccacgcgcccctgttcgaggacgtaatggcggtcggcgagcttgtcgcagaccatcaggttctgttccaccagcagcaccggcaggccgtcgtctttgatcttgcgcaggatcttcaccagctcgtcgacgatcaccggggccaggccttcggtgggttcgtcgagaatcagcagcttgggatcgttgagcagggcgcgggcgatggcgagcatctgctgctcgccgccggacagcgcgtggccggcgtttttgcgccgctccttgaggcgcgggaacatgccgtagacatcctccagctgccagcggctgctcttgcgctgggcgatgcgcagattttcctcgacgctgagcaggcggaagatgccgcggtgttccggcaccagcgccaggccctggcgggcgatctcgaagatcttgcggcccaccagctcctggccgttgaagcggatctgcccctggcgcgggcagatgatcccgagaatgctgcgcagggtcgtggtcttgcctgcgccgttgcgccccagcagggtcaccagctcgccggcgtcgacctgcagcgagacgccttcgaggacgtggctcttgtcgtagtaggaatggatattctcgacggtcagcatcaggcggcttctcccaggtaggcgatgcgcacgcgctcgtcggcgcggacgaattgcggtgtgccctcgaccaggatctggccgtggctcatgacggtgatgcgttggctgatggacatgacgatgctcatgttgtgttcgatcagcagcaccgtgtggtcgcggcccaggtcgctgatcagctgggtcatgatcgggatgtcgtcgatgcccatgccggaggtcggctcgtcgagcatcagcagtttcggcctggagcagatcgacatgccgacttccagcacccgctgctggccgtgggacagttcgccggcgagggtgtcggcgcgtgccgtcagttgcaggcgttcgagcacctggtcggccatctccaggtgttcgcggcggctgtcgacgtggcgccagaaattcagcgccgccaggccatcgcggccctgggcggccaggcgcaggttttcccgcacgctgaggttctggaacaggctggtgagctggaacgaacgggccatgcccaggccgacccggccatgggccggtttcttgatgatgttcttgccgttgaacaggatcgccccggcggtggcctggcgttcgccggtcaggcagtggaacaggctggtcttgccggcgccgttggggccgatgatggtgtggatggtgccggcctcgactttcaggttgacgccgttgaccgcgtggaaggcgccataggccagctccaggtcctgggtttgcagcaggtactgcgtcatgacagtttctcctcggtcggcagggccgccttgcgtggcccccggatgcgttcgaacaggctcgacaaaccgccccacaaaccgccgcgcatgaacaccaccaccaggatcaggatgatccccagcagcatcagccagcgtggccagaggtcggagaggaactcgccgagcagcacgatggaaccggcgcccagcagggagccgaacagcgagccggtgccgccgactatggtcatgatcaggatgttttccgacatcgccaggtcgatgttcgacagcggtacgaaatgcaggagcatggcgtacagcgccccggcgatcccggtgaccgcgccggacagcatgaacaccaggatcttgaagtgccgggtgtcgtagccgatggcggcggcgcgggtttcattctcgcggatcgccatcagcgtgctgccgaacggcgaggcgatcacccgccgggcgccgatgaagatcagcaggaacagcaccgcgacaaaggcgtagaagtagcgcgcatcgcccagcgacagcagcacggtgtcgccgaggcggatctccgggcgcggcacgctgagcaggccgttgtcgccgccggtccagtcgctcagggtgtaggcgatgaagtaggccatctggctgaaggccagggtcagcatcacgaagtagatgccggtgcgccggatcgccagggcgcccaccagcaacgccagcagcgcgcccaccagggccgcgccgaacagggcgctgaacaggcccagttgcaggtggatcatcagcagcgcggcgcagtaggccccggcgccgaagaagatgccctggccgaacgacagcaggccggtgtagcccagcagcaggttacaggccagcgccgcgagggcgaagatcaggatctcggtggccagggtcgccgacggcagcaccagcggcaggccgatcagtaccgcgaccaccagccacggcagggcgcgcgactgggtcttggcgaacggcaggggatttttctcgctcatgttcatgctctcccgaacaggccgtagggacggaccagaatcaccgccgccatggcgccatagatcatcaggctggcgccttgcggccagagggtggtcatcaggctctgcaccacgcccaccagcaggccacccaccagcgcgccgctgaacgaacccatgccgccgatcaccaccaccacgaaggccaccccgaggatttccgggccgacaaagggctgggcgccgcgcaatggggcgaacagcaccccggcgatcccggccagggccacgccgagggcgaaggtcatggagaacaggcgaaagatgttggtgcccagcagcgacacggtctcggtgctttcgctgccggcgcgcaccagggcgccgaagcgcgtgcgctccagcagcagccacagcgccagcccgaccagcgccgagaagacgatgaggaacaggcggtagtaggggtagacgaagtcgccgacgatcagcacgccgcgcagcagttccggcaccgcgacgcttttgccgacggggccccagatcagcacgctggcttcctggatgatcagcgcgatgcccagggtcaccaggatctggaaggtgtggggcaggtggtagatgcgctggatcaataatcgctcgatggcccaggccagggccgcgaccaccagcggcgcgaccagcagcgccagccagaagctgccggtgaggctgacggcggtgtagcagatgtaggccccgagcaggaagaacgcgccgtgggcgaagttgacgaagttcagcaggccgaaaatgatcgtcaggcccaccgcgatcaggaagtagatcatccccaggccgaggccgttgaggatctggaacaggtaaagattgagcatgcgggtaccctcgacagggggccggcgactgtcgtcgggcggcccgctgcctctagccagcgatgaaaaggtcggtcggggtcaggccaggttgcagccggtggcgccgacatccgggaacgagcgcccggagctgagcacttcggccaggtcgtccttgtcgcgcatgctggccgtggccttgccctgcagcaggtagtaatccttgatcacctgatggtcgccggcgcggatgctttcctcgccggttgggccctggtacgtcaggccttgcatggccttggccacggtcgcgccgtcgaagctgccggtggcgactatggtgtcgagcatgattttggtgccgatgtagtcggcggccagcgggtaggtggggttgatgccgtacttggcctgggtcagtttgaccagttcgcggttgagcggggtgtcgacctggtgccagtactgcgcgccgaggtagatgccttcgagcacgtcgctgcccagttcctggaactggtcgagcccggcggaccacaccagcagcactttcatgcgttccttgatgccgaagttgaccgcctggcgcagggcgttggaggactggctgccgaagttgagcagcaccagcacgtcgggctgggcggcgatggcgttggtcaggtagccggagaattcctgctcctgtaacgagtggtagctgttgccgacgtgctcgatgccatgttcggcgcagacctgtctggcgccttccagcagtgcttcgccgaatacgtattgcggggtgatggtgtaccagcgcttggcctcgggcaggcgcttgatcagcggcaccatggtttcgcgaatggcgccgtaggtcggcaccgaccagcgaaaggtcgaggcattgcagtccttgccggtgacttcgtcggcgcccaccggggtcatgaacacgccgttgaccttgcccacttccttggccaccgccagcgccgaagacgacagggtgcagccctggaagaatcgcgcgccgtcctgggcaatcgcctcctgcaccttgcgcaccgccttgccggcgttgccttcggtgtcgatcaccttgtagttcagcgggcggccgagcagggtcgggtactgttccaccgccaggcgcgagcccatgtcggcgaacttgccgtagctggcgaaggctccggacatcgacttgagcccgtagaaggtaaagggttcggcggcaaaggcgttgcgcacccccagcggaaggctgaggcctgcggcaacggtcagactggctttcaacaacgtacgacgctgcatggggtaactccctggtttagttattggcaggagtggcaatggcaaaacggcgcagcagcctgtgttcaggctttgttattggcgaagcggcgtgtggcgggtgcggcggttatcaatggtggtggtcgaactccagcaggaagtgttgggtgacctcgccctcgagggcgctcatatggtgttcggcgtcgcacatgtgttcgtgcatcagttggcgtaccgcggtttcgtcctcggctttgaaggccagcaacaggcgcttgtggtaatcgaggttggcggcgtcgaactgcttgcgcttgggcttgtaggctttcttcagcaccaccaggtcgcgcagcaggtcgttgaggaactgcgccatgaaactcagcagcgggttggggcaggcgcggcccagcaagttgtggaactccagttcggcgatgcgctgttcgcgctggccggcctcgctgtcttccggggcgctgcagaagtcgatattggcctgcagcgccgcaaaatcgtcagcgctcaggcggccgatcaccgacaccgccagctccacctcgatgaccttgcgcagttggtacacctgctcgccgtccatgtgctggaagtgcaggtaattgcgcagggcgcggctcgccggttcggtgccggcctggttcaggtaggcgccgccgctggggccggtgcgggtgttgaccagcccttcgacctccagcgccttgagcgcttcgcgggccgaacccttggaacactggaagctttccatcagttcgcgctcggtcggcaagcgatcgccgggacgcagggcgttgatcacaatggaacgcttgaccgactcgacaatcacgtcggaaagcttctggcgtttgcggcgaacaggtcgtttgagcatgttttcgatttatcgtattaatgcggataaatagtacttaatagggctgggcccgctgcgtcaatcgtcctgggggcgagctgtcgttttcgatgtgggagggtcgtaatcagaaccagggtgagtggcggcgaggcgcttgccgaaggtcctccatcctgtgtccagccactaagctgatggcaggccatgcgctgccatagacgggaggaaatcatgattctgtgcaaacgtgcctacgagccggcgagcgccgacgacggctatcgggtgctggtggaccgcctgtggccgcgcaactgtcgcaaggagcggttgccgctggacgagtggttgaaagacctggcgccgtccagcggattgcgtcgcaccttcaagaccggcgagctggatttcgccaccttccgcagccgttaccgccaggaactggcggcccgccccgagcattggtgggcgttgctggaacgcgcgcaaaagggccgcttgaccctggtgtactcggcccacgatgaagcgcacaacaatgcccgggtgctggccgagtggctggaggacgagctggaccgacagggcgagggcagttcgccggtgtgctatgcgcacctgtcgccacctgaatgacgttgctgggtttcagggagacttcaacatcacataggcctcgccaccacgccggtcgtgcatcagcaggaaggtctggttgtcgagggtgacttttgccggcaggtgctgcgccaccggggtgctggagaactgctcggccagcttgagaaattgcgcggtcagggtcttgtcccgctgcgacggcgtggtcaccgcgcattgcttgcctttctgcacctggaccccaaggctgtggtccggtctgagccccatccgcgcatagccggcatcgtccagcctggcgatgccataggccttggccgcgttgtcggccccggcgaaggagggcgcggatttcaggcagatatcgcgaaaggccagcacgccttcggcgatggccgccgcttccttgtcgatgacttcgggcgggctggcgcagccggccaacagggccaggaccaggctcaaagggctcaggatcgcgcggttcatcggacctcccaggcattcacggggcatgcttatagcctagccaagcttcagcctgcggggggcctgggtgatgggcgcctcgcaccatgaaacatttgtcatgggccgtcggcgtcgccagcccctacactggctttcacctccatggctcacggacaccccatgacggcagcagcggcggcaagcattctcgaaacggtcgaaggccagcgcctcaatggcgaggcctgcgaaccctggcgcgagtgggggccgtacctgagcgagcggcagtggggcacggtgcgcgaggactacagcgccgatggcgatgcctgggcctatttgccccacgaccatgcgcgcagccgtgcctaccgctggggcgaggacgggctggcggggttctccgacaaggcccagcactggtgcctggggctggccctgtggaacgagcgcgacagcattctcaaggagcgcctgttcggcctgaacaacgccgaaggcaatcacggcgaagacgtcaaggagctgtatttctacctcgatggcgtgcccagccatgcctatatgcgcatgctctacaaatacccgcaggcggcctttccctatgaggacctgctgcgggaaaacgcccggcgcggcctggacgataccgagtacgagatcctcgacaccggggtattcgaggacgatcgctacttcgacgtgaccgtggaatacgccaagcatgcggtcgacgacatcttcatgcgggtcacggtgcacaaccgttttcatcagccggcgcgtttgcgggttttgccccaggtgtgggcgcgcaatacctggagctggggcggcgactcgcgcaagccgagcttgcgcctggagggcgagcaattgctggcccggcatccgcggtgctcgccgatgcaggtcagcgcctgggggccggagcgctgcgagtggctgttctgcaacaacgaaaccaacttcccgaagctcgatggcctcgccgcgcccggcccgttcaaggacgggatcaacgactacctgctgggaggcgccggcaccgccattgcccgtgacggcggaacccgcgccgccgcccacttcaccctggaactggccgggctggagagcaaaagcgtatacctgcgttttgctccgactggctcgccacaggtcagcgccaggcgcctgttcgaacaacggcgggccgaggccgacgcgttctacgccgcgctgcaacagggcatcgccgatgccgacgcgcgcaatgtgcagcgccaggccctggccgggctgctgtggtccaagcaactctacgatttcgacgtcaaccgctggctcgatggcgaccccggccagcccgcgccgccggcgccacacgcgcatctgcgcaacagccattggcggcacctggcgaacttcgacatcgtggccatgcccgacacctgggaatacccctggtacgcctcgtgggacctgggtttccaggcggtggtcctggccttgatcgatccgggcttcgccaagcaccagctgttgctgctggtcaaagaccgcttcatgcatcccaacgggcagttgccggcttacgagtggcgcttcgacgacgccaacccgccggtgcatgcctgggccagctggcgggtgtacctgcgggaaaaggccctgaccggccagggcgacatggactttctcgagcggatcttccacaagctgctgctgaacttctcctggtgggtcaaccgcaaggacgccgaagggcgcaacctgttccagggcggtttcctgggcctcgacaatatcggcctgttcgaccgctcggcgcccttgccgccgggctacaccctggaccaggccgacggcaccgcctgggtcgcggcctatgccctggacctgatgcgcattgccctggaactggccaggcgcaacccggtgtacgtggacatcgcggtgaagttcttcgagcacttcctgtacatcgccggggctatcaaccggctggacaacgacgacacaaggctgtgggacgagcaggaccggttcttctacgacgtgctgcatcgccccgacggtggcaacgaaccgctgcgcctgcgctccattgtcggcctgatgccgctgttcgccgtgcaggtgctggaacagcatgaacacgaatgcctgccggggctgcgtgagcgcttgctggagttcatgcaccatcggccggacctggccagcctggtgtcgcgctggaacgaaccggggcagggcaatcgcctgttgctggcgctgttgcgtggcgagcgcaccaaggacctgctcaagcgcatgctcgacgaggcggagtttctttccgatttcggcattcgctcactgtccagaaacttcgccgaacaaccctttgcgctgcaggtcgacggtcaccaactgtgcgcccgttacgcgccggccgattccgactcacggctgtatggtggcaactccaactggcgcgggccgctgtggatgccgatcaactacatgctgatcgaatcgctgcgcgagtttcatcgctactacgccgacaacttctcggtggaataccccagcagttccggctacctggcgtccctggaggaagtcgccgacagcctgagccagcgcctgacccgcctgttcctgcgcgacgaggacgggcggcgcccgtcgatgtgcgcctacgcgcagttgcaggccgatccccgggaccgggatctgctgctgttccatgagtacttccacggcgagaccggccgcggcctgggggcgagccaccagaccggctggactgcgctggtggcgttgttgttgcagcctgtagccgctgccgagcctgcgaggctgcgacaaggcccgcagggccttcagcggtcttgagaacgccgcgcccctacgggtcgatcgcaggctgcgccagcggctacacggagcctgggtctgtagccgctgccgagcttgcgaggctgcgacaaggcccgcagggtcttcagcggtcttgagaacgccgtgcccctgcgggtcgatcgcaggctgcgtcagcggctacacggagcctgggtctgtagccgctgccgagcctgcgaggctgcgacaaggcccgcagggccttcagcggtcttgagaacgccgtgcccctgcgggtcgatcgcaggctgcgccagcggctacagggagcctgggctgtagccgctgccgagcctgcgaggctgcgacaaggcccgcagggccttcagcggtcttgagaacgccgcgcccctgcgggtcgatcgcaggctgcgccagcggctacagggacgggggatcaggcactcaaggtatccggctgcggcaccgcccagtcctcgatcaaccgctgcggcgtgcagcaggtcttgcgcttgtagacgaagctggcgcatttctcggcgaagccgtggcggttctgcaccatgtccaggtgcatctgttccagctcggcgttgcggcagtgctgcatcagttgcgggtcggcgttggccttgcgctcacgcagggcctggtatttcggttcggtcagcacggcgttggcccgttgcagcaaccacaggccgaactcgtcggggcagcgcgggccgatttcctggaccatgcccatctgcagggcctggaaggcgttgatcggcaggcattggtcagtgagtttgtgcgccatgacgtggccgacggcgcggggcaggctgtaggtccagtattccgaaccgtacaggcccatgctcttgtagtgcgggttgtagacggtattggcccgggccagcaccacgtcggccgccagcgccagcatcaggccgccggccccggcattgccggtcagaccgctgaccaccagctggcgggcgctgagcagctccttgcagacgtcgtcgatggcctggatgttgttccaggcttccaggcccggcaccggcgcggcctggatcacgttgaggtgcacgccgttgcagaacgcgccacgcccgcccttgatcagcagcacctgggtgtcccgggccttggcccattgcagcgcgctgaccaggcgctggcagtgttcggtgctcatggcgccgttgtagaactcgaaggtcagctcgccgacgtggcccgactcgcggtagcggatcggctggtaggcctcgtcgctgaacggctcgctggcgaccgaccagtccaggtgaggcacgccgtccagctggccggccagcacatggcgggccggcagcttgaagtgttcggtgcctggccgggccttgcgcttgagggagccgatccacaggctgcggtcgccgcaggccaccagcacggcatcgtcgtgcaccgccagcagttcgccggggatgccgctgcggctatccaggtgcgcgtcatacaggtagtactggccgccggcgaggctggccaggaccccgggctggccatcggcggcgtcgatgcagcgcttgatgaaggcggcgctgtcgtgccagctgaagctgcggtcgtcctgtttcatgttcggttgcaggcggccgcgcacctgcggttggctgtagtccaggggcaccgggacgaagtcgctgccgaatttttccaccacatcgcggatgcagtagatcgccgcgtcggccaccggcccgttgtacagctcggacttgcgcgcctgcgccggcaccttgaactcccaggtggaccagaccggcccggcgtccatctcttccaccgcctgcagggcggtgacgccccagcgctcgaggttgttgctgatggcccagtccagggcgctggcgccgcggtcgccgacgatgcccgggtgaatgatgatcaccggacgggtcgggtggcgccacagctgctcgggcacccggtccttgaggaaggggcagatcaccaggtcggggtcggcctgttcgatctgccggcaaacctcttcttcgctggtgaacagcaccacgctgggacgatggccggactggcgcaggtccagccaggcacgctgggtgagaccgttgaaggcggtggacagcagaatgatcttcagcgattgcatagcgactcttccttgaggatgaagcggggccggccgttccgaaagccgtccctggccgatggaggcgccagagtagtggggctgcgcatgcggtctgctgatcgagatcaatcaagtgtgtggcgtgggtttttgaggcgcgggattgcccggctgaggattcaagattgccgtcgatgggctggaggacgcaggcgtcagaacgacgtcgctgaaacgacgaatcccgccagaaggcgggattcgtgggcaaacaagggcttcgctggggaagcgcttactcaggccgggaacagttcgctcagcttcatcgccagcatcatgtcgccttcggcgcgcagcttgccgcccatgaaggcttgcatgccgtcggtttcgccgctgacgatgccttgcagggtttctccgtccattaccagcgtgacctgggcgtccgggttctcgccttccttgagctcgcaggtgctgtctttgacgatcagcgagaagttcttggtgtcatcgatacggaaaccgaaaaccaggtccaggccggcagcggcagctgggttgaacttggctttcatggcttgtacggcgtcggctacggaggtcatggttcgatccttttatgggttgttacagcaagggtcacagtgatccggactcagcggaaagtgatgagttccggggccttcagcagttgcaggtgggcatggctgttgaaggaagccagggcaacctcgcgaccgcgaaacttcagctggttgagcgaggtattgacgatttgccaattcagttcgaaggcctgggcggcaggcatccgggtaatcaggtggagcagggcggtgatggtgccgccggaggtgaacacggcgattttctgggtgttgtcggcctgttccagaattcgctgcaggccggcctgcacccgttcgacgaaccccagccagctttccaggcccggcggatcgtaggtgccggccagccagcggtcgatgatcagggcgaagatgcgctggaattcggcgcggttctgcgcggcgttgcgcaggatgtccagggcgtcgggctcctcggacaacatggcgggcagcagggcgcggatcaccgcgtcggcatcgaattcgttgaacgccgaatcggtttccaggatcggcgtgggcaggcccgcggcgctgaactgctgcagggcggaattggcggtgtgttgctggcgacgcaggtcgcccgccaggcagcggtcgaagttcacgcccagttcgaccaggtgttgaccgagcacttcggcctggcgaatacccgtggtcgagaggacgtcgtagtcgtccgcaccgaaggaggcctggccatgtcgaatcagatagatgctgcccacgtccgcgtcatcccggtacgttgaaagttttgcgaggttatgaggatgccggtgagctgtcaatgaaaaaacatacgcttgtttgaaatgcccgttagagcacggtaacaggaggtttcgcgactggccgacgcctgtctgcgccggtatgctggagccattccgccacgtgttggcagtgatgcacgtctttaaggagtccctgtggagtttctctccgagtacgccagtttcctggccaaaaccgtcaccctggtcatcgccatcctggtggtgctgatcaccgctgcctcgctgcgcagcaaaggccggcgcaagggcgccgggcagttgcatgtgagcaagctcaacgatttctacaagggcctgcgcgagcgtctggagcagagcctgctcgacaaggaccagctcaaggcactgcgcaagtccgaggccaaggccgagaaaaaacacaagaagcagcacgaggaaaaaccgcgggtgttcgtgctggatttcagcggcgatatcaaggcttcggccaccgaggggctgcgccacgaaatcaccgcgctgctgagcctggccacgcccaaggatgaagtggtgctgcgcctggaaagcgccggcggcatggtgcacagctatgggctggcctcgtcgcagttggcgcggattcgccaggccggcgtgccgttgacggtgtgcatcgacaaggtcgcggccagcggcggctacatgatggcctgcattggcgagaagatcatcagcgcgccgttcgccatcctcggctcgatcggcgtggtggcgcagctgcccaacgtcaaccgcctgctgaaaaaacacgacatcgacttcgaagtgctgactgccggtgagtacaagcgcaccctgaccgtgtttggcgaaaacactgaaaagggccgggagaaattccaggaagacctggatgtcacccatcagttgttcaagaacttcgtctcccgttaccggccgcaactggtcatcgacgaagtggccaccggtgaagtctggctgggtgtcgcggcgcaggagaaaaaactggtcgacgagctgaaaaccagcgacgaatacctggccgagcgcgccaagagcgccgagctgttccacctgcactacgccgagcgcaagagcctgcaggagcgggtagggctggcggccagcaattctgtcgaccgtgtgctgctgacctggtggagccgcctgacccagcagcgtttctggtaagggacaccacgggaacgagtttcttctgtaggcgcgaggcttgcccgcgatcgcgggcgccgcgttaaagatgccgcgtttaaagatgacagacacaaaaaagccctgaaccggtttcccggtccagggctttttgttggcgcgggccttagcggcgacggaacagcggcagcggttcgtcggtggcggcctggtaggtcacggagaagtccttgaggctttccagggcttcgtacgggtccttgtcggcgcgcagggcgtaggcgtcgaacccgcagcggcgcaggtagaacagctggtcgcgcagcacatcgccgatcgcccgcaattcgcccttgaagccgtagcggtcacgcagcaggcgggcgttggagtagttgcggccgtcggtgaaggccgggaagttcagggcgatgacctggaagtgctgcacgtcatcgccgatctcctcggcttcttcatcggcgtccagccacacgcccaggccgccgtcgcgggccttgagggcgtgagcgtgctcgcgccacagggccagcggcacgatcaggtcgtcgcagttggaaatgccgtcgagggtcgcgtccttgggcagcaggtgccaggtttcgtcgatgacctcgttgttcttaatgattcgctgcatagacgcgctccttgaagaggtcgatgccaatacgttggtaggtgtcgatgaagcgctcgtcttcggtacgttgctccacgtacacgtcgatcagcttcgagatcacgtcgggcatgtcgtcctgggcgaaggacgggccgaggatcttgcccaggctggcgtcgcggctggcgctgccaccgagggaaacctgatagaactcttcgcctttcttgtccacgccgaggatgccgatatggcccacgtggtggtggccgcaagcgttcatgcagccggagatgttcaggtccagctcgccgatgtcgaacaggtagtccaggtcgtcgaaacggcgctggatggattcggcgatcgggatcgacttggcgttggccagggagcagaagtcgccgcccgggcagcagatgatgtcggtcagcaggccgatgttcggcgtggcgaaaccttgttcgcgcagctcgccccacagggtaaacagttggctctgctcgacgtcggcgagaatcacgttctgctcgtgggaggtgcgcagctggccgaagctgtagcggtcggccaggtcggcgatgccgtccagctgcttgtcggtgacgtcgcccggggctacgcccgtgggtttcagcgacagggtcacggcgacatagcccggcttcttgtgggccagggtgttgcgcgtgcgccagcgggcgaagcccggatattgtttgtcgagctcggccagctcggcgtcctggttgaccagggccttgtagtccggatcgacgaagtgcttggccacgcgatgcacttcggcttcggtcagggtggtctggccgccgcgcaggtgagccatttccgcttcgaccttctcggcgaacacctctggggtcagggccttgaccaggatcttgatccgcgccttgtacttgttgtcacgccggccgtagcggttgtagacccgcaggatggcgtcgaggtagctcaacaggtcctgccacggcaggaactcattgatgaaggcgccgaccaccggggtccggcccaggccgccgccgaccaggacccggaagcccagctcgccggcggcgttgtgcaccggctccaggccgatgtcgtggacttcgatggccgcgcggtccgaggtcgaaccgttgatggcgatcttgaacttgcgcggcaggtaggcgaattcagggtggaaggtggtccactgacggacgatttcacaccaggggcgcggatcgatcagttcatcggcggcgacgccggcgaactggtcggtggtgacgttgcgcaggcagttgccgctggtctggatggcgtgcatctgcacggtcgccagctcagccaggatgtccgggatgtcttccagcgccggccagttgaactgcacgttctgccgggtactgatgtgggcgtagcccttgtcgtagtcgcgagcgatcctggccatcatccgtgcttggcgcgaagtcagctggccataaggcaccgccacccgcagcatcggggcaaaacgttggatatagaggccattctgcaggcgcagagggcggaattcttcttcgctcagctcgcctgccagatagcgccgggtctgatcacggaactgcttgacgcggtcctcgatgatccgctgatcgtactcgtcgtatacgtacatatagatcctgttctcaggcttatcaggtgacgcagaggcggatgtcacccaagaaattctgcgcgcacggccgcgcactcccaacggagccgggcgaagataccagtttgcagttatgcgcaaaagtgatgtttgagtatatgcaaagaaccaaaacgactaacggtatccgaccggctcaaacccacatttgtggtgagggcaatcctcgacttaactgtgctcgagtctttgtgcaatcaccgataaaaccgacaagaggcgatgctatgagcaatccaaccaaagcaaggaaaagcgacagcgctgtcgatgcttgggccattctctttctgatcattctggtcgtgggaacggcggtgttctgggtcagtcatcaatagttgcggtcaagcgatgggcagagtccgaattgtctgtgggaaatgacgatttgccgacattggccagtattttgccagttatactgcggggcaatattccgggactctggtcgcaatgttcaaggcgtttggtaagtgtctgctgctggtgctgcttgtactgagtccagcgttctgggccatggcccatgccacctcggtggtgtttttgaacccgggccactccactgaaaccttctgggtcggttattcacagttcatgcaggccgcggccaacgacctcggcctggatctgcgcgtgcgttattcgcagcgcgattcgcaaaccaccatccgccaggcccgggaagccctgcagggcctggaccgaccggattacctggtggtggtcaacgagcaatatgttgcgccggagatcctgcgcctgtcccagggcagcggggtgaagctgttcgtcgtcaacaacgcgctgaccgccaatcagcaacgcttgctggacgagcgccagagccgttatcccgactggatcggcagcatgatcggcaacgacgaagaagccggctacctgatgctcaaggagctgattcgccgtcatggcccgctcgctcccgggcagtacatcgacctgctggcgttctcgggcgtgaagaacaccccggtggcgcaatcccgcgaacaaggcttgcagcgggcattggcggagcaccccgaggtgcgcttgcggcagatggtgtatggcgagtggaatcgccagcgcgcctttgagcaggcccagcagttgctcaagcgctatccgcagacgcagttgatctggtcggccaacgacgagatggccctgggggcgatggaggcgctggaacagcaagggcggcgaccgggcaaggatgtgctgttcagcgccctgaacagctcgccgcaggccttgcaggcattgatcgacggacgcctgacggcgctgatcgccgggcacttcaccctggggggctgggcgatggtggtgctcaacgatgatgcccgggggctgaaccctgcggcccatggtggcccgagctggcaactgggcgtgttccagctcctggacaaggtccaggcgcagcgtctgctggagttgcaggggacacagcaatacggcgtggactttcgcgggttgtcggccgagggcaagccggccggctacccttatcccttctcgctgaatctattactgcactgacaggcgttcaaagccccgccaggtgcacgaccagcttgacgataccgaacagggtcaaggcgaacaccgccgtgaacagaatgcccaggatcatgaaatggctgggcttgccgtgggtgaagtcgcgcttgcggttcttgccgctctgcacgccaaaggccgcagcggcgacgctttgcagcatctgccaaagggtcggcggcttgtcgttggtggggtcgtccataaatccctcgacacaaatgggtgtggggaaagcatagacaatattcgcgtagctcccgcccacactctgtaggagcgagcttgctcgcgatcaaaacgtcaagacagcgcgattcttcagattcaccgcgtcatcgttgacgtctatcgcgagcaagctcgctcctacaatttagttgtcgtagcccaggttcggcgccagccagcgctcggtcacggccaggtcctggcctttgcgcgcgctgtagctgctgacctggtccttgtcgatcttgcccacggcgaagtactgcgcctgcggatgggcgaagtaccagccgctgaccgccgccgcggggaacatggcgaagtgttcggtgaggaacacgccgctgcgcccggccttgccttcggatgcctcgggatcgagcagggtgaacagggtgctcttctcggtgtggtccgggcaggccggataacccggggcggggcggatgccgctgtactgctccttgatcagcgcttcgttgtccagctcttcgtccttggcatagccccagtagtttttacgcacttgctggtgcagccactcggcgcaagcctcggccaggcggtcggccagggccttgaccatgatcgagttgtagtcgtcgcctttgtcctgataggccttggccacttcttcggcgccgatgccggcggtggtgatgaaaccaccgacatagtcggtcacgccgctgtccttgggcgcgacgaaatcggccagggagaagttcggcttgccgtcggtcttgatggtctgctggcgcaggtggtgcagcctggccaagggctggccgtcggcgccatagacttccaggtcgtcgtcctgcacctggttggccggccagaagccgaacaccgcgcgggcgctgatcagtttctcgtcgatcagcttgtcgagcatttcccgggcgtcctggtacaacgcggtggcggcttcacccaccacttcgtcctcgaggatgcgcgggaacttgccggccaggtcccaggagatgaagaacggcgtccagtcgatgtattcggccaggacccgcaggtcgatattgtccagcaccttggcgccggtgaaggtcggcacggtcggctggtagctgctccagtcgaactgcggcttcttggccacggccgccgggtagctcaggcgctcggtgcgggcgctgcggttggcggtgcgctcgcggacttccacgtactcttcgcgggtgcgctggacgaaaccggccttgagctccttggacagcagctgggtggccacgcccacggcgcgcgaggcgtcggtgacgtagaccaccgcgtcattgctgtacttgggctcgatcttcaccgccgtgtgcgccttggaagtggtggcgccaccgatcatcagcggcaggtggaagtcctggcgctgcatttcccgggcgacatggaccatctcgtccagcgacggggtgatcaggccggacaggccgatgatgtcgcacttctgttccttggccacctgcaggatcttctccgccggcaccatcacgccgaggtcgacgatgtcgtagccgttacagcccaggaccacgccgacgatgttcttgccgatgtcgtgcacgtcgcccttgaccgtggccatgaggatcttgcccttggcttccggcttgtcgcctttttccagctcgataaagggaatcaggtgcgccacggcctgcttcatcacccgggcggacttgaccacctggggcaggaacattttgccggcgccgaacaggtcgccgacgatgttcatgccagccatcagcgggccttcgatcacttcgatcgggcgggcgaaggacagccgcgactcttcggtgtcttcgacaatatgggtggtgatgcccttgaccagggcgtgctccaggcgcttgttgacgtcccagttgcgccactcttcggtctcggcttccttgacgctgccgtcgcccttgtacttgtcggcgatggcgaggagggcgtcggtgccttccggtgtgcggttgaggatcacgtcctccacggcgtcgcgcagctcctgtgggatctggtcgtagatctccaactggccggcgttgacgatacccatggtcaggccgttgcggatcgcatacagcaggaacaccgagtggatcgcctcgcgcaccgggttgttgccgcggaaggagaacgacacgttggacacgccgccggaactcagcgcatagggcagctcgtcgcggatgtaggcacaggcgttgatgaagtccaccgcgtagttgttgtgttcctcgataccggtggccacggcgaagatgttcgggtcgaagatgatgtcttccggcgggaagccgacatcgttgaccaggatgtcgtaggaacgcttgcagatttccttcttgcgcgcctcggtgtcggcctggccggcttcgtcgaaggccatcaccaccacggcggcgccgtagcgcttgcacagcttggcgtgatgaatgaactgctcgacgccttccttcatgctgatggagttgacgatgcccttgccctggatgcacttgaggccggcttcgatcacttcccacttggaggagtcgatcatgatcggcacgcgcgagatgtccggctcgccggcgatcaggttgaggaaggtcaccatggccttcttcgagtccagcatgccttcgtccatgttgatgtcgatcacctgggcgccggcttcgacctgctgcagggcgacttccagggcttcggtgtagttctcttcacggatcaggcgggcgaatttggcggaaccagtgatgttggtgcgttcgccgacgttgacgaacaacgactggcgatcgatggtgaacggctccaggcccgacaggcggcaggccttgggaatatccgggatctgccgcggggcatagccggcgacggccttggcgatggcctcgatgtgccccggggtggtgccgcagcagccgccgacgatgttcaggaaaccgctctgggcgaactcttcgatgaccttggcggtttgcgccggcagttcgtcgtactcgccaaattcgttgggcaggccggcgttggggtgcgcggagacgtgggtgctggccttgttcgacagctcttccaggtaggggcgcagttcactggcgccaagggcgcagttgaggccgacggagatcggcctggcgtgggccaccgagttccagaaggcttcggtggtctgcccggacagggtgcggcccgaggcgtcggtgatggtgccggagatcatgatcggcagttcgaggcccagctcttcgaacacgccctgcacggcgaagatcgccgccttggcgttgagggtgtcgaagatggtctcgatcaggatcaggtcggcgccgccctcgatcaggcccttggtggcctcggtgtagttctccaccagttcgtcgaaggtgacgttgcgatagccggggttgttgacgtccggcgacagcgagcaggtgcggctggtcgggcccaggacgccggcgacgaagcgtggcttgtccggggtctccagggtcttggcgtcggccacctggcgggccaggcgcgcgccttcgacgttgagttcgtagaccagcgcttccatgccgtagtcggccatggaaatctgcgtggcgttgaaggtgttggtctcgaggatgtcggcgccggcatccaggtaggctttctcgatgccgccgatcacgtccggacgggtcagcaccagcaggtcgttgttgcccttgacgtcgctcggccaatcggcgaagcgtttgccacggtagtcctgctcctcgagcttgtagctctggatcatggtgcccatgccgccgtcgagaatcaggatgcgctctttgagggcttgctgaagggcttggaggcgcgtgctgcgatcggacatgaaagactacctggaagggccattacgaagggcgaggatcatagcaaacctgtgcgcttttagagcatgcggcgcttttgcatgaatatcgctcatgttggtggccgtgctggcccggtagaatcgccggattttcttatggattggaccagggatatgtcttaccgcgttgtcatcggcagtgtgttgctgcttttaagttcgctcgccagtgccgagggtcccgcgccagcgatctcctacacccgcgatatccagccgatcttcaccgagaagtgcgtggcctgccactcctgctacgactcggcctgccagctcaacctcggcagcggcgagggcgcggcccgcggcgcctcgaagatcccggtgtacgacggcgaacgcagcaaggcgcagacaccgacccgcttgttctacgatgcttccggcaagcacgcctggcagggcatgggcttctactcggtgctcgacgcccagggcagccaggcggcgctgatggcgcgcatgctggaactgggccacaagacgccgttgcaacccaacgccaagctgccggacaacatcgtcctgggcctgaaccgcgagaacatgtgtgcgcaaccggccgaattcgacggttatgccaaggcccatccgcgcgaaggcatgccgctggcggtgaccggcctgaccgatcagcaataccagaccctgcaacgctggctggcctccggtgcgccgatcgacgagcagggcctggcgccgagcgccagggaagcgatgcaggtgctgcagtgggaaaacctgctcaatgccccgggcgcccgggaaagcctggtggcccgctggctgttcgagcactggttcctcgcccatatctacttcgagggcggcgagccggggcatttcttccagtgggtgcgttcgcgcacgccgagcggccagccgatcgacctgatcaacacccgtcggcccaacgacgacccgggcacccaggtgtattaccgcctgtggccggtgcagggggtgatcgtgcacaagacccacatcacctacccgctgagcgcggcgaagatggcgcgggtcaagaccctgttctacagcggcgattaccaggtcaccgcgctgccgggttatggcccgggccgacgcgccaacccgttcgagaccttcgaggcgattccggccaaggcccgctaccagttcatgctggataacgccgagtacttcgtgcgcacctttatccgcggcccggtgtgtcgcgggcagattgccaccgacgtgatccgcgacaatttctgggcgctgttccaggccccggaacacgacctctatatcaccgacccggcctaccgcggccaggccacgccgctgctggccatgcccgggcagaacgacgacgttggcagcgtgctgagcctgtggctggcctaccgcgacaagcgcaacgaatacgagatcctgcgtcgcgattcctacgccgatgcgccgccacccagctggtcgaccctgtgggcgggcaacgacaacgcgttgctgagcatcttccgtcacttcgacagcgcctcggtgaccaagggcctgatcggcgaggtgccgcagacgatgtggctgttcgactacccgctgctggagcgcacctattaccagttggcggtcaacttcgatgtgttcggcaacgtctcgcatcaggcgcagacccgcctgtacttcgacctgatccgcaacggcgccgagcagaacttcctgcgcctgatgcccgccggcacccgcgaggacttcctcgacgattggtaccagaacagcggcaagttcaagatgtggctggactacgagtccatcgacgacgacaaggccagcgccctggtgctggacgaaaaggatccgaaacgcgacttcgccaaccagttgctgaaccgttacggcgacctcaatgcgcggcccgatccgatcaaccgctgtgacggcgcctactgctcgcggccgaatatcgacccggcgctgcagaacgccgaacaggccctcagcggcctggtttcgcggccagcggccggcatgcgggtcatcgacctgttgccggaagccaccatgctgcgtatccaggcgccgagcggcaagcgggtgttctacagcatgctgcgcaaccgcgcccacagtaacgtggcgttcctgctgggcgagtcgctgcgctaccagcccggcctggacaccctgaccatctatccgggcgtgctcagcagctacccgaacttcatattcaacattcccgccgggcaggtgccggagttcgtggccgagatggaaaacgccaaggacgcccaccgtttcgagaaaatcgtcgagcgctgggggatccgtcgcagccatccgcagttctggcagtacttccatgaccagacccagtacatcctcgagaccgatccgaaagaggcgggcgtactggacatgaaccgctacgagaacctctgaaggcgccaagcccttgaaatcccgggtcgcagccctcaggttgcggcccggcccattccggaaaagccttgtaaaaaatcccaggcgttgcgtcgaccacgcagcgcgggcctatcgaccaaggtctatcccgacaaaaatactaggactttgtccggcacgccgattggcgtaaactgcgcccacgcctgcgaggaatttccatgaccgctattaccattaccgacgccgcccacgattatctggctgatctgctctccaagcagaacaccccgggcattggcatccgcatctttatcacccagccagggactcagtacgccgagacctgcattgcctattgcaagccgggtgaagagaaacccgaagacaaagccctggggctgaagagcttcaccgcctacatcgacgccttcagcgaagggttccttgatgacgcggtggtcgactacgccaccgaccgcatgggcggccagctgaccatcaaggcacccaacgccaaggtgccgatggtcaacgccgacagcccggtcaacgagcgcatcaactactacctgcaaaccgagatcaacccggggctggccagccatggcggccaggtcagcctgatcgatgtggtcgaggacggcatcgccgtgctgcagttcggtggtggttgccaaggctgcggccaggccgacgtgaccttgaaggaaggcatcgagcgcaccctgctcgagcgcattcccgagctcaagggtgtacgtgacgtcaccgaccacacgcagaaagaaaacgcctactactaagtaaggcgttcgctgcgaacatgaaaaacggcgccccgtgagcgccgtttttttatgcccattattccaggtgtcttgcggcgcctggatcgcgagcaagctcgctcccacagggggacactatcaactgtaggagcgagcttgctcgcgatacaccctcaaggccgatacaggtgcgcatgccccgcgcgatacaacgacgactcactgaaactgtccgtggccagcacccggcccaccaggatcagcgccgtgcgccgaaaacccttggcctggaccttttcggcaatgtccgccagggtgcccagcacccagtcctggtccggccaggtcgcccggtgcaccacggcaatcgggcaatcggcgccgtaatggggcagcagctcggcgacaatcttttccagatggttgacccccaggtgaatcgccatggtggtgccgtgggcagccaggctggcgaatgcctcgccggcgggcatcgaggtcttgtcggcataacgggtcaggatcacgctctgggcgacatccggcagggtcagttcggcgcccagcacggccgcgcaggccgcggtggccgtcacgccggggacgatctcgaagggaatgcccagctcgcgcaggcagcgaatctgctcgccgatggcgccgtacaggctcgggtcgccggaatgtacccgggccacgtcctggcctttgccatgggcgtccttgatcagctcgatgatctgttccaggtgcagctcggcgctgttgaccagctgttcggcgcgatggccctggagcacggcttcgggcaccagggaaccggcatagatgatgaccgggcagctgtggatcagccgctggcccttgacggtgatcagttccgggtcgccgggacctgcgccgataaaaaagacggtcatggcgttctcctgtgaaaaaaggggcgaggcaacctcacagatgaagattgctcatgatcagcggcggggattatcgaagatttacccggagcaggccaaggcgagggttgcctgggcgtatttctgccgagggaccagcagctttgccgggcttcgggccagctgttcggccagggccagggcggcactttcggcgaccccgtagcagccggtgtgctcgtaggcgatctgcgaacgatggctgagctgcggcgcataaggcgtcagctggctactgctgaaacaggtcaggggcaggtccagttgcgcggccagggccagcagcccgggttcctcgcgtttcaggtcgatgctggccagggccttgatctgcccgaggtcgatgcgattggcactcagggtctggtcgagcagggcgcgcaaggtctccaccgggcagccccgctggcagcccaggccgaccaccagggtcggcgctgtgctggcctgtgtcatgccgagtactgatcgtcgctcttgcggcggaacagccaggcgctgatcaggcccagggccagccagaacgcggcgttggtcagctgcgaagcgatcttgaactgcgcctccagctcctccggggcgagcatcgaatgcacttgcggctgtggcgcgccgatgagatgcggcacggcgaggatagccacgcccagcactttcagcagccagttccgggcgaagacgatcagggcaatgccgaccgcggtggaagcggcggtgccgacccaccagatctgccgttgcgccaggtccgcggcggcggtgccgggcagttcgggcggcaagccgagggtcggcgccaggcagaaggtcgcataaccggccaggccccagagcaggccctgggacgtacggttcggcgcgcgcagggtgtagagaccggcgagaatcagggcgaaacccacggcgaccaccaggttgccgccggtggtggacagcacgcgctgccagccgtcttccggctcccaggcttcggcgtcatgactatgggcggcgctgccggcggcatgctcatgcactgcttcatgctgggtggccggggccttctcataggtttccgcctccaggatcagcggcgcgacccagaagctttgcagcagggtcagcaacagggccgccagcaacccggtgaaacctgcggtttgcgcgatacgcttgatcatctcggcaggtctcagtggcaagggaaggcggcgctgtgacgggtatcgtgggcggcgttgtgcaccgcttcgatatgggagaaaccggcgaaatacacaaggcacgcaccgaggatcgaggcgccgatggcggcgaccaggcgttggctcagggtggcggtactgctgctggaatggctggtgctgctgatgatcgacatggcgcttccctctggtgtgtcagcgggtgaatcgagcgcagcaaaaccccgcgagacgggcccgcggggaattaacagcgcccgcccaccgcgggtttgttatgactgtgtagcgggccggtctccgggctcgcgaggggcggggcttgcgccacgcctgcaagaatcgccttcccatgccggactgctggcacagtggatctgattcttcgctcgcttaccgttgcgggggcagcaccggactgatcaaggctttttggcctgtgacgcaccggtttcccgtttcaccctgtgaagggcacccgtaacaaggtgtgtaggagagcatgggcgagggaggggcgtcaattggcaagggttctcgttttcgatcgcaattggcctgtcctcgcgctgcatgaacattgaccgccccccaagctctgcgtagccttgcgctttcgaggttcttcggcgtctgtcgaagctaagaagggaacgcggtccaagccgcggctgcccccgcaactgtaaacggtgatgaacgatgcaaggccactgccaggcggcgggaaggcgcatcgttggccagtcgaacgaccggcacaccgtcagccaggagacctgcctcggacctgattctcactacaaccgggcggggtgatccggtggcgaactcctccatgcagctacctgcgcggttctcgtcccgtatgcccgccaccttgccaaagggcatccgatgaaaacactggccaaacttcccgtcaccatcgttaccggcttcctcggctcgggcaaaaccaccttgctgcggcacatgctggacaacgcccagggccgacgcatcgcggtgatcgtcaacgaattcggcgagctgggcatcgacggcgagatcctcaagcagtgttccatcggttgcaccgaggaagaagccagcggtcgcgtctacgagctggccaacggctgcctgtgctgcaccgtgcaggaagagtttttcccggtgatgcgcgagctggtggcccgtcgcggcgacctcgaccatatcctgatcgaaacctccggcctggccctgccaaaacctttggtccaggctttccagtggccggaaatccgcagcgcctgcactgtcgacgcggtgatcaccgtggtcgacagcccggccgtggccgccggcaccttcgccgccttcccggaccaggtcgacgcccaacgcaagctcgacccgaacctggaccacgagtcgccgctgcatgagctgttcgccgaccagttgtccagcgccgacctggtgatcctcaacaaggccgacctgatcagcccggcagacctggccaaggtgcgcctggaagtggccgaggagctgccgccggcggtgaaagtcatcgaagccagcagcggtcgtctgccgctggacgtgctgctgggcctgggcaacggttcggaagaacacatcgacggccgccatagccatcacgaccatcaccacgatggcgacgatcatgatgatcacgatcacgacgccttcgattccatctccatcgagctgccccaggccgacgaaagcctgctgctggacgccctgacccaactggtggtgcagcacggcatcctgcgggtcaagggtttcgcggcgatccccaacaagccgatgcgcctgttgatccagggcgtgggcacgcgtttcgacaagcacttcgaccgccagtggggcgccgacgaagcccgtaccacgcgcctggtgctgatcggccaggaattggacgctgtgctgctcgaagcgcaattgcgcgccgccctcagcgtgtaagccatgcacctgctcaggacccagcccggcggtttcgtgtcggatgacaacattgccgacctgggacagacccccgccgagctggtgatcctgtgcagcggcgactccagcctggcgctgctggccgaagcggcgcagcagttgcctgaggattacccgagctttcgcctggccaacccgatgcaggtgcagaaccatgcctcggtcgacctgtatgtcgaccaggtgctgcgccacgccaaggtgatcctgctttccctgcatggtggcatcgcctattggcgttatggcattgagcaactggtgcagctggcgcaacgtggcgtgcagctgatcctggtgccgggcgacgatcgtccggacccggaactgagcgacctgagcacggtgcccgccggcgaccgcgagcgcctctggcacttcctgcgccagggcggcatgggcaatgcgctgaacctgtaccgctgcctggccagtggctggctggggcgcgattaccactggtccgagccgcagatcctgccgcgcacggcgatctaccacccgcacaaaagcagcgccgccctcagcgactggcaagccgactggcgggccggccagccggtggcggcgctgctgttctaccgctcgcatttgcaggcggccaacactgcctttatcgatgagttctgccggcgattgcaggcggccggcctgaacccgctgccgattgccctggccagcctgaaagagcccggttgcttggcggtggtcgaggacctgctggacgaggtgcaggcaggggtaatcctcaacaccaccggctttgcccagtccagcccggaggcgccgcacctgcgaccgttccgccgcgatatcccggtgatccaggccatctgcgcccaggacaacgaacccggctggcgcgccagcgagcagggtctggggccgcgggacctggcgatgcatattgccttgccggaactggacgggcgcatcatcagccggcccatcagcttcaaggacctggcctggcgcagcgagcgcagccagtcggacgtggtctgctaccgcccggcccccgagcgcatggattttgtcgccgaactggcgcggcgctgggtcgatctggcccggctgccgaatgctgaaaaacgtatcgccctgatccttgccaactacccgacccgcgacggccgcatcggtaatggcgtgggcctggatacgccggcggcggcgctgaacatcctgcgcgccctgcaagccgagggttacccgttgccggccgagttgcccgacagcggtacggcgctgatccagcaactgctcggcggcgtcagcaacgacctggacagcctcgacctgcgcccgtgccagcaaagcctggcgctggagaagtaccaggccatgttcgacgcgctgcccgaagccaatcgcctggcggtgctcgagcgttggggcgggccgcaaaacgacccgatgttccgcggcgggcggctgatgatcgccggcctgcgttttggcctgacctttgtcggcattcagccggcacgcggttatcaggtcgatccgagcgcggtctatcacgacccggacctggtgccgccccacgggtacctggcgttctacttctggctgcgccagacctacggcgcccatgggctgattcacgtcggcaagcacggcaacctggagtggctgccgggcaagggcgtcggcctgtccgaaagctgctggccggacgtgctgttggggccgctgccgaatatctatccattcatcgtcaacgacccgggcgagggcgcccaggccaagcgccggacccaggcggtgatcatcgaccacctgatgccgccgctgacccgcgccgaaacctacggcccgctgcgcgacctggaactgctggccgacgagtactacgaagcccagttgctcgatccgcgccgcgcccgcgagttgcagaaagacattctcaagctggtgcgggtgacccggatcgaccgcgaactgcaactggacgggcagctcgacggcgaggccgacgcggcgctgtggctgccgcgcctggatacctacctgtgcgacctgaaggagtcgcagatccgcgatggcctgcatgtgttcggcgaatcgcctgttggccgcctgcgtatcgacaccttgctggccttgctgcgcattccccgtggcgatggccggggcgcgcagtcgagcctgttgcgggccctggccaaggctttcgagctgggtttcgatccgctggattgcgccctggccgagccctggagcgggcgccggccacaggccttgcaggatctcagtgagcaactgtggcgtaccgccggcgatgcccgcgaacgcctggagctgtttgccgggcgcttgatagaagcggccttggccggtgaggtcgagcaactgaacgagtccggctggagcgaggtcaaggcgatcatcgacagcctgcgcgaagtagtggcgccgcgcctggatgcctgcggccctgcggagatgggcggcttgctggctgccctgggcgggcgtttcgtgccggccgggcccagcggcgcaccgagtcgcgggcgcctggatgtgctgcccaccgggcgcaatttctactcggtggacgtgcgcaacttgccgaccaccaccgcctggcgcatcggtttccagtcggccaacctgatcctcgaacggcacctgcaggaccatggcgaccacctgcgtcagctcggcctgtcggtgtggggcaccgcgaccatgcgcactggcggcgacgatatcgcccaggccatggcgctgatgggcgtgcgcccggtgtgggccaccggcagccagcgggtcgacgacttcgagatcctgccgctgagcctgctggaccgcccacgagtggacgtgaccctgcgggtgtccgggttcttccgcgatgccttcgccaacctgatccgcctgttcgacgccgcggtgcaggcggtggccgcgctggacgagccggacgacctcaacccgctggcggccaaggtccgcgccgagcgtgaagcgctgctgcagtccggtctcgatgccgaggccgcgcagcgccaggccggctggcggatcttcggcgccaagcccggggcctatggcgcgggcgtgcagggcgctatcgacgctcgcctgtggcagagccgcgaggacctggccgaggtctacctgaactggggcggctacgcctatggcggcgccgacgaaggcaccgcggcccgtggccagttcgcccagcgcctgagccaggtgcaggcggtgttgcagaaccaggacaaccgcgagcacgacctgctggattccaacgactactaccagttccagggcggcatgctcgcggcggtggaaagcctcagcggcgaaaaggccgccagctaccacggcgaccacagccagccggacctgccgaagatccgcagcctcaaggaagagctgaaccgggtgatccgctcccgcgcggccaacccgaagtggatcgcaggggtgaaacgccacggctacaagggcgcctttgaaatggccgccaccgtggataatctgttcgccttcgacgccaccaccgaactgatcgacgatcaccagtacgccttgctggccgacgcctatctgctggacccggcgacccgcgaattcatccggcagcacaacccccatgcgttgcgcgacatgaccgagcgcctgctcgaagcccagcagcgcgggatgtggcaggcgcccggcgagtaccgcgaggccctggaaaacctgctgctggatattgaagaagatggctgatgctcctgtagccgctgccgcaggctgcgatcgggcccgcaggggccgttgggacaggcgacgcggcctgtcagataccaatgcgtcgtctgttttatgccgactgcgtcgtcaatcgcagcctgcggcagcggctacaccgattgatgttcgtgcatccctttatcgagaaccgacatgagcgataccccacatttccccctgtccgccgtggtcggcgccgatgacctgaaactggcgctgtgcctgacggccatcgacccgaaaatcggcggggtgttgatcgaaggcccgcggggcatggccaagtccacactggcccgcggcctggcggacctgctggcgagcgggcagttcgtcaccttgcccctgggcgcgaccgaagaacgcctggtcggcaccctggatctggacgcggcgctgggcgaaggccgggcgcagttttccccgggggtgttggccaaggccgatggcggggtgctctacgtcgacgaggtgaacctgctgccggaccatctggtggacctgctgctggacgtggccgccagcggcaccaacctgatcgagcgcgacggtatttcccaccggcactcggccaggttcgtgctgatcggcaccatgaacccggaggagggcgagctgcgcccgcaactgctggaccgctttggcctcaacgtctccctgagcgggcagacgccgcccactgagcgggggcagatcattcgtcggcggctggatttcgacagcgatccccagggtttctgccagcagtgggccgccgagcaggcggcgctgcgccagcgctgccagcaggcgcgtctgttgctggcggagatcgccctggacgatcgagcgctggagcggatcaccgaacgctgtttcgccgccggcgtcgatggcctgcgcgcggacctggtctggctgcgtgccgcccgcgctcatgcggcctggcgtggtgcccgggctatcgaggagcaggacatagacgcggtggccgaattcgccctgcgccatcgccgtcgcgaccacccgccgagcgcggcgcatcagccgcagccgtcttccgcgccatccccggcccaatccagccccgccgaaggccagggccaatggggtgaattgccggcccaggcgctggccaccggcgcccggcgtgaagtgccgagctggccaaaaaagccctaggcattcgcccccggtccgacgcgggggcgaatgccaagtcccgcgccgggcggttggacaagggcaggcaaggccgcgcgcgcgcggccgtccatggctcgatcaactggccgggcaccttgctcaacggtcgaccccgtcagtgtgacgatctgctgtggcacctgcgcagccgttcgccccatgagctgtggctggtgatcgtcgatgcctcggcctcgacccgccgccatcaggcactgagcgatgccaagggcctgctggcccagctgttcgacgatgcctaccggcagcgcgcgcgcctggccctgctgaccgccagcggccgcgcgccgaactggcaggtgcagggcctgaaggcctcgaaggatttgcgcgactggctcgacgggctgggcgcgggcggcggcacgccgttgctggcggccttggccgaggcagggcggtggctggtctcgcggcagaagcgttacccggccgagcagcagcgggtactgctgctcaccgatggccggctcaagaccttgccgcccttggcgcgcctgggttgcccgaccctgttgatcgatatcgaacgtgggccgatccgcctcggccgcgctcgcgagctggcgcagcaactcaacgcgcagtaccagcatatcgacgacccttcgcagctccagcttctgtaggcgcgaggcttgcgcgcgatagcgctgcacctgacccagcgcagcgcttgcatcgcgcgcaagctgcgctcctacaggtttggcgggtatctattcggccagcgcccggcggtactggcgctgttcaattggtcgagcagcagcgccagccacgggcgtacttgaggtttgggcgcgcgcccgcgactcaggcgatgcatctgcaggcggacgatggccatggtcgccagggaggccaggggcttgcgtttccagcgtagcggcggcagttgcggatggctttgctggccgctgcggcagagccggggcagggccgcctcgagggcctgcgcggtggcgatgccggccgtcgcgatacctctgtccagcacttgctgcaccaccggcaggcggcatggatctgcaccccggaaaaaccggcctgttcggccagccaggcactgttggcgaagcgctggatgatctcggcgatgtcctcttcgctcatgggcctgggttcggcgaacattttcgagaactgccccatgtccagggccaccgccgatggcgccagggcctgctgccccaggtccagcgccaggccaacggctatcaccgttacccaccgcagatcctgcagaccctgaagatcgtccagagcgcccagcaggccgggttcagcctggacgaactcaagcagctgctgtcgggctgcgagtcgagtgaccttgaccatcaggccctgctgcaaagcttcgagcgcaaggtcgggcagatcgaggacatgcagcggcacctggcccagagcaaggtgaaactgctggagatcatcgacaacatccgcgaccgcccggaaagcatgggttgttccgagaacgccgagcgggtcatggtatcgatcaagggtggggtgttctgagccacctgtgtttcgggacgcttgaaacaatttgggcgaccatcgcggtcgcccaaaaggtgtttcaggtttggcggatcgaaccgcttactgtggcgtatcgttgcctttgccccgaatgttgccggactggtccagcaatactggggtggcgagcaaggcatcgtggtgggatgcacggtacgagtggacgaagtgacgaatcagggcgatggccacaccgagcatcaggcccagtaccagcgacaggatgatgaccagggcgggcttcggcttgagcgggctcaccggttgcaaggccttgcgatcgatggtgaccagtttcagccggtccatatcgatgttcaggttgcgcaggcgagccacttcagccctgagcggaaaaacgtccttcaggaaaatgtcctcgttggagcgcttgttcagttcctgcacctggcggttgacctgcagcatctgcagttccttgccgatttcggcgatacgcttctcggtgaaatcgtcagaggtgcgtttttgcagggctgcgcgctcggcctcgagggtttcatagcccatgaaatacaacgggatgctctgagtgttgacctcggtgcgcatcacttgggtcgagccggcgtgggaggcgtcggacatcgaggacggcgtggttggcgtgcggatgcccatcgacttggcaatggtgatcgcttcggccagttcggccagacgatccttgcgctgttctttcaactgcccgcgcaaggccttgagttcgtcctcgagctgcgcgcggcgaatattatcgctttcgagcaaggccgcgattttcgattccttgtcggtttcatagttggagcgcgccgcggtaatcttgcctttgagttcattgagccggttgttgacgatgaccttgaggtcggcgccaatgcgttcccgttcagcatcgatggcgtattcgacgaaaccgttgaggatctgtaccccgttgacatccttgggatattgcatttccagcttgatgtagctgctcagggcgttgtcttttttcggatctggctgaaccagctttatcgagtcgcggttgaagtcctcgaagctttgttcgagtgtttgtcctgggcgtttgaaggcctggaacagatcctgatgagaacggaagaactccagtcgtgtttcataggactcaagtgctgcgccgaccttggacaaggcatctgcgggcggcagtttgtagacttccgagcgattgagggcgtcgagttcattcagggcggctgggcgtaatacgctgctcacctcatatacacggggagccaatagcgcataagccatacccaccagtgtcacggcaacggtacaaccgattaccagcttcttttgctgccagacggattggaacaatgcaaacagatcaatttcatccgcgtcagcattcatctgaggccggggaacaatattcaaaatcagcacacctctaattcatgtgaatcctaaccctgtcatgccgtaccccagacggagcatgcatgcagggctgcccccgtgatgaggctccttgccgatgggcgccactcgttgccagaaaaaaacccatgagatggggctgttttcttgcgagagatagttggcaggccgctttccgagctaggtcccggaaatggctgtttcgataccgagcgcctttaacgtaactcttgaatcctgaaggcactttgccattggcgttggtgaagacgttaagtgggcgaatattacaggaatgctcgggaggataaatatatgaatttaaccgtaccttcataattcgccttatctattgctgtttggatagcaaagcggcctgtttcccatatggaagtttatcggtgccccataagagggcgggtaggcttacaagttgtgagtatttctaatagcctggcagttggcctcaaaagaatgggcgatagaacaccctgaggttttattggtgctgggcagatcatgactggcctgatacagagttgtcgcaccttgagcgcgagagggggcgagccccatgagtgttcactccacgctcagcgtcaaaggctgcggctgcgggatgggattgcgcatcagcgtgcccaccgtcactgccgccagcagcgccagcaggccggccactccgagcaccatgccgaaaccgtcgacaaaggcctggcgggccagcggttcgaccagttctttcgcggagtcgggcagcaatgccagggctgcgggcatgtcgccggccaccacccgggaggcgatggcctgggcctggtcgagccattgcgtggcgctttcacctaggctggcgtgcaggcgttgttgggtatggctgccgagcagggcgccaaacacgccgatggccagcatgatggcgctgaagcgcatagtggtgctcaggcccgaggccatgccggcgcggtcgcggggcacgcaggtcatgatgtttttctgcgtgtcgccgttgagcaggccggcgccagcacccgtcaccgcgatggccagggcaaagctcaggtagccgccagcctgcacggcccaggcggcgagcaggttgccgcaaccgaccagggtcaggccggcggccatcagggtcgccggggtataacgcgtcgccaggcgcacgccgatgcgcgggcagatcagcatggtcagggcaaatggcagcatgcccagccccgaggcgatcgccgagaagcccaggccgttctgcaggtagaagggcagcagggtcatcatcacctgggcgcagccggcgtaggcgaacatccccagcagggcaccgatgaagcgcggatggcggaacaactgtaggtcgaccatgggccggtgctgcacccgctcgatcagcacgaacagcccgagcaacaccatgccgcccagcagccgggcgtaggtcagcgggtggctccagccgatgcgattggcttcgatcaggccccagatcaggcacagcaggctggcgctgaaggccaggctgccccagggatcgaggcgggcggcctgggtgtcgcgggactcgggtatcgcgcgcaacaccatcagcaccagcagcccgcccaccggcaggttgaggtagaagatccagcgccagccgatgaactcggtgatcaggccgccgacggtgggcgcggcggtcatcgccacgcccatgcaggctccccagaacgcccaggccttggcccgttcgacctcgtcatggaaggtgtggccgatggtggccagggccgaggtcagcagcagtgccgcgccgacccccttgatcgcccgggcgatgtcgagcaacagcacgttgggcgcggcgccacagccgagggaggcgaggatgaacagcccgagaccgtagagcagggtgcgcttgcgcccgaagcggtcggccaggctgccggccggtagcagcagcgcggcgaaggccagcatgtaggcgctgaccacccattcgatatcggcgaagttggcccccaggtcgcgagcgatgctcggcagggtcaccgcgacaatgttggtgtcgagcacgatcagcgagcaccaccccggaagcggtgagcagggtcaggcgcgggctggccggcctcatggctgcacccgttgacccagcgcggcgagggcggcctgggcgatttcatcgtcatgggccggggtgtcggcgctgatgccgatggcgccgatcctggccgtcgacgcggatcggctgcgcgcctttcatcatcagcaggcccgaggtgatggccgcctggcgcccgccgttgatggcgttttccaggtcgccggaagggcgcttgaacaatgccgaggtccgcgccttgccctgggccagttcgataccggccaccaccggcgcaccgtccatgcgcgcgctgaggatcggccagccgccgtcgtcgacgatcgccacggcgcagggccagcccttggccgaggcggtgtcctgggcggccttgagcagttgttgggcggtggcgaaattgaggattgccttctgggcaacgtcggcgtctttctcggcggcgaaagtcgtgggcacgctgcagcaagtgatcatggccagaaacagtggtttgacgtgcatggcgtgggctctctactgtgaaggtctggccagcttatcccgggctttcgcccgttctgttaggcgagctggagcaattcattacctttgagctaacgcacttatggaaatccgtcatttccgctatttcctggcggtggcccgacaatgcaatttcacccgcgccgccgagcaactgggcatcgcgccgccaaccctgagccggcagatccaggacatggaacaggccctgggcacccgcttgtttgtgcgccagcagcgcgaggtcagcctgaccgaggccggcgcggccctggtgcgcgaggccgaggccacggtgcgccagttcgagttcgcgcaacgtaacgcccaacgcgccgggcgcggcgaaatcggccatatcgagctgggatacgtggcctcggcggtgtattctgggcttctgcaaaaacaggtgcagcgcttcagccaggagtgcccggacgtcagcctgagcgtgcgcgaaagcccgatggcggcgttgcccggactggtggccgaggggcggttcgacatcggttacatccgctcgcccatgaccctgcccgaaggggtggaggcggtccgcctggatggcgaaggttttgtcctggcgctgcccgccgagtcctggctgggacgcttgccggagatcgccccggcccatctgcataacgagaccttcgtgcttccggaacagatcagcggcaccttgcaggtcgccgccgagggcggttacgcgccgaaactggggccgcagcccggcggcctggtggcggtgctggccctggtctccctggggcagggggtggccgtggtgccggaatcggtggtcgggcacgtggggctgcccaatgtgttgtaccggccgatccagggcagcacggctgcgtcctggctgtcgctgatccaccgccgcttcgaaaaggccccggcggtggcgcgttatatcgagcaggtcagaggcacattgcgggggtaggggcgatgcggccgctgaggtagttttgctctaagccggccagcagcgcctgaaatgttttgtaaaaaattcttcggagcctgtaggcataaggcttcgagcgcaactgcgcaacttcttgcgcaattcatggttgctagagtggcgggctcaatggaacgactgacaagcgcctgacagatcgcgctgctcgggagggagcgggatggttcgatttcaaggactgagatcctcaattcgtctttatggcttggtcacggtcaccggtattcacgaccagcctgccctggatccggtgcagataagttgcgtcggcgacctcgatgcacccaccgtccgggtgttcatttcccggctggacgcggagatctacctgcgcgcttcccatctgcgcaactatcgtgtggtgccacttcgatcgttcgatccttcccagctcctcaatcaggctaatggctggttgaaactcaatatctgcctgggtttcgctgcccaggacgactgcctcctcagtatcgatcaacaggaagtgattccggtcgggctgacggcctggacccggccggtcctggatgatcagggttattacctgcaatggtcggacacggaattacccgagtacctgctaagtgcctataaaagtgttggcgcaccggactacaaccggcagctcaacgaactggacgattgggcgccagcggccatggagcgcactgttaccgaagcactgcagatgtcacccccgttcaaggcccccggctcgacggccagccagctcgcattattcgatgtggaggatgcctgttggcgctttggtctcttccagatcgatggcctagggacaacacgcaatacctaacggataaaggagattgcaatgagtggaaaacctgcggcacgtgtcacggatatgaccgcttgcccgttgcccgggcacgccagtaacccgattgtctcgggatcgcccgacgtattgttcgatgggctcagcgcggcgcggatgaccgacaccacggcctgcggcagtgccctggtcagtggggtggttgccaatgtgctgatcaatggcttgccgatcgcgaccctgggcacaaccggtaatcacgggaatgtggtggtgagcgggtcgggaagcgtgatcatcgggcagcaggtcagtgccgcggctgtcgctcccctgatcaagattcccgggctttgcctgccgtgcctgttggcggcggcgcagcgcaatgaagcctttgtcccgctgcaaaacctggggaactgatcatgagtgttcctggcaatggacgccggcctgatccgaatgttctgcaatttcgtacccatattcgtcactgtctggagcagcaccctgaaacccggctctatgtgctggtggatggcgcccggtacatgaccctggagaaccgcctggacgtggccggggcggcgatccgcgtcgagtggttgctggccgctaccgagctggacgaaatcagccgtgggggaccagcgctggtggagttcatgacggatagcgatgaggcctcgcaactgctcgactggctgatcgagcgcgaccagaagtcgccgctggtttcatggctgtggagcgagcgctcctttgaggcgctgagcaaccatctcaaatcccatttgttcagccgtctgccggacggccggatggcgttgtttcgttattacaacccgatcgtccgccgcagcctggaggctgtcctggacagcgaacagcgaatggccctgatgttgccgctcgatcgctggcagatctggcagccattggtcctggcgtaccagacgtattaccgggtcgggcaggaggctcgccatgcttgagttgacggcagaccagctgaaagcgctggagcaggttcggcaaaatgaggtgatcgagaagatcatgctcgagatacgtcagcacaatcctcaatggctcgagcagaagggccagtggcagacgatccagtacctcaaggactaccgggaaaaagcctgggcgctgcaaatcgaagagcccgatacggttgaaagcttcatgcgctttggcctgcaatttcctggtttcgaagaaacacccgggtttatccggtggatgaaaaggccggtaaacgacaccccggaacagcgttttcgcgattacgcaagcgtcatggacttcgtccaggggcaacgggcctggcgggccgcactcaagacagggatgcctgaatgaccagttttatttccggagccgtcgcgcaacttgcgcctcccatgaccggcgcgttgcgtatgccattacctcgcggcgggccgaagctgcccttcgaggtgcccatgcccgcgccgcctcgattgccgatgccgccgccccgaccatcgccgatcccgcccccggaagtcgtgccccggccattgccgctaccgaacccaaggccggtgccgcaacctttgccgctgcccgggaccaagcctgaggcactgcccaagacggatgcacccgcaagcacccgggaccggaccaaggaggccgagaaagactgcaagacccagaagaaggactgtgtgaaatgccctcccgaagacgggcaaatgtatattcccgtcaacgggaaagggcacagcatgagtgacctgtcgagcaggtaccaacactgggtgaccaactttccgtttccctgggagtggctgtggagtactacggactgggacggttttgtgaaaagccgctgtaccctgcaagaggccaaggccaactacaagttcatgctcatattcggtttcaagcatccgaagtttgccaagagcctggagaaggatctgatcgtgaaggcgttcacccaggcaggcaaggccaagcccagtccgccggtgaggctggagtggcattttcttcagcgagaggtttacgagtattgctccgagaggtacgaggagggcgggctcaccaacctgacggcctattggaatccgatgcctggaaccaaagatcatgaggagtacgaggaagtgcgtcgtgaggagcaaaaggcgctggacgaatacaaaaagcagcatccggacataatcgtctgagaccgtatggagtactcatggacacattcaagcgttttaatttcaagctgagcttcgataagcagaagattgcccaggtcaccgaacaggagcagatcgacaggagcctggtctttctcaaggcgataggcgagatcgaccccattctcaagaactggttcttgtgcgccgaaggcaaggatgacggcctgacgcacaatgtgctcctcgacccgagcagcttgcggcgggaaatagcctcctggaaagactcggacttcgacgtcaacgacatgagctttgtgttgtggaacgggatatccgatccgctcaagggcgggctgtcgctcacctatcacgcccgaagcggcggctcgttacccgcgggcatcgagttttccgaagccgggacactggtccgttgcctgccggatcctcgacagggcattgtcgagttgatgaacgcagcggtcgatctctggccggaaatctattggggcgtggccgctcccaacgagtactttcgcaagcagcgggtgttccaggaccggcagaccatcggctggatcggttattgcccgcaccctctgtcggcggccgattttccggaggtcgccgagctgcgtcccactcaatcgaagggcaccatcgtcgttgcctgccccggcatcatggacgagaagaacgtccagcatgtgcaggtggtgggcgacaccgatatcaagttggtggaactggggctgttgcccggacgctattgagtcgcacgggcaggctcgcttttgctggggcgagcttgcctgcgatagcggtggccaggcaccccgataagatcttgaaatgatttcccccatgggaagttccccttggggttgtaggattcaagtccgtttttcttcacaggacttgcatgaacaccctctcggagcctcccagtcgtccttattcctggacgcctcagcctttccccgctcgatccgcctcgcggtgccttccgtcagtcataaggcgcggccgttaccccgaactcgctgtttttcgctgctcgccgccggtcgtcgcgaccgttgggcgctggcctgcgttcgccgttcaaaggccttgtggccttgccttgccgtgtccggctgcctgaattcactggagagatagagtcgtttttatggaatggataatggaccccacggcctggcttggcctgttgaccctgatcgtgctcgagctggtgctggggatcgacaacctggtgtttatcgcgatcctcgcggacaagttgccgccccatcagcgtgaccgcgcgcggatcatcggcctgtccctggcgctgctcatgcgcctgggcctgctggcgagcatttcctggttggtgaccctgaccgcgccgctgttcgaagtgttcggcaagagtttctccggccgtgacctgatcatgctgttcggtggtgtgttcctgttgttcaaggccaccatggagttgcatgagcgcctggaaggtcatgtcagccaacgcgccggcaatgccgcttacgcgctgttctggccgatcgtcgcgcagatcgtggtgctcgatgcggtgttctccctggacgcggtgatcaccgccgtgggcatggtcgacgagctggcggtgatgatgatcgcggtgatcatttccatcggcctgatgattgtcgccagcaagccgctgacccgcttcgtcaacgcccacccgacggtgatcatgctgtgcctgggcttcttgatgatgatcggttttgccctgaccgccgaaggcctgggtttccacatcccgaaaggctacctgtacgcggccatcggtttctcgatcctgatcgagctgttcaatcagatcgcccgtgcccgccgcaagaaatccatgcagggcctgcggccgatgcgcgagcgcacggcccatgcggtgatgcgcctgctcggcggtcgccagctggcggtggaggaggtgggcgaagagatcgccgacctgctggacaatggccaagcgccgagcgccgagctgttcgaccgccgcgagcgggtgatgatcagcggcgtgctgcaactggccgagcgaccgatccgcaccttgatgacggtgcgcgccgatgtcgactacatcgacctggccgacgatgccgaagccatccgcaacaagctgatgcattcgtcctactcgcgcctgccgctgattcgcgacggcgcggtggaagagccgctgggcttcgtgcacaagaaggaactgctcaaggaatacctggccggcaatgagccgaacctggaacacctggcgcgcacggcgatcaacctgctggacagcttctcgatcctcaacgccctggagcagatgcgtaaagcctcgacccacatcgcgttcgtgatcaacgaattcggcgatttcgtcggcgtgctgagcatgaccgacatcctcgaatccatcgccggcgagctgcccgacgccagcgaaatcgaaggcccggacattgtcgaggagcagggcggtttcatggtcagcggcgccttgaacctggcgcagatccgccagcgcaccggcttcgacgccgagccgaccgaggactaccagaccctggccgggctggtgatgagcctgctggaccgcttgccggtgattggcgaccgactgcaatggcaggactggacgctgcaggtggtgacggtggaagagcggcgagtgacccgggtgctgctgcaccggcaggatgccgcctgagccatgagctgaatcgccccggcttttgtggaggccgtttcgtttaagtcaggccgccatggcctgacctgcttgttgctggtggaagtttgcctcagcctccgcgggcgggatatatccgattgagctcagcaggcgttggtggttgtaccagtgcacccatttcaaagtcgccatctcaacagcttcgcggctcttccatgattgacggtaaatcagctcggccttgtacagcccgttgatggtttcggccaaggcattgtcgtagctgtcacccttgctgccaaccgagggctcaatgccgcctctgccagccgctcggtgtagcgaatagagacgtactggctgccacgatcgctgtgatgaatcagtccatcggcacggtgtggctggcgggcatacagggcttgctccagggcatccagtacgaagtcggtcttcatgctggtactgactcgccagccgacgatgcgccgcgcaaagacgtcaatcacgaacgccacgtacagccacccttgccaggtcgagacataggtaaagtccgagacccagagctggttcggacggtcggcatggaactggcgttgaacacgatccagtggacacagcgatttgtcgctggccaccgtcgtccgcacaacctgtccgcgccttataccctgcaatcctgcctgccgcattagccgctccaccgtgcatctggcgatcccaatgccctctcgctgtagctgcttccagaccttcaccgcgccatagcactgcatgttggtatcccatacacgctggtgatctccagactcaacacctcatcgcgttgagcacggcaacaacgcaagtcagggttacgtagttgggccgcatgcctgcggtaaccggacggggcgatctgcaaaacacggcagatcgactcgaccccgagacggtcacggtactggtcgacaaaggccctcaggacttggtacggcggtcgagttccgcctgggcaaaatacgcactggccagacgcaggatctcgttggctttgcgcagttcgcggttctcacgctccagagccttgatgcgctcgcgctcttcggtggtcggccccggacgctgaccggcatcggttggatgacggcgaatccagccatgcaacgtttgcgctgcacagccgatcttcggggcaatggcctcaatggccgcccactcggacgggtagtcgttcaggtgctccagaaccatgcgcacggcacgttcacggacttcaggggaataggtcgtagtctttctcatggcctcatcttctcaagagttgaggcctccacgaaacccggggcgattcagttcattgtgctggtgcttgaccacgacaaaaccaaccttctctccagatacctcgatgtagcgtgtattgcgggcttcaaagccgctaagaaaacgttcgcgcgcgcgtaccggatcaaatcgtccaacacgctccaggctttcgcgcatggcctcgattcgaatggctacaagattgtccaagtcgctttgttgagccaggaccaaaatgaactgggaattcttatcggctgtggcgggcatcatttgcgctctgactatcatcctgggcagcgagtatagagagattagaaacaagcggctcacccgctttatctatatgaggcccacaggcgaaaacgcccactcgaccggtagtgaaatcaagcagggcttgtcacgcacccagtatcagccccgatccctgcttatcaatggaaaggaaagatgtagttcatccaggccgacatgcgcaggaggatcttgcgcatgatcgccacatggtggaagtgctggctgtagagcgccgcctggccataggcgccaccgggcatgagtttggcgtagggcaggtagtccgggtcggtgatttcaatgaccaccggcacccgccccggcggcggtgagccggtgtagctcagcagggtgccggacggctggacctgtccttcgccgatcaccgtgatgacattcttcacccggcccttgaataccttgccggggataccgtcgaacgccacttccgcctcgtcccccgggaccaggcgcagcaggctgttctggcgcatccaggcagagaagtaatggccctcgtccggaatgaacaccatcgacgggcgcagcggcagcttgctcgccatcattcccgggcgcagcgacacgtgggtgacgaagcctttgctcggggcacggaccacggtgctgttcagctcgaactgggcgttggcgatctgtgcctgcaggtcgtcgacccgggcaatggcggcttcctgctcacggcgagtgccgaagttgcgcctgatcaactcgttgatccggaacaggtcgccctgcgctgctgtctgctgggccttgagcgacttgaggcggttctcgaaaggctcggggtcgatgcgaaacagcacatcgcctggctccagcggcgtgttgccctgcatcggcacctcgatcacccggccggtgacgaccgggatcacgggcaccgagacgaagtaggagcgcgccacttccgaataggggtggttgtagttcatcaggaaaatcagcgcgccgatcaataccacgccgcccagcacggcggtgggcaccgtccatttgttcagcgggatacggaagatcttgaagatggccacgcagatggcggtgtaggtcaggatcagtaacaggtccatgggtcacggcttcccttccgggcggggcccggcctgggattgtccttccagtcgctcgacccgctgtcgcagttcggccagttcttgggccagatctctttcggcctgcatccgcgccttgtcggtcgcgaacccccagccccggtcctcgcggtacaacatggcccagatccacaggaacggccacagggcatggagcgtgaacagactgacccagcctgccgcgtgaatggcgtcctgatgtggatggttccgatggacggcaatttcgtagggaatgtcgtgcaggacaatgattccgtagaacagcactatcccggcaaagataagcatgcccagcgcaatctgatcgagcatgattcgcctcccggaagccatcggcctgcacgcaagcgcttatgaagcctgttgatccgccactgccatccgacagtccgatgggacgggccttacgaaatccatactagttcaagttcgatcgtctgcctggctgccttctaggaggcgcgcggccctggacctggaaagctgcgctcgcccaggccgcggtttatgatcgctacctgtcgtccctcactgcgagcccgatcatgccttttgaactggaccttcccgaaatccgcgccggtatcgttgaattccctgtctggcatgcgcgcggtggtacctccaccggcttgatcctggctcgcgaaaccctgcccgaggacccgttgctggtcgaagaactgttgcgtcacctgatgggagtgccgttgagcggcgagctgccgggcaataaccagatcaccggcctgggccgtggcgggcccaccagcaacaaggtgttcatcgccgagcgccagcccggcgagtcgcgtctggtcagcaccctggcgcaactggcggcgggtaaaagcgcgatcgactggagcgtcaactgcggcaacatgtccgcggccttgcccctgtatgccctggagcgtggctggctgagcgcggacgaggacagcgcgcagatcgagatcttcaacagcaatacccagaccaccatgcttgcgcgcctggcgttccgcgacggtcgcctgctgagcgatacgcgcattcccggggtcaatggcgtgttccccggggtcgacctgtttctcagcgatccggtgggggccaagaccggccagctgttccccaccgggcaacgcatcgacctgctcaatggcgtgcgcgccacctgcctcgacgtggcggtgccgatggtcatcgtccaggccgcggacctgggcaagaccggcctggaaaccccggcgcaactggacgccgatgccgacttcaaggcgcgcttgatcggcttgatggtcgagggcggcctgcgcatgcaactgcgcaatcgcagcggcgccttgatgagtgccgatgagttgcagcgcagcgaaaccctgccgaagatctgcatcgtcagcccggctcagggcgcgggcgatatcaatacccgctatttcaccccgcaaaacgcccatccttcattggccgtctccggtggctgctgtctggccgccgcctgcctggcgccaggcactgtggcccatgaactgctcaagacacccaagcccctgggcgccaccacggcggaatacccggtgtcgatcgaaaacccggcgggggtgctggacaccttgatcaccgcgcgcgaggagggcgcctcgatgcgtatcgacgcggccgcctaccggcgcagcgcgcagatcctgctcaagggccgggtgccgctgtacaacgcttcggcggcgttggtcgaggcgttgcaagggcggcgttgacccgcaggcgctccggggccatcgccgaccggggccctgcggttcacaggtccaggtcgacccacaccgccgcgtgatccgagccggcgttttccttcttgtccaactgcgggtagacctcccagcgcttgggctggctgcccggccacatgcccttgcgccatacgccgccggcggtgacggtggcgaacagcgcgggggagagcagcaggtagtcaatcttgttcgccgccttgcaagtgtcgaaggtgccggggtaaccaccgtcatcgaaggccggatggacaaaggcatccttgaggtcggtgcccttgagcaagggctccagcggcgcgctgtccggggtgtcgttgaagtcgccgaccaccgcgatataggcctcgccctgggccaccagctcttggtagatgagcttgatccgctcggcctgggccaggcgttttttcgccgaggccgcaagaccgccgaagcctttgctcttgaggtggttgaccaggacgatcagctgcttgtccttttgttttccagaaggcaacgggatatgaaactgcgcgcaatcgcgggaaaagatcagctcgccgttggccgcggcgtcgtcgacatggctgcgcagctggccgatggggtagcccgcggcggtcatcaggccgacatcgatgccccgtgtatcgttgccgtcgatcagcatcacatgggagtacagcgggccgcccagggcgccgatgatttccgtgttgaagtcgcgcagggccgggcggctttccgcctcgaccaccgccagcacatcggcttgcaggtcgatcatcacccgcgcggtattgcgcatggcttccaggtccaccggggcctcgatcaactccagcgaaccgacccactcggtgcggccgttggcgacaatctccaggccgccggccttgggccgcttgaccaggctgccgcggttttgccgcaggatcacaaaggggcccttgtccgacttgctcaggcccagctcggtcagcagcttgaccatctgcgccttgtcctggtcggtgtagatgggctcgcccagcagttggttgagcttggcgaaacgctccagcaccggcttgccttcggcccagccttccaggttcatggccttggcgcggttgaacaggttttcaacgttgtaggacgcgagtctcatcgggctcttcctttacgtggggcggatgtcaatgggcattacaaccgataaaaatgaccgaatgccgacagacgcggcatcttgttgccttctttatgctgaactcaagaaaggactaaaccggcccgggattcccggtgggcgaatcgcagagggccggtggggaagcgacctgacagacagcacttcgcccgaaccgaatggggaggacagggcatgaatgatgcgtcccgcgagcagggcgagccgttcaagcggctgttcttcgccttgccctgcaccgccgcccagcgccgggccattgcccagtggcgcggcgcgcttgggctcaggagcggccggccggtgccggcggaaaactttcatttgaccctgatgttcctgggctcggtcgccgtgacgcagattccgcggatctgcgccgcggcggcgaacgtgcgaacgcccggtgaggcgctgcacgtcccgctcgaccgcctggaggtctggcgccgggccggggtcttgttgctggcgccggcgcaggcgccgctggcgttgcgtcagctggtgtatgccttgcaggaagcgctgctgccccttgggttggtcgattcgccgcgggagtttcgcccacacttgaccttgatgcgcgactatcgggcggcggttcccgagtcccagacccctgcggattttcagctgagtgcccggcacttcgccctgttcgagtcgcataagggccgttatcggccgctggccgaatggacgctggcgcggtgacggtcggggcagccgccggtcagccgaaatccgcgtgcctcagggcctgcacgttatagttgatgaggccgaatcaataggaggagggcatgcgccagatcgtcagcaaagagccgtggtgggccgcgccgccgaaaccgggccaggatgagtccgagctggactggggctggctggtcacttacaacgagggcgagccgcgcttcgagttcgtcaaggagcgcccttcggagcaggagatccgtcagcgcaagagttgccggaccacgccgtccgagtagccggtcggcgcggaggacaatcttgcgcgaccctcactgtttgtagccgatctgccgcagcaggttcttgcgccacaggatgtcgtcgtcgccttccaggcccttggcgcagaagccatccaccacccccagcaccgcccggccctgcgccgtttcagcgagaatcacctggctcgggttggcggtcgcgcagaagatgcggcacacctcaggcaccatcttcagggcgttgagcacgttcaacggataaaaaccgtcgccgagaaacacgataaagctatggccggcggcgatcgcctgggcgttcttttgcgccagcgcgatcatcgtcggatcgctgccggaccagcgcaccaggcattggccggaggcttcgcaaaaggccaggccaaaggcgatgttcggcacgctggcgaccagggcttcgtggatgtcctcgacggacttgatgaagtgggtctggccgaaaatgaagttggtggcttccggcttgtcgatgttcacgctaatcagttgcatctcgaaccgctccttgccgatgtcgcgcggcgctgagggggcgttgacgaaaagggggcagccgtcgccgcccgttagcgcggcggcgggattgcttgctgcaacagatcaagcatagccactcatggatcgttgcttcgctcgttcgcgcttggggcgcgagtgcccggcaacaggatcgacggtcatgcgtcgcgagcggcaggctgctatgccttccctagggggcaatggtttcgggccggccgagaggcggggcgataccgatgcgtggtcgtggtcacggtgcctgcctggcgcacgcaacgaacaacgggcgcccgtttcgcaggaggtggcagatgttattcattgtcagttggtcaatcagccccgaacgtcgtaacagtgcgatcgagcgatttctcaagacgggtggggcgccacccgcaggggtgagcatgctgggacgttggcatgccgtcggcggcatgacggggtttgggatcgcggaaaccagcgatctcacgctgatgcagaaatgggtgctggagtggagcgacctgctgcgcatggaagtgcacccggcgttgaccgatgaacaagccgcgccgctattggcggcagcgcttggcaggtaacgggcaagcagaccgttggcgatccgccgagggctgtctgcctcggccaatatacggggtaacgctgtttgtcggcgtgccccggccattcacgaagtggaggttgtcatgccgaagttcgtcatcgagcgcgagatgccggaagccggggcgcttacgccgcaggatctgcaacagatctcgcaaaaatcctgcaaggttatcagtgagctggggtcgcaagtgcagtggctgcatagctacgtcacgggcgacaagatctattgtgtctatatctccccggacgaggaactcgtcagggagcacgccaggctaggcggttttccggcggaccgggtatcgcgggtgacctcgatcatcgatccgacgaccgcggagtagggccttgcggtgacatgtgtgcgcctggctcggcgtccccttactccagggcgaggtgatgccgctggcaggaaaacaaggccgccctcggggcggcctttttcatgggcgcggcgtgccgcgttagcgtcgcggggcgtcttgccaggcacaggctcggctatgctgcagagtcgacggccggtttgcggccgatgtccacaccttgaaccaagagcgccatgagaaaaaccacccagcagatgttgctccacgaaatcgccgactggcgccaccgtggcctgatcgatgccgaggcgcagcagcggctcggcgccctgtacgaacgtcccgaacaccgcttgtccacggtcctgcaatggctgggcatcggcgcggtgttgctgatcggcatggcggtgctgggcggcattggcctgctggccgagtcggtgctggtgggggcggtgctgtttttcgccgccggtgtcgggctatggctgatcggcgcgcgcctggcccgcgacccggcgcgacgcatgccggtcaccggggtggcgatcctgaccatcggcctgatcctgatgggcgccagcctgttgctgggcagctccgacagcgagaccggcgacttcggcaacctgcccctggcgctgctggtcaccgccgccctgagcattgccaccgcctatggctatcgcctgccctggccgctgctgctgggcctgctctgcgtcttccacagcctgggttcgtgggagtggtatggcggttccggcacttactatttcggcatccaggacccgcgctccatggccgtgatcgctgcgttgactgcgctcctggggctatggcaccagcgcgccgaggatcacgccttgcgccggttcagtggctttgggcggttgtatgtgatcttcggattgttgtacttcaactgttcgctgtggttcctcagcctggaggaagcttaccggcagaccctgacctggaccctgttgttcaccttgggcgccatcgtccagctggtactcggtgcgcgtttcaagcaccccagcttcaccggttttggcgtggtgttcctcggcatcgacctgtacacgcgcttttatgagtacgcctgggaacagctgagcgccgcggtgttttttgccgtggctggcgcggtgggcatgctcctgggctggttgttcgaacgcaccgcgctgcgcgccggggaggctggccgatgaacccggatcgccgtaatcgccaggtgcacaacgccctggaccaatggctgcgcgacggcctgatcgacacccaggcccacgcgcggatcgccgagctgtatccgcagacccgctgggactggcgttccctggggcgctggttcctgaccttcggcgccatcagcctggcggcgggcttgctgatcctgctgcatgaacacctgacgttcaccttgccgaaactggcgggcggcctcggtctgttgatggtcggcttgttcgtcgccgggcgctggctgctgggcaaacaactgaagctgctcggcgcgaccctggagttgctcggcggttttgccctgatcggcctgagcctggtgctgggcatgatctactccgacggctcgggcaactggccggcgctgttgctggtggacctgctgctgttgctggcgctcagttatgtgctgaacaacgccttgctgctgaccctgtgcagcgtgctgttctttatctggttcggcgggcgcagcggttatgagtcggggtggggcgcctactggttcggcatgaactacccgctgcgcttcctcggcgcggccctggccatggtgctgttcggctttgtccatctgtggggcgaggcctcgacgctggcccgttatcgcggctttgccaaggtgtggatttctgctgggctgttcatggcccagatgtcgttgtggctgctgtcgctgttcggcagttacgacctgatcgagggtccgtggcacctggccgaggccggcgaactggtgctgttcaatgggctgtgggcggcgttcagcctgggcttgctggcactgggcattcgcctgcgcttttccatgctggtgggttatggcgcgaccttcttcatcatccagctgtacacgctgtttttcacccaactggcggacaccctgggctggttcgtcagcctgctgattgctggtggcagcctgctggggttggtgatatggctggaaggcaagcgccagcaacgccgggctgggccgggcgaagcggaatcggtgtagggcagggcggagcccatgcccgaagttgcgggcatgggcaggcgacggaccctaggctgtcagtcgtttttcgatatcccggtaggtttcgctgtctgtggccgccagcagtttgcggccatccttgaaggtgccgatgaaggtcacctcggtttccttgccggctatcaagtagcccgcaagcgcacccaccggacccagtagcatggccccggcgatgccgtagccaatagcgtccctgttggtgatgctgtcctgtgtcgcgatttccaggtgtttgaatgcggaggctttgacctcgacgcccggcgaggggttggtcacggtcggcagcttgaagacgccctgtcggtactcgccattcccttgtagaaaatcaccagccaatacattgatctttgccatgttgaatatccttgttcaagcattgcggattgaccatacagcgccgtcccgtgcccaccgtcaatgagggggcgatgaagggcggtaccactgatcggtgatgttgcgcctaacagcatcggtctcgagtgtagacgcctggttgacgcagatcagttcgctggtcgcaatgggataccgctcgtccgtttgattctgcgcgggctgcaaggctgtcacgagctgtctggcgtccatgttcggcaatgttaataaatgttaggtattaaaaaatacttcacataatccgttcattggtggatgatcgggccacacctgataacaacaaatcacaggacggcccctcgatgtccgacaaggtctcgattcccccgccaggcgaccctgtcgcccccgccgcccgtgttgccctttacctcgcggcccgccgcccgcgccttgccggcgtggagcaagccgctgtcttccctggagtaccccatgaataacaagaatgtcggtgttgtcggcctgggcgcgatgggcctgggcattgcccgctcgctgctgcgcgcgggtttcaaggtgcatgcctgtgacgtgcgggaagcggtcacccagcagttcgccagcgaaggcggggtggcctgcgcgtcgccggcgcggatggccgaggcctgcgatgtgatcatcacagtggtggtcaacgccgagcagaccgaaaccgtgctgttcggtggagagggcgccgtggcggccttgggtgccggcagcctggtgatcggttgcgccaccgtggcgccgacctacgccgtggagctgggcgagcgcctggccgaacagggcctgctatacctcgacgcgccgatctccggcggcgcggccaaggccgccgccggcgagatgaccatgatgacctccggcccggctgcggcctacgccaaggccgaagcgatactcgccggcatggcgggcaaggtctatcgcctgggcgatgcccacggcctgggttccaaggtcaagatcatcaaccagctgctggccggggtgcatatcgccgcgtccgccgaagccatggccctgggcctgcgcgaaggggtggacgccgacgccctgtacgaagtgatcacccacagcgccggcaactcctggatgttcgagaaccgcgtgccgcacatcctcaaggccgactacacaccactgtcggcggtggacatcttcgtcaaggacctgggcctggtgctggataccgcccgcgccagcaaattcccgctgccgctgtcggccaccgcgcaccagatgttcatgcaggcctccagcgccggtttcggccgcgaggacgactcggcggtgatcaagattttcccgggcatcgacctgccgaccgccaagcccgagcctgtctgaggaacgctccatgacccattccaccgcacgcccgttgctgggctgcatcgccgacgatttcaccggcgccaccgaccttgccaacatgctggtgcgcggcggcatgcgcacggtgcaaagcatcggcatccccagccgcgaagtggcggccgggctggatgccgacgccatcgtcatcgccctcaagtcgcgcaccacgccggtggccgaggccgtcgaggaatccctcgctgccttggactggctgcgcgaacagggctgcgagcagatcttcttcaagtactgctcgaccttcgattccaccgccgccggcaatatcggccaggtcagcgaggccctgctcaaggccctgaacagtgatttcaccctggcctgcccggcgttcccggaaaacggccggaccattttccgtggccacctgttcgtccaggaccagttgctcagcgagtcgggcatgcagcatcacccgctgacgccaatgaccgacgccaacctggtgcgcgtgctgcaggcccagacccagctgaaagtcggcctgctgcgctacgacagcatcgccgggggcgtagaaacggtgcgggcgaaaatcgccgaactgcgcgcgcagggcgtcggcatggccattgccgacgcgctgtccgaccaggacctctacaccctgggcagcgcctgcgccgacctgccgctgctcaccggcggctccggcctggccctgggcctgccgggcaacttccgccgcgccggcaaactgcgcgacttcgatgcggcgtcgctgccgaccgttgtaggcgacgaagtggtgctggccggcagcgcctcggtggccaccatcggccaggtcgcggcctggctggaggccgaccgtccggccctgcgcatcgaccccatggccctggccgccggcgagccggtggtggagaacgccctggcctttgcccgcgacagtgacgaaaccgtactgatctatgccaccagcaccccggccgaggtcaaggcggtgcaacagcaactcggcgtcgaacgcgccggggcgctggtggagaacgccctgggcgagatcgccgcgggcttgcgccagaacggcgtgcgccgctttgtgattgccggtggcgaaacctccggcgcggtggtcaaggcgctggggatcaacctgctgcagatcggcgcgcagatcgacccgggcgtgccggccaccctcagcaactccgccgaaccgctggcgctggccctgaagtccggcaacttcggcagccgcgacttcttcgccaaggccctcaagcaactggccggaggtggccaatgagcgccgcggcgaataaggaacaggccctgcgcgaagagatctgcgacgtcggccgcagcctctaccagcgcggctacaccgtgggcagcgccggtaacatcagcgcgcgcctcgacgatggctggctgatcaccccgaccgacgtctgcctcggccgcctcgatccggcggccatcgccaaggtcaacctggcgggggagtgggtgtccggcgacaagccatccaagaccctggccctgcatcgccaggtctatgaccgcaacccgggcgtcggcggcgtggtgcacacccattccacccacctggtggcgctgaccctggccggcgtatggcggccggacgacatcctgccgccgctgacgccgtaccaggtgatgaaggtcgggcacatcccgctgatcggctaccagcgcccgggttcgcccagggtcgccgagcaggtggcgcaactggccaacagcgtgcgcggggtgatgctcgaacgcctggggccggtggtctgggaaagctcggtggccaaggccagctacgccctggaagaactggaagaaaccgcgcggctctggttgatgagcaacccccggccggaaccgctggatcaggcagccctggatgagctgcgcgagaccttcggcgcgcactggtaggtagcgcgccgctgcaactcgaaactgtaaaccgacattgcaagcactgcccgggagccgtcgtcaggctctcgacggccccggcttgcctgaaaaaacaataacaacaggacatccccgcatgacgttccctgactgcagctgttttggcttcaccggcgcttctttctcttatgagggaggggccgcgcaatgagcccgcttatcctgatgttgacggccggcgcgggcatcgcgctgctgctgtttttggtgctcaagtacaagttccagccctttgtcgcgctgatgctggtgagcatcctggtggcgctggtggccggggtgaaaccggccgacctggtggcgaccatcgaaggcggcatgggcaagaccctcggccatatcgcgatcatcatcgccctcggcgccatgatcgggcggatcatcgagctgtccggcggcgccgaggccctggccaagaccctgatcgagcgtttcggcaaccgccgcacgccgctggcgctgaccatcgccgggttcatcatcggcgtgccggtgttcttcgaagtgggggtgatcatccttatgccgctggcctatggcgtcgctcgccgggcgcgcaagccgctgctggtgttcgccttgccgatgtgcgcggcgctgctcaccgtgcatgcgttcctgccgccccatccgggcgccgtggccgcggccagccagctgggcgccgacctgggccgggtgctgatgttcggcctgccgatcaccgccttcctgtgctacgtcggctaccgcgtggccgggcgcatgacccggcgcttctacccgatgaccgatgacatccgcgccgaagtctacggcccccacgtgaccaacgaggacctgcaggcctggaccaacggcaacggccatgagcagaacccgcaacaggcggcggtggcggcgtcccacatgggcctggaagaatccaccagcgccattgtcgccaagctgccaccggcgcccgcgccgggtttcggcctcatcgtcagcctgatcctgctgccgatcgtactgatcctgctgggcaccctggccacttcgctgctgccggccgaatccaccctacgcggcatcatgaccgtgctcggcgcgccgctggtggcgctgctgatcgataccttgctgtgcgcctggctgctgggttcgcgccgtggctggagccgcaaccaggtgtcggacgtgatcggctcggccttgccgggcgtggccatggtgatcctgatcgccggggccggcggagtgttcggcaaggtgctggtggacaccgggatcggcgcggtggtctccgacctgctgcgcaccaccggcctgccggtgctggccctgggcttcttgctgaccatgctgctgcgcgcggtgcagggttcgaccaccgtggccctggtgaccaccgccgggatcatcagcccgctgatcgccaccctgaacctgacccccaaccacatggcgctgctgtgcctggccatgggcggtggcgggctggcgatgtcgcatatcaacgacgccggctactggatcttcaccaagctcgccgggctcaacgtcgccgacggcctgcgcacctggaccgtgatcactaccttgctcggcaccctgggtttctgtattaccttgctgatctggccttttgtctgagccgtttttaggagccaacatgcctcgttttgctgccaacctaagcatgctctacccgcaacacggatttctcgagcgtttcgccgccgcggcggccgacggtttcgaagcggtggaatacctgttcccctacgactacagcccccaggagctcaagcagcgcctgagcgataacggcctggtccaggccctgttcaacgcgccgcccggcgactgggcggcgggcgagcggggcaccgtgaccctgccggggcgcgaggcggaattccgtgccggcttcgaccgcgccctggaatacgccgcggtgctgggcaactcgcgcattcatgtaatggccggcttgctgccttcggaagacctgcgcgaacgccatcacgcggtgtacctggagaacctggtctacgccaccgcccaggcggccaaggccggggtcaccgtgctgctggagccgatcaacacccgcgacatgccgggcttcttcctcaaccgccaggaccaggcccaggcgatctgcaaggaagtcggcgcgagcaacctcaaggtgcagttcgactgctaccactgccagatcgtcgagggcgacctggcgaccaagctgcgccgcgacttcgccggcatcggccatatccagatcgctggcgtgccggatcgccacgagccggacctgggcgagttgaactacccctacctgttcgcgctgatggaccagctgggctacgacggctgggttgggtgcgagtaccggccgcgcggcgatacctcggccggcctgcaatggctgcgggactggaaagccttctgaggggcgggcagggcgggggcgctggtcagtgcgtgccgcccgctagccgtgattctgcgggaatctgaacatttctggaggtgtcggccttcgctccccagctgcgggtacattggcttcctgtcgccagggccatcactggtgccatcaatgggagcggggagcatggaaaagtcgatattcgtcgatcagtcgggcctggacgacgcgccttgtcgtccgcacgatctgcattgggaacagatccccaccgtgaccctggagcgcatcgagcgcgaataccgccgtgcccggcgcaccaccattcttggtcagtggatcaatatcgccagcgtgctgctggtggtgctgagcgccgcctgcggcctctggctgtggaaccacttccgcgcccaggggctggaccagggctttggcttgcggcaactgttcgtgctgctgttctttttcgccagcctgtgcgcggtggtggagtggctgcggcgcattcgccgcacgacccgggtggccctcgacgggctgggtgaagacctgcgggacatagcctgcgtgctgtggttcagaaagcagcaccagtgagcggcacccgcgcagcggttgtcagtctttcgctgcaaccgcttgtgagtcggacggcagcagcaattccaccccttgcttgcgaatcccgtccgccgcggcctgggccaggtcgtcgtcgctgatgatcacgtcgaactgctccagcccggcgatgcggtacatgctgaaggtgccgtacttcgaactgctggccaccagcaccacctgggacgccgactgcatcgccacctgcttgacctcgaccttcaacgccgacggcgtggtgatgccgcggcgcaggtcccaggagctggtggacatgaaggcgatatcggtcaccacctgacgcagggtcgccaccgccagcccgccgacgcaggaatggttgtcgtggtcgacctggccgccggtgtggatcaccgtcacctgcggcgcctccatcagcgcctggacgatgccgaagtcgttggtcaccacggtcatgcccgacagcgctttgatgtacggcacgatctccagggtgctggtgccggcgtccaggtacaccgtcatgtccgcgtgcagcagccgcgccgccagccgcgccatagcctgcttctgcggcagctcgaccaccgccttggtctggtggctcggctcgctgtgcaactggctggcgatacgcaccccaccggtcactgaataggcccggccttcctgctccagcagcgcgatatcgcggcgcacggtcatgtgcgagcagtcgaacatctccatcaactgatgcacgctcaacacctggtgcttgcgcaactggcgcaggatcagctcgcgacgctgctcgggaatcatcggggcgccgctatcgctggcgatgtccttggggttgggcattgaggctccgcagtggctgggcagaaggcaggtaactggcggacatagtagcgaatccgcggggcgggaacgagaagcacgcaaccgatcgtccccctgtaccaccgcgcggctctgcctctgcaggagcgcagcttgcacgcgaagaacgatgacgcgatattcctgcattgcgcgtgacggctgttgagcatcgaccggcgagcagttaccaaggagcggtcatggaccccaagcgttatgaacacctgacgatcagcgtcgagccccatgaaatgcgcatgagccattgggtgtacgcacccagggtggtggatgctcgcgatggccgggtcgtgctggacctgagtggcgggccgtgggacctggtgtcctgctcgccatcgacggcggcggtggaactgctgttgcgcaagtaccccggagagcgtgaggcggtctgcctgagcattcgcctggccgacaacagcctgtggctggagggcactgcggttgctaccgagaatatcgagggggcgttggagagggcgcatggctgagccgcgccgtggctcaggccggcgaagcgtcaccgggcctgacgaccgttggtaagctggtggttctttcttttgccaaatggcattagattgaatgccatctgtcatcaggccgggagatgatcatgaccgccgccgccaagaataccgccaccgtgaaaccttcggccgaggctgagaaggccaagggcagtgcgcccaaggccatcgccaaggtcgaaccgcgcaagccctccgccagccgcattcgcggccccaaggccaacctgctgcgcgaagaggcggcggtctatgcgctgccttcgcccatggtgcgcgggctgctgccgggcactgacgccgatgacccgatggcggtgttcagggccacccagctggggttctccctgggcgcggtgatcgagctggtggagtcggtcgaggccttcaagcgctacaacgtgctggcgaagatcgtcgggttttccgagcgcaccctggcgcggcgcctgaagaaccaggaccaggccctgacccccgaacagagcgcccgcgccttgcactacgcgcaagtgctggaaaaggccgaggcggtgctgggctcccgggcgctggccgaagactggatgacccagccggcgctgggcctggatggcgaagtcccgatcgacctgctggccaacccggtgggctacgaactggtgacggactttctgcaccggctcgagttcggggtctactgatgctcaccgaccccttggccccggccctgcatttctggcgcctcgaccaggcccggcatgcctcgacctggaacagcggcattggcgccgaaggcagcggcgggcgctggaaccccaagggggtgcaagtggtgtacgccagcctggacgcctcgaccgcgatcctggaagtggcggtgcacaagggcttcaaggccctcgactgcctgccccacaccctgaccgcggcccgggtgctggacccgtcgcgggtccacaccgtccgccccgaagacatccccaaccccaactggctgatccccggcacccccagtcacagccaacaagccttcggcgccagcctgctggaacagcatcccttcgtgctgatcccctccagcgtgtcgcgccatagctggaacctgctgatcaaccccttgctggccaccgggttgtatgagctggtgttgcaggaacgctttgcgctggatgggcggttgagtccgccggagcgtgtcgtgtagcacagcagcaccgagcaatttcagaatcttcctacacccccgccgtagccacttagcgtaacgttctgttgccaactgcaaccaaacttgcccccatcttgatgggggcttttttatggacgatgtggaagtggacacggcctgctgaaaaggagtttttatgtgcctatgcatcactggctttctacctgatgaagctaacgacagttcattgcagtacgagttggacgtctcgtctgagtttgaacaggctgtaatggaaatattgggctggcggagcttggcaactgaagccgatggtgagctactgctcaccaaggagcaggtcaggcagatagcaacggccatcaacgaagtcttacctgacgaccttgatatgtttattggtgttgaggcatcaatgttgaggcgatagctcaggaacgtttatgagtagggcgctctgcgcagggaagaaccacactcaaatgaagaggagttttatgtacttgcgcatcactggttttctacctgacgaagctaacgacgacttattgcagtacaagctgaaagtctcatctgaatgtgagcagaccgtaatggaaatattgggttggcagagcttggcagccgaagctgatggcgagctactgctcaccaaggagcaggtcagacagatagccgcagccattaaagagtccttacccggtcacctcgatatgtttattggtgtggtggcgtagctccacccatcatccgtgtcccttgctgatccgttgaagagcgaaacaggagcttctgatagttcttattcgccccctgcggtgcataaggacttttagtacggaggtttgggaaagctctgatatttacgacttttctgcattgatagggtcggtgcctgaatttttcagacactcaggatgtactcatggcctatgtcatcagggaaggagacccgaccacgaccggtggaaaggttatcgcaggttcatcaacgaccatcgttgagtaccgcaaagttgcacgcatcaccgacccggtgtggtgcccggtgtgccagtcggtggggtatatcgcggagggccatgacacatggctggataaccaacaggctatcgcggtagaagggtgcgccgttcagtgtggctgccctgtaggttctaaccgtcttgtcgccactcaatcttctgtcctctcggataatcagccagcggttcctgttcccgccgccttggtgccgcaagttgtggcgaatacccatcaatgggccgaagcgatcaggcggggatattcgcaaaaccaatttgcggattcgcagccgcgcgatcaggtgaaggggctggcgcccatcagcgaaacggcgctgtcatcgcccgctcggttgtcgcaacaaggcgtagagccgggcttttatatcgttcagtccccgatgagccgtgcagccctcgaagtggtgcttttcgggcggcccgacgcggccctcctggagaaatttcgtcgactcaacccccaactgacggactccgtcaaacccggccagatggtggtcctcagccatcccgaaaaccatcagtgcagccgtgaagaaacactgctgatggacgcagcgcaaaaggtcagcgccgcgctggacaccctcacggccgaggaggcggccttatggtccagtaccggcagcagatcgagtcggtcctgtcttatggctcaaccaaccttggggtcgcgaccgctgccgccggcaatcatctggacggtattaaaagaaccttgcaggccatcgaatccctccaccaaacctacttcctgcgggatgggcatctacgcagcgtccagttcttcgccgaacggcgggcactgctcgcccggctggacgcaaacctcaccgccatcacgaaaatgagcatcgcctttcccgaccaccccgacctgaaaaccgccctgggaatttccagccgcagcttggttcatcattggaccaaagcgggcgcggtggggcagataccgggttacgccacgcatatcgagggcgtgtcgaaggcttccaaggtgctcaagtatggggggtggattggcacggctttgggcggtggcgcgtcttatgtgaaggttcaggatgtttgttctgcggggaataaagaggtttgcgagaaggtgaagtttactgaggtggggagtttcacggggggagttgctagcgggatgtttgctcccccgttattaacggctgcttcaggtgctatctgtgccgcagtggcggtccctacaggcggagtaggcggtgttatctgcggcctggtggtggtcggcggtggtagctatctggcgagcaagagtggagaggctttcggggagtttgtcggggagagcatatatgaggcaaggcagtgagtcagtttggtgtggccgagtatgcgcttgccttttgtggcgttgtaaccctatcaggcggggcaattatttcaggggtatttttctactgggggtgtaagcgaatggatgaaattttaggctatgttaaaaactgcaagatcataatgaataacaggttctatctatatatgggtgcgtggggtcggatggcgatgatagggatggtcgcgggctccttagcctatcccgggtactatattaggaaggggatgatggatattgaggatataaggaactttcctgagccgctcaaacggcgactgatcaagctgtttaacatacagttggtgtttgcggcctgttttatagttgagtttattattctgaagttgatcaggccgtgataagtggcgttatttatgaggttctcaattgagcctgcttaacctggcggcagttgtgcttgcatttacatttgccggaatacttgttggtgcctttgccctgatggcgtttttctgtatgtcgggtattcacgtatggaggaaatgctgggccatcttgagaattgccaagcaatacagcaaagaagttttcttatgcacgtcgggccgtgggggacagtcatgctcacggcgtcgattgcgggaatcatgacatttcccggaatctatcttcgtcacggcggagtcagccaggcggacttggacgcttttccatcggccctgaagcgcaagctgatcctgttgcatatcgtgaatattgcgttggccgtgggtggttttttggtcggcggagcaatggttgtgtgttggaactatgtaaaaaaaggcggactttaaggccccgaggttcggacataaactgccacgcctttgtcgttgccccgtatcgagcccagagctagcctttgatcgtcgctgcaaacgcagtgatcgggcttggtaacccgttttgatacaggcgcaacgatatggagttcaatcatgtgcgccgacaagtcgtccgcagatcgcggcttttctaatctcctttccctgcccaattacgtctgcttcccaagagcaaagggaggtgggctatgagcacctcgacccctgtcaaaaccctcggcctcgtcaccttcggtccttgcggcgatgccgaccagaccctgttccgagttaacgccgacgtgcctctgcaccaagccctggagcatgcttcgaccctgctgtactacgccaagaaactcgccctggatgcggcgatggaagagcagggcgaacgttacgcctgggccgcgcactttctggcggagatgggcaaggcggtgatcgatgatgtggggttggggctgagggaagaggaggtgttgcaggcttaacaggtagggggatgttgggcagggcgtcgtttctgggtggcagggaagcggcgtcgatttcccaaagtctggttcgactatctttcagggaatgaagccgatggatcgcaatgaccgtcagcattcccttcggccgggccatccaggacctgctctcgcagccgttcgagttgctgctggggcaccgaatcggtcgagagctgcccggggacgtagcgatgacaaagagcaactatgctaggtctgatgccgaaattgattgagcagatcgggctttgcgtccttgcgtcgtggaaaagcaatgggagtgggatcgatccgcttgggtttaattgaccgtcgctgcctctcaaggtcggtctgttggaggtctgaagttgcgaatcgcttttctggtgaaccgagacgtggagagcaatctcactctcaacttcctgttgcccgagattcacgagagcacagtggggatcttcctctcggagagagtgggaacgggcagcaaggtaccccgcatgctcgggcaactcgcattgatcgagcaggacctcttcaatgccttggctccggggttgagcggatcgagcgaccaggtcggcagcggccatcgattcggttttgcagaactgcagcaacgctttggggtgcctgtgcgggtattgcccagcttgagggaaccgcagggcctgcaaatgctgcaggatgcgggagcggatctgtttgtctcaatccgctttggtcaaatcctctccaatgacgcgttggtcattccgtcacgcggcgtcctcaaccttcactctggcctcttgcctcactatcgaggcgttctcgcgacgttccgggcgctgcttaatggtgacccggagatcggctgtacgctccattggatagacagtcccggcattgatgtgggtcgcatcattgagacggcgcgggtgacggtcgaaaaggagcgctccttgctgtggcacatccttgcactttatcaaccaggcgcgggcctcatcctggacgcaatcagacgcctggagcgcggcgagcccatgacgggggcgcctcaggatccatccgcaggcgcctactactcctttcccagcgaagaggacctgatgcgcttcacgacactggggtggcggctcttcgatcgcgaggacgtctgggatcttttcgagtcgtacggatttccgttgcacccgcgcacgctttgagcgttgaacgaaggaagaggttcaccgggctggagaggcattgatctggcgtttttccagcgttgaatctgacagtctcgcgtgagcggctgcatgactgtgtttccagttgcgaccctggccggataggccgacttctcgataccccgcgcagagcgcagcccgccctgagtgacccattccagatatttccaagacgacggggttagacataaactgccacgcctttgtcgttgccctgtatagaagcccgagactagcctttgatcgtcgctgccaactcagcgatcgggtttggtcgcccgactttgatacaggcgcaacgatatggagttcaatcatgcgcgctggcaaatcatctgcagattgctgtttttctaatctcctttccctgcccaattactcccgctttccaagagcaaagggaggtgggttatgagcacctcgacctctgtcaaaaccctcggcttcgtcaccttcggcccttgcggcgatggcgagcaaaccttgtttcgcgtcaacgccgacgtacctctgcaccaagccctggaacacgcttcgaccctgctgtactacgccaaaaaactcgccctggatgcggcgatggaagagcagggcgaacgttacgcctgggccgcgcactttctggcggagatgggcaaggcggtgattgatgacatcgggctgggcttgagggaaggggaggtgctgaaggtttagtggagggatgttgcagagcgccgtttctgggtggcagggaagcggcgttttttaggggggttaccccgcatcgcactgtcgatttcccggagtctggttcgactatctttcagggaacgaagccaatgagtcgcaatgaccgtcggcgctcccaacctgagaacctttacgcggacgaaccaggagaagaccatgcgcaagcttatcgttgccgctttcatgagcctggatggtgttatccaggcgcccggcgggcccgaagaagataccagcggcgaatttcgcttcggtggctggatagtgccctacgccgatgaagccttcggtcgggccatccaggacctgttctcgcagccgttcgacttgctgctggggcggcgcacctacgacatattcgccgggtattggccgcacatacaggccggctcaagcaacagcgccatcgccgacctgttcaaccgcgtgcccaagcatgtggccacccatagtcccgacacccttgattggcacaacagccatgcgctgcaaggaaaccttgccgacgccatacataccctcaagcagcaggacggtgcccacctgttgacccagggcagcggcgatctggtgcgccaactgcttgtcgccgggttggtggatgagctgcggctgatgatccatcccatcgtattgggacgtggcaagcggttgttcgatgatcaggcacaagcttgggctttcactttggtgagctcgacgagtactcctggtggggtgttgattgcccactacgttcgtagtggtgaggtgcgcacagggacgtttgaagagtaggaaagaccgtgacggtgttggaaccctgcgcttcgggcgggtagttttctctggagtttcagggcgttggcctcggggcaaaaacggggcgattgtgaatgaccgctaacggccaatagcggccattcttgaccggcggcatctgacaaagcgacatccagaataatgaaacatttagcttctttttcgaaagctcaaggtactgtaggcatattcggattttcgcctgttcggatgaaagcgctatgagcgcaaatattgctaccgaacggcaaacatttcttgcagattgagctaccgtagggacgaaggggcgatgtcgaagcccagaaaaacgggtagaatcgcgcgccggctgtgactacatagcgcattttactagacgaattgattgggggcttgctcggattcctcgaaggggttcgaacggaaagaactatggcacgtggcgaattgatgaaaaagctgctggcaagctatggccgagacgaggagtttcgagctgttgcagagcagatcattctcgaagaagagcagaagaacaaccgcgttctcgccaggtctcttcgtcacacgcttgacaatgccacttcggcgaacgttcgttcaagcaaacagccaccttctcaaaagctggcttcgctaatcccatttcctgacgctggcgacgattttgttgatagagtcgatccagttcattctcacaaagacatcaccctttcgcacgctaatacacgcgtgttcgatggactcctccttgagtacaggcgctccgaagaaattcggcgacatgggttgcctgtgagatccaggcttttattctgcggtccgcctgggtgtggcaaaacactctgtgcagaggtgtttgcctctgagctcggtctacctctttttgtcgtaaaactcgaccgactaatctcctcatacctgggcgaaacagctggaaacgtacggaagatatttgagttcgccaagcgacaaccatgcgtccttttcctcgacgaattcgacgcattagctcgttcgcgtgacgactcagccgaacacaatgaattacgtcgggttgttaatagcctcctgttgttcattgatcgcatgcagccacgcggctttatgattgctgcgactaacttggatagttcactggatccggccatatggagacggttcgatgaagtgatatggtttgacaaaccaaaccaggcactaatcaaacgcttcctgaagaccaagttcaaaaatgtcgtaatcgactttgatttggataagtatgttgatcgtctggaaggctattcttttgcggagatagagcgaatctgccttcaaacgatcaaggcgcctctaattgttcgccgcaagggaatcgccgaatccgacttcaccgctgctattgcagacgaaagtcgtagaagggctggacgcgcaaggctctgaactagctaacgacaatcgaggtcaggatggcccgctacgatcatcttcgcttaattcgagttccgacggagctccctcgcaggaaaaagcctggctttggggcgccgatccctagatctcccggagagcacagtgctcggcttaccgatgagctaacgcaagcggttgatcaacaagtttctcgaaagcggccaggcattgtagatccgtcactcatcctcagggtgaggatgacggagggtttactggagcaagactggcataatgcgggattggagctcttatccagtgatcctgacaagtcgctagttctattctcgtccagcggcgacctcgctcattttcgtgcccaactggcggcgttcggtggcgatgtccccgccgggcagaaaaatcctccctatgcggggttcgtctcaggaattgagtccattggtacggtcgagccgcgcgatcgaataggcatgcgtctcaaaatagagggttttggcgatctggatgatattcatccagaggctcaaatgctgcttgatttagagatatggaacatcgggacaccccatgtacgaagcgcgaagctcgatgagctaacagaactcattgaagagcgaggcggtagtgtctacgaccggtacaacgggcccgcgatttcactgctgcgcatcgaagtaccaggacatcttctagttgaactcctttccgttgaagtcatagcagtcattgacttacctcctcagccagacacctttactcaagatgctctcgaacttaccttgacggacttccctcaagttgaaattttcgataacactccgatcattggaattctcgacagcggtattaacgcgcatccgttgctggaaggcatcgtagttggggctattggtgtacccgataatctgggtactgctgatgagttcggacatggaactagggtggcgggagttgctgcttttggagatttgcgaacccagttagccgaaggcggcgatttggtttgttcggcgcgtatatgctccgcgcgcgtcgtgaatcatcgtggtggatttgacgaccatagcctgataacaaatcaaatgcgcgatgcaataaccactttaaacggagattttggttgtaggatatttagcatctctctggctgatataaaaagcgcaccttacgctggtggtaaagtcggcccatggacagccaccttggatgagcttgctcgcgagctggatgttttgattttggtgtcggcaggtaatcgaatgccgcggcagggagagcgtcaagaggaaagtgtcactggatatccagagtatctcttagaatcttctaaccgttttctagagccgtcagcggcactcagcgtgctaaccattgggtctatcgctcatggaactggcattgatcaagcacgttatgaggatgcagttggagttcgaccgattactggtccttatgagccatcgccattctcccgcgccggccctggcattggaggggctataaaaccagatctggtagatcttgggggtacattgatttatgacccgcttaccggcccgcgctcaggatatgatcaaccaagcgcggggattcttacgttaaaccatcgctatctagaacagatgcttaggacagcttcaggcacttcatattccacacccatggccgccaataaagctgcccagctactgcagcgatttcccgaggcatcggcaaacctcctaaggtctcttttggttggagctgctacggtgccgaaccaagccaaacagcgtctgatccatttggccccagaggctatccgccatatctgcggtaacggatttattggtattgaaagagctgtttactccgatgacgcgcgtgtcgtcctgtatgcagaagaggccttagcactagacaattttgctgtcttcgaaatacctattcctgaacgttacctcaatcaaccaggcgatcgcacgataactgtcaccttggcatatgatccaccagtgcgacataccagagtcgactataccggtgtacatatgaatttccgcgtgcttcgtggcgtgcacctagatgaagtggtagaacacttccgcaggcgatccaaggaggaagggcccgccccccagattgccgcttccaaagtttgcgacatgaaccccgggccaaacttgcgagagaaaggcacggtgcagacaagctgcgtaacttttaagcgtggcgagctaactcagtacggagatacgtactaccttgtcgtccgctgtgagtctggttgggcccactttttaactgagcagcgatatgcggtcgtcgttgagattgcccatcacgctggaatgcagatttatcaacaagttgagcaacgtgtgcgtatccgcccacgaattgacctgagcctgtgaatatacctgtctcgtttatctttatcctacccgttggcaggcagcgtccggcccaaaaaacattaggatttatatatgactagccttaccgctgctgttttagcaacagctcttaaaccattcgtaagcgaagtatatcaaagcgcaaagcactcaataaaagataacttaaaaaaaatgagccttgctcaagtaagcaagaaaactgctgcgcaattgctcaagcttgataaagtcaagacgatatgggcccctgaattagaaatatccttgcaaaaattctatttcccttcaagactgatgattgcaggacgaccagccacaatatcaaagctgtccgaattgccaatgggtaatttagttattgaaggtattgtcggtcagggaaagtccatattcatgcgttacctcgcgatgtctagccttcatgataaagacagcataagcacagtgccaattctcgttgagctgagaaaaatcaccacagaacgaagcttagcagacattattcaaacccatctagatacgcttgcactcccgtgcgatatatttgcatttgattatttagcagaaacaggaaagataactctgttgctcgatggctttgatgaaattccaagcgagtgcgttagtgataccatttttgaaattgaaacaattcaagcaaagcactcgatgttgaaaataataatctcgagtcgaccaaaaagctcaattcaaaatgtcacaggctttggtgttttaaacctagttcagctaagtgacgacgattatgcaccattcctaagaaaacttatcagttctacaagtaagcgtttagaaataatcagagcgctgtctgagtgttcagctcatatatccggagttatttgcactccactaatgttaacattggtggttatagtgcatcaaacagaacaagaaataccgtctactcttcctgagtttttcgataagctgttcaacactgtttttagtaagcatgatcgttttaaagcgggttttgatagacagcaccactccggattatctgaaaacgagcttaagaaattatttgatgcgttttgttttatggtgattcaaggtcgtggtgggcggtcgttagctattgaagagtttaataagttttacgacaaagcgttgaactataccaagagtggcagttgcactgttgagcgctttaggaaagacatagtaaacatctcctgcttaatgttagatgaggggtatgacactacaacatttctacataaaagcattttggactatcacgctgcagctttcgtaaaagcactgccagacataacggcagaacgcttttacgacaccgcattcaactcatataatatttggaaatatccgctagagtttctggaggccattgacactacgcgatacttgaagtactacactcttaaaaatctttcaatgcaactatcaataattaccaagcttatcgcctcaaaagacgacaatgagcttattgtgtatcttgagactatacagcccgactttatgtactcggtggataaaaacttatcgtttatacaagccggccccttccatccgacaacgacgaagctaaacgatacaatatcggatcagctgctcgaggctgcaatgggctcagtagaagatacgaatgaggaaaaaatgaaatgggccattagcaatactcaagggttaggagtgtttgctgatggatccagtgacattagcattcgaactataataagagctttcggttcagacttgctctggcaaactcttcaaattctggagagcgatacgttgcgagagatagacagcgctgaaagatacttggccgagtttaacgaaaaaaatcagtttttagaagatatacttgctggaggctaatgagtgaacgattgagcggcaagtctgcccaagtgttagagtttaaatgaaattgtgttcgagcaccgtcttgctttttgggatagggtaggcgtgaaaaaaattaggttattataacggctgcgaaagcttcgtaatattttgtaccgctacaaactcgcgcagccagttactgataaattacagaatatggtgtcggttattcttattgtccttacattttaagttgcgaagctttgagccccataagatagacgcatgtgaattgttagccttttcttgcaaacgtctgattatggcggttacctgtcactctcgatcgtccgctaatggccgaaagcagcccttagaaaagttgcagttcttgacccatttctgcaggtcagatcttgtggatatgggcggacagcgctaagggataggtattctcagacagacgctcgacaggtaacctgagccccccaactgcgtagcaccgcgatggacatcaatctactgaatgaatccatgatcggccattggcgtattccctcgggtgtctggcaatgcgagctccagttcgggagccgattaatttacgtccaacatgacgatgatgagctaccccatgccaggcttatcgaggcgcaacgtgtggtcaacgccgcgtggactgatttgccccaagccctaaagtttgccgagcagcactgtaaaacgcagatgcctgagttgatgcggctttatgagactcatatgccgtgggagtctccgttgtatgtgtactcgatccacttcgatctcgactcaccttaccccggctataccatttccaagaaccttgatttcgattggggtcgtaccctggtcgatgaagacgacctgtgtatgagtcacaacgtctgcatgaagctgcatgagccaggggatgacttttggatttacatcaaacgcgtgggctttcagcaatttgagcctggctattagcctagtggtcgactatcaacccagggcctgttcctgaacttcgttgatcaggcacgctccccaatacaccaccactgaacttcaacctcatcatcgctttgggttacatcatgcccatgctcgatgaatgactcgggtatatccagggcaagcttgtggctcaggcttattggagcgagcgaattatgctgccccagaaaactcaggtagtactcacggtcatagaacacggttatttcactttggtgcagccagggccataccagtaggcaggcgacgcggtagtagccctggctgcgatccgcagcgcgggaaagatggttcgctgcttcgagcagttgctgaacgcaaaacgcctgcaattcgatacgtgcctgcggaccttcaacgagggtattgagcactggaattttccagtgcgtgtagcgctggcgttcatcaatgtgaggatagaactcaccgctaaagcccgcggcccagtactccaatgcgcggagacggcgggggatgcctcggagttttttgttactgaggagtaatcttcgcaagggatgtccttatgctgtgcggtgacactgacggtttgggtactcattgtaagctgctaaacgatcggcattttcgggagttgatattggaaatatccgctcttgaaagctgccaggcatgggctttcatttctgacggtttgcgcaaatagcctgatgtttttctgtgtggctcgacatcctttttagcgatccccggaaacggtccaaccacaatccctgcttcacccataccgaaaacacgagcggcaaaaaatcttgaaatagctcggcgaaataaccctataagccgtccgcccccttttctgcattctggcagcaaccgtcgagcgtccatcagttgcagttcatctgctgtccagtggtctcacgaacaggtctggctcttcgtgaagccctgaaatctggcacatcggacaacccggtgactaaagtgccctccacaagcggacactaaggattgcatggccttggcgagggccggcgggctgaccggcgttcgcacggttttccatggccctgccacttcgcggctattctctaatttcaggtcgatggcctaaagatccatgtccacgcctatggcctgatgtcctgcttgcccgggtaaacgcgcgtttctcagccttgctgagccgtgtcgggtgttgcttcgaggacgggcccctccagttcgagggcggttaatggcgcttcacggtgatcagggacgatgaccgtgagggcatgcatgcagtggcggccatggatatgagcgtcgggtcaacgaccggagaagaggcggcggactttttcgtgcagaccctggaacaggccaacgatgccgtggtgatcatcgatgatcgcaaccaggtggtgttcttcaacgcggcggccgaacgcttttggggctgtccacggtgcgaggtgctgggcagcgacgtcagcacgctggtgccgatccccatccgctcgcgaaacgacggcgagaccggggtcaacaagatcatcggcaccagccgcgatgtgtgcatcacgcgcaaggatggcgaagagcgctggggcgcgatggcgatctcgaaaatcactctgcaggggcgcattttgtatgccgcctttttcaaggacgtgacccagacgcggctcaaggatatcgagcagcgcttgctgtcgatgtcggtcaacgccagtagctcggccacctgcatcgtcgacgccgacggccggctgatctatatcaacgacgggctggtccgcttgctggggtatgcccgcgaggagttgctggagcgctcgccgcaggtgttcttcgtcgccgataccccgggccaggcccgggccgacgagctgcaattggagagcatcctcagtggccagccccatgaagcctgcgggctggtcagcaagcgcaacggccagcggctgtgggtgcaggtctgctcggcgccggtgttcgacgccggcgggcggatcggcaatatcgtcatcgtgttcaccgacatcacccgttccaggctgcccgaagtgctgcaggacaaggtcatcggcgccttgttgcaagagcagcccctggaacgcgtgttgacactgctgtgccaggaaatcgagcgcctggcgccggaggtcgtcgtctcgatcctcagcgtggacccacaggggttgctgcatcccctggccagtcccggcctgccggccgactattcccaagccatggagggactgccgatcgggcccgccgccggttcctgcggcaccgcggcctttcgcggcgagccggtgctggtcaccgatatcgacaccgatccgctgtgggccgattaccgtttgctggcgcagcgggccggggtgcgggcctgttggtcgatcccgctgcgcaacagcgccggcagggtgtgcgcgacctttgccctgtacttccgcgagcgccgcaagcccgataccacccatgcccatctgatcatgaccgggacccacctgtgcatgctggcgctggagcgcgaggaggcgcgccagtcgatccgccacatggccttgtccgatgccctgaccggcttgcccaatcgcagttccctgctggccgaggccaatcgcagcatcgccgaggtggccctggagcagggcgagttggcggtgctgtatgtcgacctggaccgcttcaagcaggtcaacgatgccctggggcatgcctcgggcgacgagctgctgcaggtcatgtcgcaacggctgcgcagcgtgctgcgcgagtcggacatcgtcggccggctgtcgagcgacgagttcgtgctggtgctgccccggatgaacgccacccgggtcacgacctttctcgaacgcctgatgccgaccctgggtgccccggccgatattgccgggaccgctgtggtgccctcggccagtgtcggcgtcagcctgtaccccagcgacggccaggatatggaaagcctgctgcattgcgccgatattgccatgtaccaggccaagcgtaccgagcgtggcggtttcaggttcttccttgaggagatggaccagctcgcccagcagcgtctgcagctggagacggcgctgcgccaggccctgaccagcgacggcctgcatctggtctatcaaccgcagatcgacttgcgcagcaacggcctggtcggggtcgaggcgctggcgcgctgggagcatccgcgcctgggcaatatcccacccgcgcaatttatcgcgctggccgaggagtgcgggttgatcaactacctcagccagtgggtgctgtgcgaagcctgcgagcaactggcgcgctggcgtcgatcgggcatcagggtgccgtccatctcggtcaacctgtcgccgatcaacttccacaacctcaacctggcggccctgatcgcccgccagttgcagcgttgcggcctgcagccggcggacctgtgcgtggaggtcacggagggcgttttcctgtgcagcagcccgaccaccgagcagaccctccaggacttgcataccctgggcgtgcgcctggccatcgacaactttggcgcgggatattccagcctgggctatctgcggcgcttgccgatcaacgagctgaagctggaccagagcttcgtcgaggagctggagcacgacgcctcctgccgcgccttgagcgaggcggtcatcggcatcggcaagggcctatccctgcgggtcatcgccgagggcattgaacaccccgcgcagcgcgacatcctgcaggcgcggggctatgacgtggggcagggccagctgttttcctcgcccttgccggcccgggcgttcgggcagtggtttgtgggttggcagagttagccggccggtcgatggggcagcgccgcgctccaggcggatgcgaagtggtccgcgacggacctgcgcacgaccctctcttttccttctttccagggccgctgcgggcattgcccggagccaggcatgggcgtggtcattcaaacactctgttctttaagtcaagttgttaacgtgtagggattttctgttttatgccgtggaaaaccaattaaacctgacggtttgttagatgtttagttgtgggtatttagtgtttctgcttattgggttttgtaactgttggcgtattccgtatgggactgatgtgattcgggaaaatcatttgtcagcggtatttttgtgggctttagtgggggtggaaaaacaattcgcgaacacttccaaacagcatgattcaatcatgggtggtttaaatataataagaaggtaagccatgacagactccacaaaagtgccggctgcgtgcgatacagcgggcgattttcataatgagaaaaccgccggcggactgaaaagaaccctgacgccccgccacctgaacatgatcgccatcggcggctgcatcggtaccgggctgttcgtcgcctcgggctcgaccattgcccagtccgggccgggcggcgcgctgctggcctttgtggtcatcggcgccatggtgttcttcctgatgaccagcctcggtgaactggcgtcctgcatgccggtcagcggttcgttctcgacttatgcctcgaagtatgtcgatgaaagtttcggcttcgccctgggctggaactactggtatgcctgggcggtgaccgttgcagtcgatctggtggccgcgcagatcatcatggcttattggtttccggaggtgccggggtatatctggagtgcggcttttctattgatcatcagcgcacttaatatggcctcggtgcgcttgttcggtgagtccgaatattggttcgccctgattaaagtcatcactatcctgctgtttatcacggtgggcattctgatgttgttcggcattctgagcggcggcgaaaatgccggccccaggctctggttgattggcgatgcgccgattgtcggcggcctgggggccctggtcggggtggcgatgatcgtggggttttcgttccagggcaccgagttcgtcggcatcgccgccggtgaaacccgggaccccgggaaaaacgtgccgcgcgcggtgcggcagatcttctggcggatcctgctgttctacgtgctgaccatcctgatcatcggcctgttgattccttacaacgacccgagcctgttgaggaatggggtgtccgatatccgtgtcagccccttcaccctgatcttcgaacgggccgacatgctcggcgcggccgcggtgatgaacgcggtgatcctgacctcggtgctgtccgccgggaactccggcatgtacgcctcctcgcggatgctctacagcctggccctggagggcaaggcgccggcgatcttcgcccgtttgagcgcatccggcaccccacggtgggcgctgctggccacggccacggtggcggccttgtgcttcctgaccttcatcttcagcccggggcagatctataactggctgctcaacacctcgggcatgctcggctttatcgcctggctgggcatcgcggtcagccactaccggtttcgtcgcggttatgtgcgccagggccatgacctgggcaatctgccttatgtgtcgcggttctttccgttcgggccgattttcgcctttgtcttgtgcctgttcgtcaccctggggcagaactatcaagccctgctcggcgactcgatcgattgggccgggctgaccgccacctatattggcctggtgctattcctggcgatctggctggcgcacaaagtcatcagtggctccaggtttgtccggttcgatgacatgagcttttcgatgattcgcaacaagtccgagccttgcccgccgctggagtcggctatgaatgagaatgcgggtcttcctgtgcgaatgacccaggtcggagccaagtgatgagtcaggattttctcgaaagttattaccaagccacggttgaaaagaccgcctatccggcgcttggcggccgggtggaaacccgggtgtgcattctgggcggcgggctggccgggctgtccacggcgctgggtttggccgaacgcggggtgaccgacgtggtggtgctggaatcccacaccgtggggcacggcgcctcggggcgcaacggcggttttgtattcggcggctattgcctgggcaatgccgagctgctcaaggccctgggctgggaggaagcgcggcggctctaccggctgaccatcgacgcggtcgaactgatccgccagcgcgtccggcaatacggtatccagtgcgacctgaccgacaggggcgtgctgctggccaactggttcaacgacccggcgcgtctggaaaagcctcggcagctgatgaaggaggtctacggcgtcgactggcagtacgtaccgccgggcgagttgcgggaaaagctcaagaccgagcgctatttcggcgccttgttcgagagcaatgcctttcacttccacccgctcaagtatgtgtatggcgtggccgcggctgtggcggggcatggcatcgatatccacgaacactccgcggccctggcgatcgagcagcagggcggcaagtacctggtcagggccgcgggtggcgaagtcctggccgagcaggtggtgttcgccgcaggtggttatgcccgtgggctataccggccggtggagcgggcgacgctgccgattgccacctatgtggtggcgaccgaacccctgggcgagcgtttgcgggaagcgatcaactgcgagtcggccatttacgacacccggtttgccttcgactattaccgcccgctggcggacagccggatcctctggggcgggcgcatttccatcctcaatcgtggcccgcaggcgatcgccggcttgctcaaagcggatctggtcacggtctacccgcaactggccgacgtccagatcgagtattcctggggtgggctgatgagctacggccgccagcagatggcgcagatcggccaggatgacaacggcgtgtggcatgccgtggggttcggcggtcacggcatggcgccgaccacggtggcgggggaagtgctggcggatgccatcgccaaggccatccccattccccagggctttggcaagttcggcctggtgcccacctttggcctggccggtctggtcgcggcgcaggcgacctataccgcctatcaggccctggatgcctacgatgcccaccgtttgaacaaatgaccgcagcttctcccgggccatacaggtcatggagcaatctcagcgttttctggcccaaaccccggaatgaacttatgctggcgggcaaatctgcactcattgaaaacccaaggcgtgacgcgaggacgttccgagcgtctacgacttgaacaagtgacgctgctgcagcccgtattggctcttggcatattgaaattgggagattgtgtatggtcatcaaaccccgcgttcgcggctttatctgtgtgacgacccacccggtcggttgcgaagccaacgtcaagcaacagatcgattacgtcaccgaacaaggcaccatcgacgctgggccaaagaacgtactggtgctcggcgcttccaccggctacggcctggccgcacgtatcaccgccgccttcggttgcggcgccaacaccctgggtgtgttcttcgagcgcggcagcgttgacggcaagctcggcaccgccggctggtacaacaccgcggccttccacaagttcgccgaagaaaaaggcctgtacgccaagagcatcaacggcgacgccttctccgacgaagtcaagcgccagaccatcgaaaccatcaagcgtgacctgggcaagatcgacctggtggtctacagcctggccgctccgcgccgtacccacccgaaaaccggcgaagtcctgagctcgaccctcaagccgctgggcaaatcggtgaccctgcgcggtgtcgacaccgacaaggaaatcgttaaggaaaccaccctgcagccagccacccaggaagaaatcgacggcaccgtggccgtgatgggcggcgaagactggcagatgtggatcgacgcgctgcacgaagccggcgtcctggccgaaggcgcgaaaaccaccgccttcacctacctgggcgagaagctgacccacgacatctactggaacggttccatcggcgaagccaagaaggacctggaccagaaagtcatcggcatccgcaaggaactgtcggacctgggcggcgacgcgcgggtatcggtgctcaaggccgtggtgacccaggccagctcggcgatcccgatcatgccgctgtacctgtcgctgctgttcaaggtcatgaaagagcagggcagtcacgaaggttgcatcgagcaggtctacggtctgtacaaggacagcctgtacaacccgaacccgatcatcgaccaggaaggccgcctgcgtgccgactacaaggaactggaacctgctgtccaggaccgcgtgaagcagctgtgggatgaagtcaccagcgaaaacctctaccagatgaccaacttcgccggctacaagcaggaattcctgcgcctgttcggcttcgagatcgacggcgtcgactatgaagccgatgtcgatccggacgtgaagatcgccaacctgatccaggtgtaagcgaacttaacgcatcattgccaacgcccctcccatgaggggcgttgtcgtttctgcccgggctgtgcgcaggttcaggccgctgcctgccaacggtcggcctgggccgggatcgacatctggcgcatcactcgtgttgaatgtcggcccattgccaagggggaagaccatgcaagccgcacccgtgcgcatcaccgccgaggagatgctctccgacaactggtacctgctgaagaaatacagcttcgacctgcggcgccgcgacggcagctggcaggcgcagacccgcgaggtctacgaccgcggcaatggcgcgaccatcctgctgtacaaccgcgagcggtgcacggtgctgctgatccgccagttccgcatgccgacctacgtcaacgaccacagcggctacctgatcgagaccgccgccggcttgctggacaatgccagcccggaggagcgcatccgcctggaagccgaagaggaaaccggctaccgcgtcggcgcggtggagaaggtctatgaagccttcatgagccccggctcggtcaccgagcgcatccactttttcatcggcgaatactcccccgacgaccgcatcggcgacgggggcggcctggaggaagagggcgaggacatcgaggtgctggagctgggttaccagcaggcgctggacatggtgcgcagcggcgagatcgtcgacggcaagaccatcatgctcctgcaatacctggaactgcgcctgatgccgccgcgccgcctgacgatcctagtggccgcgccccggtactcggcaaccgacaatgcggcggcgctggcgcagcaggtcgccagcctggacgactgtgccgcgcggctgttcgaggccgggcacagccctgtgttcggccagtggctggggttggcggcgggtgattcgggcgctgccgacgagttccaggcgcgtgcgcggcagcagttgcagcgttgcgacgcgctgctgcgcatcggcggcgcctgcacccgtgccgatgccctggtcgccatgggtgagcaattgggcttgccggtctaccgttcgctgcaggacatcccgcgttgcacttcggccagttgagccagcgctcaacaggccggctggccgacggccttgtatcggagtgtgtatcggcccgctgctgatacacctgcttgtcctggcgccggttgcgcacacaacccggatacaccccgaggattaactacgtccacccgccagcaccgagcttctcggtgtcggtggcgggaaccgttaatcaatccatcgaaggggtatcagcatgttcaaactctccaatgtttccaacgtcgcgctcggcctggcgctggtcggcggcctgggcctgtccaccgccgcttcggcgctgagcatgaccgagctgtcccagggctacacactggccgcggccgacggggtcaagacctccaccgaaggcaagtgcggcgaagacaagttcgccaagaccgacactaaccacgacggcaaggtctcccgcgaggagttcatcgccgccgcccccgagcgcgctgccgagttcgacaagatcgacgccaaccacgatggcgccatcagcctgagcgaagccaagcagtacctggcggccaaggccggttcggccgaaggcaaatgtggcgaaggcaagtgcggtgcggcgatcgagtcctgatcgacggtggcggggggcatccgggtgccccccggttttttccggggcaaccaggagactggcccatgcaaccctctcacagcgtgttatctgcccaggctccgcggctgcccgtttcggcaaccgtggggcttggcttgcgtcgtgccttgctcgactcattgcatacggcgcctgcgggcgcttttgactttctggaactggcgccggaaaactggatcggcatcggcggtgcccatggcaccgcgttgcgcgccctggccgagcgctacccgttgagctgccacgggctgtcgttgtccctcggcggcccggcaccgctggacctggggttcctgcgggaagtgcggcaattcctcgaccgctttgaggtgccgttgtacagcgaacacctgagctactgcggcgacgacgggcacctctacgacctgctgccgctgccgttcaccgaagaggcggtgcgccatgtcgcggcgcgcatccgccaggcccaggaggtgctgggccggcgtctggcggtggagaatgtctcgtactatgccgcgccgcgccaggacatggacgagctggccttcaccaacgcggtgctggccgaagccgattgcgacctgttgctggacgtcaacaacctctacgtcaactcggtgaaccacggcttcgagccccaggcctttctcgccggcctgccgccagaacgggtggtggcgatgcacgtggccgggcactacgaccagtccgacaacctgaagatcgacacccacggtgcgccggtcaaagcggtggtctgggccttgctggcgcgcgcctatgagttgtttggcgtgcaaccgaccctgctggaacgggacttcaacttcccgccattcgccgagctgctgggcgagctggacagcatccgccagttgcaggccagtgcctgccagatgcaggggaggctggcccatggataagccgctgatcgccctcgacgcccagcaacaggccctgaccgcctacttgcgcgaccccgagcaccgggcgccgcccgccgggatggaccgcgcgcgggcggaaatttaccgcgagctggtgttcgacaacctgcagtcgttgctcagcggtacttttccggtgctgcgttcggtgctcggcgagacggactggcgccggctgctacgggtgttcctgcgtgagcaccgctgtgccacgccaaagttcggcgagatcgccggtgaattcgtggcctggatggcttccacgcccgccggtttgcaggacggcagttggccggccttcatggtcgaactgagccattacgagtggatcgaaatggccctgcaacagaccgaggccgaaccgctgctggccagcgacccggagcggctgctgacccagcccttgcgcctgtcgcccctggcctggccgctggcctacgcctggccggtgcagcacctgggaccggcctggcgtcccagcgagcccggggcagcaccgaccttgttgctgatctaccgcgatgccggctaccgcgtgcgcttctctgaactcagcccgctggcctggcgcctgctggagcgtatcgaggcgttcccccaactccacggtcgcgcccagttgcaaggcctggcccgggaagcgggcatcgacgacctcgacacctttctcgccaatggcctgaacctgctgcgacagctgcacgaccaagccgttatcggcccaatgtagccgctggcgcagcctgcgctcggcggcgtagccgtcgtaaaacctggttgcacgttctccctggcacaccgcgttgcctgggttcgcgtctgctgcgcagccgatcgcaggctgcgccagcggctacggggatatgtgcctgttatcgaacttccgccgtagaaacgccaaagccgcagctcaagctgcggctgctttgcagcaatcgggcggttcaatccgatacgtgcttgaacagatgccggctccagccgttattggcccgatgtagccgctggcgcagcctgcgatcggcggcgtagccgtcgtaaaacctggttgcacattctccctggcacaccgcgttgcctgggtttacgtctgctgcgcagccgagcgcaggctgcgccagcggctacgggaatatgcgtctgttatcaagcttttccccagtagaaacaccaaagccgcagctcacgctgcggcttttttctgccccgaggcatcagcttccgtgtcgcaggcgcccgatcaatgcatccaggctgagtttgcccgggccctggaatagcagcggcagcagcgccgccaggtagatcaccggcagtttgaagttgccgtggcccttgttgctgatggcgtatccctgggccagttcactgaggcttgaccagtcggccggccagtgcacggcggcggtggcgaccactgtgaccacgatcagcaccagcgcggcgcagcgggtgcccaggcccagcagcagcgccagggggcacagcagctcggcccacatcgacagctgccagttcaggctcgccggcaactggtcgaagggaaaggggaaggcggactggatctgctggaaccagttttccccgcgccatttttccaggcccgactcgagaaactcccaggccagcaacaggcgcaggctgaggagcgcgacccagggggacaggcgattgaggtggcgttgcagcccgtcgagggcggacgaaagcgtgaggatcatggggtggatctcctgggcaaagtggggggcattacaaaagcggcgccgcctgcgccagcggctatcggggcggcatcagctcagcgcgggttcagggcctggcgttgccgacgtttgttggcctgggccagcttgcccagcaggttgatcgtcatggccgagcaggtgagcgtgaaaggcagcaggtaccaggcgctcaaggggatgcgtttgaaattggagaaagcgaatatcgcggcgatcacccacatgccggtggtgtgcaagcgtttccaggccgtgcggctgagcagcgaggccgggcctttgaacgaggtcagggtcagcagcaggataaacaggtaacccacggacccgggcaggttgcccagggtgctgcggccgggccagaactccgggttcagttgcccgtagctgtagatcagcagcgcgtgcaccaggtgcgagaaggcgaacgccaggccgatgaaacggcgctcgcgcaccagggcctggcccagcggcgagggcagcagcacggcgaatgccgaggcagtgaaggccagcagaaacagcacgaaggacgaacgcgcggtggcgcggatggcgctgcgggtggcctcgaccaggttcggctcgagcagcagcaccagcgcggtcatcagcagcacggcggcggccagcaggctgaacagccgccagccgtggaaacgcgagggaagggattgtgtgggcatgagaggctccttgaggttgggcgccgctgccgcggcgcgtcccaggagtcttgcaaggccatgtatatcggctgtgtcggcgaggggcggttatgtatgcctgtgtagcgaggcgctcagaggctggccttgttgctgaccaggatcagctccgcgcacaggccgccgccctggcgattgctcaggcgcagcgagccacccagggccaccgccagttgctgggcgatggccagccccaggccggtgccgccggtgtcgcgattgcgcgagctttccacccgatagaacggcttgagcacttcggccagttgctcttcgctgatccccgggccgcggtccaggaccttgaccgacaggcgatcgccggcttgtgcctggacttcgatccgcgccgcgccagagaacttcagcgcgttgtccaccaggttcaccagcacccggcgcagggcgtgggggcgggtgtcgatcagcgcgccgttcttgccggccagctcgacgtcctggccggtgtcctggtagtcgaacaccaggctgtcgagaaacgcgtccaggtcgatgcggcaactggcctcggtggcgccatggatgctgcgggcataggccacgccttcgcgcaccaggtgttccatttcactcaggtcgttccacagcttgtccttctcggtggagtcgtccatgaactcggcgcgcagtttcatgcgggtgatcggcgtctgcaggtcgtgggaaatcgccgccagcagttgcatgcgctccttgaggtaggcgccgatccgcgcctgcagggcattgaaggccttggccgcgtgcaccacttcgatcgggcccttttcgtccaggtgtacgccgtgggtgttggggtcgaggctgtccaccgcctgggccagccgggtcagcgggcgcacggcgatgcgtaccgccagccaggcgcagaggatcagcaccagcaactgccccagcaacactgccggcaaccagggcgatatcggcgtcatcgccgggcgcacgtcgatggtcagcgggctgccgtcggccagttgcaggtgggcctgatagtgctggcgcggtccggggatggtgttgaatgtcaggtggtagtcgccgccaatggcgttcttgatcgagtacaccgagaccggtacatcggcgctgtccatgggctggccgggttcgccggcgctgagcaggtagccatagttgcgccgttgcagacgttgcagccaggcggggcgctcggcggcgggcaggcggtcgaggatggcgatggaggtggcgacgtcgctctccaggttgccgagcatggtcatcttcgcgctctggtagcgctcgtaggactgcgcggcgaacgacaggccctgggccagcgccaggccgatcaggaaaatcagcgacagtcgcgaggcgagggtgcgcggccagtgcaacgcaagcttcatgacgcggcctcgaggatctccaccggcagcgagaacacataaccctcgctgcgcacggtcttgatgtaggccggttcgcgggcgtcgtccagcaggcgctggcgcaggcggctgaccagcaggtcgatggagcggtcgaacaggtcggcgtcgcggccctgggtcaggttgagcagctggtcgcggttgagtacccgttgcgggtggtcgaggaacacccgcagcagccggtattcggcgccgctcagggcgaccagggtgccgtcctggtccagcagatggcgcgcggtggtgtccaggcgccagcggccgaagcccagcaggcggccgctctcggtgaccaccaggttcggcggcagcatgcgcgtgcggcgcagcacggcattgatccgcgccagcagctcgcgggcggcgaagggcttgaccaggtaatcgtcggcgcccatctccaggccgatgatgcggtcggtctcgtcgttgcgcgcggtcagcatcagcaccggcgtggccttgtgcttgccggcacgcagctcgcggcacagcagcaggccgtcgtcgccgggcagcatgatgtcgagcacgatcaggtccaccggggtggtttccaggaagctgcgcatctgcctgccgtcagccactaccgtggtgcgcaggccgttctttttcaggtagttgcctaccagctctctgatttcgcggtcgtcatcgactatcaatacgtgatcgacatgatccatggggctgcctctgtatagggtcgtgctgcctagtctatagggcccgggcgggcttgcctgcggcgctttgtattgcagtgtatctggcgccttgttgaacacacggcgatgcaaaacagggtttttccgacgcctttgtatcgctgtgtatcccccggcggtgtggatacgcagggaaaccgcaagggcggtttgccgacacaagcgcgataccttgcgcgcattcaatgggctccatcgaggcacagccactggcctcgccaccaaaacccattgttgcccgaggaaaccatcatgcaacgcaccgccctctacgctgcctgcctgttcgccgcgctgaatatctgcaccctgtcggcccgtgccgaaagcacggtacaggcccggacctacagctacggcaccccgctggatatccagaaagtcctgtcgatgaccgaagacgccgagccgagctgtggcgtggtcaatgcccgcatgacctacctcgattcccagggccgtacccaggccctggattaccgcaagttcgccaacaactgtaacgacggcaactgagtgcactcacttgtcatgtagtccctgttgaacatgaggatcagcccatgaacaccctgaaaacctgcctgcttgccctgaccttgaccctggccggcgtggccgtggatgccagcgccgccgactcgtcctgcacgacctgcttccagcttgcgcccttgagccagggcggccagccagagcgagcggcgccgctgctcgccgaaggcggctacgagcgcaccccgcaggggatgcgcgccgacaaccaggcctgaaccgggcctgccacccctggatacgcccgccatcgatggtgggcggaacattgaccgatcacaggtgatgccatgttgctcatagcgtttctcggcggggtcctgaccatcctcagcccctgcattcttccggtggtgccgttcctgttcgcccgggccgaccgctcgcgcggctcggtgctgctgaccctcggcggcatggcgctgacctttgccctggtgtcgagcctggcggtggtcggcagcgactggatcgtccgggccaacggcatcgggcgccagctggcgctgattgtgctggggctgttcgcgttgtcgctgatctttgcccgcttcggcaactggctggcgcggccctgggtcagcctgggcaatcgcctggacggcctgcgcctcgatcaggcgcgcaagttctccgggcccttggcggcactgttgctgggggtggccaccggcttgctctgggcgccctgtgccgggccgattctcggggtgatcctgaccggcgccatgctgcaaggggcgagcgcccagaccagcctgttgctgctggcctacggcctgggcagtgccctgtccctggggctgctgatctttgccggaagagggctggtcaaccggctcaagccgtccctgccggccaccgcctggttgcgccgtgccgccggttgcctggtgttgctggcggccgtggcgatcggcagcggggtggacgaccgcctgttggccagcacctcgtcccaaggcggcgcggccctcgagcaaggcctgctgaagagcgtgcccaaggccctggactacctgatcgacaaggctggcgcggcacccgccgagacgctgccgagcaagggcccgatgccttcgctgagtggcgcggtgcaatggttgaattcgccgccgctggacgccgaggccttgcgcggcaaggtggtgctggtggacttctggacctacgactgcatcaactgccagcacagcctgccgtatgtgaacgcctgggcgaaaaagtacgccaaggacgggctggtggtgatcggcgtgcacaccccggaatacgccttcgaaaaggtcatcgacaacgtcaaggcccaggtgcgcaagctggatatcggctacccggtggccatcgataacgactatgcgatctggcgtgccttcgacaaccagtactggccggcccactactttatcgacgcccgcggccaggtgcgctacagccactttggcgagggcagttacgagacgcaggaacaggtgatccagcagctgttgcgcgaagccaaggcgccttgaggggccgggttgccgattgggggccgggcggtggggcaggcacaccgcgttcttcagagcgcaagccagcccctacaaccaccagcgcagcaggaaaaagaacgccatgctcagcagcatgctgaccagggtgttgcgggtgtagatcaccagcacgatggccaccagcgagctgatcaggtacgggttgtcgtaggccaggttcagctggtgctcgggcatgaacacgatcggcccgcagatcgcggtgagcatgcccggtacggcaaagccgaggaactgccgggcgttgctgctcaggcgcaccggcaggcgcggttcgagaaacacgtaacggttgagaaacaccagcaagcccatgccgaaaatcactgcccagaccatcatgtgcgctcccggtagaacttgttgcagagaaaacccgcggtcatgcccagcaggcccaacagcaccagggccgagccccattgccagtagctgaacaacaccgagcagaacagcgacaccgccacgcagaccatggtcggcacgttgcgcaccagcggcgtgatcagggcgataaaggtggcggcgatggagaagtccaggcccaggtgttcgagcccggggatggcgcgcccgaggacgatgccggcgagggtgaacaggttccaggcgatatagaacgtcagacccacgccgagggcgtaccagcggtcgaactgctgcttgtcgtgctggctggtcagggcgaacagctcatcggtgagcaggaaccccaggccgacccgccagcgccctggtagcggcgaaatcaccgaacgcatgctcatgccgtacagcaggtgctgggaggtcagcagcagggtggtgagcaggatcgagaaaatccccgcgccgcccttgagcatgccgatcgccaccagttgcgcggcgccggcgaagacgatgctcgacaagccctggccttgcaggggcgtgagattggcctcgatggccatggaacccgccagcaacccccagggcgcggtggccagggacagcggcaggatggcaacggcaccgcgcaggaacgcggtgcggggaagaacaatgctggacatgacagcctgcaatcaaggaacgggagccgactgtgccagcccgcgacggaaatggcttgaacgatcttgcgcacttggcgccaacgaccgtttttattgcctggcccaggtttgcctctgtaggagcggccggtcgacgctcgattgtcggcgattggggcagcgcggtgtgcctgacacaccgcttcgcgagcaagcttcgctcctacagaagcgagtgtttgccacaaatcccgcattcgcctggtcattgcgtagacgctgcctgctggccatggcgccaacccgatctgtctgctacaacgcttcgctagcatcgaccggcttcttccctggagaagccggcctgtcatcttcctgcaacagccccgtgccaagaagggtgtctggccgctatcggctaggtcactacggggccgttcacccactgccccatcccaaggagagggtctatgagaaaactgtttgcaaccgcggcactggccgcgctgatgatctgcaccgtcggggtcagccaggcacgggaggcgcgacagcagcgcgactcggtcgccggggtgttcgactactacctgctgtcgctgtcctggtcgccgaccttttgcctgacccatccggaaaacgagcagtgctccggcaagggttacggttttgtcctgcacggcctgtggccgcaatacgccaagggcggctggccgcagtcctgcccgcccttgacgcagttgaacgccgaagagcgggccaagggcctgaccctattcccgacggccaagctgatggagcacgaatggagcaagcacggcacctgcagcgggctgggcgccatgggctacctggagacctccgaccaggccctgggcaaggtgaagattcccgaggtgctggaaccttcgaccaccgtgcattacttcgaggcccgggagatcgagcagttgttccgccaggccaacccgggcattccggagaagggcgtagcggtgttgtgcagcggcccggaactctctgaagtgcgggtctgcctggacaagaacctggggttcggcgcctgtggcaagggcgtgcgcacccagtgccgccaaggcgatatccgcattccgccgattcgctgaccggcgagcggccaggggggaggcggcataggctggcctgagcatctagggttacaagacgcccgtcttcatccaaggagcccatgatgctgcatatccgcacccccctgatcctgcatcccgggttgtccacggccacccggcgtatctggctcaagctggaaaacctgcaacccagtggctcgttcaagatgcgcggcctgggcctgctctgtacccaggcggcgcagcagggcaagcgccgcgtggtctgtccgtccggcggcaatgccgggctggccacggcgatggcggcggccagccttggcctgcaagcctgcatcgtggtgccgcagaccaccgcgcaaaccacccgcgaacgcatcgcccggaccggcgccgaggtgctggtgcatggccaggtctgggatgaagccaacgaacgcgcgctgcaactgagcagcgctgccgacagcgaatacgtgccggccttcgaccacccggtgctgtggcaagggcacagcagcatggtcgatgaaatcctcgaagactgtccgcaggtcgacaccatagtggcgtcggtgggcggtggaggcttgctggccggcatcctcaccggcctgctgcgccaccagcgccaggactgccggatcatcgcctgtgaaaccaccggcagcgcttccttcgccgcggggctggcggccgggcacccggtcaaattggcgaagatcgacaccgtcgccagttccctcggcgcggcccaggtggcggcctggccgttgcagcagatccagggttttccttatcagtcgctggtgttgtcggatgccgaggcgatcctcggcgtggtgcgttatgccgacgatctgcgccagttggtggagccggcctgcggcgtctcgctggcggtggcctacctcgatcacccggccatcgccgcggcgcgggacgtggtgatcgtggtgtgcggcggcgtcagcatcagcgctcgccaggtggcggactggggcgtatcgatgccgggctgaaagccctggtgtatgctggccgacctgttgtacctgtggttttacggagggttcggatggacgccaccacattgtttctgtacgtcgtcaccgtcagcgcggtgatgatgaccccggggccgtcgatgctgctggcgctcaataacggtgccacccatggcatgcgcatcgccgggtgcggcatggctggcgcgatgctgtccgacctgctgctgatcggtgcggtgggctgcggcctgggggcgttgctgcaagcttccgagcagctgttttccatcgtcaagtggggcggtgcggcgtacctgttgtacctggcgtgggtgctgtggaaggcgccgacaacggcgctggccgcgcagagcggcggcgctgccagcagcgggcgcggggcgttcatgcgctcattgctggtggggttgtcgaaccccaaggggttgctgtttttctctgccttcctgccgcagtttgtgcgccccgaccagccggtggcgcagcagtacctgatcctggcgctggtcagcacagcgatcaattgcgtgatgatggcgacctacgcttttggcgggcgctatgccatgcgcaccttctccgcgcgggcgatgctgtggatcaaccgcagctgcgccggcatgcttgcggtgctggcgctgggcctgagcctgtatcggcgcagcgatatccgctgagtctgcattacgccagcaagctggctcctacaggctttgcggcgagcgcggactcgcggcaggcgccgatcctgtaggagcgcagcttgctcgcgaggcggtgtgtcaggcacaccgcgttgtccctggcgcgacctttctgaaacagcctctagaacctcaaggtcgcgccgctggtcagccagcggtcgcggccttcgttcaactggccaccgagcaccaggtcgaggtccaggttcgcccccaggtgcagtcgtggcccggcttgccaggcctgctcgccgcagcgctggccgtaacgctcggcgaccagggtcaggcgttcgcccaggtcgtattcgaagccgccgccccaggtccagtggtggttctgctggccgtcgtcataggcgtgggcccagccggcgttgaggttcaggcgcaggctgtccaggggctgataggttagcggcaggccgatgtcgccaccgtcgaacgagtggttgcggttgagggcgaaatgcgcggacgtcgccaatgccagttgcaggcccaggtcctcgcggttccacagttgcgccttgagttgcgggctcagttgggtttccccgtggccgtcctcacggttgcgctcgagggcggcgcccagttgcagcctgggcaggccggcgaaggtgcaggccggggagaccaccgcgccatggcttgcgccgtggtggcgcaggctctggtaccagatatccaggttgcattctcccggggcgttgatcgcaccatcgtccaccacataggcgccgcccgcggcattggccttggcgaccagggtcagcaggccgatcaggctcagggtgaggccgacgaacatcaggttgcgccgcagcatgcgccgtttcgccgggggcaggtcgcgggtgaggctggcgaaacggttattgcgcgaagggctgtatttggacatgtcggttctcgctaaggcatgggcagcggccacgctgtgtgggccgctgcgtagtcgagtggggaagtagtcgagtggggaaaagggtcattgccagtcgctcactgacagggtctggatgcccgcggccctggccagggccaccagctcttcggtgtcgtcgccgccgggcagggcgatgaccatgtccggccggctgtcgcgcaacatgaaggcgttgcgcaggcgttcggcgagcttgccgtgcaactgccagttggccgggtaccgcacgatgtcggcgccgatttcccggccccagtcttctatttgtgcgccgaggaactggctgccgccgtggatcagcacctgcacttcatgcaggcgctgaaaggcgtcgagtacccgccggcacagctggacgtcggcgcagtggcgcccggcgcagatcaggacacgcatcgtgcggtctcctgcgccgtcggctggatgctcaacgggttgtccagcagcatttcgcccagttcggcgttatccaggtcgcgctcgccggcccgctccagcgccggataggccagggccgcgatgtggtggtgcacgcgccggtagtcgcgcagcacccgctggaaaatgtcgccggattcggcccaggccgtgcggtcctcgcgcaggctgcgaaagtgctcgcggctggcgtcggcttccagccgcctgaccagttccttgcggttcaccagttggtgggcgttggccaggtcttcgcgcaggaatacggtgatcgccaggctcaggctgtcgacacggcctggtgcaagggctcgatgcagtccagctcgaacaccgagaactgctcgccgcgccgcagccggcgcgccgccagttgggtcaggctgctggagaggatgtcgccggcgtgttccaggttgatcacgaacagcaggatttcctgggcgcggtcggcgtcctggtcgctgatgccgtcctggccgatatccgccaggtaggcgcggatcgcggcgctgagcaggtccagcgactggtcgatgcgccgcacctcatcggcgccggccggggtcgaggcctggaacaggcgcagcacccggtcgagcatcagcgacagcatgtcggccaggcgcagggcctcgcgggcggcgttggacaagccgatattggccaccgccaggccggcttcgtccaggtagtgcggcatgcccgggtcgacgtcgcgcggcggctccggcagcaggcggctgagcagcgtcgccatgggcccggtcaggccgatgaacagcagggccagcaccaggttgaacaggctgtgcaggtagaccacctgcaggctggcatcgagggcggcgaccggcgtgctctgggcgatccacggcaggcacggcagcagcacggcgacaccgctgaggcgcaccagcagattgcccaggggcaggcgccgggcgacgctggagtcggcattgagcagcgacggcagggcgccgccgatattgatccccagcaccagggccatggcggtcaccgaggacagcagcccggtggcggccagggacgccaccagcagcaccacggcgacgctggagtggcacagccaggtcagcagcgccgccgccagcagggcgatcagcaggtcgccgtcgaggccgcgcatcagcgcggcgaacaccggcgtgccttccacttcgcccagggtgccgccgagcatgcgcagggccagcagcatcaggcccaggccgatcagcgcgcagccgaggctttcaaaacgcgagtcgtcgcgcaggcgaaagacgataaagcccgccagcagcaccagcggcgtgaggatcgagatatcgacgctgagcagttgcaccaccagggtcgagccgatattggccccgagcatcaccgccagcgcgggggccaggcccagggtgccagtggcggtaaaggagctggccatcaggctcaccgcggtgctgctttgcaggaccccggtgatggcgatgccggacagcagggccatccagcggttgttcaggtgctgccccagccactggcgcaactgggtgccgaagccgcgcagcagcgccgaggaaatcatctgggtgccccacagcagcagggcgatggagccagcgaggttgatcagcagagtagttcccgacatgaggactctcccttgtgtgtttcatggcttggcggatcgcagcaggcggatgcagcggcgatgaagggcgctggcaaggcccagcagcaggcggatctcgaccccgctcagcaggccccgggcatatagccgcacgctggccttggtcagcagggtggcgatccgttccaggacgattaccagcagcgcgcgcaaggcgcgttcggccgatgacagcagctcgatgatcggtttcatgctgggtgctccacttgggcggggcccggtgtttgcgatacctggatgggcggtgcctggggtagcgccgctttgcggctatcgcgagcaagctcgctcctacaagggggtgtgttctgtaggagcgagcttgctcgcgatggcagcaaagcggaccgtcaggccctcagaaccattgcttgaagcgacggatgtagagggtcttcatggtctgggcgacgacgcagtagcacagcagggtgccgaccagccaagggaagtattcccacggcagcggtaccaggccgaccattgcacccagcggcgagaacggcacgtagatgcccagggccatcaccaggccggtcatcagcatcaccggcagcgccgcggtgctctggatgaacgggatcttctgggtccgcagcatgtgcaccaccagggtctgcgagagcaggccttcgatgaaccagccagactggaacagggcggccatttccacgctgttggcggcgaacacgaaccacatcagggcgaaggtggtgatgtcgaagatcgacgaggtcggcccgatccacagcatgaagcgcccgatgttcttggcgtcccacttgcgcggcttgcgcaggaactccttgtccatcttgtcccacggcagcgacagctgggagatgtcgtacatcaggttctgcagcagcaggtggatcgccagcatcggcaggaacggaatgaacgcactggccaccagcaccgagaacacgttgccgaagttggagctggcggtcatgttcaggtacttcatgatgttgccgaaggtctcgcggcccttgatcacgccttcttcgaggaccatcaggctcttttccaggaggatgatgtccgccgattccttggcgatgtcggtgccgctgtccaccgagataccgacgtcggcgtcgcgcagcgccggggcgtcgttgatgccgtcgccgaggaagcccacggtatgcccgttggcctgcagggccttgagcacccgggatttctgcagcggggtgagcttggcgaacaccgtgcgttcttccaccaggcgcgcgagcaccgcgtcgtccatgtgctcgatatcccgtccgagcagcggctggccgacttccaggccgacctcgcggcagatcttcgcggtgacgatcgggttgtcgccggtcaacaccttcaccgtcacgccgttttcgcgcagcgcggcgatggccgggccggcggtttccttgggcggatcgaggaaggtcaggaagccttcgatgatcagctcgcgctcgtcgctggcgctgtattgctggcgggtctgccccggcgccaggtcgcgggtgccgaccagcagcacgcggaaaccatcgcggttgtattcctcggccagctccagcagcgccgcccggcgcccggcgtcgagggccacggtgacgccgtcctggcgcacccgggtggcggtgtcgagcatctcctcgaccgcgcccttgcacaccagcaggtgatggccgctggcgtcggcgaggatcaccgagaggcgccgacggacgaaatcgaacggcagttcatcgaccttgctccaggcatcgggcgcgctgaacttcggattgttttcggcgtagctcaccaccgcgcggtccatcaggttcttcatgccgctctggtggtagctgttgagccaggccagttgcagcacctggtcgcagcggctgccgctgatatcgacgtggtgctcgaggatgatccggtcctgggtcagggtgccggtcttgtcggtgcacagcacgtccatggcgccgaagttctggatcgcgttgaggcgcttgaccaccaccttgcgcttggccatggctgcggcgcccttggccaggttggcgctgacgatcatcggcagcatttccggggtcaggccgacggccaccgccagggcgaacatgaaggcttcggcccagtcacccttggtgaaaccgttgatcagcagcaccaccggcaccatcaccagcatgaagcggatcagcagccagctgacgctgttcaccccgcggtcgaaggcggtctgggtccgcgagccgacgatggagcgcgccagggaaccgaagtaggtgcgcgatccggtggccaccaccaccgcggtggcggtgccgctgaccacgttggtgcccatgaagcagatgttcggcaggtcgagcaggtcctgctggtcggccgccgtgcggtgggcggatttctcctgcactgcgcccagggtgtcgtacttctccaccggcagcgcctcgccggtcagcaccgcctggctgatgaacaggtcgcgggattcgatcaggcggatatcggcgggaatcatgtcgccggccgacagttgcacgatgtcgccgaccaccaggtcgcgcatcggcacttcgcgcagctcggctttcatgcccatctgctcgcggcgcagcacggtggcggtggtccgcaccatggccttgagcgcctcggcggccttggccgagcggtattcctgccagaagcgcatcaggccgctgaccaggaccatgaccaggacgatgatcaccccggtcaggtcggtttcctcgccggcttgcaggggcagccagaagtcggtgaagaagctgatggcggtcagcgtcatcagcacatagatgaacgggttgttgaaggcttgcagcaactgcaccagggcatgcggcggccggtcgtgggccacttcgttgaagccgtcgcgctgcaggcggccttcggcgtcgagttcggtcaggccgttggcgttcgacttgacgttgtccagggtcacgccaaggctgttctgcgcttcgcgggcggcgcgcatcgacagccgggtgtcgtcgcgggtggggttttgcgaggaggcggtgcgggtttttaccgtagtcattacgtgtgctcctgccgcaggcttgcggcacgacacacagaccactcacctattcaaagacgagcgaacgtatgtcgagccgcaagtaagcgatcgattcaggtagttgcgttttattggttttaacgttcgccgcctattcaatgaatatgaacaggcgacgaacctactactggcttcgtccataataatgaccaccaacttttagttgtaagcaggcaataggaagttgccgaattccttattagggaaaacgttcaggaaggacttgaaagtgccttcgattgaactagaagtgcgagtcccgggacaggctcagcagcaggccggcctgcatgaggaggccggccaggctccgactctgagggtcctggctgtcgtcgaaactccagcgttgctggagccggcaggtgaccgggcagacgcgccagttggctcgcggccgggtttgcgaggagggggtggaatacagggtaccgacccgggaaacggccgcgcgctcagcgcagggcttgacccgcatggtcgatgcaaaggctcgtacgccgggcattacagtggatttgaagttcataacagttgcctcgcgaccggactggctccggtgaaggcaagttacgaaggagcgtcaagctctagcgcagctcacccgaccgaaaagtcgagtcccgtcatgttctgggttaagtgcccagccttgcgcaagcgcatcgaccagacagcgtctagatactgtgtccattggcttcttttgtgagttgaaaaaaggccggtttggccggcccgcgcaatttactcagggccacctgtcaagtcaagattaaattgccacgaatcatatgttcgttcagctttaagtaaggtctgtagcagaactcagataaatgatgggcaagttatataaggcagttctgaatgacgaccataacaatgctggagagagttattgtgctgtagccgttgagaaacaggccgaggcgcattgcgcgccccggcggatatatcagtcgaggatcaggtgcggcaggaagcggctggagtccttggtgatcaggctgtcgtcttcacgcacgccgataccggcggcctggtcgccgatgacccaggagccgatcagggtgtagctgtcgccaaagcgcggcagcggggcgaaggactgcaggatgtagggcgcgtcggtgtaggggccgtcttccttgaccacctcgtcctgcggggtgcgcaactcgatgttggcgccttcgcgggaaaagaacggtttgcgcacccagcccttgggcacctcgcgttgcggatgtgggtccaggtgggtctccagcaggttcgggtggcccgggtgggcctcccagagcagcggcaggatgcccttgttggagaggatggatttccacgccggttcgaagaactgcgtgtcgctggcggcgatcgccgcgccgaagggctcgtggaagatgaactcccaggcgtgcagcttgaacaggtgcgggatccagcggtcctgcaggtcgacgaagcggccttcggcggtgaggccgatgtcttccacgtcgatgtgccgcgactcgatgccggccttttccgcgatcaggcgcaggtagtcggtggtggcgcggtcctccaccgaatccttcatcgaggcgaagtagaacggtcgcgtgatccccagttgagcgaaagcctggtgcagccgggtgtcgatgctgttgaactggtcggcatgccgtggcagcaagccgcgctcgatgttctgctccagccagccccattggaacgccgcggtttcatagaggctggtgggcgtgtcgtagttgagctccagcagcttggccgggccctggccgttaataggaaaaactccaggcggccatagaggtgcgggtgaccctcgagccatgaagtacggatcatgtcgtagaaggccggcgggatgctcaggcgatcgagcagggcctcgctgcgcaccacccggtccaccaggtccatgcacatctcatggatctcggtggtcgggtcttccaggtcgtcctcgatctgcttgaggctgaactggtagtaggcgctttcgtcccagtaggcttcgccgtcgatggtgtggaacaggaagccgagtttttccgcggtctgtcgccagtccgggcgttcgttgcaggggatcttcttcatggcgcgcttccttagctgctcgagcgtcccgaactccagctcgaggagctggagccgccccagccgctgcgggcgctggcctggctgccgaagccgccgcgggaggtggaggaggccacggacatcggccgggtggtggtccggaagccgctgcccgactgcacctggcgtgacttggagaaggtcgagccgctggcgatgcgctggttgagcgtcgagttggcgtagctgccgcggtcatcgcgatagcggtagaccggctcggagtaatagttgcggttgccgccgctgagcaggttgccgatcagcaggccggtgagcaggccgctgtcattgctgctgaacgacgagctgcggccagcctcggggctgaccccggctgccgccagctgttcgcgggtgaaggcgccctgggcgttgatttcaaagccgccgagcttgggcacgaacttgccgttggagtccacctggcaccagttttcgacgaagtcggcatcgcagtcggcctggttgtcgtagaccggcgcctgggcgcggtgctccgccatggccttgatataggcatcggagcagacgtccacggcgatcttgccgtccacgcactcctgcaccgactggaagttgaatttctgctggaccgctagggtctccggctccgagttgcagcccgagatcgccagcgccaccgaggcggccagggagagctgaacgtattggcttcgtttcatcgagggctccgtgcggtcgatcagttctgcgaaggggtcatgcaggcggcgttgagcaggccgacgctgatggccacggcggcgacatagatgccggcggcgatttcaccgttgcggatgcgctgcgaagtgcccttgagcaccaggctggtcatcaggaacgccagcagttgcaccacggcggcgatcagcgcccagacggcgaagtccagcaggctgatggagtaggcgatgacattgctcgccgggatggcgaaaccgatgatggcgccgcccagggcgatggcggcggaaacgttgccctcgcggatcagctggaattccttgtgcggcgtcaggcgggtgtagacgaactggaacagggcgaacagcacggccgcgccgaggatgtaggtcaggaaaccgaccacggcgaatttgttcagggagatggaaagggcttcaagcatgggttctggtccttgtcagagggtttgcaggtcggtcatgtacagggaaataccgagggaggtcaccaggctgacggtgccgtcggtgtactgctccacggaaaacagcaggaactcgcggcgattggtcaggccggtgtcgcgggcatagagcatcgaatggctttcgaaggcgaaggtctcgtccggcttggacacctgctcgcgcagcggcaccagctcggtctgcccggcttcggtgccccattcgcgcaggtactcgacgccgtcgaggctgtaggtgggctggccgatcaggccggccaggcgccgcagctcggcttcgctgttgacggcctggttgctcaggtagttgaacaggatgatcgatttgacctggccgtcgatgccgccgctggtatgcacctgcagccagtagtcctcgtcgtccaggtagtagcgcgacagccattcggactggcccaggtccaccaggccttcgctgtagaccgcctggtcgccgggaatcgccacgcggctgttatcggcgagcagcagcttgaggctggcatcgaagcggatgcccgcgcccatgctcaggcccagtgggccggtggcgaaactcgagcttgtggtggccggggcctggagccccagaaagcgtttaaaccatcccattgtcgatgtccttgaggcgggtggaagcgatgtagaagagttcgccgccctggatccgcgtatcgctgtgcggcttgatctgcgggtgttgcgcgccgcgggcgcggtagccgatcagggtggcgttgtagcgttccttgaggtgtacgtagagctcggcgaaccggccctggtaagtctcgggcagacgcatgacgtattgggtggcgccctggccgacgcacagcagttcgttgatcaccaccgaggagcccgggtcctgggaggagcgcaccagcatctcgatggccatgctcgaggtgcactccagcttcggggcgtaggaggcggccagggtggcgatttcgctgtcgttgaagtgggcgaccacatggccgctggggcgcagctggttgatcgccagcacgctggccagggtcaggtcgtcggagctggtgcgcaccagcacccgttcggcgccgggcaccccggcgcgcaacagcagggccgcggacgacaggctttcgcccttgatgaaggcggccttgccctgcatcgggttctcgtcgaggcaggcgtcgcagatgacgatcaggttgtcgttggaggtttcgtcctgcagcagcaattcgatcacccgctcgctggacgcgccttcccagccgaccagcacggtatgcccggtcttgccggtgaagtcgcctttgcctttcatgccttttctccatacatcgataacgctgctggtggtcttgccgatggctgcggtcagcagcgcgatgccgccgagcatcacccacacggcgacgaacacccggccagcggcggattgtggcgacaggtcgccataacccacggtcagggtggtggtgaaatagaaatagatgaaggtcgcgggcgcggtgaggtgctgctcgcccagggccaccaggccgagataggaggtcgcggcatgcacgccgagcgcgatggccaggcccatccagccgaagcgctggaagaaggtggccgcgtatacccgaagcaagatgaaaatcgacatcgaatccctgatttcctgatgagcagatctatccgtgatgcagcgcgccgtgcccgagcaaggcatggctcattgccgcgcggcattagacatcggcttggcgccggataaaagcatttttgctgcgatgaaccccgcgaaggcgccaaagatgtgcccttcgaaggacaccccggcccgtggcaggaaccccaggaccaggccggaatacagaaacatcgtcaccgcggcggccagcaggctgctccagctgcgcaataaccatgcgcgggtgaggatgtaggcccacaggccgaagacccaggcgctggcgccaacgtggatgcccctgaagccgaacagccagaccagcgcgccgccgagcaggatgatgatcaggctgaccaccacgaagcgccgctggccttcggcgatcaccatggcgccgaggatcaggaagggcaccaggttggcggtcaggtgggtaaaggaaccgtggagaaagggcgaggcgagtatccccggcaacccctgcagggtacgcgggatcaggccgaagagattcaggctgtagccgctcaggctgttgagcacctgcacggcgatcattaccagggccaggcccgccagggtcttgaaaccatttgcaacggccatcgaggccctccaggaggccgaaaaaacacaggcgattcactgtaggagcgcagcttgctcgcgatggactggagggcgccgcgctcatccaggcagtacgcgacatcgttaacgaccatcgcgagcaagctgcgctcctacaggttgagtggtgcaacagcgctgtttactcggcagactgctgctttttcaggcgctcgaggatggcgttggcgctgccctggtccggcacgatgttggcttcgcgcaggcggcgttccagatcgttgccattgctcgaatcggccagttgctcctgggcttccatttccgccgcgcgctggtcttgcttggcctgcaggcggttcagggtgttgaccgcggtttccagcttgccgttggcgccgccgctggcgatcgaggcgctgacctgggctttctgcacgctctcgcgggccttggccatgtccacttgctggcgcaggctgcggatgcgcgcttcggccttgccgatgtccttgcgcatcttctcggcgtaggcgccgaattcgctggcttgcttttgttccgcttccaggccggtggtcagggtcgagatggcttcggcgacttccagggccaggtcttcgcggttggcctgcagggaagcgacggccttggattccaggtcggcgatcttcgcggtgaattcgctgactcgctccgaagacagcttgtgcttggccatgatggtgaccagttcgcgcttggcgttggacagggcgttgtcggcgtcgcggatttcctggtcgaggatgcgcagggcctgctggtcggcgatgctttcgccgacttcgttggcgccgccgcgcagggcggtgaacagtttgttccagatggactgagtcatgtaggtgtactccggattctcggcaatcagttgaagaagctttcgaaggcttcggtggcgcgttggacgttgtccaccagggtcttgacctcggtcaccacgttggtcaggttcgagctggcgctcagagcgccgaacatgttgtagacggtctggccgttgggcatggactcgatgccgatcgaggagagggggaacatctcccggctgcgcagcaccgcgtcattgaagcgggcgacgtcgttgatcgactccaggtccaccagcacggtgtcgacgatgatctgctcgccgaccaccgcgatgtagatcggcaggccgccgaagtcgtgcatttccagcttgatgcttggctcggcgccttgaatcaggctcaggccgatttcgttcgaggtcacttcgtccagggcctgcaaggcgctgaagaggcggtcgatggtccagttctcacctgcgatcatgtcattctccaataccggtgcgccgccgatcaggggttggcgcagcttcttctcaatgtgcttgagcacgctccggttttccggaagtacccaggtttcgtgtttcacataaccagcggcactcaggcccgcgcgcatctgcttcatgtagaagctcgacggcttcttggcggaagccttgctgggggccctgttgctggaggccttactgctggaagctttcgagcgctctccttgtcgactctctgaggaagccggtaggtcagcaggctgcctggccgggaggggctttttcatggggtgactccgttatgcacgtatcacgcgtgagaacattacaggggattttgttacgactcaatgactcacgcgtgatatttttttgctcggcgaagcaacggtcgcagggctctggagcggcattttgcgttaatcagccgactgccgtggctcaggggggcatgccggtgcctgggggctgggcgaggcttttcgggcctcgatcattgcccggacgatatcggggtgtggaatttatacagggtgcaggggtagccgtctgccgtgattggatgacagttgtaggcgtccccgacgagcgtgggaatgacccgggcccagaaatcccgggccggccggttgtcatcgatatggaagatctgccagtgcccgggcagcagctccagcagttgcgtcaccacctgccggccgatgccgcgaccgcgaaagcgccggaccacgaagaagtaggcgaggttgtactgcgcctcggcgaagtgcacctggtcgtcgactatggcaaagcccgccaactcgccgtcgacccgcagcagccagggacgggtgccgggctggcgccagtattcggtcttcggctggatctggaacagaccgtggcggccgagcttgagcggcagccactcgctgaattcgtacatgaagaactgcatcaggttttcgatgcattccagttcgtcgcgctgggccgggtgcagttcgatctggctcatggttccaggctccgggcaggttcatcaaggctgtagcgcgggtgggcgttgagggtgagcgcgtcgggcatgggatttgtccgtgagcgagggggtgtttttcttcaatacagggggcggcctgcgcacctaccttagtcaccggtctctccgattgatcctttgaaggtgtgtgatgagcgtagtgttttccatggcggccttcgcgctagcctcttcgattacccccggcccggtcaatatcgtggccctgagttccggcgcgcagttcggctttcgcgccagcctgcggcatgtcggtggcgcgaccctgggctttgtcctgctgctggtgctgatcggcctgggcctgcatgagctgttgcggctgtggccgttcctcacccgcggcatccagttgttcggggtggccttcctgctcttcatggcctggaagctggcggtggacgacggccggctgagcagcgatggccaggccaaggcgccgtcggcctggtacggcgcgatcatgcaatggctcaaccccaaggcctggctggcctgcgtcgccggcatgggggcctttgccgccaatggcgaggcgctgctggtgtggcagttcgcgctggtgtacttcgtgatctgctacctgtcgattgcctgctgggcctacgccgggacgtttttgcgccagtacctgagcaacccgaagggcatgcgcctgttcaaccgcagcatggcggcgctgctggcggcgagcgcggtgtatctgttgttgccttgaatcggcgttggctttatcgcgagcaagctcgctcctacagagatcgcgatctctgtaggagcgagcttcgctcgcgatgagggcgtcaggtctgtcaatcacccgcgatattgccccggcgtcgccgccaggtgctgcttgaaggcccgctggaagtgcgcctggtcggcgaagccggcttccagggccacatcggcgatcggctcgccgtcacgcaaccgggactgggcgaactgcacccgctggttgaccacgaacgcgtggggcgtcatgccgtaatgctgcttgaaggcgcggatcaggtaggacggcgacagctcggcggcctggcagatttcctccagcttcagcgagcgggtgcagtgttggcgaatgtagtcggcggcccgttgcagtttctggttgcgctcgcgtggcggccggcttgccgggttcaggcgctgctgcaggtcgctgaaaaacgccaccgtggcgttgtgcttgtgcagcgtctcggcctgttcgtccaccagcacttcatacaagcggttgagcccggcatagagttcggggtcatcactgtggggcgtggaaaaggcgcgaaagcccaggtcctggctgaagcccagctgatgctgcaggtcggtcagccaggaagtgtcgacatagagcatgagatacgaccagggctggtcgtcgatggggttgcaggcgtgcacttcgccggggttcatcagcaccacggtgccggcgccgatgcgaaattgcgcctgctcgtgcaggtaggtgctgtacccggcggtgatggcgccgatggaaaaatgctcgtgggcatgccgggcgtaacagaccttgcgcccgtcggcgatcgagcgggcctcgataaagggcagcgccgcatcgcgccagaactgcggggcggtatcggggctgtggctcaagctcggcttcatcaaaggcatcccatcggcaagcgtcggccaccgagtgtattagctctcgccggcgaaggctcgttccagcgcggcgatatcgagttttttcatctgcagcagggcctgcatcacccgctgcgacttggccgtgtcggggtcggtcatccagtggttcagcgcgcagggcacgatctgccaggacagcccgaacttgtctttgagccagccgcactgctgggcctcgggcgcgccgccgtaggacagggcgttccagaaatgatcgatttcgccctggttctggcagttgacctgcagcgagaccgcttcgttgaactggaacaccgggccgccgttgaggccggtgaaggtctgcccgtcgagctcgaaggacacggtcatcaccgagccttcggggcggccgtggaactcgaagccggccttgccgtagtgggtgagggcggtgatgcgcgagtgctcgaagaccgaacagtagaactgggcggcggcttcggcctggtggtcgaaccacaggcagggggtgatgcgatgaatgtgcgacatgacggttctcctcggcaggtgatccacgcttgagcaagcgtagtcagccgatagtcgtccggggttgccgtagatcgacaactcaccgcccttcatccgggggcggtgggcgcatgaccggcggtcgcagaatccgacctgttcggcaaactgcgcttagctgtatggaaaacctcgcggcgcgcgtaggccttcggccacagcgacaccgctccaggatcccgtgaatcctgtcccccctcggcctgaggagttgcgcatgctgacactcaatatcaatggcaaggaccagcagcttgaagtgcccgcggacatgccgctgctctgggtgctgcgcgatgtggcgcacctgaccggtaccaagttcggctgcggtatggcgcaatgcggcgcctgtaccgtgcatgtcgacggcgcgccgctgcgttcctgcgtgaccccggccgcgacagtggccaacgggcagaaaatcctcaccatcgaaggcctgtcggcggacggctcacacccggtgcagcgcgcctgggccgagctggacgtggtgcagtgcggttactgccagtccgggcagatcatgtcggccgcggccttgctggcgaagatcccgtcgcccaccgacagcgatatcgaccaggcgctgtccggcaatatctgccgctgcggcacctacccaaggatccgcgcggcgctcaagcgcgccgctgaaatcggctgagtcggcattaagaggggcaaggcatgatcactgcgtcgcgtcgtggatttctcaaaggtggcgcgctgctcggcggcgggctggtggtggcgttcgtcatcccgggagccaatcgttttgcccgggcggcgagcgaagaattcgtgcccaatgcgttcttgcgcatcgctccggacggcatggtcaccgtggtgctcggccattcggaaatgggccagggcatttggaccgggctgtcgatgctgatcgccgaggagctggatgccgactggtcgaagattcgcgtcgagcacgcgccggccgccgcggtgtatggcttgccggcgttcggcgggatgcagatcaccggcggctcgacctcgacctggatggagttcgaccgctatcgccaggccggcgccgcggcccggcagatgctgatcgaggcggcggccaagcgcctgcaggtggcgccctcgaccctgcgcaccgagcagggctgggtggtggccggcgaccagcgcctgagctacggcgacctggccaacgacgccgggcaactgccggtgccggagccggcctcgctgcgcttgaaggaggccaaggactggcggctgatcggcaagccgaccccacgcctggacaccccggagaaaatcaccggccgcgcgcagttcggcatggacatgtatttcgatggcctgctgaccgccgtggtcctgcgttcgtcggtgttcggtggcacgctcaagtcgttcgatccccaggcggcgctggcggtgcccggggtgatcaaggtgctccaggtgcccacgggcgtggcggtggtcgccgagcattactgggcggccaagcaggggcgcgatgcgctcaaggccgaatgggacctggggccgaacgccaacatgagcagcgaaagcctgatgcagagctttcgcaaactggcgctgacccccgggaccaaggccgccgaggccggcgatgcggccgggagcatggccaaggcaacgcaggtgctcaaggccgaatacagcgtgccgtacctggcccatgcgccgatggaaccgctcaactgcacggtgcgcatcggcgccgacaagtgcgagatctggaccggcacccagttccagaccctggaccagatggtcgcgtcgaaaatcaccgggctcaagccggagcaggtgcagatccacacgcaatttttgggtggcggtttcggccgccgggccaacccgacctcggacttcgtcagcgaagcggtggaggtggccaaggctgccgccgccccggtgaaaaccgtctggtcgcgggaagacgacgtgcgcggcggctacttccgttcggcgttcctgcatcaggcgcaggtcggcctggacgcccagggcctgccgctggcctggcagcatgtgctggtggggcagtcgatcatggccggcacctcgttcgaggccagcttcgtcaagaacggcattgacaacacctcggtcgagggcctggcggacgggccttacctgaagggcacgccgaaccaccgggtcgacctgcattcgccgatgactggcatcaccgtgctgtggatgcgttccgtgggccatacccacaccgcgttcgtcgtcgaatcgttgatcgacgagatggccgccgcggtgggcaaggacccggtggagtaccgccgcatcctgctcaaggatcacccacggcatctgggcgtgctcaacctggcggtggagaaggccggctggggcaagccggtacccaatggccatgccctgggcgtggcggtgcacgagtccttcggcagctacgtggcgcaggtggccgaggtgtcccaggaggccgagcggattcgcgtgcaccgcgtggtctgtgcggtggattgcggtatcgcggtgaacccgcaaagcatcgtcgcgcagatggagtcgggcatcacctttggcctgggcatggccctgcacagccgcatttccttcaaggacggccgggtggtgcagtccaactatcacgacttccaggtgttgcgcctgaacgagatgcccgaggtcgaggtgcacatagtcgccagcagcgagaagcccggcggtatcggcgaagcgggcgtgccgccgacgacgccggcggtggccaatgcggtgttcgccctgaccggccagcgcctgcgcgagctgccgctgcaactggcgggggtgtgagatgaaacgccacctgctcctcggctcgctgatcctgatcggcctgggcggttatgcctcggacctgttcgccgccgatgaaccggcgctggcggcattcgcgacggtgcagaaggtattccagagcccgcgctgccagaactgccacattcccggggatgcgcccttgcagttcgacgccggcacgccccatgccatggccgtggtccgtggcctggacggcaagggcgcggcggggctgccgtgcgccgcctgccatggcgcaagcaacccgccggacagctacggcccgcacacgccaccgggggcaccgcactggagcctgccgccggcggcgcacaagatggcctggatcggcctgccggccgaccgcctgtgccagatgatcaaggacaaggccagcaacggcgatcgtgactttgccgcgctgatcaagcatgtcagcgaagacaagctggtgctctggggctggaaccccggtggcaatcgcgcgccggtaccggtgccccacgacgtgttcgtcagccagttcaagctctgggccgaggcgggcggaccctgtccggcggtcggaagttgacaccaggagcccccagcgagggctggttgcggggcagtcgcgggccccggcaactaagctctataggtgatacccgccaatggagtgtgcgatgttttccccagacaagcctgtccaggcaccggaccaggtgccagccccggaggcggacgacccgtcccggcaactgttgcgcgatcagaaccgtcgggccgagcaggagctggccgcggtgcaggtagccaacctcgataaactgaccctgctgcccaacccccacggctttgcggtgctggccggcgatgcgctgcaggcctgcaaggacctgaactgcccggcgaccttgctgctgttcgatcttgacgatatctaccgtatcgcccgcgcttatgggtcggaggaaggcgaggcggcgctcaagaccttcgccgacggcctgcgcatcgcctttcgcgaaagcgacgtggtcgggcatctggagttccagcgtttcgcggtgttgctgaccggctcggaacggatggaaaagctggcgatcatcgcccgcctgcaggccatcctcgacgagcgcaccaccacccagcagtgcatttacgacatctgcttcagcatcggccagatcgagttcgatccggcccggccggtcgatgtggaaaccttgctggcggatgccgacaagtccatgagcaggccgggcctcgggccgcaggtaaaggggtagccgccgatccacggaggttttcgtcaaacggctgtgtgggctggacggggagaaagtccagccgataaaaaaccgcccaagggcggttttttatcctgtgccggtcactcggcggtcggcaccaggaacgcggcttccagcaactgccgggtgtagggatgctgcggcgcggcgaagatgtgctgtgcgtcgccttgctccaccacctggccatgcttgaccaccatcaactggtggctcagggccttgaccaccgccaggtcgtggctgatgaacaggtaggtcaggttgtacttggcctgcagcttgcgcagcagctccactacctggcgttgcacggtgcggtcgagggccgaggtcggctcgtccagcaggatcagcgccggcttgagcaccagggcgcgggcgatggcgatgcgctggcgctggccgccggagaactcgtgggggtagcggtgccgggtttccggatccaaccccacttccttgagtgcttcgatgattgcctgttcctgctcggcggcgctgccgatcttgtggatgcgcaggccttcgccgacgatctggctcacgcacatgcgcgggctgaggctgccgaaggggtcctggaacaccacctgcatctcccggcgcaacggccgcacctgctgctgcgacaggccgtccagttgctggccttcgaagcggatggcgcccttgctgccgatcagccgcaggatcgccaggcccagggtggatttgcccgagccgctttcgccgacgatgcccagggtctggccctggggcaggctgaagttgatgccgtccaccgccttcacatggtcgacggtgtggcgcagcaggcctttcttgatcgggaaccagaccttcaggtcctcgacctgcaacagcggcgggccgaccacattgctcgctggcttgccgctgggctcggccgccagcagttcgcgggtgtagggatgctgtggcgcgcggaacagttcttcgcaggatgcctgttcgacgatgcagccgcgctgcatcacgcagacgcggtgggcgatgcgccggaccaggttgaggtcgtggctgatcagcagcaaggccatgcccaggcgcgcttgcagctccttgagcagttcgaggattttcagttgcacggtgacgtcgagggcggtggtcggctcgtcggcgatcagcagttccggttcgttggccagggccatggcgatcatcacccgttgccgctggccgccggacagctcgtggggcagggccttgaggcgcttgtgcggctcggggatgcccaccagttccagcagctccagggtgcgccgggtggcgaccttgccgatcagacccttgtgcaggcccagcacctcgttgatctgcttctcgatgctgtgcagcgggttgagcgaggtcatcggctcctggaagatcatggcgatgcggttgccgcgaatatggcggatggttttttctttctgggtcagcaaatcctggccggcgtactggatggtcccggacggatggcgggccagcggatagggcaagaggcgcaggatcgagtgcgcggtcaccgacttgccggaaccgctttcgcccaccagggccagggtttcgccgcgcttgatgtcgaagctgatgccctcgaccacccgttgcgtgtgctcgccgacgccaaattcgacggcgaggtcgcggacttcgatcagattgtcctgattcatctcatttcctcgggtcgaaggcatcgcgagcggactcgccgataaataccagcaggctcagcatgatcgccagcacggcaaaggcgctgatgcccagccacggcgcctgcaggttggatttgccctgggccaccagctcgcccagggacggcgcgccggggggcaggccgaaaccgaggaagtcgagggcggtcagggtgccgatggcgccggtgaggatgaacggcatgaaggtcatggtcgagaccatggcgttgggcaggatatggcggaacatgatcgcgccgttctgcatgcccagggcgcgggcggcgcgcacgtattccaggttgcgcccgcgcaggaactcggcgcgcaccacgtccaccaggctcatccaggagaacagcagcatgatccccagcagccaccagaagttcggctgcacgaagctggcgaggatgatcagcaggtagagcaccggcagcccggaccagatctccaggaagcgctgcccggccaggtcgacccagccgccatagaagccctgcagcgccccggcgatcacgccgatgatcgaactgaggatggtcagggtcagggcgaacagcaccgacacccggaagccgtagatcacccgcgccagcacgtcgcggccctggtcatcggtgcccagcaggttgtccgccgagggcggcgcgggggccgggactttcaggtcgtagttgatgctctggtagctgaacgggatcggcgcccacagcacccaggcgtccttggccgccagcagctcgcggatgtatgggctcttgtagttggcctccagcgggaactcgccgccgaaggtggtttccgggtaacgcttgagtgccgggaagtaccagccgtcgtcgtagtgcaccaccagcggcttgtcgttggcgatcagctcggcgccaaggcttgcgccaaacaggatcaggaacagccacagcgaccaccagccgcgcttgttggccttgaacagttcgaagcgccggcgattgaggggggacaggttcatctcaatgctcccggctttcgaagtcgatgcgtgggtcgaccagggtgtaggtcaggtcgccgatcagtttcaccaccagccccagcagggtgaagatgaacagggtgccgaacaccaccgggtaatcgcggttgatcgccgcctcgaagctcatcaggcccaggccgtcgagggagaagatcacctccaccagcaaggatccggtaaagaagatgccgatgaaggccgaggggaaaccggcgatcaccagcagcatggcgttgcggaacacatggccgtagagcacgcggcgtctggtcaggcccttggcccgggcggtgaccacgtactgcttgttgatctcgtcgaggaagctgttcttggtcagcagggtcatggtggcgaagttgccgatcaccagcgcggtcaccggcagcgccaggtgccagaagtagtcgaggatcttgccgccccagctcagctggtcgaagttgttcgaggtcaggccgcgcagcgggaaccagtcgaaataactgccgccggcgaacatcacgatcagcaggatggcgaacaggaacgccgggatcgcgtagccgacgatgatcgccgagctggtccagacgtcgaagtggctaccgtggcgagtggccttggcgatccccagggggatcgacaccaggtacatgatcagggtgctccacagccccagggagatcgacaccgggagcttttcgcggatcaggtcgaccaccttggcgtcgcgaaagaagctgtcgccgaaatccagggtcgcgtagttcttgatcatgatccacaggcgttccggcgccgacttgtcgaagccgtacatcttctcgatttccttgaccagggccgggtccaggccctgggcgccgcggtagctggaaccggccaccgagacttcggcgccgccgccggcgatccggctggtggcgccttcgaaaccctcgagcttggcgatcatctgttccaccgggccgccgggcgcggcctggatgatcacgaagttgatcagcaggatgccgaacagcgtggggatgatcagcagcagtcgccgcagaatgtaagccagcatcttattgctccacgccgtcgggggcggcctgcgagtgggtgtccagggtcacggcgggcttggcgtcgggcttgatccaccaggtctggatgccgacgtcgtacttgggcgagacgctcgggtggcctatgtgatcccagtaggccacgcgccaggtcttgatgtgccagttgggaatcacgtagtagccccattgcagcacccggtcgagggcgcgggcatgggccaccaggctcttgcgcgagtcggcgttgatcaggtcttccaccagggcatcgatggtcgggtccttgaggccgatgaagttgcggctgccggggttgtcggcgctggaggacttccagtattcgcgctgctcgttgcccggcgaactcgattgcgggaagccgccgaccaccatgtcgaagtcccgcgagcgcaggcggttgatgtactgggaaacgtcgacccggcggatcaccaggtcgatccccaggtccgcgaggttgcgcttgaacggcagcagcacgcgctcgaactcggtctgcgccagcaggaactcgatcaccaccggcttgccctgggcgtcgaccatcttgtcgtcgacgatgcgccagccggcttcctgcagcagctggtaggcctggcgctgctgggtgcggatcatgccgctgccatcgcacaccgagggctggaaggcttcagtgaagacctggtcggggatcttgccgcgcagcggttcgaggatctgcaactcgtcggcgtcgggcaggccggtggcggccatttccgagttctcgaagtagctgcgggtgcgggtgtaggcgccgttgaacagttgcttgttggtccactcgaagtccagcagcaggctcagggccttgcgcacccgcacatcctggaacagcggacggcgaatgttgtagacgaagccttgcatgccggtggggttgccgttggggatctgttccttgatcagccgaccttcggccacggccgggatgttgtaggcgttggcccagtttttcgcgctggtttccagccagtagtcgaactggccggccttgagggcttccagggccacggtgttgtcacggaaatagtcggtggccatgacgtcgaagttgaactggccgcggttgatcggcaggtccttgccccagtaatccttgacccgctcatagcgcaccgagcgcccggccttgacctcgaccactttgtacgggccgctgccgagggggatttccaggttgcccttggaaaagtcgcggtgttcccaccagtgcttgggcagtatcgacagctgcccgaggatcagcggcagctcgcggttgttcttgtgcttgaacttgaacagcaccttgagcgggtcttcggcgatcacgtcctcgacgtcggcgtagtagccgcggtacatcggcgcgccggcctgcatcagggtctggaagctgaacaccacgtcctcggcgcggatcggctggccgtcgtggaagcgcgcctcggggcgcaggtagaaacgcacccagctgttgtccggggctttctcgatctgcccggcgatcaggccgtattcggtgaagggttcgtccaggctctggcgcatcagggtgtcgtagatcaggccgatattgtccgccggcacgcctttgttgatgaacgggttgaggctgtcgaagccgccgaagccggactcgcggaaggtgccgcccttgggcgcgtccgggttgacgtaggcgaagtgcttgaagttcgccgggtacttcggcggttcgttgtacagggtcagggcgtgttgcggggcggcctgggcgaggcaggcgatccccgccagcagcacgccgccggcccacgggagcagggcacgcaggggcatcattgggctttctccagagacttcagccaccaggcgctcaggcccagttggtagggcggcgtggtgacgaaggcgaaccggttgcggtacgccaggcgatgatagttgaggtaccagttggggatgatgtagtgctgccacagcagcacccgatccagggcccgaccggcggccagttgctcgtcgcggctctgcgcggcgagcaggtgttccagcaggtgatcgacaatgggattgtcgatgcccgcatagttcttgctgcccttgaccccgacctggctggagtggaagtactgccattgctccaggcccgggctcagggtctggttcagggtcatgaggatcatgtcgaaatcgaactggtccaggcgctgcttgtactgcgcccggtccacggtgcgcaggcgcgcgtcgatgccgatgccggccaggttctcgacgtagggctggaggatccgttccaggttcggattgaccaacagcagctcgaagcgcagcggttgcccgttgctgtcgagcaagcgctggccgttgagcttccagccggcttcggcgagcaggcccagggcccggcgcagggtcgcccgcgggatgccgcggccgtcggtctgcggcaggctgaagggctgggtgaacaggctggcgggcaactgctcgcggtagggcgagagcagcagccattcatggccgaccggcaggcccgtggcggagaactcgctgttggggtagtagctggtcgcgcgcttgtaggcgccgctgaacagggtgcggttggtccactcgaagtcgaacatcaggcccagggcttcgcgtaccttgcgctcggcgaagatcgcccggcggctgttcatgaacaggccctgggtctgggtcgggatctggtgcgccacctgggccttgatgatgtcgccgcgattgaccgcggggaagttgtagccgttggcccagttcttcgcctggtgttcgatgtagatgtcgaactcgccggccttgaaggcttcgaaggcgacgtcgctgtcgcggtagaactccaccgcgaccttgttgaaattgttgaagccgcgattgaccggcaggtccttgccccagtagtccttgacccgctcgaacagcagcgagcgccccggttgcacccgggtgatacggtaggggccgctgcccagcggcggctcgaaggtggtggccttgaaatcgcggtctttccagtagtgctgcggcagcaccggcaactcgcccaggcgcaggatcagcagtgggttgccggagcgcttgaacacaaagcggatgcgttgcgggccgaggatgtccacccgctgcacttcctgcaggttggtgcggtattgcgggtggccttccttgagcagcagccgataggaaaacgccacatcgtaggcggtgatcggctggccatcgtggaagcgcgcctcggggcgcagattgaacaccacccagctgcggtcttcgctgtattcgacggaacgggcgatcaggccgtagctggaagtcggctcgtcgccggacggcgcgtactggccggtgccgaccatcagcggctcgttcagctcgttgaccccgtattgcaggaagttgggcgtggaaaccgggctgctgcccttgaaggtgtaggggttgagggtgtcgaaggtgccaaacgccatgacccgcaaggtcccgcctttgggcgcggcggggttgacccagtcgaaatgggtgaatttggcggggtacttgagcgtgccgaactgcgcgtaaccatgactttcagtgatcgttgcgcttgcgggaaagctcaaggccagactgattagggacaggaggaggggacgcatcaagtcagagatccgatccaggcggcttgggctttgtgctccgtacagtaacagcttgtatcgacaggaaaaaggccgccccgggctggccacgacatttgcttgtcgccgctggatacagtgcaatccgtagccgctgccgcaggctgcgaacgaccggcacggtcgtggggatcttcagggcgcaggagggcctgcggccctatcgcagcctgcggcagcggctacagatagggctctgggggatcagtgaggcaggtagacggtcagcatctggcctggcttgagggcctggccggcgcggggattccagcgcttgaggtgctgcatctcgacgttgaagcgcttggccaccatgtacagcgaatcgccttgcttgaccttgtactgggtcgacttcttgtcggcgcgggcgaccagggtcttcttgccggaagccttggcgctggtcttgctgctggccttggcccgggtgtcctgcatgaccagggtctggccgaccttgagctgcttgccgctgagcttgttccagcgttgcaggtccttgacgtcgaccttgttggccttggcgatctgcgacaggttatcgccacgcttgacccggtagttgcgcttggcctgggccatttcgcgactgtcggcaccctcgaacaccggcttgaacgaacgctggctgatcagctcttcgggtttcatggtcgacaggctggcgctcagcagttgcgccttggacgtcggcaccagcagatgctgggggccgtcgatggtggtgcgctgcttgaaggccgggttgagctggaacagctcgtcttcgtcgatattggccaccgcggcgaccttggacaggtccatgcgctggttgatctcgacgacctggaagtagggttcgttggcgatcgggttcaggttcacgccataggcttccggcgccagcaccacctgggacagggccagcagcttgggcacgtaggcctgggtttccgacggcagcggcaggttccagtagtcggtgggcaggccgagcttctcgttgcgctcgatggcccggctgaccgtgccttcgccagcgttgtaggccgccagggccagcagccagtcgccgttgaacatgtcgtgcaggcgggtcaggtaatccatggccgcagtggtcgaggcggtaatgtcgcgacggccatcgtagaagcgggtctggcgcaggttgaaggaacgcccggtggacgggatgaactgccagaggcctaccgcatcggcccgggaataggccatcgggttgtaggcactctcgatcactggcagcagggccagctccagcggcatattgcgttcttcaaggcgttcgacgatgtaatggatatagaggctgccgcgttcgctggcattctcgagaaacgagggattgctggcgaaccacaggcgctgctgttcgatgcgcgggttgacgccgatgccttcctgcaactggaaaccttcgcgcatgcgcgcccagacgtcctggggcaattgcggactgggtttttcattcagccagatgggtttctgcttgatgcgggcgttgaaattctgggtgtgcgaagcgtcggtttgcgggacgtggctcgtgctttggcagcccgccagggtggcggacacagccaccgcgatggcttgagccaaccgcgtcaatgcgtctgaattgatggatttacgaatagatgacgacattggctggaagtaagttccgggcaaaaatgtcgggcgattctagaaagcgcacccggtgcggtcaaccattcagaattttcgtaccaacccgcaacctgcttagaacttatctttccaagcccgcaaggcagcaaaaaccgcactctgagcccggttatcgaggccattccgttcgtccgctttttgtttaacggatgtttcaccggtacgcaggaaaggattggtgagcttttccagggccagggtggagggcagggtcatgcggccgttttcccgcagttcgctgactttgcgcaggcgctcggcgatgtccgggttatccggttccaccgcctgggcaaaacgcaggttgctcaaggtgtattcgtgagtgcagtacaccagggtgtccgcgggcaatgcggccaggcggctcagcgaatggtgcatctgctccggcgtgccctcgaacaggcgcccgcaaccggcggcgaacagggtgtcgccgcaaaacagcaggccgtgatggtagtaggcaatatgtcccagggtgtgcccgggcaccgcgtagatgtcgaagtcccagccaaggatgctggcccggtcgttgtcgttcagggccacatcgcgccccgggatgttttcgttggccgggccccagaccctggcgccgctggcttttttcagctgttcgacaccgccgacatggtcgtggtggtgatgggtcaccaggatatcgctcagcacccagcccggatgttcggcgagccaggcctgcaccggtgcggcgtcacccgggtcgactactgcgcaacgctgatggctgtggtcctgtaacaaccagatgtagttatcggtgaacgcgggcagggcactgatctgtatcatcgttggagtcgccaagcggaaaacattggcgcatcttagaacttcttggcgggttggagaatgcaatgaccgataaagcgttcgctcaggccgatcctgactggctggccctgatcagtgctgcccgtgagtggctgtccgggccactggggcaatttctgctggatgaagaacggcgcatgctcgacgacgagctggggcgcttcttcggcggctacctggtgcattacggcccgtcggcgcaaaccccgccggcggcgccccaggtgcagcgcaatgtccgcctgggcgcgccgctgcccggcgtcgagatcgtctgcgaggagcaggcctggccgctcagcgagcatgctgccgatgtggtggtgctgcagcacggcctggatttctgcctgtcgccccacggcctgctgcgcgaagccgccagcgccgtgcgaccgggcgggcatctgttgattgtcggtatcaatccctggagcagctggggcctgcggcatgtgttcgcccatgacgccttgcgcaaggcgcgctgcatttccccgtcgcgggtcgccgactggttgaacctgctgggcttcgcgctggagaaacgccgcttcgggtgctatcgtccgccgcttgcttcggcggcctggcaggctcggttggccggctgggagcgcaaggccggtgactggcaattgtccggcggcggcttctacctgctggtggcgcgcaagatagtggtcggcctgcgcccggtgcgccaggtacgccgcgagccgatgggcaagctggtgccgctgccgatggccaaggtcaaccgccggcacagcgaaccccctctttaattcagccgggccgaacctgcccggcttgggcgttgtcgatcgacgatcggcaagccacaggtattttcgattggaagtctggcatgagcgatagcgtagaaatcttcaccgacggcgcctgcaagggcaatcctggcccgggaggctggggcgcactgctggtgttcaagggcgtggagaaggaactctggggcggcgaggccaacaccaccaacaaccgcatggagctgatggcggcgatccgcggcctggaggaactcaagcgcgagtgccaggtggtgctggtcaccgactcgcagtacgtgatgaagggcatcaacgagtggatggccaactggaaaaagcgcggctggaaaaccgcggccaaggaaccggtgaaaaacgccgacctatggcagcagctcgatgagcaggtcaaccgccatcaggtcacctggaagtgggtacgcggccataccggccaccacggcaacgaacgggccgaccaactggccaaccgcggcgtcgacgaggtgcgcggttacaagcaggcctgatgctttgagcctgtagtcagttgcaacgcagcggccgttcgagccgctgcttcacttcccgcatcgcgcggggcgaatccaccagcaccgcgtccatcttcaggcaggcggctgcctggtaatcctcggccgtgttgattccaatcgccagcatctgcaccttgccccgggactggaagcaatccaccgcggcgggcgtccacagccgggcatcgaccttggagcgggcctcgcccagggtgaaggcctcgaccaactgcaccgggcgccggtactcgaaggccacccaactgtctggcgccggcggtgccgtgcagctgtgggccagggcgacgctggccagtcgatcccgggtgtcgtcccgggactcgaatagccgcgcttgcggatagtgcgcgaacgcctgctggtagctggcatcggtggagtagatcagcacccggttccaggcatgcagttgctccagcacctgggcgaccgccttggcctggggagcggcgggcagggccttcatgtcgagaatgaccggcaccgagccggggatcgccgctagcgcctgctgcaatgaggggatggtcaccgccagggagcgatagggaaaggtcacctggtcatcggccgcggtctgcttgaagttccagccggcattcagtgtttgcaactgcgccagggttttctcgctgaccgcgccggacgccggggtattggcgctcaggtccgccggtcgatacagcaccggcacgccgtcgcggctcagttgcaccgtcagccagagcatgtcgacgccgttgcgcagggcgttgtcgatggccagcagggtgttctcgggaaagtccgccgcgccggcgcgatgggcgacgatcagcggccgttgcccggcgtcgctgtcggttgccggaagggaagaacagccactgatgaaggccgcggccagcagcagtgggagcatctgtcgagtcttgagcatggaagggcggtttcctggaaatgagcgcaaggccgggtgccggcccccgcccgcctgagtgggccgtacggtagcgcaagggccttgctcagttaaagaaacgcgtaatgcgagggctgaattagtggcgcggttccgtggcggtcaaagggtgaggatggcgctggccagttgcaggtcggagtaccctgggttgccgagcgtctggcgaatgtgccgcatggccgcttccagctgggcgccgcggatctcgccggcgctggcgacaaaggccgcggcatcggtccgggcggcgagcacgagtttgtcgtccttgaacgagctggtggctttcgaactgccttcggtggtgctcaaggccaggctcatggtgatgtcggtgctgattaccaggctggtggcctggccgacgtcggcgaacaggcaggcgcagagcagcaaggtcaggcgggttttgcagggggtcataacagggcgaggtccgctgaaaatagggtcgggcaccctaacaagccgccgcgcggcgaactgcatgagctttgcgaatgattgttaaaaactgcgcacgccgggccaggcgaatccgccatgcgtgccatgccgcgagagcgtgctaaaatcccgcgccttgaaagacttccaccgttgagaactgacccctgatggccaacagatctgttgtactcgataccgaaaccaccggcatgccggtgaccgacggccaccggatcattgaaatcggttgcgtcgagttgatcggacggcgcctgaccggtcggcatttccacgtctacctgcagccggatcgcgagagcgacgagggcgcgattggcgtccacggcatcaccaacgagttcctggtgggcaagccgcgcttcgccgaagtcgccgacgagttcttcgagttcatccagggcgcgcagctgatcatccacaacgcggcgttcgacgttggcttcatcaacaacgaattcgccctgatgggccggcacgaccgcgccgacatcacccagcactgcacgatcctcgacaccctgttgatggcccgggaacgccaccccggccagcgcaacagcctcgatgccttgtgcaagcgctatgacgtcgacaactccggccgtgaactgcacggcgccttgctcgactcggagattctcgccgacgtctacctgaccatgaccggcggccagaccagcctgtccctggccggcaacgcctcggacggcaacggcagcgaaggttcgggcaaccgcgccagcgaaatccgccggctgtcggcggatcgcccgcgcgggcgggtcattcgcgccagcgaagccgaactggccgagcaccaggtgcgtctcgagatcatcgccaaatccgccggtgccccggcgctctggacccaactggccgaggccaaggcccagcagcagtagttgttcgtgggcgaccttttgttacaggaggtcgttgacggggttacgcgccggcccccgagcttctaccctgaggtgattggcggacccttgtctgccgcctcaggatgcctggtgccatgtacaaagacctgaaattccccgtccttatcgtgcatcgcgacatcaaggccgacaccgtcgccggcgaccgggtgcgggggatcgccagggaactggagcaggaaggcttcagcatcttttccgcggtggactacgccgaagggcgcctggtggcctcgacccaccacggcctggcctgcatgctgatcgccgccgaaggcgccggggaaaacacccacttgctgcagaacatggtggagctgatccgcctggcccgggtgcgcgcgccgaacctgccgatcttcgccctgggcgagcaggtgaccctggaaaacgccccggccgacgccatgagcgagctcaatcagctgcgcggtattctttacctgttcgaagacaccgtaccgttcctggcgcgccaggtggcgcgggcggcgcgcaattacctcgatggcctgttgccgccatttttcaaggcgctggtgcagcatacggcggagtccaactattcctggtacaccccggggcacggcggtggcgtggcctatcgcaaaagcccggtggggcaggcgttccaccagttcttcggtgagaacaccctgcgttcggacctgtcggtgtcggtcccggagctgggttcgctgctcgatcacaccgggcccctggcggaagccgaggcgcgggcggcgcgcaatttcggcgccgaccacaccttcttcgtgatcaacggcacctcgaccgccaacaagatcgtctggcactccatggtcggtcgcgatgacctggtgctggtggatcgcaactgccacaagtcggtgctgcactcgatcatcatgaccggtgccatcccgctgttcctctgcccggagcgcaacgaactggggatcatcggcccgatccccctgagcgaattcagccgcgagtcgatccaggccaagatcgacgccaactcgctgacccaggggcgaccgcccaaggtcaagctggcggtggtcaccaactcgacctacgacggcctttgctacaacgccgagctgatcaagcagagcctgggcaacagcgtcgaggtgctgcatttcgacgaggcctggtacgcctacgcggccttccatgagttcttcgaggggcgttacggcatgggcacctcgcgcagcgccgacagcccgctggtgttcaccacccattccacccacaagctgctggcggccttcagccaggcctcgatgatccatgtgcaggacggcggcgcccggcagctggaccgcgaccgcttcaacgaagccttcatgatgcacatctccacctcgccgcaatacagcatcatcgcctcgctggacgtggcctcggcgatgatggaggggccggcggggcgctcgctgttgcaggaaatgttcgacgaggccctgagcttccgccgggccctggccaacctgcgccagcacatcgccgcggacgactggtggttttccatctggcagccggagcgggtggaaggcatcgaccgggtcagcaccgcggactggctgctggaaccggaaggcgagtggcacgggtttgccggggtgaccgatgattatgtgctgctggacccgatcaaggtcaccctggtgatgcccgggcttaccgccggcggtgccttgagcgagcgcgggataccggcggcggtggtcagcaagtttctctgggaacgcggcctggtggtggaaaagaccggcctgtattcgttcctggtgctgttttccatgggcatcaccaaaggcaagtggagcaccctgctgaccgagttgctggagttcaagcgcaactacgacgccaacgtcagcctcgccgcctgcctgccgagcatcgcccagcaggacatggcgcgctaccagggcatgggcttgcgcgacctgtgcgatcagttgcatgcctgctaccgcagcaatgccacggccaagcacctcaagcgcatgtacaccgtgctgccggaggtggcgatgaagcctgccgacgcctacgatcagttggtgcggggcgaggtcgaggcggtgtccatcgatgccctcgccgggcgggtggcggcggtgatgctggtgccatacccgccgggtattcccctgatcatgccgggcgagcgcttcaccgagtcgacccgctcgatcatcgattacctggctttcgcccgtacgttcgatagcagctttcccggctttgtcgcggatgtgcatggattgcagcatgaagacgaaggcaatgggcggcagtacaccgtcgattgcatcaaggtttgaggacgtttcccgctatgcagccaatgatcaatcccaagtaccccggcctgtcggtgcgcgtcgccgacgacggtttcgccgcgtatgtctggggcagcgatttcagcttcgaagtcagcgcctatgcccaggcacagagcgggcaggtggtggccaagtggccgttgcaccccatcaccccgtaccgcaagtgctacggcatcgaccccgaagagttcagcagctatcgcgatgccgcggacagcgcggtgttcatggcctacctggacgacgaaccggtcggccatgtggtggtcagcaccaactggaacggctatgcccatatcgacgagctggcggtgcatgcgccggcgcggcgccacggggtggccaaggccctgctggatgtggcgcagttctggagccgcaagaaaaaactgccgggcatcatgctcgagacccagaacaacaacctgggggcctgccgcttgtacgagcgctgcggttatgtggtcggtggcatcgatcacctgcgttaccgcgggatcgacccgaccacggccgaggtggcgattttctggtatcggctgttcaacgacgagctggcacggcaagccgggacctagccggccagcatcccttcagccttttccgtgagggtttccagcagcgcttccagggtgggcgaggatggactgccgccgcgggtcagcgcatagagggtgaccgggatcggcggcgacagcgggcagacgtccagcccgccttcgcgcgcacccagggcggtgaaggggtcgacaatcgccaggccttcgccggcctcgaccatgctgcgcatcatctggtgggtctgtacccgggtgtggatggtcgggctcgggcgcaggttctgcagcttgctgtcgagggtcacgctcagcgggtcctggccttcgaggccaaccatcgcctggcccgccaggtcctgcagggaaatgtacttctgcttcggttgcagccagccgtggggcgccagcaattgcagcttgccctgggccagggccacgcactggatatcggggtggtcggggttgtgcaggctcaggcccagttcgccttcgcgcagcagcaggctcttgaccatgtcgcgggtgccctggctggcgaggtggcacggggtgtcgggaaaacgccggcgcagggcggcgatgctctgcggcaacaattgctgggccaggggcggggtgccgatgatgcgcaagggcggcgcctggtattgcttcaggctgtcggccaggcgttgcacgggttcgaaggcgtcatacagggtggcgatcgccggctgtagctcgcgggcctcgcgagtggcttgcaggcgtccgcgaacactggcgaagagcatgaagcccgattggctttcggcgtcgcgcaggatcgtttccacctcggccaccggcaattgcagcagctcggcggccgtgcccaggtgtccggtttgcaggagcgcctgaatcacttcgatatgacgtaaacgcatgcttgaagtccatgtccagccggtgggggattcacactgaatcctaacccatgtccgcgcctatgacttctgctcataacggtacgttatgaaggaaggatggtctcgggttcgcgaatgagggtgatgcccgattgcacgaggagaaactggttgtcgtccattttgttgacgcgatcgccaatggccaggcgataggtggtgacgggctccgagccggcgataccctctggcgagggggtggattcctggaactcatgcaccgaatagacacggccttccgcgtcccttgcatgaaattgtccgacgagtactgctgccatctttagagcctctggagataaaacactcaatttgcggtcctgtagaccgtgcttgggcgaactaagtttagcggcggaaaaaaaatagtccgcggccctgattgcagctggcgtgaagcctggaaaagcccacggaacttccttcgacgggtggctgtgggcagggtggatcatctataactaccagcctcctcaaccagaagtcgggaattcgctatgagcaacgtctacacgattgcagtactggtgggcagcctgagaaaggcctcgatcaaccggaaagtggcgctggccctcgcggaactggcgccggccaacctacggctgaatattgtcgagatcggcgatctgccgctctacaacgaagacatcgatgtggatccaccggcagcctacaggactttccgtgaacaggtgagagcagccgacgccgtgctgttcgtcactccggaatacaaccgctcggttcccgcaccgatgaaaaacgccatcgacgtggggtcgcgtccctacggcaagagcgcctggagcggcaagccgggggcagtgatcagcgcctccccgggcgcgatcggcggttttggcgccaaccatcacctgcgccagtccctggtgttcctcaatgtgccatgcatgcagcagccggaagcctacctgggcggcgcgggctcggccttcgacgaggcgggcaagctgtccgagtcggtcaagccgttcctgcagaacttcatcaacgcctatgcccagtgggtcgagcagcacaaaaagccctgatcctggcgccgcgggagtcggtcagtcggctcccgtaggtaatggaatattccactcgccacggtaaaagcgctttaccgcatatctgaatattcatatattcgccgctccaaatgcctggagtggccctggtgtccgactctctcaaccccgccgagctgttcaaggcgcttgccgacgaaacccgcagccgcatcgccttgctcgtgacccgcgaaggcgaattgtgtgtctgtgagctgaccgccgccctgggccagagccagccgaagatctcccggcacctggcgctgttgcgcagctgcggcctgctggccgatcgccgccaggggcaatggatctactaccggctgcacccgcaattgtcaccctgggtgagcaccctgctgcaggacacgctggaggccaacagcccctggctgcaggaggacctgcaacgcctgcagaccatgatcgatcgccccgtgcgctgctgctgagttccccctttacctcactttctgttcaaggctgcctggcatgctgactgcttcattgattttcctgctgaccattaccctggtgatctggcaacccaagggcctcggcgtgggctggagcgcggtgctcggtgcggtgctggcgctgctgttcggggtggtgcaactgacggatatcccggtggtctggcagatcatctggaacgccaccggcaccttcgtcgccttgatcatcatcagcctgctgctcgacgaggccgggtttttcgcttgggccgccttgcatgtggcgcgctgggggcagggcagcggacgcaagctgtttgccttcatggtgctgctgggggcgctggtgtcggcgctgttcgccaacgacggggcggcgctgattctcacgccgatcgtgatttccatgctgctggcgttgcgtttctcccgggcggcgaccctggcgttcgtcatgggcgccgggtttatcgccgataccgcgagcctgccgctggtggtgtcgaacctggtgaacatcgtttccgcggacttcttcaacatcggcttcaaccagtacgccgcggtgatgctgccggtgaacctggtcagcgtggccgcgaccctggcggtgttgctgtggttcttccgccgcgacattccgcaggcctacgaccccgaagagctggcacagccggccagcgcgatccacgacaaggccaccttcgtcgccggctggtgggtgctggtcatcctgctgctaggatgttttgccctggagccgttgggcattcccatcagcgcgatttcggcggtgtgcgcggccctgctgctgggcatcgcggccaggggccacaagatttccacgcgcaaggtgctcaaggaagcgccgtggcagatcgtgattttttccctcggcatgtacctggtggtgtacggcctgcgcaatgccgggctgaccacccacctggccggctggctcgaccgcttcgccgactacggcatctggggcgcggccatgggcaccggactgctgaccgcggtcttgtcatcgatcatgaacaacctgccgacggtgctgatcggcgcgctgtccatcgacgccagccaggccagcggcctggtcaaggacgcgatgatctacgccaacgtgatcggcagcgacctggggccgaagatcaccccgatcggcagcctggccaccttgctctggctgcatgtgctggagcgcaagaacattcatatcggctggggccgctacttcaaggtcggcatcgtgctgaccctgccggtgctgctggtgaccctggcggcgctggccgtgcgcttgtcggtgatgtgagggtccaccgcgcaccctgtaggagccagcttgctggcgatgcaggcaccgtggtgtgtcaggtatgacgctatcgcgagcaagctcgctcctacagggggcaggcggaggctcaactggttccggggacgttcggccagaggtccgccaccaggaacaggcgttcggcttcttcccaatcgccggcgcggttctccgtcaggcgcaccagcaattgcgccggggcgtgcgggtcgagctcctccagccaggcttgcagccggggggcgctccaggtttgttccgccgggtaggacgctggcgccagccaggcctggcgcggcaagggttgccagcgcccgggcgggctttgatcgataaaggccggccagtcgcgctgatgcagccagcgtccgcgcaggtgctgcgggtgggcgccgcggggcggttgcgtggtgccgggccaggggtagagcaggtagccgccgagccacaggtgggcgctgaagtcctggatatccatggccgccagcacctccaggctgtcggcccgggcggagatcggcagctggtgctcgttcagatgcgccagcttgcggtccaggcggtcgtggcagccggggcccagccataaggcggtgtccgcgccgttgccggattgcgggccgaggtagagcttgatcgccagttccaggtggtgaatgccgtcgcgatcgcgcagcagcatgtccagttcgcccagggtgtggccggcgcggcggatcggcaggttggccgccagcagttcgacaccgggagcgtgctgtacggcaaattgccacaggcgttcgtagtagagccccaggcgcttggtcggcccgagggccagccagcggcgcagggtacggccgtcctggtccagctggcgcagccagtgcgccagcagctgcggcgcctgcacccagtcgctgccggccagtggatggcgctgcggccagggagtctcgtcgagcatcggcggcgcgaggatgacccaggccaggtcgcgcacttcggggtggcgcaactggcgggggaggtcgagcaagccgggaaacaggatcattctgcgagcatagcgcctaacgtcgaggctgaaaggattttgtctatcgccggctttcgcccataatctctgctttgcccgtcccagaacccctgcaggagccccatggagcaatttcgcaatatcggcattatcggtcgcctgggcagttcgcaggtgctggacacagttcgccgactgaaaaagtttctgctcgcccgccacctgcatgtgatcctcgaagacaccatcgccgaagtcctgcccggccacggcctgcagacctcctcgcgcaagctgctgggcgaagtctgcgacatggtgatcgtggtcggcggcgatggcagcctgctgggcgcggcccgtgccctggcacggcacaacatcccggtgctggggatcaaccgcggcagcctgggcttcctcaccgacattcgtccggacgagctggaggtcaaggtcgccgaagtcctcgatggccactacctggtggaaaaccgcttcctgctgcaggccgaagtacggcgtcacgccgaagccatcggccagggcgatgcgctcaacgatgtggtgctgcacccgggcaagtcgacgcggatgatcgagttcgagatctacatcgacggtcagttcgtctgcagccagaaggccgacggcctgatcgtcgccacgccgaccggctccaccgcctacgccttgtccgccggcgggccgatcatgcatcccaagctcgacgccattgtgattgtgccgatgtacccccataccttgtcgggaaggccgatcgtggtcgatggcaacagcgagctgaaaatcgtcgtgtccaaggatatgcagatctacccgcaggtttcctgcgacgggcagaaccatttcacctgtgcccccggtgacaccatcaccgtcagcaagaaggcgcagaaactgcgcctgatccacccgctggaccacaactattacgaggtctgccggaccaagctcggctggggcagtcgactgggtggtggaggcgactgatgctcgatcccgcgcgtagctacgacctgatcggtgacgtgcacggttgcgccatgacccttgagcacctgctggacaagctcggttatcgcaagcagggcggcgtctggcggcattcgtcgcgcatggcggtattcctcggcgacatcatcgaccgcggcccacggatccgcgaagccttgcacatcgtccacgacatggtcgaggccggccaggcgctgtgcgtcatgggcaaccatgagttcaacgccctgggctgggtcaccccggcaccgcccggcagcagcaggcagttcgtgcgcgaacacacgccgcgccatgcccgcctgatcaacgagaccctggcgcaattcgagcagtaccccaaggactggcacgatttcctcgcctggttctacaagatgccgctgttcgtcgacgccgggcgttttcgcgtggtgcatgcctgctgggacgccggcctgatcgagccgctgcgggcgcaataccccgatggctgcatcgacgagcacttcctccaggcctcggcgatccccggcagcttcgccaataacgtgttcgaccgcctgttgcgcggcaccgacatgcgcctgccccatggcttgaccatgaccagcggcgatggcctgacccgttcgttcttccgcaccaagttctgggaagacgacccgcagacctacggcgacatcgtgttccaacccgacgcgctgcccgagccggtggcccgcacgccgctgtcctcggcggagaaaaacaacctgctgcgctacggcgtcgatgagccgctgctgttcgtcggccattactggcgcagcggcaaaccgtcgccgattcgctcgaacctggcctgcctggattacagtgcggtgctctacggcaagctggtggcttaccgcctggaccaggaaacccgcctggacccggataaattcgtctgggtctatgtcgagcggccggaggagcagcaatgagtgcggttgcggtattgcgtctgccgttgaatgtggacctgagtggcttcgtcaagttgttgcagcgcatgcaggtgccgcaccgggtcagcgaggaagcgggggagcaggtgctctgggtgccggacgccatcagcgaggatgtgcgttcgttgtacgagcgttttccggcgggcgaccccgagcagcaactggacatccccgaggccggcgccgccatgcgccggccggggttcgtcgagcaattgcgccgtagcccggccactgcgctgatcctgctgctgagcctgatcgtcggagccctgaccctgcttggcgaaaacctcggcaccctgcgttggctgaccttcctggaatttcgcgtggtcggcgactacatccagttcacgcccctggccgacagcctggcggcggggcagtggtggcgcctggtcacgccgatgttgatccacttcggcttcctgcacatcgccatgaacggcatgtggtactgggagctggggcggcgcatcgaacagcgccagggcagcatcaacctgctgggcctgacgctgctgttcagcctggtgtcgaactacgcgcaatacctgttcagcgggccgagcctgttcggtggtttgtccggtgtgctgtacggcctgctcgggcattgctggatctatcagttgctgtcgcccaacccagcctatcgcctgcctcgcggagtcctggcgatgatgctggtgtggttgctgatctgtatgtcggggctgatctcggtgatcggcttcggtgaaatcgccaacgccgcccacgtcggcgggttgctcgtcggatgcctcacaggtttgttgggtggcttgtacagccgccgtaaactggccctctaatgctggagaccgcttatgtcgtcgtttgttgaaatgattgaaaacatcaccccggacatctaccagagcctgaaactggcggtagagatcggcaaatggtccgatggccgcaagctcaccgccgagcagcgcgagctgtccctgcaggcgatgatcgcctgggaaatgcagaacctgcccgaagagcagcgcaccggttacatgggcccgcaagaatgtgcgtcgaagtcgatcgaagtgccgaacatcctgttcaagtcggatgccatccattgatcgagatcggccgtggctccatcagtaaaatgtcggcgcgcctggacggggcggacgtgcagtatgcctttcgccttggcgacaccgaggtgccggtcaatccattgatcggcagcaccgtgcgcctggaatacctgggggcgatccactgcacccattgcgggcgcaagaccaagaccagcttcagccagggttactgttacccgtgcatgaccaagctggcccagtgcgatatctgcatcatgagcccggaacgctgccactacgacgccggcacctgccgcgagccgtcctggggcgagcggttctgcatgaccgaccacgtggtgtacctggccaactcgtcggggatcaaggtcggcatcacccgcgccacccagctgccgacccgctggctcgaccagggcgccagccaggcgctgccgatcatgcgcgtggcgacccgccagcagtccggtttcgtcgaggacctgttccgcacccaggtggccgacaagaccaactggcgcgccttgctcaagggcgacgccgaggcggtggacctggcgcaagtgcgcgaccagctgttcgcttcctgcgccgagggcctgcgcgccttgcaggaacgcttcggcctgcaggcgatccaaccggtcagcgatgtcgagccgatcgagatccgctacccggtcgagcagtacccggccaagatcgtcagcttcaacctggacaagaacccgattgccgaaggcacgctgctggggatcaagggccaatacctgatcttcgataccggcgtgatcaatattcgtaaatacacggcctaccagctcgccgtgcatcagtagaaggattcgccgcatgcgcaccgaacaaccgaagatgatttacctgaaggactatcaggcgcccgagtacctgatcgacgaaacgcacctgaccttcgagttgttcgaggaccacagcctggtccatgcgcaactggtgatgcgccgcaacccggcgcatggcgccggcctgccgccgctggtgctcgacggccagcagctggagctgctgtcggtgtccctgggcgaccgcgagctgacggccgcggattaccagttgaacgccaaccacctgaccctgcagccgaccagtgaatccttcaccgtcgacaccagcgtcaggatccacccggaaagcaacaccgccctggaaggcctgtacaagtccggcggcatgttctgcacccagtgcgaggccgagggctttcgcaagatcacctactacctcgaccgcccggatgtgatgagcaagttcaccaccaccgtggtggccgagcagcacagctacccggtgctgttgtccaacggcaacccgatcgccagcgggccgggcgaagacggccggcactgggcgacctgggaagacccgttcatgaaaccggcctacctgttcgccctggtggcgggtgacctgtggtgcgtcgaggacagcttcaccaccatgaaccagcgcgaagtcgcgctgcgcatctacgtcgagccggaaaacatcgacaagtgccagcacgccatgaccagcctgaagaaatccatgcgctgggacgaacagacctacggccgtgagtacgacctggacatcttcatgatcgtcgcggtcaacgacttcaacatgggcgccatggagaacaagggcctcaacatcttcaactccagcgccgtgctggcccgcgccgaaaccgccaccgacgccgcgcaccagcgggtcgaggcgatcgtcgcccacgaatacttccacaactggtcgggcaaccgcgtgacctgccgcgactggttccagctgtcgctcaaggaaggcttcacggtattccgcgatgccggtttttcttcggacatgaactcgcgcacggtcaagcgcatccaggacgtggcctacctgcgcacccaccagttcgccgaagacgccggccccatggcccacgccgtgcgcccggaaagctttatcgagatttccaacttctacaccctgaccgtgtacgagaagggctcggaagtggtcggcatgatccgcaccctggtgggcgccgaaggcttccgcaagggcagcgacctgtacttcgaacgccatgacggccaggccgtgacctgcgacgatttcgtcaaggccatggaggacgccaacggcatcgacctgggccagttcaagcgctggtacagccaggccggcaccccgcgcctggcggtcagcgaggcctatgacgcggcggcgaagacctacagcctgaccttccgccaaagctgcccgcaaaccccggacaaggtggaaaaactgccgttcgtgattccggtcgagctgggcctgctggacgccaagggcgcggcgattgccctgcgcctggccggcgaagccgccgcgcaaggcacttcgcgggtgatctcggtgaccgaagccgagcagactttcaccttcgtcgacatcgccgaacagccgctgccgtccttgctgcgcggcttctcggcgccggtgaagctgagcttcccgtacaaccgcgaccagctgatgttcctcatgcagcacgacagcgacggtttcaaccgttgggacgccggccagcaactggcggtgcaggtgctgcaagacctgattgcccagcatcagcagggccaggcgctggcgctggaccagcgtctggtcaccgcgctggctacgctgctggccgatgacagcctggaccaggccatggtcgcggaaatgctttcgctgccgggcgaggcctacctgaccgagatcagcgaagtggcggatgtcgaggccattcacgcggcgcgcgagttcgctcgccagcaattggccgatagcctgttcgacgcgctgtggaagcgttaccaggccaatcgcgaggtctcccggagcaccgcctatgtggccgagtccgcgcacttcgctcgccgcgccctgcaaaacatcgcgttgtcgtacctgatgctcaccgagaagccgcaagtgctggcggccgccatcgaacagttcgacgccgccgacaacatgaccgagcgcctgaccgcgctggcggtgctggtcaactcgccgttcgaagcggagaaagccaaggccctggcggtgttcgccgagcacttcaaggacaacgccctggtcatggaccagtggttcagcgtccaggccggcagcacgctgccaggcgggctggagcgggtcaaggccttgatgcagcacccggcgttcaacatcaagaacccgaacaaggtgcgcgccctgatcggcgccttcgccggccagaacctgatcaacttccacgccgcggacggctccggctaccgcttcctggccgacctggtgatccagttcaacggtttcaacccgcagatcgcctcgcggcaactggcgccgctgacccgctggcgcaaatacgacagcgcccgccaggcgctgatgaaaggcgaactggaacgcatccgcgcttccggcgagctgtccagcgatgtctttgaggtcgtgagcaaaagcctcgcctgacgccgggcttgggcctatgtaggctcgacagctgtagtcgctgccgagcctgcgaggctgcgaaaagccccgtaggggcttgcctgacgatctcccgtccagcctcttgcgtccccgcgggccgttcgcagcctgcggcagcggctacagggtggtggtcagggcgctgctcaggtcagggtgatagttctgcgcgccgatggcgtgcaggatgccgacccgctcaagcttggtgtggaccttgaggttggcttcgcacagcttcaccacgatcccgcgtttatgcagctggccaatcacttcctccagcatctgcaagcccgtgatgtccatgaaaggcacgtgtctcaggcgaatgatcagcacccgcgggtcgctgtgggtctgcgccagcgctcgttcgaaagtctccgcggcgccaaagaacagcggcccctcgatggtgtagatcagcacgcccggtggcagatgcaactggccgttgccgtgcagctcgtgctgcaggtcctgttccaccacctgttgcacctccaccgaggaggccatgcgccgcaggaaatgcagcatcgccagaatcaccccgatattcaccgcgatcaccaggtcgctgaataccgtgagggtaaaggtggccagcagaatcgccacgtccgcccggggcgcccgctgcaccatgcgcttgaagtggtgcagctcgctcatgttgtaggccaccacgaacaggatcgcggccagggcgcacagcgggatattggccgccagcggcgcgagaaacaggatgatcagcaccaggaccagcgcgtggacgatgcccgccagcgggctgctgccgccgttgcggatattggtcgcggtgcgggcaatggcgccggtggcggcgaatccgccgaacagcggcgtggccaggttggcgatgccctggccgatcagttcctggttggagtcgtggcgggtgccggccatgccgtcggccaccaccgccgacaacagcgactcgatggcgccgagcatggcgatggcgaaggccgggccgatcaggtccagcacccggggcaggctgatctcgggcagttgcagcgccggcaagccctggggaatgccgccgaaggcactgccgatggtggccacgccgtcgaactggaacagtgactgcagggccgtggccagggtcatggcgaccaggggcgccggcaggcgtttgagctgcgcgaccctgggcacgccccacaacagcgccaggctgagcagggccagcagggtggtggccaggtgcaggtcgggcagggcctgcaacaggtgccagagcttctggtgaaagtgctcgccgccgacggcgggcaggccgaagaagtccttccactggctgacccagatgatcaccccgatcccggcggtaaagccgagtatcaccgggtccgggatgaacttgatcagggcccccaggcgactgatgcccagcaggaacaggatgatccccgccatcatggtcgccagttgcaggccgtcgaccccgtacttggcggtgactccggccagaatcacgataaaggccccggtgggcccggcgatctgcaagcggctgccgccgaacagcgacaccagcaggccgccgacgatggcggtgtagatcccctgttcaggcttgaccccggaggcgatggcgaaggccatggccaacggcagcgccaccacgccgacaatcaccccggacaccaggttgcgggcccagtgcgcgcgtcccagcaatccggctttccacgcctcgcgtatggcaatcatggctcactcctgaagtccggcttgcagaccacgcagctcaatcatagccaaagccgggaggcgcggcccctggcctgagtcagtctttgcgcggctatctggagccggtgctcaaggatggcggagcgcggtccgcggcgtttgcgttcctgcctcagctacgcttcttataccgcgccagcctcggccacccccgtgtatgccggggtatcccggcatacacgcaaggtacggtggttaacaaaagataacgtggcgtcgattgtcagacgtttctaaagcccgataggataggtcagcttccgaaggggctctagattgcaggtttcaggacggtgtcctggatcccatgccccgaacggcgccctgtaaaggttgaacgacctaacaataataaatgggggaaaggtctatgagtgagcctgtcatgggtgtgagttcctgccgcccgccggccttgcgcagatttgcgttgctggctacagcgctctcgctgttgggggtcgccctgttgccggccccggtccaggccgctgcgtccgcggcggacactgtctattccaccgaatcgaccaaggccagcaagggcctgatgctcgatgtcgtgcatgccggttcgcgcctggtcgccgttggcgatcgcggacacattctctattccgacgaccagggccagacctggacccaggccaaggtgccgacccggcagctgctgaccgcggtgtatttcgtcgacgccaagcacggctgggcagtcggccacgatgcccaggtgctcgccagcgaagacggcggcctgacctggaccaagcaattcgaagacctcaagcgcgaagcgccgctgctggatgtgtggttccaggacagcaacaacggttttgccgtgggtgcctacggcgcgctgctggccaccaccgacggcggcaagcactgggaagacgccagcgaccgcttggacaacgaagatcagtaccacctcaacgccatcgccgcggtgaaggattccggcctgttcatcgtcggcgagcagggcagcatgttccgctccgccgactgggggcagacctgggaacgcctcgaaggcccttatgaaggttcgttcttcggcgtgatcggcaccgcccagcccgccacgctgctggcttacggcctgcgcggcaacctctatcgctccaccgatttcggcagcacctgggagcaggtcgagctcaaggcggctcgcggcagcctggagttcggcctgtccggcgccacgctgctggacgacggttcgctggtgatcgtcggcaacggcggcagcgtggtgcgcagcaccgacaacggcgtgaccttcagcgtctacaaccgtccggaccggatctccctggcagcggtgacggcggccggcaatggcaacctgattctggcggggcagggcggtgtgcgctcgacctcggcgaatggcgccgatctcggaaaataatcagggcaagcaagccaggccaaataataagaaggcgggaacacttccatgagcagtcatcaaaccgacaaggcgacgtttctcgagcgtctgattttcaacaaccgcccggcagtgatcgtcatctgcctgctggtcagcgttttcctgttctggcaggccacgctgatcaagccgtccaccagcttcgaaaaaatgatcccgctcgagcatcccttcatcgagaagatgatggagcatcgcaacgacctggcgaacctgggcaacaccgtgcgcatttcggtggaagccaaggacggcgacatcttcaccaaggagtacatggagacgctgcggcagatccacgacgaggtgttctacatctccggtgtcgaccgctcggggctgaagtcgctgtggagccccagcgtgcgctggaccgaagtgacggaggaaggcttcgctggcggcgaagtgatcccgcagagctacaacggctcggccgacagcctcgacctgctgcgcaacaacgtgctcaagtcggggcaggtcgggcgcctggtggccaacgacttcaagtcgagcatcgtcgacatcccgctgctggagtcctacccggacccgcaggaccagggcaagctgctggccctggactaccagaagttctcccacgagcttgaggaaaagatccgcgacaagttcgaggcgcagaaccccaatgtgaagattcacatcgtcggtttcgccaagaaggtcggcgacctgatcgacggtctgatcatggtggtgatgttcttcggcgtcgccttcctgatcaccctggtgctgctgtactggttcacctggtgcatccgcagcaccatcgccgtgctcatcaccaccctggtggcggtggtctggcaactgggcctgatgcacgccgtgggctttggcctcgacccttattcgatgctggtgccgttcctgatcttcgccatcggcatttcccacggtgtgcagaaaatcaacgggatcgccctgcaatccagcggtgccgacaacgccctgaccgcggcccggcgcaccttccgccagctgttcctgccggggatgatcgcgatcctcgccgacgccgtgggcttcatcaccctgttgatcatcgacatcggggtgattcgcgagctggccatcggtgcgtccatcggcgtggcggtgatcgtgttcaccaacctgatcctgctgccggtggcgatttcctatgtcggcatcagcaagcgcgcgatcgagcgcagcaagaaggatgcgacccgcgagcatccgttctggcgcctgctgtcgaacttcgccagcccgaaagtcgccccagtgtcgatcttcctggccctgctggccttcggtggcggcctctggtacagccagaacctgaagatcggcgacctcgaccagggcgcgccggagctgcgtccggactcgcgctacaacaaggacaacaacttcatcatcaacaactactccaccagttccgacgtgctggtggtgatggtcaagaccgcctccgaaggctgctcgcgctacgaagccatggcgccgatcgacgagctgatgtggaagatgcagaacaccgagggcgtgcagtcggcgatttccctggtgaccgtgtccaagcagatgatcaagggcatgaacgagggcaacctgaaatgggaaaccctgtcgcgcaacccggatgtgctgaacaactccatcgcccgggccgacggcctgtacaacaacaattgctcgctggcgccggtgctgatcttcctcaacgaccacaaggccgagaccctcgaccgcgcggtgcatgcggtgcaggcgttcgccaaggagcacaacaaggagggcctggagttcctgctggcggcgggtaacgccgggatcgaggcggccaccaacgaagtgatcaagcgctcggaactgaccatcctggtgctggtgtacatctgcgtggcggtgatgtgcatgatcaccttccgctcctgggcggcgaccctgtgcatcgtgttgccgctggtgctgacttcggtgctgggtaacgcgctgatggcgttcatgggcattggcgtcaaggtcgcgaccttgccggtggtggcgctcggggtggggatcggcgtggactacgggatctacatctacagccgcctggaaagcttcctgcgtgccggcctgccgttgcaggaggcctactaccagaccctgaaatccaccggcaaggcggtgctgttcaccggcctgtgcctggccatcggcgtggctacctggatcttctcggccatcaagttccaggccgacatgggcctgatgctgaccttcatgctcctgtggaacatgttcggcgcgctgtggctgctgccggcgctggcgcggttcctgatcaagccggagaaactggcggggcagaagggcaactcgctgttcgcccactaagccttgcggctgcaagcaaaaccgcgacccaggtcgcggttttttattgcccgtctccgtgacctgtagccgctgccgagcccgcgaggctgcgatcgaccggcacggtcgcggcggtcttccaggtccaggagggccttcggccctggcgcaggcttcgccagcggctacagggtttgtaacaatggggcgcgcgaactttgcaatgccactacagccgcgccgcgccggacccgctatcatggccgctttccattgctgactgacgaccatgactgccgctacagacactttgctgactgccctccaagcctgcgacatgctggaaatcgacgggctgcatgccttcgacttcacccttgacgaccaacagctgctgatcgaatgcatggacggccgcgcggccaagcgctggagtttcagcctggcccaggtcaacgccgcgaccttcgacgataccctgcagagctggaccatcgtcggcgattccggtgagcaccgcctggtgtgcatgagtgctttcagtgcccgtaacgatgaggaggatgaacatgaggatgcgtaacttctggccactgctgatggctggcagtgtcggcgccatggccgtgcaggctgcgccggtcgagacccaggaactgctggtcggttcctacacacagggccagagcgaaggcatctaccgcctcaagttcgacggccgcaccggcaagatcgacgccaagccgctgcaggtggtcaagagcgccaacccgtcctggctgaccctgtccaaggaccagaaacagctgttcgtggtcaacgagaacgggccaggacaagccgacccgatcggccgggtcagcagcttcggcatcgaagccaagagccgcaagctgaacccgatcaaccaggtgcagagcctgggcaacgagccgacgcattcgagcctgagcggcgatggccgctacctgttcgtcagcaactattcggtggtcgcggatccaggcggcagcctcgcggtgttgccggtcggtaccgatggcaagctgtcgccggtggtccagctcagcagccacccaggcagccgggtcaaccccgagcgccaggtggcggcccacgtgcattcggtggtgtcgtcgccggacggccagttcgtgttcgccagcgacctgggcgcggacaagatcttcgtctaccgctacgaccccaaggccaacgccgagcgccccctgaccgcggccgagccggcgttcgtcgagctgccgccgggcagcggcccacggcacctgctgttcagcgccgatggcaagcacgcctacctgaccctggaaatgagtgcccaggtggtgatgttcgattaccaggacggcaagctgacccagaagcagatcctcgacttgaccagtggcggcaaggacaagaaggcggcgggcgcgctgcatgcctcgaaagatggcaagtatctgtacgtgagcaaccgcggcacggccaatcagttgctggtgttcgccatcgacgaagccaccggccagctcaaggagatccagcgccgttcggtggagggcgatcaccctcgtgagttcagcctcgatccgagcaacaagtacgtgctgatcggcaaccagaagagcaacgaaatcgtggtgatcgagcgcgacgccaagaccggtttcctcggcaagaccgtgcagaaactgccgttcgattcacccagcgatatcaagttcctggtgcgtcaataagccacaggccccggttgacggggcctgagcctttctattaatgacgctgatatctgctactgctggaaaagatttcaacccgccaaccctcgggcgtagttttgcttcacggcccggcgcatcaaggcttccgggcaaacaagccgactgcatacgagggttacccgaatgaacttcaatctcttctccgtgatcgccgcttccgccatctccgctaccgtggccctgccagccagcgccaacgtggaaatcagcgagaaaaaatccgcgaccaacacctacacccagaagtacctgcaacagagcgccaacttctacgccgccctggatcacaagatccaacactgaaattccccgcaacgcccaggtatgcaggagcgaagtcactggcttccctgaatggactcgttcatccagcggaccggcagtgatgtcgctcctgcatcacctgtatgcgacgttttcccctctgccaggcaaattagcttggtaatgtcatatcgccatatgtttaaatttgacgctaattaattgactcctcctttccaaggatcgacagcatggcgatgcgtctggcagtggttcttctgttcctttattccaccccgattctctcggctgcccagcccgtcgaaggcgagccggaaacctctcgcgagcgcatgctgaccctgcttggggattgattggccgcggattcacgatcaatccaactgatggtgactatgcaccgaggttgtttctgcggcgggcgcttttaacggattctgtgggcacgcaaacatgcccacggagaccaccatggcccactcgatcctcacctctgccaagcgcggcgcctatgtcgccattggcctgtacctggccatggtcctcctggtcagcctctcggcccagactccatcggcagtgcaaccgccgatccaggtcgcttacccggccatccagtttgaacaccgcgcgcaagccgccgaacaccctgcggatgcgggagtggcgctgctatgaaaggacgcaggttctgggtcattgccgtcctggcgttcatgaccaatggcgcgtccttgctggggatcgggcagggctcggcgggctcgctggcccgggctatcgaatgcaatcacaacatcgcccacaacattgaaaccgccaaggccctgggcctgttggccggcaacccgccagccaaacccaaggccgcgttcttcggcccgttcagcgtcgattgctcggcgttgcagatgtgcagtgtgctggcctgatccgaggaacaaccctgtagccgctgccgcaggctgcgataggtccgaaggacctccagcgtccgagagatcgcagcgcccgttccggtcgatcgcagccttcggcagcggctacaggggcggtttggccatcacctgggtgaacagctccgactccaggaaccgctgcaaccagcgctgcaaatgccggtaaggcgtctgcgcgaaccattcgcgatcgacatgggcgaactgccgcacgaacggcgccagggccatgtccgccaggctcgggtgatccgccagcaggtaatcgcgctggctcaacagctcatccaactgccgtagaaatacttctccctggccacggtaatgctccatcggctgctcgggataacgctcggcgtatttgtagcgattgaggtgcagcttgaacacctggtcgttttccgcgatcagcgcgtcgatccggtgctgcgccggcccatcgtccttcaagagccagtcctgcggatcgttctgggccagggcccagcgcatgatatccaggctttcgtcgatcacccggccgtcaacgctgagcaccggcaccgtgcccttgggcgacagcgccagcatcgccgccggcttggccttgaggctgacttcgacgatctccagcggcaccccgctgtagcgcagcgcgaggcgcgcacgcatggcgtaggggcagcggcggaacgaatacaacgtattcatttcacctccagggtactcaggccgttgccctggcgtcgtacctggatctgcaccggaatccgctcgtgcatttcctgcacgtgggaaatcaccgccaccttgcgcccctgggcctgcaagccgtcgagggcgtccatcgccagttgcagggattccggatcgaggctgccgaagccttcgtcgataaacagcgactcgatcttcagcgtgctggaagccatggacgccaggcccagggccagcgccagggacaccaggaaggtctcgccgccggacagcgaatgcaccgagcgcagttcatcgcccatttccgtgtccatcaccagcaggccgagcatgctgccgccgcgcttgaggcgatagcgccgcaccagctggcgcagttgcgcgttggcgtgatgcaccagcagatcgaggttgtaggcctgggcgatcttgcggaaggtgtcgccgctggccgaaccgatcaaggcattgagccgcgcccagcgctgccattcggtgtaggcctgggcgatctgttcgctcagcgcctggttggcgtcttgccggcgctggtcttcggtctgctgggcgcgcagttcggcgctcaactgttcgctggcggccagctggttgtgcagctcgcccaaggcgccggccagttgttcggcgtcgagctggccgttgtgctgggcctgatggctgtgcaggcgctgctcgcgttcggtgaccaggaccctggcctgttccaccgccttttcgcgctcttgcagctgctggcgcaacgcggcgacctgctggtcgtcgaggctgagcaattgctccagcgcgccgtcgtccagctccgggtgctgctggcgccagtcggcgatcttgctgcccagttcctgctgctcggcttccagggccagcaggcgctcctccttgccttgcagttccgcgcccagttgcaccagcaggcggcggacttcctgcaactgctggttggccagcacctcggcggcgcgcgcctgttccacggcctgttccagatgctgctgccactgttcggcactggcatgttcgcccagcagttgcgcgagcttgttgtgggcggcttgctgctgttcggccagggcattgaattgctcctgggcggcttgcagttgctgcacgcgggtctgctggcggtcctgttccttgtccagggccagctggcgctgttgctgctcttgcgcttcttccttctgctggtcgagctgctccaggcgctgcatgacctgctggtcgatctgcatgaacgtcgcggccgggtcgttgcgcagggcttcgagggtatcggccggcagcagggtggcgaaggccgacagctcttcttccaggcgctggcggtccgcgcccaactgctgttgctgctgggtcagctgttgcgtggcctcgtggctggcttcgaccgccgcttgcagttgctgttgcaggcgcccggcgtccttttgcagtttcagcagggcgccttggcgctgttcgtcctgctggatgctctggcccaactggttcagttgctggttcagccaggcatcgcgcttgccggcgtcctggtcgagcagcgccgccgacaacggatgggcttcgatgcttggcgccagggcctgctgctggcttgccagttgttcctgttgctggaggaattccttctgctgggcgatcaggccgccgacctggctgcgcagctcggcgagtttctccttgagttcatccaccgccttgcgcgcgttggcttcttcgttttcgtcgtggcgacccaggctctgcagcagcgcctcgggttgatggtagggatgctcgtggctgccgcagaccgggcagggctgatcgtcctgcaactgttcgcgcagctcttcgacactggcactgcgcgccaggcgctggcgttccagcagttgctgggtcaccgtcagggtctgttcggcgaccgtgagttcggccttgctctgcaggccgatccggttcagctcttcgcgctggcgcgccgcggcctgcagtttgtccgccagctccgcgccgcgtttgtccagctcctgttggctggcccacagccgcgccagttcttcgaaggcgcgctgttgcttgcggttgtcctgcagcaggtcgctgaggatctgcaactgttcggccaccgcgtggggctcggcgccggcttcgctgtacagcacttgcagttcatcgcgttgcgcggccagttgctgcgcggcgctggcggctcgttgttgcaggccgggcagttcttgctggcccttgttcagccggttgccggccagcatcaactgttgcaggcgatcgcggtaggcgttccaggcatcgctcagcggcgccagatgagtactgtgttccaactgttcggcaatccgctgcaggcgttcgcccaccaggcgctgctgttcgagcatggcctggatcgcctgctggccttgttcgctggcctgttgcagtttgtccttgagcgcgccggcttcaccgcaggtcttgcccaggtgggcgagggtgctttgctcggcaaaggcctcgcgcagcagcggcgcgctggtgttttgctgttcctgggcggcgagcaacgcggcctgggccgcacccaactgttgctccagttcgccctggcgttgttgctctgcgccttgttgctgacgctgttgctggatctgttcgcgcagcggtgtcagttgctggttcagttccacctgccgggcgaactgatggcgttgcggcgccagctgctccaggcgggtcagccgggtccgttcgctggtcaggccttcccaggccatttgcgcctgttgcagttgctcggcggcgctctgctgctggtcctgcaactgctgcaactccttgagccagccgtgttgcagctccagctgcttgagctgcgcctgctgggccttgagctgctgctgggcggcgtcgaagcgctggtccagttcggcccgggcctcgggctccagcggggtgatgccactggcctgggccttgagggtcttgtgctgttcctcggcttccttgctcttgctgtaggcgcgccgcccgagctggctgtagattgaggtgttggtgagcttttccagcagctcgctgcgttccttgtcgtcggccttgagaaaggcgctaaactcgctctgggccagcatcaccgcgcgggtgaactgctcgaagttgagccccagcttggcttcgatcaattgctcgtagtcacgcttctggctggccaacagttgattgctgtccaggtcgtgcaggctctgcttgctggcctgcagcttgccgttggccttgtcccgggcgcggttggtttcccagcgggcgcggtagcgatggccgtcgatgccgacgaagtcgacctcggcgtagccgctgccggtgccacggcgcagcagggtgcgcgggtcgctggtgagcatttcgctgtcgacctccggcaccttggtttcgcggccgatattgttcagccgcggcaccgcgccgaacagcgccaggcacagggcgtcgagcagggtgctcttgccggcgccggtgggtccggtaatggcgaacagcccggcgctggccaggggctcggcggtgaagtcgatttcaaaggggccggccagggaggccaggttcttcaggcggatggcaagaatcttcatggctgctcctcctcgtgctgcacttcctggagcagttgcgcgaagtccttgagggtctgttcgtccacctcgctgccgtagctatccagccaggcgcggctgaacaggtcctgtgggctgagctggtccagctccaccagttgcgcggcgccgtcgtcgccctcgcgaccgccatggccggcgtattcggcggctatgcgcaccaggcgcacggccttgccctgcagggcgctttccacttgctggcgcaggtccggctgcggctcgtccaggcgcacccgcacttccagccagggctggcgctgctcttcggccagcaggtcgatgtccggcaactcggccagttgcagcaggatctccgccagcggcgccgggcccaggcgctgtaggttgaccgcgcgcgggatcagccgtggttcgacgctgaccagggtctcgccgtcgagctggatatcgaggatctggtgctggtagccgatctcggagaacgacagcggaatcggcgaaccgctgtagcggatgcgctcctcgccattgaccttctgcggcttgtgcagatgccccagggccacgtagctgatgctcgggccgaacaggctggcgggcagggcctcggcgttgccgatgatcaggctgcgctcggagtcctccgataccgagccaccggccatatgcgcgtggctgatggcgaccagcgcctggcccggctggcgcttggcgttggccgcggcgatcagccattcatgcacctggccgatgccccgcaggtaatcgtcgcccaggtgcggcccggtgacttccgccgggcgcaggaacggcagcgccaggcaccaaccggcaatcgcgccgctggcatcgggcaacggcagcaacagacgctcactgtccaactgcccgtcgtccagccacaacacccggcccaaagcgtgggtgcgcagacgccgcatcaagggcgccggcaactcgatgcgcgaacccgagtcatggttgccggcgatcatcacaatggtcaggccgggctgctgttcatgggcgctgacaataaagtcgtacagccgctcctgggctttgaccggcgggttgaccgtgtcgaagatatcgccggcaatcagcagcacatcagggctgtgcagcgccagctggcgcaacagccattcaagaaagcaggcatgctcgaaatcgcgttcctggccatggaggttctgccccaggtgccagtcggaggtgtgaaacagacgcaaggcaaactccgcaaacaatcaggtgagccgcagggaagaggagagcggcgtgaggggggagagtttactgcaaatcggctggggggcctggttggatggcgaatagtggtgccgtttagcggcagccaaaagttgacgctcggcaagagagcgcttgagtcatgggacgaggcttgcgcggatcattcaagtcgcttcgaaaaagcgagccagggagcggggtaatgaccccacccccattcgtagtgacataccccatgttcgcatctcctgtgtggaaggtaggccatgaccgaagcgagttccgatcgcagcctttcatgagcaacgtgcgccctgtccaataggcattccggcgggggttggctctggtctggtgtccactttcccctgggtccatggcggtcgagcagtgctttacacctgcgctgcttggccgccaatttactttaggtttaaagtcaactttaaggtcaatggtttttcgggtgggaatatgagaattggcgaactggcgaaaatcagcggattggcgccttcacgcatccgcttctacgaagcgagcggcctgatcaaatccgtcgagcgcaaagccaatgggtatcgggactacgcacctgacaccgagtgggtcctggagatcatcaccggggcacaggcggcaggtttttcgctggaggagatccgccagttactgccgatgaatgccaacggatggcggcatgaagagttgctcagtgggctcaagcgcaaggtcgaggaaatcgaaatcctccagcaacggctggcccagaataaagcccaactactgcttgtgatcgagagtgtcgagagtaagcccgagggcgtgggctgtgtggagaacacgcagttgttattgcatcgtctgcgcgaagagggggtggcgcccgcttcaggccgccgtaatggtgcgtcttccaagtaacacgcaacctctcaggctgataaggcctgacaggggtaaaaagccatgcccctttgatcagttttcttcgctgtgaaggacacgtccacctggtcggtctggctgtcggtaatgtcatagaccaccgaggtcgcctcttcttttcggttaatgcccgtcagccatttcggcaggttataaccgacaacgccgcgaaccctggcaagctcggcactgaactttaaggtcaagcgccgtgagctggcttttttcgttggttttcagcgtgccgtttgcaatggctcagcgagttttattgcccgccgagagcaaggccatcacggcttcagccacggccctgggcgactgagggttctgccccgtcaccaggcgtccatcggtgatggcaaatgaggtgaatggcaaccaggccttgcggtaacgcgcaccctggccgaccagcctgtcctcgaggaagaagggaacctggttcttcatgcccgaaagcagctcttcgcgatttgagaaaccggtgatgtttctgttcttgataagtgcctggccttgctcatccttgagatccaccagtcccgccacgccatggcagacggctgagacgatgccgccctggttgtagatcttttcggcgacacgacgcaggtccgggttttcgggaaagtcccacatgacgccgtggccccccgtgaaatagatgacgctgaaccgggagggatcgatgtcggcgatcggtatcgtgttgttcagacgagcgcgaaacgccggtgactgcaaatgctcacgggcggccttgtccatatagagccaaccgaggctgcgctcgtccagcggaactactccgcccttggggctggcaaaaaccgtcgtataaccggcagcctcgacgacatccgtgaaatgcgtcagctcggtcaaccacagccccgtggtgtcggtgcgtgagggatagctggcgtggttggtcatgatcaccagtatctggcgatccttcggtattgcagtggaagggttggtttcagcatttgcaaaagtcatgaatacaccgcctatcaataccaacgcacaagaaacaagggtcttcaacatcatccgggctccgactgtcatgcagtgccagtcatgctcaccttgaaccatgctttaaggtcaatccccatatttccaaaaagcttccgttggcgctggtgcgcttctgcttgactctaaacctgacttcaacattagcgtctggcgccgattgggcaagaacgcacttaaccatccagtcaggagccacagcatgagccagcaagaccaccccgtgacgcagatgaaatggatgatctatggcgcctacgggtataccggcgatctgatcgcccgcgaagccgtcaagcgtgggctcaggccggtgctggcggggcgcagccgcgacaggatcgaacccttggcccgggagctggggcttgaggcacgtattttcgggctggatgacgaggtgcgactgctggcacagatcaaggggcttggcttggttctgcattgcgcggggccgttttcggcgaccgccgcaccaatgatggacgcttgcctgcgggcccattcgcactacctggacatcaccggcgagatcgccgtgttcgagcatgcccagttcctgcatgagcgtgcacaagcggcgggcgtggtgatttgccccggcgtcggcttcgacgtgatccccaccgactgcgtcgccgccgcactcaaggccgcgctgccggatgcaacgcacctggccttggggttcgattcgcgctccagcttgtcgccgggcaccgccaagacttcgatcgaaggcctggcccagggcggcaaggtacgtcgcgaggggaaaattgtgtctgtacccttggcctatcgggtgcgtcgtatcgactttggcgctggagagaagcttgccatgaccattccctggggggacgtttccacggcctatcacaccaccggcattgccaatatcgaggtgttcgtgccgggctccgccggcatgattcgcggcgccaggttcgccaacttcattcgcccgctgctgggcttgtcgttcgtgcagaagcggctcaaggcccacatcggcaagaccgtgatcggcccggatgacgaaaagcgcgccgatcagggcacctatgtctggggcgaagcccgtaacgctcgcggcgattgcaaggtggcgcgcgtgcacaccaccaatgtctacagtctgacggtctacggtgcgctgaccgtggtcgactacctgttacaggcgcgcccggctggcggtgcctacacacctgcgaggttgctgggcgccgatctggtgacgcgcttgccaggatcgggcgccttgaacatcgaataggcggtgtccgatgaaactgtcggatgcagttgaaaaaaggtattgaccttcaagttcacttcaaacttaggctggtcccacgtcaaatgagggactgcccatgaatgtgttcgacaccctgatgctccccaatggttcgaccatcaagaaccgcgtcgccaaagccgccatggaagagaacatggcggacgccgaccaggcgccctccgaagaactgatgcgcctgtatcaggcgtgggccgatggtggcgccgggctgataatcacaggcaacgtgatggtcgatggccgcgccatgaccgggccgggcggcgtggtgctgcaggatgaccagcaactggacaagttcaggcgctgggcacggatcggtcgatccggcggtgcgcagttctggctgcagatcaatcatcccggccgccagatgcgggcaagccttgggcagaagacctgggcaccgtcagccataccgctggacctgggcaaaatgtccaagcacttcgccacgccccacgcgatgacccccagcgtgatcgaagaggttatccagcgcttcgcacgggctgcgcgcctcggtgaagaggccggtttcaccggcgtgcaaatccacgcggcccatggctatctgttgagccagttcctgtcgccgctgaccaatcagagaacggacgagtggggcggctccctggaaaaccgggcacgcctgctgcttgagattgtcacggcggtacgggccgtggtttccccaggctttgcggtggcggtcaaactcaactcggccgatttccaacgtggcggattcaccgccgatgacgcaaaaaaggtggttgagctgcttaacgacctgggtgtggatctggtcgagttatccggtggcagctacgaagtgccggccatgcaaggcgaggcgcgcgatggtcgcactctggcgcgtgaggcctatttcgtcgagtttgcccgtgacatccagaccgtcgccaggatgccggtgatggtcaccggtggcgtacgccggcgtcccattgccgaaatggtcgtcaagagtggcgtggacatggtcggtatcggaacggccttggccatcgatccctacctgccgcgtgattggcttctgggtaaagacaatgcaccgcaattgccaccgatcacctggaaaaacaaggccatcgcgtccttggccaacatggcggtcgtcaagttccagctgcgcaaactcagccaggacaaaaagccctatccaggcgtgtcaccgttacgcgcgctgctcttgcaacagctcgccaatgcctgtcgcactcgccaataccggcggtggatagaacagcgttcggcgtgattcgatgcccatttcaaccgcaaaggctcaagggtgaaatccactttggcgagtagctgacagcgtctgcttttggccgaacgcaggctgtcagtcccgctcaaacccgcgccagcagtagcaaatacatcctttcaagcagattcctgcactcccgccatgcggcacccagcccacgttgttcatattgctcgaacagttcgaagcgctcctggcgcagtccggtagtgcgcagggccaggcagtcggctaaggccagtcgggacaggctggcatctaacacagggtagggctggctcgactgaataagccaccccaactccgtctgctcgacattgcagaacaacaactggcaatcagccttcagttcatgatcgagaatcgagttcagccgctcccgcaggaggtcggctggctcgaaggcgctgcccctcaaatgggtgatgagcagaaaacgggcgctggaggtgatgatcaaaattcgtggcctgcctcgacgggggagagcggggattagctcactctcggcccgtgctggggaaggggacaattctgaaatggggtgcagaaaccgcagcgcaaggctgcgcggtttcctgggttatttcgggtagagcggcggcaggctgctggtgtcggccagtggggcctggacgtgttcggcgatcgggatggcgcggatcgcacgccacagttcttcgccttgccagtagtggccggtttcgctgtagagcgcgccgttgaggccgtccagggcgtcggacaggggcacgaagcgggcggccatgtcggccagggtttccggttgctggcgggcccaggcgtccagggcctggcgggtggcttgcgggtcgttggccaggctggcgcgcttgaggtcgtcgagcagggtgcgcgggttggggccggcctgcacggcgcgcaggattgccggttgccagcgcgcgcgccaccagaggccgaagccgagcagggtggtgcaggccagcagcagggtgctgagtttccaggcccacagcgtggagctgtcgccaccggcgccagatggcgtcgtgccggccggggtgtccaccaccaggctcgggttgttcgccacttgcagggtacgcgccggcaggctgctgtgttccaggtggtcctcatgggtgttccaccagaccacttccagtgccggtaggtcgatgctgccgctgcggttcggcaccagggcctggctgtcttcgcggctgccgatcagcccgcggtcgctgacctgattgctcagctgcggctggtccgggtagctgcgcaggccgttggcttcggtcaccggcaagggtggcagctgcgagctggacaggccttcggccttgagggtcaggctgcgggtcaatgagtcgccgacctggctatggtccggctcggggttccagctttcgctcaggctcaggctgcgggccggcagccaaggcgcgtcggccgggtattcggctggcttggccttgaccgtcagcggcatctgcgccgagctcacgtgcatcagcttgcccggcttcaggccctggggcgccgagtcctgggtgctggcagtgtcggccagggtggcgctgaaggtcagctccggaatgtccagcacgccgctgtgctgggggaagatcgcgtagcggatctcgatcacgccgtggcgcacgccgttgatgactttttcataggtgcgcgactcgccgagctgttcgacccgggcgtcgtcgatctgcaacggcgtcaggctgctgtcgtcgtacagcgacaccgagtgatagatgtgcagggtcagcactgcctgggcctgcacgtagacgctgtcctggtcgaggctggcgtcgatgaacaccggctccagcggcgcgctgtcgctgcggcttgcgctttgcagcacctgcagggtgatcggctggctctgtacttcgcccagttgcagggccgggatcaccacggtgccggtggtcctgggcagcagggtgatgatccagcgggtgatggcgcggttgtcgccgttgaggctggtcaactggttgacctggcgcgtgccctggacctcgaactgcgcttgcagcggggtcaggtcgggtttgccgaacagcgtgacattgttggattccagggtcagctcgacggtttccccagagttcacgcggctgcggtcgacactggcgaccagcccctcggcccgggccgcaaaggcgccgagtgtcagcacaagcgtgagtaagagggcggtgaagcgggtcatcgaatttttccctgatcctgatgttgttgctgttcgtaccagaacttgcggcgcagcagttcgcccggatcgtccggaatctgccgcagccattgttccaatgcctgacggtgttcgccgtcgaaattgtcctgggcatcgcgcagcggcggcgtggtggtctgttcgtcgcccagttcgctgccgggaaccgcatcgttgcccggggtggcgacctcgtcgtccgtcgcctcgtcggcggtggtggggtggctgttctccggcggctgctggcccggggtgaccggtgcctgggtcgccgcgccggcttgcggcggctggcgggtttcgtcgttgtcctggctttcgcccttggccggttcttccgcgggcgcgggctcggtttcctgcagcaggcgttcgaccagggccttgttcttttgcgcggcggcaagctccggttgcagttccagggcctgctcgtaggcatccagcgcggcttccagctcgccgctcttggccagggcgttgccacgattgtagtgggcgcgggcgtcgttgccttcggcaaagcgctgagcggcagcggcgtagttgccggcctcgtacagcgccacgccttgccactgtgggtcctcgaaatgctgcgcggcctctccgggccgcttctgttccagcaggcgctggccctgctggtcggggcgcagccacaggtcgttgaactcgaaggcgtagctgggctgcggcacggcgaacagcagcagcggcaggcagaacagccagccgcggcgcccggcgcaggcggccagcagcaacagtggcaggagcagccagtaaccctggtcggcccaggtgtccaggcgcagggtctggccgtcgctgcgcaggttctgcggaccgctgagcaggcccaggccacgcaggtcgttatcgtccaggcgcgccgggcgatagcggccgcccatttcgccgatgaagcgcttcaggctcggaccgtcgaggcgcgacataaggatcgcgccctgttcgtccttgagaaagctgccgtcttcctgggccaccggcgagccctggcggctgccgatcccgagcatcaacagttgcggtgcctggccaccgagggcctggcggatgccttggcgttcctgctcgctcagggacgagccgatcagcaggatccggccctggcccagtgcgccctggtccagcagcttcaaggctttttgcagggccaggtcggcgcgatggccgggctggggcatgatcgacggcttgagggcttccagcaggttgcggctagtggccaggtcgtccgacagcggcaccagggtgtgggcgctgccggcgtagaccacgattgccgtctgcgcatcgctgcgcacctgcagcaggtccagcagcttgcgccgggcctgttccaggcgattgggcgggacgtcgccggcgagcatttccggggtcagttccagcagcaccaccagcgggtcggccggtttctggctggtctgttcgacccgctgccagccggggccgatcagggccagcacggcgagaatccaggccaggccgagggcgatccacggcagtttgctttcgcggccgttgccgccgctgagcagggcggcgtgaaaggccggcggcaggatcatctgccaacggccggcgcgtttctgccggtgccacaactgccacaacagccagccgagcagcggcaacagcagcagccaccagggacggaaccagtggggccagagttcggcccagaacggcgcgctcatcgacgcctccgcaggcgcaggcgtttgagccgttcgcgccagtctggcaaaggttgcagaaaacgctcgcgggtgaagaagcgttgcagcggatggtccggccagcgctcgcgcaccaccagtagcatgctcaacagcagcgccgcggccagcggccagctgtacagcgcttgcgccgaacgggcctgggtcggctgctgggtcaccggctccagttggtcgagggtgtccttgatcgcttgcagctcctggctgtcgcgggcgcggaaatagcgcccgccagtggctgcggcgatggccttgagggccggctcgtcgaggtccaggctcgggttgaggccaagcaaacccagggtgccgctttgctccgggtcggcgccgatgccgatcgggtagatcttcacgccttcttcggcggccaggcgggcagcggtcagcgggtcgatttcaccgccgttgttggcgccgtcggtgaccaggatcagtacccggctctgcgccggacgctggcgcaggcgcttgagcgccaggccgatggcgtcgccgatggcggtgttcttgccggcgatgccgatcttcgcttcgtccagccagacgcgcacggtgtgccggtcgaaggtcagcggcgcttgcaggtaggccttgctgccgaacaggatcaggccgacgcggtcgccttcgcggctttccaggaagtcgccgagcaggtgctggaccaggttcaggcggctgacgtcttcgtcctgccattgcatgtcggggaagtccatggagccggacacatccaccgccaccagcaggtcgcgaccgctggcggccaccggcagcggttcgcccagccattgcgggcgggcggcggccaccagcagcaacagccacaacagaatgaacggagcctgctggcgccaggtcggcaggttggctcgggcgcggcgcttggccaggccttccaggtcgctgaggaagctgacttttagcgccggttcgccgctgtcggccaccggcagcagcacccgcagcagccagggcagcggcagcagggcgaagatccacggccaggcgaactcaaacatgtttgcgaatccagatttccaccgcctgggtcaggccggcaatggccttgtcgtcgagcttgcactcgggcttgtaggcgccttccaccaggaccatccagcgcgtgaggccggccgccgggcagcggttgtcgaggaacgccagccacttgcggccgttgagggtatggctctggctgtaggggtaatggttgcggcacaggcgcttgaggcaagccattgagttgttgcagccaggcgccggcgggcgcgccgtcgtagggcttgggcagcaacgccagttcggcgagggcggccaggcgtagcgggtccagcggttgttcggcgcggggcagggcatgttggcgcggccagaagcgcttgagccgccacaggccaaagccgagcagcggcagcaacaccagcaacagccaccagcccggtgccggaggccacaggccgatggcgggcggggcgatcaagggttgcagttgctcgaggctgctcatcgggttttccccgggcgttgcgggttcaggtactcgcgcagttgctcgaccatttcgctctgggtgctcaggggcatcagcagcacccgcagtttctgcgccagcagttcccagcgggcgatgcgcgcttcgctctgcgcccgataggcctggcgcagttcgtagttgagggtgtccagctccagctgcgcgccgcgttcggcgaaacgcagcaggccggcggcgggcagggcgtggtccagcgggtcggacagcggcatcagcagcaaatcgcaatgccgcgacagcaggctcagttgctgttcggcggcgtcgctcagggcgcgctcgtcgcagatcacgatcaccaggctgcccgggcgcagcacttcgcggccacggcgcagggcggtgccgagggcgtcgcgctcgggttcggtctcgctgtgcagcgactggttgacccgcaccaggcggttgagcagttgcagcaggctctgcttgctgcgtcgcggcttgatctcgtagtgctcgtcgtcgccgaacaccaggccgccgacccggtcgttgtggcccagggcggcccagccgatcaggctcgcggcctgggcggcgagcaccgacttgaacatcagcccggaaccgaagaacagccgccggctctgctcgaccatgatgaagatcggccgttcgcgttcttcgtggaacagcttggtgtgcggttcctgggtgcgcgcggtgacgcgccagtcgatgctgcgcacgtcgtcgccggcctggtagacccgcacttggtcgaagtcgacgccacggccgcgcagcttggagtggtgcaggccgaccagcgggctgcgctggctcggcgtggaaaacagctgcacttcgcgcacgcgatggcgcatctcgatcagctcggcgaggctgacgcggatgcccggggcatcgacagggctggcgttcatcggggtcaagcgacggctacgacgtcgagaatccgctggaccacccggtcctggtcgatgccggcggcttctgcttcgaaggacagaatgatgcggtggcgcaacacgtcgaacagcaccgcctggatgtcctcggggctgacgaagtcgcgcccggccagccaggcgtgggcccgggcgcagcggtcgagggcgatggagccgcgcgggctggcgccataggcgatccattcggccatctccgggtcgaacttggccggggtgcgggtggccatcaccaactgcaccaggtattcctccacggcgtcggccatgtacaggccgaggatttccttgcgcgcggcgaagatcgcctgctggctgatgcggcgctcgggcttggtttcgccgttcagcgcttcgccacgggcctgttgcaggatacgccgctcgacggcggcgtcggggaagccgatcttgacgtgcatcaggaaacggtcgagctgggcttcgggcagcgggtaggtgccttcctgctcgatggggttctgcgtggccatcaccaggaacagtggcgacagctcataagtgctgcggccgacgctgacctggcgctcgcccatggcttcgagcaaggccgactggaccttggccggggcgcggttgatttcgtcggccagcaccaggttgtggaaaatcggtccttgctggaacacgaagctgccggtttccgggcgatagatttcggtgccggtgatgtcggcgggcaacaggtcgggggtgaactggatgcgatggaactgcgcttcgatgccttcggccaactctttgatggccttggtcttggccaggcccggggcgccctcgaccagcatgtggccgtcggcgagcagggcgatgagcaagcgctcgatgagtttttcctggccgagaatctgcgttgaaagaaaggttcgcagcgcgagtagcgcttcacgatgttccatcgatgactgttcctgcagagggtgaccgagggcgttcgaataacgccagggctgggggcgttactttaatccatccgggcccccggcgactaacggcacctggcaaatttctgtaaataaccgctaattgcccgcaaccgcgcagggtatttcgaggtttgggagaaggggatggcggcgggtgcctgacgcgccgccctcacggcgcgtcagtggcggggggctcagttcttgaagctggagtgcttgcggccctggtcgcacagggcgaagaccaccaccatcaccgccgagaccgccaggatcagcgccacgccgtcggtcgagtgagtcgccgagttggccaccagggccagcccacccaggggcgccaggccgccggcgatggcggtgccgatttcacggccggtaccgaagccggaagagcgggtctgggtcgggaactggcggctgaggaacgagccctggggcgcgaacatcattggtgccaataccccggtgccgatggcaatggccaggtagatcatcagcggctcgccggtattgagcaggctcaggaacggataggcgaacaacaccgagcagaggccgccgagcatcagcaccttcttgctgctccacttgtcgcagagccagccgaagcagggcacggcgactatcgccaccaggctggcgatggtcaccgacagcgaagtgacatgggcctcgacgcctttgtactgggtcaggtaggccagggagaaggtcttgaagatgtagctcagggcgttgtaaccgatggccacgaacagcaccacggccaggcccttgaggtcgttctggaacagcagcttgaggggcgaggcctgggccttggcactgtccttttcctgcgccttgtccagcttctcgaactgcggggtttccggaatgctgcgccgcacccacaggccgacgccaaccagggcgatgctgcaaacgaacggaatgcgccagccgccggagagcaggaagtcgttgccgttcatggtcagcaggtagacggtcagcgacgacagcagcaggcccaggttcaggcccagcgccggccaggccccctggctgccgcgcttgccttcgctggcgtgctcataggaggtcaccgccgcgccggacagttcggcgccagcacccaggccctggataatccgcaccagcaccaggatgatcggcgcccagatgccgatcgaggcatagctgggaatcaggccgatcaacgtggtgcacacacccatcatgcagaaggtgatgaccagcacctgcttgcgcccgaaccggtcgcccaggtagccgaacagcacgccgccgaagggccgggcgataaaaccgatggcaaaggtggagaacgccagcaacgaggcgactttcgggttgccggggtcgaagaagattttcgagaagacgatggccgccatggtggcgtacagatagaagtcgtaccactccagcatcgagccgaagatggtcgccgccgcgaccttgcgcaggcgtttttgtttttgttgcggcgtttcgcatgcggccggggccgcctcatggactgacatctgaggattccttgttgtttgtagttattttcaagcgggcgccaggcacccgtgcagcggggatcaacgggctttgcggattctctcggcaatcatctggccgatggggatggccgaggtcgcggccggcgagggggcattgcagacgtggaccatgcgcggggtttcggcgaacaggaagtcgtgcaccagggtgccgtcgcgcatcaccgcctgggcgcgaataccggcctcgtacggcagcaggtcggcgacttccagggatgggcagtatttgcggcactgttccaggtagccgcgcttgaacagcgagttcttcatctccgtggtgccggaaccgaggttattccaaatggttttccagaaaccggggaagcgtgcgtactcggccacgtcgcgccagttgacggagaacttgcgatagttctcccggcccaggccgagcacggcgttggggccgacggtgacgctgccgtcgatcatccgggtcaggtgcacgccgagaaacggcagctccggatcggggatcgggtagatcaggtgattgacgatggcgttcttcgccgccggcaggcggaagtactcgccgcggaacgggatgatctggtggtcgattttgaccccggccagggccgccaggcgatccgattgcaggccggcgcaggccaccagctgtcgggcgctccagaccttgtcgtcgctgctgatggtgactttttcggcggtttcgacgatggcgcgcacggtcgtttgcagttgcacttcgccgccggcctgctgaatgacccgggccatggcttcgcacacctgccggtagtcgacgatgccggtggcatcgaggaacaggccgccgaggccgacgatgttcggttcgcgccgctgcagctcttgcgcatccaggcgttcgaccttcaggccgttctgctgcgagcgctcgtacaaggcatgcatgcgctcgacttccaacggcgtggaggccaccagcagcttgccgcagacctcgaacctgatcccgtgctcggtacagaaatccttggtcgcctgggcgccgcgcttgcacaggtcggccttgaggctgcccggggcgtagtagatgccggcgtggatcaccccgctgttgtggccggtctggtgccgggcgaggacgttttccttttccaggatcagcagcgaggcgccgggctggcgttcgagcagcgccatggcggtggcgaggccaacgatgccgccgccgatgatgcagtagtcgtagatcatgcagatgtcaccttggttattcttgttcgggtctgatcatcaggttgtcagacaaagttaggtaaacaaaagacgccgcgcggcagcgtccgtcaggcagtgggttacaggggtttaatcgatactcggcaggtcgattttcaagcgcttggccgcggcccgcaggtgcgcttcggcgcaggcggcggcctgctgccggtcaccggcggcgatggcttcgtacagcgcctggtgttcgcggccggcatcggcggaaccgccgaccgaatgggccgccgagttttcccaggcggtgcgccgtgcttcggccagctggccacggagaaaatcatggaaggcgacgaagtagtggttcttgctggcgtcggcgatggctcggtggaactccacgtcggccagggcggccgcggccagatcgctgcgctggtcgtgcatctcttgcagggcgctgcgcatgcgttgcaggtcggcgtcgtcgcggcgctgggcggcgatggaagcggcctgggtttcgatccacaggcgcatttcgaacatctgcaccagatcgggcttgcggcccttctggctgggaaaacgaaacacgctgccgttggggttctgcgaaatgaacgagcccagcccgcggcggctgaccaggatgccgtcggccttgagttgcgccacggcctcgcgcaccaccgaacggctgacgttcagttgctcggtcagttgctgttcggtcggcaggcgcgattcggcggtcaggcggccggcatcgatctccttgcggatcgcgttgaccactcgttcgaccagggtgtcggggcgctggagctgaagcatggaggagggggctcataagtcaggttgtcagacaatgccggggcgccggtttcttgtcaagaaaccagtcgcttgctcacagcgggttgaatcaaagcccgtagatcagagctcgtaaatcaaagctcgtaaaatcagagctcgtaaagtcaaagctcgctgatataggtgccggtgcccttgaggatgttctgcagggtttgctcgacttccgccaggtccgccgccgcggtgttgtgcaggatctccaggtgatcgctgccattgagcgcgtcggcgtcggccgcggcgatttcgatcagcaggcgggtcgggcccagggtgactttcaccccgtccagggtcgagggttcgccgtccagggtgatctccagttcgtcctcgtccgggtagcgagtcatcaggaacatctcgccctggttgctgtggcagcagagcatggccatgttgtcttcttcgtcgtcgcacgggttggcgatcaggtgggcggtggtcatttgcatggggcgagtcctgggtctggctccgacgggggagcggggcgaacaaagtgcaattctgccagcccgggggaatttctgctgctttgtgtgtcagagaacaggtcacgatggcgtcgctgcaactgtccgtttctggcacgacagtcccgtaaagcctcggcgcgaccgccgttttgtccggcggctgctagtgttgttcaaggcttggcccgccagttgcctgccaatgaccgaatatgtcgcagcaccgcaagcagcgctcttgccgcactcgttaagctgcgcaacggatgagcacctgtaaaggcattgcccggcgcaccgcggcagtcgtttttgcagatgcccatccgggaacggtgaatgtgacctgagcgtctcatacagcttcaccaccctgtcatcctgcgacctctgcccgagatccaggagcaggatgaccgacacccccgcaaggggattgcatgcgacgctttactcaataacaagcccaagcggagtaccacagatggcgttcttcaccgcagccagcaaggccgacttccagcaccaactgcaagcggcactggcgcagcacatcagtgaacaggcactgccacaagtggcgctgttcgctgaacaattcttcggcatcatttctctggacgaactcacccagcgtcgcttgtccgacctggcgggctgcaccctttctgcctggcgcctgcttgagcgcttcgaccacgcgcaaccgcaagtgcgcgtctacaaccccgattacgaacgtcatggctggcagtcgacccacaccgcggtcgaagtgctgcaccatgacctgccgttcctggtggactcggtccgcaccgagctgaaccgccgcggctacagcatccacaccctgcagaccaccgtgctgagcgtgcgtcgcgggagcaagaacgagctgctggaaatcctgcccaagggcacccagggcgaaggcatcctgcaagaatcgctgatgtacctggagatcgaccgctgcgccaacaccgccgagctcaatgtcctgagcaaggaactggagcaggtgctcggcgaagtgcgcgtcgccgtggccgatttcgagccgatgaaagccaaggtccaggaactgatcgatggcatcggcaacagccagttcgagatcgacgccgatgaaaagggcgagatcaagagcttcctggaatggctggtgggcaaccacttcaccttcctcggctacgaagagttcgtggtgcgcgaggaccatcacggtggccatatcgagtacgaccaggactccttcctcggcctgaccaagctgctgcgcgccggccttaccgtcgacgacctgcgcatcgaagactacgccgtgaactacctgcgcgaaccgacgccgctgtcgttcgccaaggccgcccacccaagccgtgtacaccgtccggcctacccggactacgtgtcgatccgccagatcgatgccgacggcaatgtgctcaaggaatgccgcttcatgggcctgtacacctcgtcggtgtacggcgaaagcgtgcgggtgattccttatatccgccgcaaggtggaaatcatcgagcagcgctccggcttccaggccaaggcgcacctgggcaaggaactggcccaggtcctcgaagtgctgccgcgtgacgacctgttccagaccccggtcgacgagctgttcaacaccgtgatgtcgatcgtgcagatccaggagcgcaacaagatccgcgtgttcctgcgcaaggacccgtacggtcgtttctgctactgcctggcctatgtgccgcgcgacatctattccaccgaagtgcggcagaagatccagcaggtactgatggatcgcctgaaggccaccgactgcgagttctggactttcttctccgagtccgtgctggcgcgcgtgcaactgatcctgcgggtcgacccgaagaaccgcatcgacatcgacccgctgctgctggaaaaagaagtggtgcaggcctgccgcagttggcaggacgactacgccgcgctgaccgtcgaaagcttcggcgaagcccacggcaccaacgtcctggccgacttcccgaaaggcttcccggccggctaccgcgagcgcttcgccgcgcattcggcggtggtcgacatgcagcacctgctgagcctgaccgaggccaacccgctggtgatgagcttctaccagccgctgacccagtccaccagccagccgctgctgcactgcaagctgtatcacgccgataccccattggcgctgtccgacgtgctgccgatcctggaaaacctcggcctgcgcgtgctcggcgagttcccatatcgcctgcgtcacgccagcggccgtgagttctggatccacgacttcgccttcaccgcggccgaaggcctgaacctggacatccagcagctcaacgacaccctgcaggacgccttcgtccacatcgtgcgtggcgatgccgagaacgatgcgttcaaccgcctggtgctgaccgccggcctgccatggcgcgacgtcgcgctgctgcgtgcctacgcccgttacctgaagcagatccgcctgggcttcgacctgggctacatcgccagcaccctgaacaaccacaccgatatcgcccgcgagctgacccggttgttcaagacccgcttctacctggcgcgcaagctcggcagcgatgacctggaagacaagcagcaacgcctggagcacgcgatcctcagcgccctggacgatgtccaggtgctcaacgaagaccgcatcctgcgtcgctacctggacctgatcaaggccaccctgcggaccaacttctaccagaccgacgccaacggccataacaagtcgtacttcagcttcaagttcaacccgcacttgattcccgagctgcccaagccggtgccgaagttcgaaatcttcgtctactcgccgcgcgtcgaaggcgtgcacctgcgcttcggcaacgttgcccgtggcggcctgcgctggtccgaccgcgaagaagacttccgtaccgaagtcctcggcctggtaaaggcccagcaagtgaagaactcggtgatcgtgccggtgggcgccaagggcggcttcctgccgcgtcgcctgccattgggcggcagccgggacgagatcgcggccgaaggcatcgcctgctaccgcatcttcatttccggcctgctggacatcaccgacaacctgaaggacggcgtcctggtgccgccggccaacgtggtgcgtcacgacgacgatgacccgtacctggtggtggcggcggacaagggcaccgcgaccttctccgacatcgccaacggcatcgccatcgactacggcttctggctgggcgatgcgttcgcttccggcggttccgccggttacgaccacaagaagatgggcatcaccgccaagggcgcgtgggtcggcgtgcagcgccacttccgcgagcgcggcatcaatgtccaggaagacagcatcacagtggtaggcgtcggcgacatggccggcgacgtgttcggcaacggcttgctgatgtccgacaagctgcagctggtcgcagccttcaaccatatgcacatcttcatcgacccgaatccggacccggccaccagcttcgccgagcgccagcgcatgttcgacctgccgcgttcggcctggagcgactacgacaccagcatcatgtccgaaggcggcggcatcttctcgcgcagcgcgaagagcatcgccatttcgccgcagatgaaagaacgcttcgacatccaggccgacaagctgaccccgaccgagctgctcaacgccttgctcaaggcgccggtggacctgttgtggaacggcggtatcggtacctacgtcaaggccagcacggaaagccacgccgatgtcggcgacaaggccaacgatgcgctgcgggtcaacggcaacgagctgcgctgcaaggtggtgggcgagggcggcaacctcggcatgacccagctgggtcgtgtggagttcggcctcaacggcggtggctccaacaccgacttcatcgacaacgccggcggcgtggactgctccgaccacgaagtgaacatcaagatcctgctcaacgaagtggtgcaggccggcgacatgaccgacaagcagcgtaaccagctgctggcgagcatgaccgacgaagtcggtggcctggtgttgggcaacaactacaagcagacccaggctctgtccctggcggcccgtcgcgcctttgcccggatcgccgagtacaagcgcctgatgagcgacctggaaggccgtggcaagctggaccgcgccatcgagttcctgccgtcggaagagcagctcaacgagcgcgtcgccgccggccacggcctgacccgtccggaattgtcggtgctgatctcctacagcaagatcgacctcaaggaacagctgctgggttccctggtgccggacgacgactacctgacccgcgacatggaaaccgcgttcccgccgaccctggtcagcaagttcgccgaggccatgcgccgtcaccgcctcaagcgcgagatcgtcagcacccagatcgccaacgatctggtcaatcacatgggcatcaccttcgtgcagcgcctgaaggagtccactggcatgagcccggccaacgtggcgggcgcctatgtgatcgtgcgcgacatcttccatctcccgcactggttccgccagatcgaagccctggaccatcaggtctcggctcaggtgcagctggagctgatggacgagctgatgcgccttggccgtcgcgccacccgctggttcctgcgcagccgtcgcaacgagcaggatgccgcccgtgacgtcgcgcacttcggtccgcacctggcggcgctgggcctcaagctcgacgaactgctggaaggcccgacccgcgaaggttggcagacccgctacaccgcctacgtcgaagccggcgtgcccgagctgttggcgcgcatggtggcaggtaccacccacctgtacaccctgttgccgattatcgaggccgcggatgtcaccgggcacgacgccgccgatgtggccaaggcctacttcgccgtgggcagcgcgctggacctgccgtggtacctgcagcagatcagcgatctgccggtggccaacaactggcaggcccaggcacgcgaagccttccgcgacgacgtggactggcagcagcgggcgatcaccatctcggtcctgcaaatggccgacgcgccgcaagacatggaagcccgcgtggccctgtggcttgagcagaaccagagcatggtcgagcgctggcgcgcgatgctggtggaaatccgtgccgccagcggcaccgactacgccatgtacgcggtggccaaccgcgagttgctggacctggccatgagcggtcaatcgggccttgtagcggcggcctgatcgagcggtaaatgaaaaagccccgtatcgcgagatacggggcttttttatggttcttcacggaatcccgggaaacacagaaacaagaacgccgatttgattgatgatgttcgtgcgagcaaacacatctaacaaaccggcgttcttatgcgtgatattaatactttccttcccttttgggagggcttttctgtcgtcacgatcaagcctgatggtgacgcgctccagatcgatctgattccccacgccacccgattcccttcctgtggcggctgccaaaaactctgttcaaccacgcatgagtactgccagcgagtcatccgcgatctgcccattcttggccgagcagtgcgcctcagcgttttgcttcggcgtgtcggctgtcgggactgtggcaaacgcatggaggccgtcagttggctggatcgctatgcccgcatgacgcgccgcctggccgatgcggtcattcaggcctgcgagcgccttcccacgctacacgtggcccaactgttcgggttgcattgggacagcgttcgcttgctgggaacgtcgcgccttgcaagcggcattgagtgttttgccaaaggcgcagccacagcgcttggtcatggacgaatttgccctgttcaaaggtcatcgttacgccagcgtagtgctggacgccgatacccggcgagtgctgtggattggcgaaggccgcagccgggcggcagtcagaccctttttcgaagagctggggtcagagggttgcgctcgcatcgaagcggtggcgatggacatgaacactgcctttgacctggaggttcgtcagcactgcccaaaagcgcgcgtggtctacgacctcttccatgtggtggccaagtatggtcgagaggtgattgatcgagtccgcgtcgatgaagcgaatcggctacgtcacgacaagcctgcccgcacggtcatcaagcaggcgcgatggctgttgctgcgcaatcggcagaacctgaaaacgccggaacaacaagtccgcctggaggatctgctggcggccaaccaagcgttgatgacggtctatttgatgaaggctgaactcaaaacgctttggacaccgagcaccgcctggggctggcgatcagcctggcgacaatggctgcgccatgcgcatgaaagcgacataccgcctctgatccagtttgccaaacgactgaagggttactggcggggcatcgtcagccgggtgcgctggccaatgcatacgggccagttggaaggcatcaacaatcgaatcaaggtcatcaagcggatggcgtacggttaccgggacagcgaattctttttcatgaagatcaagagcgtctttcccggtaatccgtgaagaaccttttttatggcctcaagaaatgctgtagccgctgccgcaggctgcgatcgagcggaacgctcgcaaggggctcaaggtcctgcggacctatcgcagcctgcggcagcggctacaaaaagcacaccgctcctgcggagtatctgctgccaggcgcttactgcttcaacggcgtcagcacttcgtccttggcgtccttgagcatgaacaccagcagcctggcgggtttgctggcgctggcgttggccgacaccgggtgctgcgagccggccggttcgtaccaggattcgcccgccttgtaggtgatggccggttcgtcgttgacccgcgaggtgatctcgccttcgagcacataggccagggccgcgcccttgtgcatgtgcggcaccgtggcctggcccggtgcgtagtcgacggtgagcatcagcacggtcttgcccggcaggttgcccagggcatgttcctgcaggatcttgagtttctcctgaccgtactccggatcatgggcggcaacgcccagagaggtgagcagggtcaggccggcgagggcgcaggtcagggcagcgcggggcttcatggtcggtttctccggtgcgaaaggggccggctcaaggtaagcccgcgggcgcgaccggcctataaccaatcccggcaaagaagcgcagaccaatgcctcaatgttcgaagtcgagggcgcaggccaggcggcggtccagcaggtcgatgaaaccctgtgccgccggcagatggaaatgcgcctgcatctcggccgccgagcgccactggccgcgcacggtccagcggtgcgagtccgctgtgttgcactgggcgttgtacgccaggcaaccgggagcctcgcgcagggcggcgagaagcgtggtcaactgctggccaagctcctccgaacggccctggacggccctgatctgcacgacattgatggctggactggacatctagaaccctccgcgagtcctgtagccgctgccgcaggctgcgatcggcttgggcggcactccgacggagcaggtgcgggatctcaagatcgcagttgcagtcacggcgtttgctggaggctcagaatagggccgcaagattgcaggaaaaataaccaatccccgggaaaagcccggggccaatcaggcgatctgttgcaggatgtcgcgcaccttgtccagggccgggtcgatgtccagggtctcgatggcgccaaagccgatgaacagcccgtccctggccggctcctgataatagaagccgtgcagcgggtagagcccgacctcgaccttcttcgccagctccagcaacagcgggatgttcaccggcaccttgcacagtgccgccatgtggaagccggcggtggacggcaccgcctgcagccagggcgagaggtcgccgttcaggcgctgcagaatgcgctcgcggcgcccggcgtacaccgtgtggcagcggcggatgtgcttgagcaggtaaccctcggcgatgaacttggccagcgcccattgcggcagggtcgaggtgtggcagtcggtgaggcgcttggccttgatcaccgcgccgaggatcgccggtggcagcaccgcgtagcccaggcgcagctgcggcagcatggtcttcgagaaggtcccgacataggccaccacgccgcgcttatccaggctttgcagggaatcggtgggccgcccctcgtagcggaactcgctgtcgtaatcgtcctcgatgacgatcgcccccagctcccgcgcccgctccagcagggcctcgcgacgggccgggctcatgggcatgcccagggggaactggtgggacggggtgacgtagatcagccgcacgccatcgggaatccgctcgacctggaggccctggtcgtccaccggcacgccgatcaccgtcgcgccctgggcactgaacagcaggcgcgccggggtgtagccggggtcttccatggccaccaggctgccgggttcgagcaccacccgggcgatcaggtccagggcctgttgcgcaccgttgcagaccacgatgtcggcctcgctgcaaaccacgccgcgcgagaacgagacatgcccggcaattgcattgcgcagcgccggcaggccttccggctggctgtagaaaccgccgctctgggcgatccgccgcagggcgtcctgggtgcagcgtcgccactcttcctgggggaactgattgcggctggtggcgccgccgatgaactcgtagcgcgaggtgccttccagggtcggatggcgcaggggcgagggcagctcctgccatttttccaggctctgcgcgcaggccaggtcggcggcgctctgcttgggtccggctttcaccggccgggcattgacgaaggtgccgcggccgatccggccgatcaggaagttctcgtaggtcagcaggctgtaggtgtccgacaccgtcttgcgcgagatccccagttgctcggccagcagccggctcggcggcaattgcgcgcccgccgccagccgcccgcactcgatggcgtcgcgcagttgccgatacagctggtcggccaggtccttgcgcccgttgatgacgacatgcagttccatcgatgacattccaaaacgatcggtgcccgccagattacccgcccggtggggtttggtgtagcggcctggtatcgggattggcctgacatcctggcgcgtactgcgtacgcgatcgcagccttcggcagcggctacaccgcctggttcgaaggccgcgtcgaaccctgtagccgctgccgcaggctgcgataagcccgcagggcttcggcggtcttgagcctgacactgttcgatggactgccgataaacccccggattggctataggggcaggccgacgcggaccttaggctagggaacccaaacacacgctcagggtgactcccgatggaaccccgcctggactactacagcgcctcgccggaagccctcaagggcctattgatgctcgaggcacaaaacttcgacctgtccatcgagaaacccctgctggagctggtcaagatccgcgtttcgcaactcaatcactgcgcgttctgcgccgacatacacgcggtgcaggcgcgccagaacggcgagagcgagcggcgcctgtacgccctcggcgtgtggcgcgattcggcgttgttcagcccgcgggagcgctcggcgctggcctggagcgagtcggtgaccctgttgtccgagtccgcggtgccggatgcgttgttccgggccgtgcgcggcgaattcagcgagcgtgagctggtcgacctgacggtcgcggtggcggcgatcaactgctggaaccgcctggccgtggcgttccgccaacagcctagcgtctagcccggactccttttccctccacgccagccaatgctcggcaaacggctgctcgcgacagggcccgaacacacaacctcaaggtcgttgcggcttcaccgaagtgccgaaggtattgcccatccgcgtgctggtggcggccggggtggccaggcccatctggttcggcgggcgcttgtggatcggcacctgcagggcttcctggttcttctgcccggccttggcgccgtcggggttgttgcccatctgctggctcaggcaaccgtagtccggggccttgtagccacccacgctgacgtcgatacaaccctctgtgggcgttttgccgggagcggcggcgggcgcttcgacaggtgtggcggcgtggccggccagcggcagggcgccgagcatcaggctggcgacaagggtgcgaagctgtttcatcgggggcctcctggcgggcccgggaggggccgttgcggtccttgagtgtagagcaaggcgggtggcgcaaaggtgatggtttttttgcgggcgccgtcacatcaggttcataaactggcctcaggatgacggttttcagggacaggtagccgtgcagcgacgccgagcaaaggtcgggtatcggtctttctttcacgcggtgttcgcgcgctgtggtcttgcgctgctgttggcgctggccgcctcgggcgggttgcgggcggcgcaacccgcgccgccgatggtggattcgcaccggctgctggacctggacatcgccgcgcaagacctggccgaagcgcttgaactgttcagccgctcgaccgggatggcggtgctggtggaccgcgagctgacccgagggcgtcgctcggtacgggtccaggggcgctacagcgcccgggacgccctgagtcgcctgctgacaggaagtggtttgatggcccgttacgcccgttccgatgcctttaccttgcaagtcgcccagcttagcgatgcgcctgcccccaagggggcgggcggcagtgccggggcctgggccagcgacagtttcgccagtgccctgcaacgcgcggtggaggccggcctgtgccgttcggaactgacccggccggggcgttatcgcgcggtgctgcaactgtggatcgaccgcggcgggcatatcgagcacagccgcctggtcaccaccaccggcgatctgcggcgcgacgaggcgctggtgcagagcctcagcgaaacctgggtcgaacgacccgcgccgagttcgctgcgccagccagtgaccttgcttctgatacccgacagcgcaggaaaacgcatggattgcagacaacgccagggagcctttggggcatgaagaataccgggcacagtgcgatggtcaggttgttcctgacctcctacgacgacttcaaggtgcgtctgcgtcggcgcctgggctcggaggacctggccaacgatgtgctgcacgaaacctacctgcgggtcgaccgcatggaagagccgccgaacctggcccagcccaatgcctacctctatcgcatggccctgaatattgccgccgaccgccgcgaggccgatgcccggctgctcaccggcagcgaggtcgaggaactgctgcaggtcagcgacgaggtcctggacccgtcgcgggtggtgggcgggcagaaggaaatccagtcgctgctcaaggcgctctacgaactgccggcgcggcggcgcaagatctttatcgccgcgcgcctggaggaggcgccgcacctggaaatctcccagcgcttcggcatttcgacacggatggtcgagaaggaaatcaaggctgccctgggccactgcgcctcgcgccttgaaagaaaagtgattcagcggttcggtcccggcgccggaaaaccgtcctagtcactaaaggccccgattaatccgtgagtacccgcacgcttgaacatctttagcatctccacttctcgggcgacaccggaccaccggctgcgcaacgaggcccaggattggctgctcctgctgacctcggggcgggccaccgcggccgacgcccgggccttgcagcagtggtgcgcgcagagcccgcagcatgccgaggccttcgagcaggccaaggtgctgtggcacagcctgaagccggccgccgaacactgccagcaacagacccagccgcggcgcttcggccgccgggcctttctcggcggggcgctggcggcctcggtggccctggtggcggtgcgggtctcggtgcctggcggttttgccgggctgggcgccgattaccgcaccgcggtcggcgagcagcgccgggtcgaactggaggacgggctgagcctggaactcaacacccagacccgcatcagccggcgcgagctggccgacggcgggcagggcatcgaactgctcgaaggcgaggtcgaggtgttgagccagagcgcgctgccggtgcgggtccaggccggcaacggctggctgagcgcctcccaggcgcgcttcaacgtgcgcaataccaatcacagtgtctgcgtgacctgcatcgatggcgcgctgcaggtcgaggttggcggtcggctgatccgcctggacagcggtcgccagctgacctacgacagccgccaggtcggcgagccgacggcggtggacccgacggcggtgattgcctggcgcgagcaggtgctggtgttcgacaacgccaccctcaacacggtgatcgacgagatcaaccgctaccgcccgggcatgctggtgctgctcaacgccgagctgggcaagcgcaaggtgcaggcgcgtttcaacctcaaccagctggccggcgtggccctgctgatccgcgacgcctacggcgccaaatgcaccgaattgccgggcggcgtggtgttgttgagctgagacgtggcacctggcatctgtaggagcgaagcttgctcgcgatagcgtccgtgcagacagcccgcgtggcctggatcgcgggcaagcctcgctcctgcagaatcgccgtcgacccaaatcccccgtggccgctgcgttaacgtgcgttgccgttgttgccgttgttgccgttgttgccgttgtagccgctgccgagcgcagcgaggctgcgatcgaggtgggcggcattccgacgaagtcctcgccaagcctgagtacgcgattttccaggaagaacaggttgtccggtttacggccgctgcgcagccgttcgcagcctcgcgggctcggcagcggctacaggtgcggcgtccagctcgacgcggcaatcactccaacggccccagtacctggcgataacgctcttcgccctggggcgtctggcgcaccaggcggatctccaggcctggcgggttttccttgcggttgccgctgagctggcgccagcccttgtcccggtcccagacccgcagctgcaagtcgctgacatgctccagcaccgccacgccgtttttcggcgcgggcagcggataacgatcgcgggccggcgccgccgcgcggtacagggtgtcgcccttgagccaccagcgcacccgttgcaggccctcgccgggcgtcgccgaactgcggatcacatccaggcggaaggtgccgctgtcggcgctgcgcacggtgagggccgccggcacatcgctggcttcggcatcgcttcccgccggcaccggctccatcaattccacgctggcccgcagcgccacgtcccgttccagctggtgcagggtgcgcagcagctcctcggtctgctcgctgctggcctgcaaatggctgtcggcccggctgacgctgtccagcccgcgccaggcgatcacgctgaccaccgccatcagcaggatcgccaccatcacctcgatcagggtaaagccgccttggcgctggttggtccgcgccctcatggctgcgccaccacccggacctggcctgtggcggtgcgttgcaccgtcaggctgtgccggccgtcggacagttgcacctgcagcggcgcgtctatccattcggcgttgagcaccagccgcgggccgggctcgatgcgcaccttgatcgtcgggctttcccagggccgcgggcgcagttgcgggtcatccttgaactggtcgaggccgcggccgtcgtcgctgggccggctgaaggcgaaacccttggcatccgcccgccaactgatagaccggccatccacgcgcgcctcggcctgggccacctggagcaactgcgccaggcgctcggcatccttgcgcaggccctgcagcgggtcggggcggatgctcaggctgatggcggcgctggcgatcccgatgatcaccagcaccaccatcagctcgatcagggtgaagccctgttgtcgggatggggtcatggggcgcgctcctgtgcgtcggttttcatcctgcccggcgaatgtgaaataaaaacgtgaccattgcgcgctaggctgcgaagacggacaaacaggaggtccttgccatggcattcgtccatcgattttccccgccgcagctggtgcagtccctggccctgctggcgatcgtggccggggtggcgacctggtcgtcgctgctgctgacccccgccgagtcgcgcaccccgcaggcgccgccgcaagccctggccgcccaggcccagagcccggcgcagcagtggttttccaaccagccgctggcgctggacatcaaggtcaccgggctgatggccagcccccgcggcgcggtggcgatcctcagcctcaacgacgcgccgccgcgcagcttcctggtgggcgagcgcctggcccagggcgtgcaactggtggccatcgagggcgacggggtggtgatcgaacgcggcggcgagcgctcgcggctggatgtcagcaagttgccggatagcccggcgttgccggtgctgacccggcagtgatggctctgtacgacaagtggctgcacgctggagccttcggcgctacgcaggcgatgcctagcggagtcccctgtaggagcgagcttgctcgcgatggacccgagaacgccgcgttcatccactcaacacgcattatcgttaacgtccatcgcgagcaagctcgctcctacagggttattccttaccgattggggtttttcggtgtccgcgcgaccagggtgtccaggcgcgccaggggcggggcctcgcggctgcggtcgaggaccagcacgctgacccgggacagccgtggatcggggctgggcgcgatgttctgctcgcagcgcagcttgagccggccctggtcgcactcgatgtttttggttccgggtggcaggcggccttccaggcgcaactccgccaggcgcgactgggccgccagcagggcgatggatctatcccgtagcaagccattgctctgggtcatcaagccggccacgcggatcgccgccgacatggccacggcgatgatcgccagcgccaccagcacctcgatcagggtgaaaccccgctgtttagcggctggcggtccggcgggtcgtttgagtagtggctggcggggccgcggcatggacgtctcgtggcgcaaatggaggcttgcaggctacatggcaaatttgaccgattggcgacggtcactcccgagcaacgtcaatatcactgacatattttcttgcaacactgcgcgacgaatcgaaatcaagccaaggaacgtcgagatggatgtcgtgcgcttcacgtcacaccccggatcctgctgtcagccccgccgccagccccgccgcccgcgcggacagggcggtttcaccctgatcgagatcatggtggtggtggtcattctcgggatcctcgccgcaatggtggtgcccaaggtactcgatcgtccggaccaggcccgggccaccgcggccaagcaggacatcggcgggctgatgcaggccctcaagctctatcgcctcgaccacggtacctacccgagcatgaaccagggcctgaaagtgctggtggaacgcccggcggatgccaagaacagcaactggcgctcctacctggaacgcctgcccaatgatccctggggccgtccttaccattacctgaacccgggggccaacggcgaagtggatgtgttctccctgggggccgacggccagccagacggtgacggcgtgaatgccgatatcggctcctggcagctgtaagcgccgccatgacagcccgttcgccgacagcggcgaaacagcgtggcatggccattatcagcgccttgttgatcgccgccgtggtggcggtgatcgccggcggcatgctgacccgccagaccctgttcacccgcggactggaaagcgagcagctgcgggtccagggcagctggcagttgcagggcggcatggaagtcagtcgccagcgcctgtgggaagaccgccagcgcgacgtgctgacccgcctcgaccagaactgggcgcggccgatccagctcgcggccctgggcccgggcgccgggccgttcgaggggcggctggaggacgagcagagcaagttcaacctgcgcaacctgctggccaacgaccggctcgacccgttgcagatagagaatttccagcgcctgtgcgagctgctcggggtcaacgcgaccctgggccagcgcatcagccagcgggtgatcgcgtcctatccacggcagttgagcccggaaggtacggcggcgccggtcaatagcggtttccacagcggccgcgacacttcgcccgaggccgcgcgcaaaccgctgttggccaagcaaccgatgctgcgcagtctcgacgacctgctgggggtgaacggcgtcgatgaaaagctgctggcgcgcctggacccctttgtcaccatcctgccggccaatacctgggtcaacggcaacaccgccagcgccgaagtgctcgccgcgacggtgccggggctggcactgccacgggccaaggcgctgatcgccgagcgcgacagcggccagtggttcatcaaccagggtgacttcatcaaccgcctgcgcatgccgcacgtaccggcggacgcggtgcgggtcggcatcaccagcgaatggttccgcctgcaaggccaggcccgcggcgagcggcgtcgggtcaagctactggccttgttgcaccgcagcgaagacaacatgccgcgggtgatctggtcgcgggtgggcgtatgagccgcttgcgcgtcagcctgccgcccttgcacacgctgacggccgagagccgggtgagctttgcccggctccaggtcaaggacggccaggtcaaggaagccggcgaagccagcctgatgcaactggggcagatgcccaaggcgcctgccgtggagtgtttcctgcaccccgaggacagcctgctggcgagtatcgagctgccggccctggcgccggccaaggtcagcgcggcggtggcctgtgccgcccaggcgctgattctcggccacagcgacagcctgtacgtggcccacagcccgcgcgacggcgacggccaggtgcatatcagctggctgccgcgcgaggcgctggcgcggctcggccaggtgctggagcaggccggcctgaaactgcgcggcctgtacccggcgccctatgccttgccggtgccggcggcgggccagttgaccgcctgcctgcaggaccagcacctgttgctgcgccacaacccacgacagggcagtgtgcaaccgctacccgaagacgccttgcaggccctgctggccgacggcaccgggttgcaatggataggcgaggcggccccgccagcggccctggaacaactgtcggacagctgtcgctggaccggccaggcccccgactggggcctgcacggcggggtgcaggacaacagcgctcgccagcagggctggggccgtgccgcggcgctgtgcgcggtggcgctgctggtctggaccctgggcctgaacttgtacgccgcgcgccaggcggcccagggccagcagctcaaggcgcagatgagccaacgggtgcagcaggtgttcccggaattgccggtgatcctcaaccccctgcaacaggcgcgtcagcaactggcggcgcgccagagcggagccagcggcgacgctccgtacagcttcaacagcctggtgctgcaggccagcaatgccatgcccttcgtgatcggcggggtcgagcgtttgaactatcagaacggcgaattgcaactgagcctgctcagcgacacccgtgtccctgcgcccgacagcggctggcagggcctgctgacccaggccgggctcgaagccagccccggcgaccagggctggaccctgcgcgccgccacaggcatggcgcccggcgcggtgccgatggaagccgacgacagcgaggaagacgaggatgaataagctgagcctcagccattaccgccagcgctggcagcgccaggccgcccaggcacagctgtactggagcggtttggccctgcgcgagaaacgcctgctggccggcgcggcggtggtgctgggcggcctgctggtgtggctggtgctgatcgagccggcgctgaagaagatcgattactggcaggccgagatccccaagctgcgctcccagtccgaagccctggagctggtgctgcaccaggccggcgggccccgtggcggcgagccggggcagagcctggagcagtccttgcgccagaccctggatgccgccggcctgcaggggctgtaccagttgcaactggcgggcgagggcgagtcccaggcctggcacttgagttttcaagaggccccggcggatgccgtggtcggttggctgttgggcaatccccggcagttttccctggaagtgatggaggcccgcctgcaacgcgcggggccggccgacatcgatggcacggcaggcaaactgtccggaaccgttcgcatggatcaggcgcttggcgctaaggaagcttcatgaagtggtcaggttctttttacgcccgccaatcgcgcaaggcgctgcccttgctcctgctggggccgctggccctggcgctggcggcgtgcagtcacaaccaggagccacagccaccgttgctggtggacagcgaactggggcggcccctgggtgagaccaatcgcagtggcggcgatgtggtggccgagcgggagagggcccaggcgcaacagacccagcgtcccaggttccagcatccgatcagccgggcgggacgcgcgcccggtgctcccgccgccagcggcactgtggtgcgcaatcccctgggcgaccagccggtgcgcctgaatttcgtcgacgtcgatatccaggccgtggtccgggcgctggcgcgttccaccggccagcagttcctggtggacccgcgggtcaagggcaacctgaccctggtcagcgaaggcgaagtgccggcccaccaggcctacgacatgcttctggcggccctgcgcatgcagggtttcagcgtggtggacgttggcggcgtggcccaggtggtgccggaagccgacgccaagctgctcggcgggccgatctacaacgccggcaagccgtcggccaacggcatgctgacccgcaccttccgcctgcaatacgaaaacgcagtgaacctgatcccggtgctgcgcccgatcgtgtcgccgaacaacccgatcaacgcctacccgggcaacaacagcatcgtcatcaccgactacgccgagaacctcacccgggtggcgcagatcatcgaaggcatcgacattcccagcgccctggacaccgacgtggtgccggtgcagaacggcatcgccgtggacatcgccggcatggtctccgagctgctggaaacccagggcgccgacccgacccagaaggtcagcgtggtcggcgatccgcgttccaactcgatcatcatccgcaccggcagccccgagcgcactgagcttgcgcgcaacctgatctacaagctggacaatgcccagagcaacccgagcaacctgcacgtggtgtacctgcgcaacgcccaggccggcaagctggcccaggccctgcgcggcctgctcaccggcgagagcgacagcggcaccggcgacaacgcgcgggccatgctcggcagcatgggcggcatgagccagggcggcagcagcggcagcagccagagcggcggcagcggttccaccagtggcagctccagcctcagcagcggcagcagttccggcagcggttatgcccagggtggcagttccagcggcagccagggcggcacccaggcctccgagcagaacaccgccttcagcgccggcggcgtgaccatccaggccgatgccaccaccaacaccttgctgatttccgcgccggaaccgctgtaccgcaacctgcgcgaagtcatcgacatgctcgaccagcgtcgcgcccaggtggtgatcgaaagcctgatcgtcgaagtcaacgaagacgacgccgccgaattcggcgtgcagtggcagaccggcaatctcggtggcagcggcgtcatcggcggcgccaacctcggtggcagcggcctcaacctcaacggcaagaccagtctcgatgtgctgccccagggcctcaacgtcggcctggtcaacggcaccgtggacatccccgggatcggcaagatcctcgacctcaaggtgctggcccgggccctgaagagcaagggcgggaacaacgtgctgtcgaccccgaacctgctgaccctggacaacgaagcggcgagcatcttcgtcggccagaccattccctttgtcactggcagctacgtcaccggcggtggcggcaacagcaacaacccgttccagaccgtgcagcgcgaagaagtcggcctgaagctgaatgtgcggccacagatttccgagggcggcacggtcaagctcgacatctatcaggaggtcagcagcgtcgaccagcgcgcctcggtacaggcaggcactgtgacgaacaaacgggcgatcgacaccagcatcctgctcgacgacggccagatcatggtcctcggcggcctgctgcaggacggctacagccagagcaacaacgcggtgccatggctgtcgacccttcccgggatcggcgcgctgtttcgcaacgaaagccgctcgaccaacaagaccaacctgatggtgttcctgcggccctacatcattcgcgacagcgccgcggggcgcagcatcaccctcaaccgctacgacttcatgcgccgcgcccagggcggcctgcagccggaccgcagctgggccatgccggacatgcaggcgccgcaattgccgacggcggagcagggggtgccgggggctgtgccggtgggggtgccagcgccgaattcgggtcaggtgccgagggcgaggatcagggcggtgccggtgcaatgagttcgcttgttgcgtttatgcgctcggcgtctggtgcgttgggtgatggggggcatatccgttgctgcggttatggctgcttagggtttcgcttttacagtggggttggggtacatatccgttgctgcggtaatggcgacttagggttccgcccttacggcgggtcacttttggcaaacgccccaaaagtaaccaaaaggtctcgcccctccattcggcccctcgctaaggctcggggtaccctcactccggcattgctccgggggcacgccgccacaggccatccatggcctggggcggctagcgcggcatccctgccgcgctaccccctacgcaacgcctgcgttcggcctctgggaaaggggcgggtggatcaagatcaaaagccaaagccaaagccaaagccaagcgcgttgtacgcgcttcttgtagccgctgccgcaggctgcgatcgggcgcgcagcgcacgccaaacccgacgacgcgatgtatcaggcagatcgaggcgcatggttttgcgtctgcttcgcagccgatcgcagcctgcggcagcggctacagggatcaccgccgaatccaggccggccgttaggccgcctcgcgttgtttttgattttcttgccccgtcgggaggccgagtggaggttctgcgcagtgggcaacccggcagggatgccgggttagccgccccaggccatggatggcctgtggcggcggcccacggagcaggaccggagcgagggaatccgagccttagcgaggaccggacgctgggggctagagccctttggttactttgggctgggccggcttccggctcttccaaagtgacccgccgtaagggcggaaccctaggtggccgtgaccgcagcaacggatatgtacacccacttcgccgtacgaacgaaaccgccaacggccatgaccacagcaacggatatgtacacggtcaagaccaagcccacgcccaagccccggagttactcccatgaacccccaactcccttacgcctgggccaaatcccaacgcatcctcctgcgccatagcgaggagggcgccgtgctcctggtctgcccctcgacccccggctggtcgatcagcgaagcgcgccgccagttcggcccggcgcgcctggagcgggtgcgcgacgaagaactcgacggcctgctggccagcgcctattccgataccggcagcgccgccgccgtggtcggcgccgccgagaacgaggtcgacctcgaccgcctgatgcaggacatcccggaaatcaccgacctgctggacacccaggacggcgcgccggtgatccgcatgatcaacgccttgctgacccaggccgcgcgggacgaggccagcgatatccatatcgagccctatgaaagccattcggtggtgcgctaccgggtcgacggcacgctgcgcgacgtggtctcgccgcgcaaggcgttgcacggcgcgctggtatcgcggatcaagatcatggcccagctcgacatcgccgaaaaacgcctgccccaggacggccgcatcgccttgcgcgtggccgggcggcccatcgatatccgcgtgtccacggtgcccaccggccacggcgagcgggtggtgatgcgcctgctggataaacaggccgggcgcttgcaactggaaaccttagggatggacccgcaggtgctgggcaagctcgaccacttgatccgccagccccacggcatcgtgctggtcaccggccccaccggcagcggcaagaccaccagcctctacgccgccctggcgcggctggacgccagcaccagcaatatcctcaccgtcgaggacccggtggagtacgacctgccgggcatcagccagatccaggtcaatgccaagatcgacatgaccttcgccctggccctgcgcgcgatcctgcgccaggacccggacatcatcatgatcggcgagatccgcgacctggaaaccgcgcagatcgccgtgcaggcatcgctcaccgggcacctggtgctggcgaccctgcacaccaacgacgcggtgtcggcggtcaaccgcctgatcgacatgggcgtcgagccgttcctgctggcctcgtcgatgctcggcgtgctggcccagcgcctggtgcggcgcctgtgcccgcactgcaaggaagaagacccgaccgcccccggtacctggcgcccggtgggctgcccggcctgcaaccaggtcggctacagcgggcggaccggcattcacgagctgttctgcatcgacgacgacattcgcagcctgatccaccagggcgccgacgaacaggcgctgcgcgccgccgcacggcgcgccgggatgttgagcatgcgcgaggacggcgaacgctgggtgcgcagcggcgccaccgcccctgaagaaatcctgcgcgtaacccgggacgcctgatgaaccgttatcgctacgaagccgccgacgccctcggcaagatcgagtccggccacctggaagccgacagccagagcgccgctttcggcgtactgcgcagccgcgggctgacggcgctgatggtgcaggtcgagagcaacacgcccaaggccggtggcgggagcctgttcagcgccaagctgtcggacaacgacctggcctgggccacccgccagctggccagcctgctgggcgccagcctgccgctggaggcggcgctgagcgccacggtcgaacaagcggagaaaaaacacatcgcccacaccctcagcgcggtgcgcgccgatgtgcgcagcggcatgcgcctggccgaagccctggcggcgcggccgcgggattttccggacatctaccgggcgctgatcgccgccggtgaagagtccggcgacctggcccaggtcatggagcgcctggccgactacatcgaagagcgcaacaccctgcgcggcaagatcctcactgccttcatctatcccggcgtggtcgggctggtctcggtgggcatcgtgatcttcctgctcagctacgtggtgccccaggtggtcagcgccttctcccaggcgcgccaggacctgccggggctgaccctggcgatgctcaacgccagcgatttcatccgcgcctggggctggttgtgtttcggcgtgctggccggtggcttctggagctggcgtctatacctgcgcaacccccaggcccgcttgaactggcacagccgggtgctgcgcctgccgctgatcgggcgcttcgtgctgggcctgaacaccgcgcgctttgcctcgaccctggcgatcctcggtggagcaggggtgccgctgctgcgcgccctggaagcggcgcgccagaccctgtccaacgaccgcctgagccagagcgtcagcgacgccaccgccaaggtccgcgaaggcgtcaacctggccgccgcgctgcaggtggaaaaagtcttcccgccggtgctgatccacctgatcgccagcggcgaaaaaaccggtgccctgccacccatgctcgaacgcgccgcacaaaccctgtcccgcgacatcgaacgccgcgccatgggcatgaccgccttgttagagccgctgatgatcgtggtcatgggcggggtggtgctggtgatcgtcatggcggtgctgctgccgatcatcgagatcaaccaactggtgcagtaacgacatcgattgccggctcgcttttctgtaggagcgagcttgctcgcgaaaagactcaagacaacgcgatgtttcggcaagaaccgcgtcaaggttcacgaccatcgcgagcaagctcgctcctacaggggatagcgtcagtccggagatttttttcgcctagtccttaccacccgagcggcacatccgcagaactcgggttcctcgttctgtcatgcacaaccacccccagcgcccccaagccaagacccgcgccgcgcctggccaaaagctggcaaaaggccccgcgacacctcgctgtcacctgcgtcgaaaagcccgtgccagggccctcgaacacccgagaaagtttttgaaaatcaagcgctttctcccgaggttttttcctttatctgtcaccggaaactgcgaacttcttccccatggcctcaccccgcacaacgctctcagagcagggcagaggagctgagcgccatggcgtcatgcaagaaccattgacctccgtatacacacgacgaaaggagattcttcatgtttaagcgcactatgatcgcagcttccatggctgtagcggctctggcttcggcccaatcgatggcggctgttgtgggtggcggtgccactctgccacagagcctgtacggcaccaccgccggtaccggcatcctggcttcctcgactcctggcttcaacccgtacatcggcgtgggcagcggtgcaggcaagcaggctttcttcaacaatgattccaccaagttcaacctggcctcgggcatcaacgtcgactacgccggtagcgactcgatcgtgagctcggctgaacttaccgcttacaacaacagcgctgacaagggtcgtgccactttcggtcctttgattcagatcccggccgaagccacttcggtgaccgtgccttaccacgtcactggcctgaccacgctgaatctcaccagcgctcagttggccgatatcttctcgggcaagattacaaactggaaaaacgtggtctccggcggtgtggccggtcctgacttgccaatcaaggttgtctatcgcaccgacggcagtggcaccaccgagatcttcaccactcacctgaaggctgtgaaacctgcttcggtacctgccgccagcaacagcttcgtcaccgcggtaggcttcaaccctgccaccaaccccccagccggctccacttacattggcgcttccggcagcggtgccgtggcgacagcggtagccaacaatgacggcgccattggttacgtcagccctgacttcgccgagttcaacaatgctgccaaggtggccacagtcaatggtttcctgccaactgaagtcaacgtgcaaatcaccctcgatactgagttgccacctaccaacccagccagcggcaagaacccagccaaccctctggattgggtaccgaccttccccaacccaagcaccggctatccaatcgttggctacaccaacctgattttcagccagtgctacaaggacgccggtgacaacctgcgcatccgcaacttcctcaatgcccactacaccggtgtcaacaacactaccgtgtcgagccactccttcatcccactgtcggctgcctggcagagcgctgtgcacaacactttctataacaccgccagcgcccagcgtgtcggtaacaccaacgtctgcaacggcatcggtcgtccggcctgataccccgccatcggcagggtttgtgtaacagccggcaatggctcaagccattgccggctttctcgtttccgcctgttgtcgcgtagatgaactttgcatgacaagagttcggtcgcgcctgcccataaccgccttagcagtaaccccgcgaatgttttggcgtcgaccgctgtacccgccattcgcccgaaccgtaagaaggactcgcaagtgatgcgctctgagccgaatctacctgtttcccgactcatcaacgcctccgctgtcgccgggcaaccggtgctgcgactcaagccgctggcgcatgccattgccttgttgatgcttgccggcacggcccaggcggcgcagccccaggctttcagttcgggctggttcggggccatgggcgcgaaccagggcgccggcgcggcgcgtccatcggtggcgcagccggccggtacgccaccgcccctggcgcaacagcagcgggtcagcagtcagctgcaacgctctatgagcaatctcaataacaccgtggccgccatcgccgcccagcaggccgcgcaagcggccgggcgcgcggcggcgctgaccgctccacagcctgtgcataacggcctggggggcaatggcctgaatgtgctgctcggggccgacggcaagccgctgttcgtcaatgccgaggggccggtgcagaccgatgccaacggcaaggcgctggtgtcgatcaagcagaccgccgacaaggcgattctcaactgggaaaccttcaatatcggccgtgacaccaccgttgaattccagcagaacgccgattgggccgcgctcaaccgcgtcaacaacagcacctcgccgagccagatccagggcgcgctcaaggccgacggcacggtgatgatcctcaaccgtaacggcgtggtattcagcggcagcagccagatcaatgtgcgcaacctggtggcggcagccaccagcatcagcgacgagcagttcaacaaccgtgggctgttcagcgccagcgacagtgcgccgacgttcagcgacgccgcgggcaaggtgctggtggagcagggcgcattgctccagacccacacgccaggttcttccacctccagcggcggttatgtgctgttgctgggcaaggaggtggataacgcgggcagcatcaatactccgcgaggccagaccgctctggtggccggcgacagttttgtgatcaagaaaggctacagcaccgacggcaacccgacctcgaccacccgcggcaacgaggtcgtcgcttcgggcatcggcaaggtcagtaaccacggctcgatccaggcagctaccggcgacatcaccctgagtgcccaggaggtgctgcaacaaggcctggccctgagcagcacctcggtggacgcccgtggcaccctgcatctgaatgcccgtggcagcgacgccaaggtcaccctgggcgagggcagtaccagcgcgatcctgatcgacagcagcacggccctggacagccagcgggacgggttgctgacgccagccttgaaccaggctggaaacgcgacgccggccgatacctatcgtcgcgaccagtcactggtggagatcgccagcggcggcagcgtggacttccagagcggttcgatcaccctggccaccggcggccaggtcgcggtgagtgccgggcagcgcagcctggtgcgcgacggtgcggtgatcgatgtgtcgggggcggtgggcgtcaaggtggcgatggagtccaacagcgtcaaggtcgacatccagggcaacgagcagcgtgacgcctcggtcaaccgcgacagcaagaacctcaacaacaacgatgtctgggtcgatgctcgcgagctggtactggtcccggcggggaccaacggctacgccacggatcgctggtataccgctggcggcttgctcgaggtgggcggatatctgggcacccagccgcacaacgttggcgaatggatggcccagggcggcagcgtacgtctgagtggcaatgaggtggtgactcagcagggttcgcagatcaacctctccggtggcaccctggacgtgcaggacgggatgatccagcagacctggctgcgggccgccgatggccggctgatcgagttgtccaaggctccgggggacattctctacagcgggctctacaagggcttcgaagagcacagcgtgcgctggggccagaccgagtatcactacaacccgttgatcgccccccgcgagcgtttcgaacaaggctacagcgtgggtcgagatgctggtcgcctggaagtcagcactcgccatgcggtactcgaagggcagatcgtcggtgacaccttccagggcgatcgccagactcaggccccgcgcccggggctcgacggctaccagcaggggcagaacgccgtggcccggggcgggcagttggtagtgggggcttatgtgccttactacgtcaaggacagcgccagcctgcagtacgccctgagtgccgatgccaataccgtcaagcaagtggtgctggggcaggccgcggcaatagccgatgggctggacctggacactgttctgcccgatgagcgcaagggcaccttgtggctcgataccgagcagctcaacgctttccagctcagcagcatcaaggttgccgccaccggcagcattctggttgacggtgcgctgcaggtcagtcccggcggcgatatcaccctgtacggccctcaggtgcaggtcaatgccgacctgacggcccatggcggcaacctggccctgggcaatgtgctgcagcagatcaccagcaacggcaagctcgacaccaccctggcgacgggaggcaagcgcgcgacgctgacggttggcagtggcgtccggctggacaccagcggcctgtggagcaacctgttgctggaccccgccgatggcagtcgcttgccttacctcaatggcggcagcgtctcgctgcgcggcagcgccgatgtcgcactggagagcggcagcctgatcgacgtgtcgtcgggcgcggcgttgatgagcgacggcaagacccgcgccggcaagggcggtgatgtcaccctggcggccaatgccaacagcgcggcggccatcggcatgctcaccctggacggcgagctgcgcggtcatggcgtgaacggtggcggcaccttgagcctgcagagcagcaaggtgttgatcggtgagcgcgccgccgatactgctgccgacaccctggtgttggccccgcagttcttcgacaaaggcttctccgcctatgacatcaccggcaaccagggcctgcgggtggccgatggtgcgcaggtcgatgtaacccaatcggtctatctgttgggcgatcaggccaggaacacggcgactggagcggacccggcctctgcgttggaacgctggctgcccgggctttaccaggaagacccgatcaaggctgtactcagccagcgtcagggcgcgagtatcagcctgcgggccggcaccgcgctctcgagcgcggtggacatggccagtacccagctggtggtgggccagggctcgaccatcagcgtcgatccgggccagtcgattgccctgggcagcatcggtcagttgaccctggacggtgcattgaatgcctggggcggcgccatcaccttgagcggtatccaggtggcgccggatgtggccgaagccgtcgagagcgccggtcatggccgctcgatctgggtgggggaacaggcggtgctcgatgtcgccgcgcgggcggccaccgcgaccgatgccctgcggcgtcgatacgggaaggtggacgcgggtggcagcatcgtgatcggcgggcaaatcgacccgcagaccggtatcgccagcgcggccaatcaattcgtggtggtgcgtgaaggcgcgcgcctggaggcttccggcgcccaggccatggtcgatgtggcgggtcaagggccggtggcgattgccagcggcggcggcagtatttccctggcgtcgaacaacggtttgtacctggacggcagtttcagcgcccacgctggtggcagcggcgcggcgggcggctcactgaatgtggcgctggagacaccgctctaccgcaccaatgcgtcgcagcgggtgcgccaggcgcgggagatggtggttggccagaacagcgccgacagcttgctgctcagcggcgccggtcccgaagccgcgcaaggcgcccttacctatggtcatgcccggctggggctggacaaggtccaggtgggcggtttcgataacctgtcgctgctcagcaacggcctgatcagtttcgacggcgcgctgtcgctggccctgggccagagcctgcagttgtatgccggcgccctggcgttgaacgatggcgccgcgaccggttcgcgggtgcaactggccgcgccttatgtacgcctggcgggtgtcggcgcggtggatgcgcctgatcgctcgatgcgccctacagtgcagggtggggtttcgacccaggcttcgacgggcagcctgttggtcacggcgggtaacgtactggacatccgcgatggcgtgagtatcggtgcccacggcaccaccgccagcggcctgagccaggccatagaccgccgtgccttcgatgacacgcaactgatcagccagggcgacctgcgcttcctggccagcaccgtcaatacgcgcaataccaacctgagcacccaggccgacctgcggctggccgctgcgcagatttacccggccaccggcgcggtggcgcaggtgctcgcgggttattggggcaatggcctggactacgacccggaccgcaccctgagtatcgggcgcaccggcagcgccaatccggcgcaaccctattcggtgttcggcaaactgaccctcggcgcgtcggtcatcgagcagggcggggtgctgcgggcgcccctgggcaatatttccctaggcacccaggaggggatattgcgttacaccaaacaactcagcctgctgccgggcagcctgacgtcggtcagcgccgcgggcctgaccttgccctatggcggcacggtggacggcgtgacctggcgtttcgacggtcagcaagtggacttgctgggcgtgggcggcaccagctccaacgccaacctggtggtgggtgcgcagctgttgggccagtcgatcgacgtgcagcagggcgcggtactggacctctccgggggcggccagttgctgggcgcggcgttcgtgtccggacgcggtggttcgaccgatgcgcgctacaacccgttggtgcagttcggcgccgatggccgctttaccttaccggggctggataccaacccggtgtacgccatcgtgcccggggtccaggcaggcgtcgcccccagtggcggcgaggcgggtgcgacaacacccctggtgggccagcagatcagcatcgacgcgggcgtccccggcttgccggcgggcacctacaccttgttgccgtcgacctatgccttgctgccgggggcgttccgggtcgagatcaatggcttggccgcgccattcggcgcgaccgggctgacccgtggggcagccatgagcaacggttcctggtccagcgcgggccggctgtccattgcccagaccgggattcaggatgccttgacccgacaggtgatcctgaccccggccgcggtgctgcgcagttactcgcaatacaacgaaaccccgtatgccgattttgtccgtagcgatgccgcgcgccagggcgtgcctcgcgccgcgctggaggccgatggcaaaaccctgcgggtcagcctgatcgccggccggagcggtgcccccaacggcttcgagttcgctggggtagcacgttcggcggtggccgaaggtggttttggcgcgagcctggaggtgatgtccggattcagctccagccccatcgagattctgccggccggtgccactgccagcggcaacggggtggcgttccatgccgatgatctgaacgccattggcacggcccgcatgagcattggcggagcgccgaccgtggtgtatggccagggcggcaattttgttggcttcgacgcgaaccgtgccgccgagtcggtgacgttgcgccagggcgcgaccttgtcggcccccgaagtattcctcgtttccggcctgcccagtggcgcgattcaaatcgagcagggcgcatcgatcaacaccctggggcgtggcgaagcggcttacgactccaccgatggtttcatctaccaacccggacttcgcagtgtgctggccgtctccaacggtgtgctgcaaatgctcgcgccgaccgagggcgatatttcccgagggcctggcagtatcttgatcggggactgtgcccaggttgtctgccagggcgagactacgttgtactcccaaggcaccattgcctttgccaccaccaacaccttcaggctgggtgatgcggtgcgctacggcacccgccatctggcgttggcggtcggagggatcaatgtcggcggttcagaggctctggccgccgctcaggcacgcaacgccctgccgtcggggttgaccctcaaccaggacgtcatgaaccgcttgctgcgcggcgatatcgccagtggggcgccggccttggaaaccctgtcgttgaccgccggccagtcattgaatttctacggcagcaccaccctgagcaccctggacagcaatggccagtcgatgctggacaacctgatgctcagtaccccggcgatctacggcgacggcgcggccggcgatgtggcactgatccagaccggcaacctgatctggaacggagtagccggtacgcctgctgcggtgatcgccaacggtgccggcaccggtagcggcaccctggagatccaggcccggcgcatcgaattcggctatggccccaacactcagcccgatcctttggccgactacgcgcgcctggccctgggctttgccaacgtcaacctcagcgccagcgaacgcctgaccgccaaccataagggcagcctggcggtctatcagtcccagggtgcctatgcagccggcaagggcttcgtctacagcggcggcaacctgaatatcagcacgccgttgctgaccggcgaggcggggtcggtcaaccgcatcatggcggggggcgacctgcggctgagtcgtgcaccgggccagcaggcggctttgccggtcatcgacagccttggcgctgaagtgttgctggccggcagcaacgtcgaactggacagcgccgtggtcctgcccagcggcaaactgacggtcaatgccgagcatgggttggacctgaccgaccgcgcccatctcgacctggccgggcgccaggtcatgttcaacgaactcaaccaatacagttggggcggcgatgtgatcctgcaaagccgcgagggcgatatccgccaggcggctggttcgctgatcgacctgtcggcgcagaacaaccatggcgggagcctgaaggtggtagccgtgggcgagggtggcggtcaggtggacctgcaaggccagctgctcggtgccagctcggggcattatgatgccggcggcaccctggtgccttacaaggccggcagcgtcgatatccgcgcgcagaccctgagggacttcgccgcgctcaaccagcgcctcaaccagggccaggtattcggcgcccgcagcttccaggtcaagcgcggcgacctgaccatcggcaacgaactcaaggccggcgaagtcaacgtgtccgtggataacggccagttgacggtgctgggcagcatcgacgccagcggcgagcgggtcggcagcattcgcctggccgccagccagggcctgaccctggccggcagctcggtgctcgatgcccacggcacggccctgcgggtcgacagctacggcaagatcatcgattcgccgaaccgtgcgctggtcgaactcaactctggccagggccaattgaccctggccgacggcgcacgcatcgacctgcgccatggcacctcggtcgctgccggtacggcgcccggccagtacgacggccaggctcgcgggacgctggagctcaatgccccgcgcctggatgccagcgacccgaccctgggcgatatcgccatcgatgccagtggccggctgaacatcctgggggctcgctccatagcagtgaacggcaccgcccgttacagcgatgcccccgagggcacggcgccggccgccagcggtcggccgtaccaggtgatcgatcaggcctacctggacgccaagcatcaggacagccagcgctttatcgacaatgccctgggcaatgccagcttgatgaacggcaagctggccggcttgaacaacgccagctatgccgacgccttccacctgcgcccggggctggagatcgtcacccagggcgatctggtgatcagcggtgacctggacctctccggctatcgctatgccagcgtcaatccccatgcgcagaaaaccgcggtgtatggctccggcgaaccgggcaatctggtgattcgcgccggtggcaacctggatatctacggcagcatcaacgacggttttgcgccaccaccgccgaccccggacgatgccggctgggtgttgacccctggtcgtcaggcctttggtggcgatgtggtggtgccggggccgggcgtgacgctggccgacggcagcctgttcccggccggcaagaccctcaactacgccttgccgatcaagccggtacgcctggcgcaggggaccgtgctgccggtcgcggcgaccctgcaggccccgctggaactgccggccggcaccgtgctgcaagccgcggtgcgcgacagcgccggcaatcaggtgtatgccgccggcaccctgatccgcgaggccgtgaccctggccagcggcatgaccctggacgctggaacgcggctgccccgggcggcttcgttgggcgccatgacctggccggccggggtgcccttgccgagccgcgacagcgttggcccgaacaacccggacggcgtgcaactggctggctcgctagcgctcaaggtgggcgcgttgatcccgtcggaaaccgatatcaagttgccgtccggggtgatttcggtgccgctgcgcacggtgaccggcgggcgccagggcagcaactgggccgtcgctccgttgttgccggagggctcgttgtcctggtcgatgcgcctggtgtcgggggccgatacccaggccgccgacacccgggcgatcaaaccggtgatggctggcgacctgaccttggccgacacccattacgcggtcttcgaggggcatgagaccatcattatcccggggactccggagcgtccgggcggcgcatggttctggagcgacttgggggtgttgatcgacccgagctttattgagggcacacgggtttctccggccgatgaaggctggtgtgtcgatggcctgtgcaatcgcttcaactacgtctggagcgatcttggggtgttgatcgacccgagttttatcgagggcacgccagtgacggcggagtatgagtcctggtgttcggatggattgtgtgtctcgctgggcgaggccattcccggcacgccggagcaggtcatcgtcggcccggtgaacaaggtggtaccggtcacccagaacttcagcgtactgcgcaccggtaccggggacctggatctgttggccgcgggcaatgtggccatgcagtcgctgtatggcctgtataccgccggcgcttccagcgcgtcgcgggccggtaccggggcgccgggcttcgatcagccgcgcagccgcactgccgatggcagtgttctgggcagtggcgccgcgacctatgagggcctggtcagcgaggactcgggcagcccgtatgcggcctggtatccggatcagggtggtaatctgctgctgcgcacgggggggaccctgactggcgacattatcagcgactacagcctcccgcgtaacgaaaatgcccgtgtgcagcggcccagcgccaacctggccaactggctgtggcgccagggtagcggtgatactcaggggatgacgccgattccaaccagttggtggatcaactacggcacctatgtgccggccaagggctcggtcaacgcgatcaatcccgagaacgaatcgatcgggaagatgccggtcctgatggggtttactggtatcggtaccctggggggcggcaacctgaccgtggatgtcgggggcgatgcgggcatgctcgcccgtcgcggcagcgccgacggtcagtcatcgccgcgtagccagggcttggcgctggcggtggccagtaccgggagggtgggggctgacggccaactgatcctgaccggtggtggcgacctcgatctgcgggttggcggtgacctcaacccggggctggcggcacgggcgtcgatcagaaacaacagcgacagtgtcgaatcctttgactacacccagcagagtctcaacctcaacggcgtcctgagcaacctgcgtggcgccctcaacatgcagaccggtcagcttggtggtatcgctctgcggtatggcagcctgccgcttgataacgatgcccgtgaaacgcgggcctatgacccgttccaggccagcctgggcaccgccacaggcggcatgaccctgatgctgggcgacaccgcggcaaacctgacgacccggggcgatctggtgctggcgggcaccggcgatccggggcgggtggccagcgagaactcctcgacctttacctatcagggagcgacttacggggctggtggttatggctggttctcgctgtggaccgatcgtactgcgatcaatctgttttcagcgggtggcaatctgaccccgagcgtgcaaacgggggccctacgttcgacttctgttccagtgcctgggcagaactattccgctaccgacgggcgttttatctttccgtcgcaactgaccacggtggccgccaacggcagtatattccttggctcatcggcactagggataagcacttcaggcgccacggactattccttgttgctggcgcctgcgagcaatggtcggttggatctgttggccggcgattcgatttatgccggtggctatgcggtcaaccgttcgggcgctggcctggatgccttgccgacgccgttcaggccagcctttgccggttgggaaggtgttcagactctcaaggtgagcaacctcagcggcgacgctattgcaccgacgatcaacgaactctcgttgtttgccttcggtaccaacaacgctagtggcgccaacagcaccgtccagccgtcgcggctatatgcgactcagggcgatattgtcggcttacgcagtggcgagattctgagtttcaccggcggttcgcgacggggccagacctggtacgaagcggcgggcccggtatggatgaaagctggtcgcgatattgtcaactcgggaacagctttgggcgaactgacagagatccccaccatcatcgccagttccctgggggggctgtccggtagcggcaccagcagcggcaacctgtttgtccataacaaccccaacgatatctccatcgtttccgccggacgcgacctgctgttcagctccttcaacgtcgccggccccggcacgctggagatcagcgccggacgcaatatcctgatgcaggacaaggcctcggtaagcagtctcggtccggtggtggccggcgactcgcggcctggcgccagcatcgtcatgcaggccggggtcggggccgccggcctggattacctgaagttcgtcacgccgtacctggacccgatcaaccaggctcaggccggcgtgccgctggccgagcaacggggcaaagtcgccaagagctatgaagcgcaattgttgcagtggctcaaggagcgctttgccttcgagggttccggcgacgaggcgcggggctactttgccagcttgccggcggagcagcagcgggtcttcgcccgtcgcgtctacttcgaggaactgcgtgagggcggccgcgaatataacgacgccaacggcccgcgtttcggcagcttcctgcgcagtcgcaacgcgattgccgccttgctgccgagcaaggatgtggcgggcaacccgatcgtttacgacggcgacatcacgatgtatggcggcgcaggcgtacatacgctgtttggcggcgatatccagatgctcaccccgggcgggcagcaggtattcggcatcgaaggcgaggcgccgccggccaccgctggggtcatcacccagggcgccggcgatatccagttgtattcccaaggcagcatcctgctggggcagagccgggtcatgaccacctttggcgggtcgatcctcggctggtcgaacgccggcgacatcaacgccgggcgcggctccaagaccacggtgatctacaccccgcccaagcgggtctatgacaactggggcaatgtcacgctgtcgtcgaacgtgccgagctcgggggcggggatcgccaccctggcgccgattgccgaggtgcccgccggggatatcgacctgctggcgcccttgggcaccatcgacgccggcgaggcggggatccgggtctcgggcaacgtcaatattttcgccttgcaagtggtcaacgcggcaaacatccagacccagggcgagtcctcggggattccggtggtggcgtcggtcaacaccggggccctgacgtcggccagctcggcggcgtcttcggcgacccaggcggccgaggatgtggcgcgccagcagcaggcggcggcgcggcagaacatgccgtcggtgtttagcgtgcaggtgctgagtttcggccaggagcgcctggcgccgacccaggatggcgccagccggggcaaccccggttacaacccgaacagcccggtgcaggtgctgggcgccgggccgctgagcgatcaggcgcgccagcagttgaccgaggaggagcggcggcaactgactttataggttctctcgtggcaacacagttcggggcgatcgttgatcgccccttttttgtctgcacctctagcgatggtcggtcgccgcctttgcgacgatttatgatttaggtagtgtcaaattaatggcattgcacattatcctgcgccacccgaatacgcctggcggcgtcgggcgaccttgttttctgaatcggaactggatggatgccaatgattgaagtcgccatgaaatacctgaaactcgcaagcttgctgctggttgccacgaccttgttcggctgcgccaccagccgttcggtggtgggcatcgatggacctgaagtggccagtggcaacggccagaaggtggtgatcaatgtgctcgacgagcgtcgttttgaagccgacccgcgcagtgccgacattccttcgttgaagaatggcgagatcgacgacaaggcgatcaccgagcgcgcgattgcgcgcaagcgcaatagctatggcatgggcctgggcgatgtgctgttgccggagggcgctgattgccaagagcatcggcgcagcctatggcaaagccggttatcaagtggtgccgagcaccgagcaagcgccggacgccaggaccatcaccgtgcatgtggtcgagttctggtcatggatgtcgccgggtgcgttctccgttgcggtgaacaacaaatcgcacctgaaggtggacaccggtagcgcgtccgcgcctgtcgaggtcaagaccttgaaacgcgaaggcatgcagatgattaccgagaatgactggaaactgatcaccgaggctggtttgcaggccatcagcgagtccatggccaagcagctctgaatccagggttgttcaattgtcgggcgcccgcaggctgatgggggcccgagcgcttagtttcccgacgcttgctctgtagccgctgccgcaggctgcgataagggcgaaggccttcagcgatcccaaaagcttgcgcctgctgcgcagtcgatcgcagcctgcggcagcggctacaggtgccgggtgtcaggcttgcaggcgccagcccatgacgtcgagcaggtcgcagctgtcgcgcagcaggatggcgccggcgttggccaggtgttgcaggtcggtgccatcggcgtctttcaggtcgaggcgggcgaggctttccagcacttgggtgacggccagcaggcgcgctgcgctgttggcgtggaggacgtcgagtggggtgtttttgtcgatcagcaggcaggggatgaggctgtcgatgcccgtgagggggatgtattgcttgttcatggggtactccttcgcggatgagaggagctgccgtcgtcgccaaacgaaagggtggcagctgcacgcaggttggcgaaccgatcatccacaaatcggcagatccgaagatctcccgcgcgcagccgccataaaagatcgccgcgaacataaaggctcgacggcaaagattgcaagcatgactgcttgtagatgaatgcccaggtcgccaaacccggtcgccttatgggcgagcaaggaatataggacgtggtttccggggcggacaagtcagcactttctgcaagttgtgtagggccaatcgctgtccgacgttctttgttttgcgcgggtttcagaggggcaagcttttcaggatcgcctgattcagcagtcgattatgcgtcgttacgttcgaggcccacccctcaccaggaacgtacgccatggcttttgtcatcagggaaggcgaccccactttatgagggagtaaatacatggtaatcaccacaacgcatattgttctgggtgtgtttattggaattacttttctcggaatgtttaccctgattgggtactacttctatttaggctatacccgcatggatagcattctggaggcggttaagaactgctcgctgatcaatagctatcggttttatctattcatggggccttgggggaagatgatgatggtggcaggggtgggcaactgtttgttgttctcgaaatatctcattaagcatggggcgttggacaagggggatatcgagaactttccggagcctctcaaggggcgattgcttatgttgcagtacatcggatgggggttgttggtgagtctttttttggaagttatcgcagtcaaaattcttagtggtcaagtgcaactataagaaggaaacaccaccctatctgatcaatttcagtaaaccggcatgcaagcatatcgctgtatccaccaggtcattccagacaaggacaaacccatgacagacctcaagccctcgcaaccgggggctgtcgatgctattgcctacaaccgggcctcttcagccttgcagcaagcatttgccttgttgcagcagcgggtctatcccgagccggatgcgcctgaagaagcggcggtcgcagcgctgcacgatcctgtgttcgacgcattctcgttttatatctgcacccacgacagggtggtcagttacgctgccgtcgccatgaagaccatcgagcatgccggcgacaccttcgagattggcgggctcagctgtgtcatgaccgaccccgattgtcagggccaaggcctggggctgaggacagtcgccgcggcgactcgctgcatggaacacagccatctcgatattggcgtctttacctgcgattcgccgctggttcctttttatgcccgggccggcggttggacgattgcgccggatgtggtcctgatcggcaaccggcacgacggggcgttgcgcagcgatacgctggggaaggtcgtgctgttgcggctgctttcggcgaaggccagggcggcggcttcggcattggccagtggggttatcgatctgggcctgccagacgggcagtttttgtagggggctgtactccatctagcatcacccgcgacagtgccgacgccatcgcgggcaatcgagcgtcgaccggccgctcctacaaatccgcttcctgatgaactcgggtccccagtcttctccagcctgcttttctgcgggctgtctcgccgattcccccgtctttcctgcaggccgccatcctgtattcccgcgtcgggtgcacaggtgttcctgggcatctcggacaagtcccttcctctcctgaatgaagcttttgtgacaaaagttcggtagcacttcgccagtcccgtcatggatatgtgacgcgcttgagggggccttctggccactgttctgagccgaggcgggacgccgggagtgaggtgatggggactatggaacgctacgcgaaagtgggcatgcaggagctggaccagcggctgtcgaagatagtcgaggccgcgcgcaagaagccggtgtcggtctatcgctacggggcgccgtgggtctggatcgtttcccaggatgactggcagggcgccttgaaggaggtgtcgagctatatcccgccgggccattcgctggtgttgctgcgcccgcagatcgacgccttgctcgaccagcaccgcgacatcctccagggcctggatgccgagcccggcatgcttatcgccccgcgcacggtgatgcacatcctgctgttgcagctgctgtattcggtgcccggcgagcagcagttgtacgaacaactcaattacaacctgctgtttcgctggttcgtcggcctggacctgaaccagaaggtctggagcctcggcgtgctgagccgtgacatcgccacgctgttgaacgatgcacgggcggtgctgctgatccagaaaatcatcggtgaagtgttctgtggcgccttgctgcaaatgcccgagttctcgttgaacttcgcgctgctgcacagctggctggccaagcacgccacgacatcgaccttgagcaattgaggcggccaaacgccgtacagacggcgacggcggtttcgacgcggttggacattcttggaaatctagggggcggtgtggagcatctgttcaagagatggcggccggggccgaccaggcgctggctgccggtgtgcggctggctggcgctggtcgcgctgggccagccgctgcaggccgaggagggcggcccggtggcaggcgagccggtgcaaggcggcgtggcgcaaggcgaggccgcgcccgcgcggctggtggatgtgaatgagtacttcgtgcgcggcaacaccgtgctcgatgcccgggccatcgaagaggcggtgtatcccttcctcggcccgcagaaagccctgagcgatatcgagggcgcccgcgacgccttgcagaaggtctaccaggcccgcggctaccagtcggtgttcgtcgagctgccggagcagaaggtcgaggacggcatcgtctacctgcaggtcagcgagaccaaggtcgggcgggtgcgggtggtgggggccaagcattattcgccggtggaaatccgcgacgaggtgccggcgctgcaggaaggcgaggtgccggacttcgccaaggtccagggccagctggcgagcctgaacaagacccccgggcgccaggtcatgccgctggtccgcgaaggccagcgccccggcaccatggacgtcgacctgcaggtggaagaccagaacccgtggcaggccagcgtcggcctgaacaacgactacagcgccgacaccaagcacctgcgggcggtcaccagcctgggctacaacaacctctggcagttgggccacagcatttccctgacctatttcaccgcccccgaggaccaggacaacgccaaggtctggtccggttcctacaccgcgccgctgaacgagcgctggagcctgcagttcgccggctaccagtccgacagcaacgtcgccaccattggcggcagcaacgtgctgggcaaagggcattcctacggcctgtcgctgatctacagcctgccggccagcggcagctgggccaattcgttctcggtcggggtggacttcaaggacttcgaggaagaactgagcctgggcggcgacagtgacaaggtgccgctcaagtacgcaccgttcaccttcgcctacaacggtttccgctacaccgagacctcccagctgggcctcggcctgagcctggtggccggcacccgcagcctgttcggctatggcagctcggacgaagacttcgactacaagcgctaccgcgccaaccccagtttcgccgtgctcaagggcgacctgaattacacctacaccttcgccaacgactggcagaccgggtccaaggcggcgttccagctggcctcggggccgctggtgtccaacgagcagttctccgccggcggcgccacctcggtgcgcggttacctggcggccgagcgcaccagcgacgacggctacctgttttcccaggagctgcgcacaccgtccctggccaagtacctgggcggttatgtcaacgaatggcgcttctatgccttcgccgaaggcgcgcggatgtacctgcgcgacgagcttcccgaccaggaggccgactacagcctggccagcgtcggcctgggcacccgcgccagcttgagcaaatggctttccggcagcctggactggggttacccgctgcttgatggaccgaacacccagaaacaggactcgcgcgtgcacttcagtgtgcaggcgacgttttgatctttcacggagtaactttcatgcagcgcttactgatttccctgttgatctgcctgggcttcgtgctcccggcgaccgcccaggcgtggtggcaggacgactggcactaccgcaagcagatctcgatcgacaccacgccgcaaggcgcggccatcaaccaggccctgggccgcaccgcgctgctggtgcgcctgcacaccggcaacttcagcttcgacggggtcaaggaagacggctccgacctgcgtttcgtcagcgccgacgacaagaccgtgttcaaccaccagatcgaaagcttcgacccgctgatgggcatggccctggtctgggtcgacgtgccgaacgtggagggcggccagcgccaggacatctggatgtactacggcaaccagaaggctccggccagcgccaacggccagctgaccttcgacccgaactacgtcgccctctatcacttcgacggcgccaacggtaccccggccaaggacaccacggcctacggcaaccatgcgcagaacgccaccggcgcgagcatcgacggggtgatcggccgggccttgcagttcaacggccagccgctgctgttgccggccagcccgtcgctgcaacacagcgccgacggcgcctttaccttcagtgcctggctgcgcctggaccaggccagcggcgagcaattgctgttggcccggcgtgaaggggccagcagcctgctgatcggggtcaaccagggcgtgccttttgtcgaggtcgacggccagcgcgcggtgtcgacccagccgctcaatcccgggcagtggcagcacctggccctgaccgcccagggcagccagctggcgctattggtcaatggccgcgaaagcgctcgcctggcggtggcgctgccggcgttcaattcgccgctggccatcggcgccgatttgccgccggcatcaacgccaggggcaacggccgaggtcagtgccttcctgccgttcaatggcgccatcgacgagttgcgcctgtccaaggtggcccgtcccgtcggcctgctgctggccgatgccgcggcccagggcgccgagtcgaaactggtggtgtacggcgtcgatgaagaacagtcgggcttcggtttcggcagcctgggctttttgctcaaggccgtgccggtggacgcctgggtgatcatcgcggtgctggtgctgatgatgttccagtcgtggatcatcatgatccgcaagaaccgcatggtcggccgcgtcagcagtgccaaccagatcttccgcgagcagttcgcccgggtcggcacccgcctggaaatgttcgccgacgaccgcgatctggcccagcgcctggagcattcctcgctgtggcgcctgtaccaggtggcggtccaggagatccgcacccgccgcgagcagggcgccgacacctcgtcggtctcggcggcgaccatcgaagccatccgctgctccatggacggcgtgcgcacccgcgagaaccagcagctcggttccaagctctcgaccctgtccaacgccatcgccggcgggccctacatcggcctgctgggcacggtgctggggatcatggtggtgttcctcggcacggccatggccggcgacgtgaacatcaacgccatcgccccgggcatggccgcggccctgctggccaccgccatgggcctgttcgtcgcgatcccggcgctgtttggctacaaccggctgatcacccgcaacaaggaagtcagcgccgacatgcgggtgttcgtcgacgagttcatcacccgcctggccgagttgcatggcgccagccagtccagtgaagccgcgcccgcgcgggctcataacgccagcgtgccggcctgaggagaaacgtcatggcttctgtgaacgcctcccacgacgacgatgacgacgcgccagtggacagcatcaacatcacgcccctggtggacgtgctgatggtggtgctggtgatgttcatcctcaccgccaccgcccaggtctccgggatccagatcaacctgcccaaggccagcgcttcggtgtcgctgtccgaggccaagaccaaggcgatttcggtcaacgacggcggccaggtgttcctcgacgcctacccggtgacgctgccggagctggaagaacgcctgcgcatggaaaaggccctgaacccggacttcccggtgatcgtgcgcggcgacgccacggtgcagtaccagaaggtcatcgaggtcctggacctgctgcgccggctggagctgtcccaggtcgggctggtcaccggcaaaccgagccagggctgaccccatgaccgcacaacaaccgatcgcaccaccaccgatccagctgccgccggtgaaaaaccgcacggcgccgcgcctgctcaagtggggcgtgggcctgctgctgggggccattgccgcctggctgctctggcagtgggccaacgacatgagcggggtgcgccgggaggcgcccaaggtgccgaccatcatcccgctgccgccaccaccgccaccgccgccggaaaagcccaaggagccggagccgccggtcgaggagaaggtgcccgagccggaaccgaccccggagccggagcaggtcaagcccgaggaagaggcgccgccgtcgccggtggacgatctggccaatcccatgcagatggatggcgatgcccaggccggcagcgacgctttcaacatcggcgccggcaagggcggcggcatggccggttccggcggtgggcgcctgggcaacggcacctacagccagttcctggccttcaccttccagcgcgtgctgcgggaaaacccggacctgcgcaaccaggccttttcgctgcaaaccgacgtctggctgagcgccgtcggcgagatcacccgggtcgagctggtcaagtccagcggcaacccgcaaatcgacacccaggtgctggccgccttgcgcggcgcggcgcatttgacggagcggccaccggcctccctgaccctgcctgtacgcctgtccctgcaggggcggcgtccgggttaaccgaacgactgatgcaagttttgccaaaaggagctgtgtgcaaatgatttccaacgtgaatcgattgtccctggcgatcggcatggtcatcgcgaccctggtgggaccggtagcggccgcgcccgctgcgccctcggaaaacgccacgatcaatctgatccgtttgctggtgcagcagggcgtgctgaaacaggaacaggccgacggcctgatcgcccaggccgagcgcgaagcgcagcaggcgcgccaggccaacaccgcggtggcggcagggccggcggcgacgccgggggatgtgcgggtgcaatacgtgccggccatcgtccgcgaccagatccgcgaccaggtcaaggccgaggtcatggccaccgccaagcaggagaactgggcccagcccaataccttcccggactgggtgtcgcgcatcagtttcgacggcgacattcgcctgcgcgacgagtcgcgctactactcgggcagcaacagcaacgaaatcgtcgacttcgccaagctcaacgacaagggcccgtacgacgtcaaccccaacagcagctccaacctgccgcccttgctcaacacccgcgaggaccgcgagaacctgttccgcctgcgcgcccggctgggcatgaaggcccaggtcgccgaggactggaccgccggcatccgcatcggtaccggctcggacaacaacccggtgtccaccacccagaccctgggcggcgggttcggcaagaaggacatctggctcgaccagggctacctgacctggaaggccaccgacgcgctgaccctgaccggcgggcggatcgccaacccgttcttctccaccgacctgctgtattccaacgacctgaacttcgacggtgtggcggcgatcttcaaccacaagctcaatcgcgactgggggctgttcggtacggtcggcgcgttcccggtggagtacaccaacgacacctccaccagcaacggcttcgacaaggaagagagcgacaacaaatggctgtacggcgcgcagatcggcgccaactgggcgatcaacggcaaccaccggctcaagggcgcattggcctactaccgcttcgacgacatcgaaggccagcgctccggtgcctgcgaaccctgggccggggcgccgggctgcgacagcgacggcagccgcgtggccttcatgcagaagggcaacagcgtgttcctgctgcgcgacatcacgcccaacccgctcaacccggccgccaccgcgcagccgcagttcgtcggcctggcttcggagttcaacctgctggacctgaacctggtatgggacgccgacctgccggagaacttcaagctgcgcagccaggccaactacatccacaacctgggttacgacgaaggcgagatgcgcaagcgctctgaaggccagatcgtcaacaacctggacagcaacggcgagctggaaagcggcgccaacgcctggatggtgcagttcaccctgggcaacagcctggagctggccaagcagggcgactggaacctgttcgccggctacaagtacatccagcccgatgcgctgcctgacggcttcaacgattcctcgttccacctcggcggcaccaacgccaagggttacttcctcggcggcaactacggcctggccaagaacgtcttcgccaccggccgctggctgagctccgaggcggtgtacggcgcgccgttcgacatcgatgtcttgcagcttgaaatcaacacgcgcttctagggcgcaagggtgcattgctatgaacagtctcgatatgaacacgcgagccagggcagggcgctgcctgttgttggccctgggcgtgctgctggccagcggggccagcgccgaaggcatggaggagcgcctgcgcactcagttgcgcagcaccacccagcagttgcaggccctgcagagcgaacaggcccaggccagcgcggcccgggtcgccgccgagaaccaggccaaacaggcgcaggcgcagatcaagcaactgagcgccgacctggccaaggcccgcggcgtcgccgagcaactggccggccagcagcagaacctgcacagccaggcccaggcgcagatggccgccagcagcgagcagatcggcaagttcaagaaggcctatgacgaactgctggtcatggcccgggccaaagaggccgagcgggccaggcttgcggcgcaattgagcgaacgtgacacacaagtgcagcaatgttcggtcaagaatcagcagatgtatggcgtggccaaagagatcctcgcggcctacgagaagatcgacgtggcgcaggtgatgaaaatccgtcagcccttcgccggcggcgcccgggtcaagttcgaggaactggcccagggttttggcgacgacctgtacaaaacccagttcgatgccccccgggcagcgagcacccactgaatatcagggaagaatcgagcatgactgaacaagcgcaattgatcctcagcgtcaccccgcagagcctcaccgaactgctgcaaggcgccggctaccgggtcaaccagaccgaccagaacggcatcgtgcaactgctcagcgccagccagggcatcggctacgccgtgcgcttcggcaacgcggcgggtgctgggcagggcagctatgtggacttcaccttcagctgcgcactgcgggtccagggcgagttgccggccggcctggccgagctgtggaatgcctcgcggcgctttgcccgactgtcggtgcagggcgaattcctggtgatggaaatggacgtggtggtggccggggtcggccacgatcacctgcgcagccagctggaactctgggaccggctgttgcaggagttcatcgtctacctgcgcgactacagccagcacgccgcgcgcctgcaggcccagcctgaagccacgccagaaaccatgcctgaagcagcgcccgaggccgtcgccgaggctgtcgttgaggtgcctgggcagtgaagaagccaagcctggtggtcggtgtcggcgccctggccctggtggcgctggcggtgtggttgggcgtgcgtccgggcagcgacccggtggcggcgcaacagcccagggtggcgctagccagcccgatcgacgacggcccggcggtggcgcgcctgggcaaccatcgggtggcgccggaggagctcaaggagctgttcgcggcgttgcccgaggcgtcccgcgagcagctgcggggcaatcgcccggccctggaaaactggattcgcacgcgcctggcggaaaaggccgtgctcgaacaggctgatgcccagggctggcgccagcgtccggaggtggccttgcagaccaaggtggccaccgaacagatcgtctttcgcgattacttgcgctcggtcagccaggtgccggccggctacccgagcgaggccgaactgcagcaggcctacgacgccggcaaggcgcagtggcaaaccccggccttgtaccgggtcagtcagatcttcctcgcggtgaatgagccgcaggcgctggaggcgacacgcaagcaggcccaggaactgagcaagaaggcccaggccgcccccggcgaattcgccgccctggccagccagtattcccaggaccccgacagcgcccggcgcggcggcgactccggtttgcagccgttgcagcaactgctgcccgaggtccgcggcgcggtggcgcgtctgaaggtcggcgcggtgtccgatgcggtgcagagtgcggcgggttttcatgtgctcaagctgaccgagcagcaaccggcccgcacggcgaccctggacgagttgcgcgagcgcctgacccaggccctgcgggcgcagcgccaggaacagatcgccaaggcctacctggaaggcatgcttgacaccgcgaccctgagtatcgacggcgcgcagttgagcaaggtgctggaggagaagctataggggggcggtgtggccgataccgctatcgcctgaacaacgtgcaatggatgccatcacccacacgacagggagtcactcatgtcctttctcgaacccgtcccgatctcgggcatcaccccctacatcgcccaggccgaaccccgggaagcctggctggccctggccgccgggatcgagccggagctggcccagtatttcctggtcaccgcccgttgcggctgctttatgcaggcggcgcgcagcctgaacatcaagtcgacgctgctgcgcaaacagctggcgcacctggaggaacagttgcgccgccccttgttcagcttccagggcagtgccctgagcctcagccgcgaaggccagcagctcaaggcgcaactgatcgccctggcccacgaacgcacgctgccggtgctcgaacagccgctgctgcgcctggcggtggccgagtcgatcctgcacgacatcctcggtcgcgacctgattgccctgttgcggcgcaacgccagcgtgcgcctggagatcatctccatcgacagcgagctgtcgctgcgggccctgagcgccgacgtggtggtgtggctgggtggggtggattcacccaggccggggccgagtttcgtcaccagcgcgccgcagccgctggtgcgcctggactacctgccgcatatcgccaagcgttattcgcgggtcgcggcgcgccccgacagcctggacgacctggccgactacatgctggtgcaatggcagcaggaccgtcaggtcgagccgctgcggccgtggaaccagttggtggagcagcgcctggcgggggtggtgcaggtacattcctacgagctgatgctggagatgattcgttgcagcgcctgcatcggcctgctgccccattatatgagccgcttcgaccgcggcctgacggcactgcccggactgttcgacgaggccatggcgcgccaggtgtggatggcggtgaacgccgaagtggagcacgacgccgaggtgcggatgctggtggagctggtcctcaataccttccgcgaacgtggcgaatggtttgactcagtcaatccgctgtaggagcagccggttgacgctcgattgctggcgatggcgtccagcctgatacaccgcggcgcaggcatcgccagccaggctcctacaccgggaatgggcccgcctggcccctgtgttcgacactcgccatgcgcggcgctggcgctctacactcgacggccgtctcgcatgaaccaaggaagacttatgcccgccgaaatccccagcatcgtcatcgaacgtttcagcgaagcccatgtgccgggcattaccgcgctgtacaacgaccccgcggtcgcccgtcagatgctgcaaatgccgtttcagccttccgaggtctggcgcaatcgcctggcgccgagcaacgaacgactggtggccctggtggcgctgcaccagggcgcggtgatcggcagttgcagcatcgagcaatactcgcgcatccgccgcgcccactgcggcagcgtcggcatgggggtggcggtggaatggcagggccagggcgtcggcagccgactgttggcggcggtgctggacgtggcggacaactggatgaacctgcaacgggtagaactgacggtgttcgccgacaacgaagccgccctgggcctgtaccgcaagttcggcttcgaaagcgaaggccggctgcgcgactacgcggtgcgcgacggccagtacgtcgacgtcttgagcatggcgcgcctgcgccgcacgctccaggcctaactcgcccctgtagccgctgccgagcgccagcgaggctgcgataggtccgaaggacctcaataggagatccgaaggacctctggcatccgtaagatcgccgcgcccgttccgggcgttcgcagcctgcggcagcggctacaggagatcatcccgcaaaagttacacctgatcatccaaggcaaacgccaccgccgcccgcgcatgcagctcggtggtgtccagcagcggcagggggctgtgttcgggcttgagcagcaggccgatctcggtgcagccgaggatgatggcctgggcgccgcgctccatcagggcctggatcacctgctggtagcgctggcgcgaggcctcgctgatgacacccacgcacagctcgtcgtagatgatccggtgcacggcctgacggtccacggcgtccggcaccagcaccttgaggccgcgatcgagcaggcgctgcttgaggaaatcctgttccatggtgaaggccgtgcccagcaggcccacgctgagggtgccggcctcgagggcggcttcggcggtcgggtcggcgatgtgcaggaagggtatcgacagcacggcctgaatctcgtcggcgaccttgtgcatggtgttggtacagagcaccacgcattcggcgccaccggcctccaggcggcgcgccgcatccaccaggatcccggccgcgaggtcccagcgcccggcgtgctgggcctgttcgacaggcccgaagtcgacgctgtacattagcaaccgcgctgagcgcagcggcccgagacggtcccgtacctgctggttgataaggcggtaatactcggcgctggactcccagctcatgccgccgataaggccgatggtgcgcatacacagctcctgttgctgaccaacctgaatgccgagagtgtcccgtgacgcagccccgcgatctatcaagaaatttcacatgcccggcgtgctgagcagcaaagtccaggatcacgagccgctgcgccgcgaactgctgggcggcaccctcgacctgcaattgctgccgcgcgcggcctacagtgcgcgcgatccgctgcagtggcaaagcctcggcctgagcctggagcgccagcagggcgtgcatgccatcggcagcgaccggcgcgaggatttcgacagctggccggggaccctggccttgaccccggccggggtcgaggtgttttccgagtcgccccagggcggtgaatacctgctgctgcgctggctggccgacccccaggccctgggcatcgcccgcggttcgcgacgcctgcaacggcccggacacgcccgggccctggcgctgggacgccaggcgcggcggctgttgctggagcccgtcggcgacccgttggccctggaacaatgcgccctgcagttcgccggcctggccgccctcgacccagcaccggccaaggccgccaggcgaaccgagttcagccgggtgctgacgctgatcgagcagcagtacgccgagcccctgtcgctcggtgaactggcggcctgcaccgggcgcaacgaactgcgtttcctgcgggatttcacccgcgccattggcatgacgccccatgcctggctggtcgaagtccgggtgcaggcggcgcgtcggctgatcgaacgcagcgacctgccgctcgccgccatcgccctggaaaccggcttcgcccaccagtcccatatgggcagcgcctttcgcaaggccctcggcctgaccccgagccagtaccgcgcaggtttttagtcgtacgccgacaccccccatctgccatgctcaaggtccgcaaccgcggtttctcgaagaggcatgaacatggacgacgtacggcaactgggcgagatgcttcggcgctatgcagaaagcgaagcccacaagaaacagctgttcgaaagccagaaggtggtctgggcgagccgtatcaccgagctgttcgagcatatccagcagtggctggcgccggtgctgatgccggacctgctggccttgagccgggaaccctacctagccttcagccctagcgtcccggtgaaaacctcgaccttcaagaccgagaagctgaccctcgtcatcgtcggcaaaccggtggagttcgtgcccgatgtgatgggcgccgccgggcagatttccctggcggtcatgggcctgaccgccgcgcgttacggcagcgtgtccctggtgggcttggccgacggcagctggcaatggcgccaggccaacggcctgaaggagtccgacgtctttaccttcgacggcgacttcctggcgtcgcagctgcaggcgctgattccccgggagcgtgggtgaggcagtagctgtctggtggcctgggcgtctaccagacccatcaagggcattcttcagatctctacattgccccagccgggcctggcggtttgcggttccggcgccacggcgtcgattttcttgccggtggttagttccacccggcgcgccacttccgggtcgtcggcgaaggggatcaggctggcgtcgtcgaggctcttggccgattgatggcgcaggcagtagccgatgctcaggtagaggaaggtcacgccgagcaggtcaagggcgaattcgatcatcgggggctcgctgtgctgcaggagggatgagcgacgcgggccgggtgtggcccgcgtcgtggtcgtggcttgggcgatcaggcgatctgggcgtcgctgagggccaggcgcgggtcggccacgcgcacggtgcgccaggtgttgtaggccatcagcagcatgccgctgaggaagaacacgcccccggcgaagcgcacgataaagcccgggtggctggcctgcagggcctcgacgaaggaataggtgagggtgccgtcgtcgttgaccgcgcgccacatcaggccctgggtgatgccgttgacccacatcgaagcgatgtagagcacggtgccgatggtcgccagccagaagtgcaggttgatcagcgcgatgctgtgcatctgctcgcgaccgaagaccttgggcaccatgtggtagatggcgccgaaggtgatcatcgccacccagcccagggcgccggcgtggacgtggccgatggtccagtcggtgtagtgggacagggcgttgaccgtcttgatcgccatcatcggcccctcgaaggtcgacatgccgtagaaggccagggacagcaccaggaaccgcaggatcgggtcggtgcgcaatttatgccaggcgcccgagagggtcatcatgccgttgatcatgccgccccagctcggtgccaggaggatcagtgacatggccatgcccagcgattgcgcccagtcgggcagggcggtgtagtgcaggtgatgcgggccggcccagatgtacagggtaatcagcgcccagaagtgcacgatggacaggcgataggaatacaccgggcgcccgacctgcttgggcacgaagtaatacatcatcccgaggaagccggtggtgaggaagaagcccacggcgttatggccgtaccaccactggaccatggcgtcggtggcgccggagtacaccgggtaggacttgaaccagtccaccgggatcgacaggtgattgaccacgtggagcatggcgatcaccaggataaaggcgccgaagaaccagttgccgacgtagatgtgtctggtcttgcgttgcaccacggtggtgaagaacacgatgccgtagaccacccagaccacggccatccacaccgcgccggagaattcgatttccgcgtattccttggtggtggtgtagcccagcggcagggtgaccagcatgatcaggatcaccgactgccagccccagaaggtgaaggcggcgagcttgtcggaatacagccgcacctggcaggtgcgctggaccgcgtagtaactggcggcgaactgcgcgctgccggcgaagccgaagatcaccaggctggtgtgcagcgggcgcaggcggccgaagctggtccagggcaggtcgaggttcatttgcggccagaccagctgggaggcgatccatacccccatggccatgccgatcacgccccagaccacggtggcgatgacgaattggcgtaccaccttgtagttgtaggccggttccattgttgctgtgctcatggtcaatgcttccacggttgcaaaggcttgccaggccacccggcctggcatgccatgcactgtagaaagcacggacgaaacaaaacaggctcagaaaaactgcattaatacggatcagattgaccgcctgccagcacaggtctacgagctgctgatacggttttttagtgtttacctgaatctgtaacgtcctgagccgcaagggcatagtcaccgccacaccaacccccccccggatcacccctggaatgcataaccccgtggccaccgtggccctgtagccgctgccgagcgcagcgaggctgcgaacggctgcaaagcagccgcaaagcggcacacgcggtctatcagccttgtcgcatgctccggcttgcgagcgctgtgcgctcgatcgcagcctcgctgcgctcggcagcggctacggagctacagggcgcatctccagggacaggatcggggtcagcactgatgaggccgtgacatgtatcactatgacgagtacgaccgggccctggtctttgaacgggtggcgcagtttcgcgatcaggtcgaacgcttcatggccggcgagctgagcgaagaggagttcctgccgctgcgcctgcagaacggcctgtacatgcagaaacacgcctacatgctacgggtggccattccctacggcaccctcagtgcgcggcagatgcgcaccctggccagcatcgcccgcgactacgaccgcggctacggccacttcaccacccggcagaacatgcagttcaactggatcgagctggcccaggtgccggacatcctcgaacgcctggccaatgtcgagatgcatgcgatccagacctccggcaactgcgtgcgcaacatcaccaccgaagccttcgccggggtggccgccgatgagctgatggacccgcggcccctggcggagatcctgcgccagtggtcgaccatcaacccggaattcctgttcctgccgcgcaagttcaagatcgccatctgctcggcccgccaggaccgggcggcgatcatgatgcatgacatcggcctgtacctgtaccgcgactggcgcgggcagatgctgctgcgggtgatggtcggcggcggtctggggcgcacgccgattctcagccagcagatccgcgacggcctgccgtggcagcacctgctgtcttatgtcgaggcggtgttgcgggtgtataaccgccacggccggcgcgacaacaagtacaaggcgcggatcaagatcctggtcaaggccctgggtatcgaggccttcgccaaagaggtggaggaggagtggcagcacctcaaggacggcccggcgcaactgaccgaggccgaataccagcgggtcgccagtgcctttgtcccgccgctctacgaacgccagccggccaccgatctcgactacggcagccgcctggccgaggagccggctttcgaacgctgggtggcgcacaacgtgcagccgcacaaggtgccgggctatgccagcgtggtgctctcgaccaagcccggcagtgcttcaccgcccggagacgtgacggcggcgcagatggaggcggtggccgactggtccgaggccttcggtttcggggaaatccgtatcgcccacgaacagaacatcgtcctgccggacgtgcccaaggccgcgctgcatgaactgtggcggctggcgggtgagcagggcctgggctgcgccaacgtcggcctgctgaccgacaccatcgcctgtcccggcggcgacttctgcgccctggccaacgccaagtcgatccccatcgcccaggcgatccaggcgcgtttcgacaacctcgactacctgcacgacctgggcgacatcagcctgaacatctccggctgcatgaacgcctgcggccatcaccacatcggcaatatcggcatcctcggcgtcgataagaatggcagcgagtggtaccagatcaccctcggcggcgcccagggcaaacatagcgcgctgggcaaggtcatcggcccgtcgttcagcgccgagcaagtgcccggggtgatcgaacgcatcatcgccaccttcgtgcgttaccgggagagcgaagaactgttcgtcgacaccgtacagcgcatcggcctggagccattcaaggagcgggtctacccgaaagtgctggaggcgcagccatgagcccgcagcgcgaccatgcaatagaaagcacagccatgagccaggagttacagccgtgagcgagagactaaaaccatgaataatctgctgcgtctgcaagatggccaggccgggcgggtcgaggacgatccctggagcctggtgcgcgaggtggacggcccgctgccccagggcccgttgattctgccgctggcccgctggctgatccgccgcatcgagcatgagccggcgcgggacggggtctggctcggcccggacgacgaggtggaaagcctgcggccctggctcaagctgatcccgctgatcgccctggacttccccagcttccgtgacggccgggcctacagccaggcctacctgctgcgcacccggctgggctggatgggcgaactgcgggcggtgggcgatgtgctgcgcgaccagctcagccatatgcgccaatgcggttttgacagctttgccatccgcgaagacaaatgcgccgacgacgccctcaaggggctggcgggcatgagcgtgctctacgggcgctcggcgatcgagccgcggccgctgttccggcgccgctgagatccgccgccgctgaagagcagcgccagcccaggccggcgcttcgatcgatgctcacagtcgcccgggaacagggccggcaacggccattgtgtggccgccaggggcatttgtccttgggtcgctgatggcgctttggtagagtcgcacctcttatgacggagccagggatcggcgaccggcgatcagtcgccggcgtgcctggcatgggccatccatggaagagagtcgcggctgtgagcgttgctaaaaagatactcgggttgttttcgttgctgctgctcctgaccctgtgggtcggctatttctatgtgtaccaggatgcccgcagcgggcgcctcggcgaccctctcgacagctacggctggtgcggccccgccgcggattcgccgcactccttcaagcgcgactacctgctgctcagggtgaccaacagcactcagggcgagttcaaggtctcgggggaggtcaacgtttccgagcgcacctacaaccgctacgagctgggccgctacccgctgaaactgcgcctggaacccttgcagtccacctacagcatgccgccgttgttctttgaagaggtcaaggtcaagcccttgaaccgcaacttcagttcgccgcacaagaatgcctacgccgacctggaaaaccgctcgatccgggtcaacggcgagtccagccggtttcccttcgaggtctaccgttacggctacaagccggtgctgtacatcctcaagggcaacgagcaggtcgacctgccgttcaagcgcatcaccacgcagctgaacctgtccaatacctttaccccgacccgcctgtacaacccggcggactacatcgccgagcagaacagcctggtccagcccggcgactatcccgcctacggcgccagcgagtgcgccttcagcatcgagcgcaaaggctcgttcaagatcatcgtgctgctgttgttgctggtgctgtgcctgccgctgttgatggtgctgtaccgcgacgagccgaccatcgactttcttgccaccttgctgggcgtggcggcggtgcgggtgttcctggtcgggccgctgcaggactaccagttgtacggcatcgacttcgtatttggcgccgtgatcatcctggccgggaccttttccctgctcaaggccatgcgcatcaacgccttgcgcgaggcggcggcaaggcgcggaacgacttggtaacggacgggctggggcgaggtgcggccttgacgccgcacccgcatctgttcgattcgccaagaattctctggccggctttggcaattgatccgcttttgctgtgctgatatgcccgctattggctatacctacacttcctcaaaccagtagcgcttccggatttctgacaggagttaccccatgaagctcgcatcaatgatgagcacgctgtgcctggcctccctagggttggtgggctgttccagcaacgtcacccaacccgacgagtactccggttttctcggcgactacagccagctcaaggaagccaagtcgccgtccggcgtcgaggtgatgcgctgggtcgatcccaagctggacctgaagcagtaccgcagcgtctatatcgagcccacccagttctaccccaagccgcagccgacggtgaagatcccgcagaacaccttgtacgggatcaaccgctattacgacgaagcgctcaaacgcgagatcggccaggacttgcccctggccaccgcgccggggccgggggtgagttgtggtgcgcgcggcgatcacggccgtgagcagcaagaccgaaggcctgaaaccctacgaaatcattcccatcgccctggtggcggcggcggtgagcacggccagcggcatccgcgaccaggagaccaccctgggcaccgaggcgcagttcatcgacggcggcaacaacaaggtgatcgcccaggtggtgcgcaagggcagtggcaagccgctgcagaatgacacccaggtcatgcagccttcggacgtgaaaaacgtcatcgacggctgggcctccgacctgcatcagtccttccagaaactgaaaaaacagtagggccggggtttctccccgagctttttgcccgctgcgtcggggtcagggcgaatacctggccccttcactgagcacttccggcagtcaatcaagaacacaggtttcgctggcgaggcgagggcgcaaggcctgctgtccgtgacaggttttcacgtccgcggcagggcagcgtgctccaggggcgagtggtagcggagcttcaggtggtgccttttggctcacgtggattatgattatttccactcttttagagtggttaacttaaagtaatttattaagttaaataaattcaataaaaacagatagatacagaatatttatgatgtattgagtgagattgtgttgaggctttcaagaggtttttccagcatgcctgtgctcgaacgcatgactttcattgccggtcgcagcccggctcaggtgctggatttctgtcttgaaggcgccaacttcccgaagatctttcccgagcgcaccagtcccttgcggggcatggatatcaatgacctgcggatcagcgccgggtgccagttcagctttcgccactggatgtggggtgtcataccggcgacatggacggtggttatatgtaaataccgaccgggtgacctatcgggcgctgggcggcgcacctgtggaatggctgctggtcaatgcctgcatggcgcgcattttcgggttccggcatcgcactctgttgcgcttgctaggttgaagcaggcctttgtagccgctgccgcaggctgcgatcgaccgcaacgcgggcgtgggatatcgatatcgccgaaggcctgcggccttatcgcagcctgcggcagcggctacagtgttttcgcgttccgccggtatttcgatggcctccagagttgcgctccgctctcggggcttgttctacaatttgtatcccgggcataggtggccgggccatttcatgtttaacttccggcctctcgattttctttacagctgttcaatgaccatcgtttaaaaggactccgttcatggctcaagtcacccttaaaggcaacccggttcaagtcaacggccaactgccacaaaccggcgccaaggcgcccgcgttctccctggtgggcgccggcctggccgacatcaccctgagcagctttgccggcaagcgcaaagtgctgaacatcttcccgagcgtcgacaccccgacctgcgccacttccgtgcgcaagttcaacgcccaggccagcggcctgaacaacaccgtggtgctgtgcatctcggctgacctgccgttcgcccaggcccgtttctgcggcgccgaaggcctggacaacgtgcagaacctgtcgaccctgcgtggccgcgagttcatcgagaactacggcgtggccattgccgacggcccactggccggcctgaccgcccgcgcggtggtggtgctggacgagaacgacaccgtgctgcacagcgagctggtcaaggaaatcgctgaagaaccgaactacgacgcggccttggccgttctgaagtaacaggttttacaattattcacggcctggccctgcccaggccgtttttatttgtgcttcagtggcttagcagacacttgcaaacgtaagcccaaggtaaattgccggtaaaggcgctttgctaaacaccggccagtgcttatctttcagccttctgaaaaagatcccctcgcgcccaatggttgatcactccatgcaatcctccgtttcccgcaactcccgtcgctggctgctcggcctgcttgtcctgttggccatcgtcggcctgtgctggaagttctggccggcctcgaccaccccaaaggatgccgccgggcaaaaggccgcggccggacactccggtcgcagcgggtctatgcggccggggtttggtggcgcgagcgggccgatcccggtgcgggtggcgccggccacgcgcggggatttcgcgctgtattacaaggcgctgggcaccgtcaccgcgctgaacaccatcaatgtgcgcagccgggtggccggtgagctggtcaaggtggccttcgaggaagggcagatggtcaaggccggcgacctgctggcggaaatcgacccgcggccttaccagaacgccttgctccaggccgaaggcacgctgttgcagaaccaggcgcaactgaagaacgcccaggtcgactacgagcgttatcgcggcctgtatgcccaggacagtatcgccaagcagaccctggacaccgccgcggcgctggtcggccagtaccagggcacggtcaagaccaaccaggcggcggtcaacgacgccaagctcaacctcgaattcaccaagatccgcgcgccgatcaccggccgcgtcggcctgcgccagctggacgtcggcaacctggtggcggccaacgacaccaccgcgctggcgatcatcacccagacccagccgatcagcgtggccttcaccctgccggagaacaacctgagcagggtgctggagcgttatcgcagcggcgccaggctgccggtggaagcctgggaccgcggcgaccagacgctgcaggccagcggcgtgctgcaaagcctcgacaaccagatcgacaccaccaccggcaccctgaagttcaaggcgcgctacgacaaccgcgaccaggcgctgttccccaaccagttcgtcaacgtgcgcgtgcttgccgacaccctgaaaaacgtggtgctggcgccgtcggcggcgatccagttcggcaccaacggcaccttcgtctatgccctggacggcgccaacaaggtcaagatccgccagttgcaggtcggcgacagcaacggtgattccaccgtgatcaaggccggcctggaagccggcgaccgcgtggtgctggaaggcaccgaccgcctcaaggacggcagcgaagtggaagtggtcaacacccccgaagaagtgccggccactccgacccagcacctgcagggccagccggccagctcggcgaccacgccggccaccgagacgccggcgggcaaggtcggcgcatgaatatctcgcggctgttcatcctccgcccggtagccaccaccctgagcatgctggccattgtcctggccggcctgatcgcctatcgcctgttgccggtctcggcgttgccccaggtcgattacccgactatccgggtgatgaccctgtaccccggcgccagccccgacgtgatgaccagcgcggtcaccgcgcccctggagcgccagttcgggcagatgcccggcctgacccagatggcctccaccagctccggcggcgcctcggtgctgaccctgcgcttcaacctcgacatcaatatggatgtcgccgagcagcaggtgcaggcggcgatcaatgccgcgaccaacctgctgcccagcgatctgccggcgccgccggtgtacaacaaggtcaacccggcggacaccccggtgctgaccctggccatcacctccaagaccatgctgctgcccaagctcaacgacctggtcgacacccgcatggcgcagaagatcgcgcagatcagcggcgtcggcatggtcagcatcgccggcggccagcgccaggcggtgcggatcaaggtcaaccccgaggccctggcggctaacggcctcaacctgtcggacgtgcgcaccctgatcggcgcctccaacgtcaaccagcccaagggcaacttcgacggcccgacccgggtgtcgatgctcgacgccaacgaccagctgacctcgcccaaggattacgccgagctgatcctggcctacaagaatggcgcgccgctgcgcctgaaagacgtcgcgcagatcgccggcggcgccgagaacgaacgcctggcggcctgggccaatgaaaaccaggcggtgctgctgaatatccagcgccagcccggggccaacgtgatcgaggtggtggaccggatcaaggcgctgctgccgagcatcaccgacaacctgccggccggccttgacgtcaccgtgctcaccgaccgcacccagaccattcgcgcctcggtcaccgacgtgcagcacgaattactgatcgccatcgccctggtggtgatggtgaccttcctgttcctgcgccgggccagcgccacggtgatcccgtcgatcgccgtgccgctgtcgctgatcggcaccttcggcgtgatgtacctggcgggcttctcggtcaacaacctgaccctgatggccctgaccatcgccaccggcttcgtggtcgacgatgcgatcgtgatgctggagaacatctcgcgcttcatcgaggagggcgacagcccgatgcaggccgcgctcaagggcgccaggcagatcggcttcaccctggtgtcgctgaccctgtcgctgatcgccgtattgatcccgctgctgttcatggccgacgtggtcgggcggctgttccgcgaattcgccatcactttggcggtggcgatcctgatttccctggtggtgtccctgaccctgacgccgatgatgtgcgcgcgcctgctcaagcgtgagcccaaggcagaagagcaggggcggttctaccgtgccagcggcgcctggatcgactggctgatcgccagctacggtcggtggctgcaatgggtgctcaaacatcagccgctgaccctgctggtggccgtcggcaccctggcgctgaccgtgttcctttatatggtggtgcccaagggcttcttcccggtgcaggacaccggggtgatccagggcatttccgaagcgccgcagtcggtgtccttcgccgccatgagccagcgtcagcaggacctggcgaaaatcatcctggccgacccggcggtgcaaagcctgtcgtcctatatcggggtcgacggcgacaacgccaccctcaacagcggccggctgttgatcaacctcaagccgcaccgcgaacgcgacctcagcgccgccgaggtgatcgcgcgcatccagccccaggtcgaccagttggtgggcatccgcctgttcatgcagccggtgcaggacctgaccatcgaggaccgggtcagccgcacccagtaccagttcagtatgtcgtcgccggatgccgacctgctggccctgtggagcgggcgcctggtggatgccttggctcaccggccagaactcactgacgtcgccagcgacctgcaggacaagggcttgcaggtgtacctggtgatcgaccgcgacgccgcgtcgcgcatcggcgtctcggtgtcgaacatcaccgacgcgctgtacgacgccttcggccagcggcagatttccaccatctacacccaggccagccagtaccgcgtggtgttgcaggcccaggccggggaaaccatcggcccgcaggcgctggaacagatccatgtgaaaaccaccgacggcggccaggtgcgcctgtcgagcctggcccgggtcgaggagcgccaggcgcaactggccatcgcccatatcggccagttcccggcggtgatgatgtcgttcaacctggcgcccggcgtggccctggggcaggcggtgaacatcatcgaacaggtgcagcaggacatcggcatgccggtgggcgtgcagacccagttccagggcgcggcccaggcgttccaggcctcgctgtcgagcaccttgctgctgatcctggcggcggtggtgaccatgtacatcgtgctcggggtgctctacgagagctacatccacccgatcaccatcctctccacgctgccgtcggcggcggtgggcgccttgctggcgctgatcctcagcggcaacgacctggggatgatcgcgatcatcggcatcatcctgctgatcggtatcgtcaagaagaacgcgatcatgatgatcgacttcgccctcgacgccgaacgcaaccagggcatggccccggagcaggcgatctaccaggcggcgctcctgcgtttccggccgatcctgatgaccaccctggccgcgctgttcggcgccgtgccgctgatgctcgctaccggttccggcgccgagctgcgccagcccctgggcctggtgatggtcggcggcctgttgctgagccagatcctcacgctgttcaccacgccggtgatctacctgtacttcgaccgcctgggccggcgctggcgttcggcgcctgagcccgcggagccggtagagcagccatgaacctgtccggaccctttatccgccggccggtggccaccatgctgctgagcctggcgatcatgctcctgggcggtgtcagcttcggcctgctgccagtgtcgccgttgccgcagatggacttcccggtgatcgtggtccaggccagcctgccgggggccagccccgaggtgatggcatccaccgtggccacgcccctggagcgttccttcggcgcgatcgccggggtcaacaccatgagcagccgttccagccagggttcgacccgggtcatcctgcaattcgacctggaccgcgacatcaacggcgcggcgcgggaagtgcaggcggcgatcaatgcctcgcgcaacctgctgcccagcggcatgcgcagcatgcccacctacaagaaggtcaacccgtcccaggcgccgatcatggtgctgtcgctgacctccgacgtgctggagaagggccagctctacgacctggcctcgaccatcctgtcccagagcctgtcccaggtgtccggggtcggcgaggtgcagatcggcggcagttcgctgccggcggtgcgcatcgagctcgagccgcagttgctcaaccagtacggcgtggccctcgacgacgtgcgcaagaccatcgccgaggccaacgtgcgccggcccaagggctcggtggagaacagcgagcagatgtggcaggtacaggccaacgaccaactggagaaggccaaggactacgagccgctgatcatccactacaaggacggcgcggccctgcgcctgaaagacgtggccaaggtcagcgatggcgtcgaggaccgctacaacagcggcttcttcaacgacgacgcggcggtgctgctggtgatcaaccgccaggccggggccaacatcatcgagacggtcaacgagatcaaggcgcaactgccggcgttgcaggcagtgctgccggccagcgtcaagctcaacctggcgatggaccgttcgccggtgatcaaggccaccctgcacgaggccgagatgaccctgctgatcgccgtggccttggtgatcctggtggtctacctgttcctcggcaatctgcgcgcctcgctgatcccgacactggcggtgccggtgtcgctggtgggcaccttcgcggtgatgtacctgtacggtttttccctgaacaacctgtcgctgatggcgctgattctcgccaccgggctggtggtggacgacgccatcgtggtgctggagaacatttcccggcacatcgacgaaggcatcgcaccgatgaaagccgcctacctgggagccaaggaagtcggcttcaccctgttgtcgatgaacgtctcgctggtggcggtgttcctgtcgatcctgttcatgggcgggatcatcgaaagcctgttccgcgagttttccatcaccctggcggcggccatagtcgtgtccctggtggtgtccctgaccctgaccccgatgctctgcgcccgctggctcaagccccatgtgccgggccgggagaacggcctgcagcgctggagccagcacgccaacgactggatggtggccagatacgccagcagcctggactgggtgctgcgccacaagcgcctgaccctgctcagcctgttcgtgaccatcggcgtcaatatcgcgctgtacgtggtggtgcccaagaccttcatgccgcagcaggacaccggccagttgatcggtttcgtgcgtggcgacgacggcctgtcgttcaccgtgatgcagccgaagatggagatcttccgccgcgaagtgctcaaggacccggcggtggagagcgtggccggtttcatcggtggcaataacggcaccaacaacgccttcatgctggtgcgcctcaagccgatcaaggaacgcaacatttccgcgcagaaggtcatcgagcgcctgcgcaaggaaatgcccaaggtgcccggcgcccagctgatgctgatggccgaccaggacctgcagttcggcggcggccgcgagcagaccacctcgcagtattcctacatcatccagagcggcgacctggggtcgttgcgcgagtggtacccgaaagtggtcaccgcgctgcgtgccttgccggagctgaccgcgatcgacgcccgcgaagggcggggcgcccagcaggtgaccctggtggtcgaccgcgaccaggccaagcgcctggggatcgacatgaacatggtcaccgcggtgctcaacaacgcctacagccagcggcagatttccaccatctacgacagcctcaaccagtatcaggtggtgatggaggtcaacccgaaatacgcccaggacccggtcaccctcaaccaggtgcaggtgatcaccgccgatggcgcgcgggtgccgctgtcgaccatcgctcactacgaaaacagcctggaagacgaccgggtcagccacgaaggccagttcgcctcggaaagcatttccttcgacatggccgaaggggtgacggtggagcagggcacggcggccatcgaacgggcgatcgccaaggtcggcatgcccgaagacgtgatcgtcaagatggccggcaccgccgatgctttcgccgcgacccagaagagccagccgttcatgatcctcggcgcgctactggcggtgtacctggtgctgggcgtgctctatgaaagctacattcacccgctgaccattctctccacgctgccgtcggctggggtcggcgccttgctgtcgatctatgtgctgggcggcgagttcagcctgatctcgctgctgggcttgttcctgctgatcggcgtggtgaagaaaaacgccatcctgatgatcgacctggcgttgcagctggagcgtcaccagggcctgggcccgctggagtcgatccgcagcgcctgcctgctgcgcctgcggccgatcctgatgaccaccctggcggcgatcctcggcgccttgccgttgctgctcggcagcgccgaaggcgcggaaatgcgccagcccttgggcctgaccattatcggcggcctggtcttcagccaggtcctgaccctctacaccaccccggtggtctacctctatctcgatcgcctgcgccataaattcaaccactggcgtggggtccgtaccgatgccgctctggaaacgccgctatgactgactgctcgccccgcaaccttcctcagcgcctggccctggcccgcggttcgcggctgttgagcctgagcttgagcctggcgctgctcagtgcctgcgccattggcccggactaccagcgcccgcaagtcgccgagcctgcgcaatacaaggaagcagcaggctggcgccaggccagccccagcgattccctggcccgcggcgcctggtgggagctgtacggcgaccgccagctcaacggcctgatcgacaagctcaacagcgccaaccagagcgtggcgcagtccgaggcccagtaccgccaggcccaagccctggtgcgcagcgcccgtggctcgctgttccccacggtcgacctgagcgccgggaaaacccgcgccagccagggcaccggcagcagcagctcggccctgagcagttcctccagcggcattcgcgacacttacaacacccagctcggggtgagctgggaggccgatgtctggggcaaactgcgccgcggcctggaagccaacgaagccagcgccgaggccagcttcgccgacctcgcggcgatgcgcctgagccagcagtcggagctggtgcagaactacctgcaactgcgggtcatggaccagcagaagcgcctgctcgaagccacggtggcggcctaccagcgctcgctgaccatgaccgagaaccagtaccgcgccggcgtctccggcaagggcgcggtggcccaggcgcaaacccagctgaaaaccacccaggccgacctgatcgacctgatctggcagcgcgcccagctggaaaacgccatcgcggtgctgatcggcctgccgccggccgagttcagcctggccgagacccaggacatcccggccttgccccaggtgccgctgagcctgccgtcgcagctgctggaacggcgcccggacatcgcctcggccgagcgttcggtgatcgccgccaacgccaatatcggcgtggccaaggccgcctattacccggacctgaccctgagcctggcgggcggctacagcagcagtacctacgccgactggatcagcctgccgaaccgcttctggtcggtggggccgaaactggccatgaccctgttcgacggcggccagcgttcggcggaagtcgaccgcaccgaggcggcctacgaccagaccgtggccaagtaccgccagaccgtgctcgacggctttcgcgaggtggagaactacctggtgcagctcaaggtcctggaagacgaagccgcggtgcgccagcaggccctggattcggcgcgcgagtcgttgcgcctgaccgagaaccagtacaaggccggggtgatcgcctacctggacgtggtggtggtgcaggccacggcgttgagcaacgaacgcagcgtgctgagcctgctgcaaagccggctggtcaccagcgtgcaactgatcgccgccctcggcggcggctgggacggccagctgcaggccagcaaggagtaacagacagaatccgcgatccgcctgttttaccagcgctacgcgctcgatcgcaggctacgccagcggctacagacagcgtgtagccgctgccgagcctgcgaggctgcgaacggttcgcgcagcgaccgcaaaccctgaatccgcgctccatctggtttcacacgttgtccgtcctacgaccgctgcgcgctcgatcgcaggctgcgccagcggctacatcgatagcggcgtccctggcgttgtgtcactgttgccagcggtcgagtcgctgtaaccggtttgttttatcaaccggctactttcgtccgactgatggctttttgcttactttgtgagtgtgtttctgtacgcaagcagtacaattgcgcctttttaccgccgggcatggacgcttccggctaacgccacgagacgttcatgctcaccggtacctactctcccgccctggttctgatttccctgtttgtggcgattctcgcctcttacaccgcactcgacctgaccggtcgcatcgccaccacgcgtggtcgagcggcacttttgtggatggccggcggcgccctggccatgggcatcggggtgtggtcgatgcactttatcggcatgctcgccttcagcctgcccatcgacctgggctacgacactggcatcaccgcgctgtcgctgctgatttccgtgctgtccttcggtttcgccctgtggctggtgagccagcagagcctgccgctctggcagctggccttcggcgcgctggtcatgggcgccgggatcagcgccatgcattacaccggcatggcggcgatgcgcatgcagccgggcatcgactacgacccgagcctgttcggcgcctcgctgctgattgccgtcggcgcctcggccgcggcgctgtggatcgccttccgcctgcgccgcaataccccttatgtacgtttggcccgctgtggggccgcggtggtgatgggcatcgccattgtcggcatgcactacaccggcatggccgcggcgcggttcgccgacggcagtttctgtggcgcggcggtggacggcctgagcggcaagggcctggacaacctggtgctgatcaccaccctggcggtgctgatcattgccttgctgacctcggtactcgacgcgcgcctggaagcgcgcaccgcggtgctggccgagtcgctgaccgtggccaaccgcgagctgacccaactggcgctgcacgacaccctgaccggcctgccgaaccgcacgctgctggcggaccggatcgaccaggcgatgcagcgggtgacggagcagggtggctgcttcgcgctgatgttcatcgacctggacggcttcaagccggtcaacgacgccttcggccatcacatgggcgaccagttgctgcgcgaggtggcggtgcgcctgcgcgaagacctgcgcagccaggacaccctggcgcggatcggcggcgacgagttcgtgctgctggtgcaactgaacgaggcggacgatgccttgcgcctggccgcgcgccaggtgggcctgatcggccaggcgttccgggttgccgagcacgagctgcagatctccgccagcgtcggcatcgcggtgtacccgggcaacggcctgacgccccaggaactgctgatgaacgccgatgcggcgatgtatcacgccaagggcaccggcaagaacggctacagcttcttcgacgcctcgatgaacagcgacgcgcgccggcaactgcaactgctgcaggacctgcgccatgccgtcgagcacggcgagttcaggctctattaccagcccaagttcgatgccgccaacggcttgccggtaggcgccgaagccttgttgcgctgggagcacccgcaactggggctgctgctgccggacaagttcattgaccttgcggaaaagaccgggctgatcatccccatcggcgagtgggtgctcaacgaggcctgccggcagatgcgcgagtggtacagcgaaggttatgaaggctggcggatcgcggtgaacatctcggcgctgcagttctgccatgccgggctggtcgacagcgtggccagggcgctgagcctgcaccgcttgccggccaacagcctgaccctggagatcaccgaaaccacggccatgagcgatgccgacgccagcatgaccgtgctcaagcaactggcggagatgggcgtggacctgtccatcgacgacttcggtaccggttattcgagcctgatgtacctcaagcgcctgccggccaacgaattgaagatcgaccgcggcttcgtccgcgacctggagcacgacagcgacgacgcggcgatcgtctcggccatcgtcgccctgggccaggccctgggcttacggatcgtcgccgagggcgtggaaaccgacgtgcagcagaacttcctgacccagttgggctgcgattcgctgcaaggttatttcctcggccatccgttgccggccgcacggttcatgcagaacatccatcaggccgaacagctggctctctgagcgcctcgaaaagcctgcctgcttcgccggttcgcagcctgctgcagcggctacagagacttctgtaggagcggccggtcgacgctcgattgaccagacagcgtcgagccataaggatttgctggcgtgagaacgccacggccgtaccggccgatcgcagcctgcggcagcggctacatcgatcgcgttgcggccgactcccgtagccgctgccgagcctgcgaggctgcgaacggtttgggcggcactccgacgcagcgagcgcaaaccccaagcccgcgatctgcctggatagacacgccgaccggcgaccagccacggggcggagaaggtttgcaacgctcgccccagggtgtttaattggcggcgttcaaagatcagcgagggagttggcagcatggacaaagtcatcctcatcaccggtggcggtcgcggtattggcgcggccaccgcgctgctggccgcgcaacagggctatcgcatctgcatcaactaccaggccgacgaacaggcggccttccaggtactggagcaggtgcgcggcctgggcgcccaggcgattgccgtgcgggccgatgtcagcatcgaggacgaagtgatcgccctctaccagcgggtcgatgccgagctggggcgggtcaccgcgctggtgaacaacgccgggactgtcgggcagaagtcgcggctcgacgaaatgtccgaattccgcattctcaagaccatcaagaccaacgtgctcgggccgatcctctgcgccaagcacgcggtgctgcgcatgtcgccaagacatggcgggcagggcggcagcatcgtcaatgtgtcctcggtcgccgcccgcctgggcgcgcccggcgagtacatcgactacgccgcctccaagggggcgctggacaccttcaccatcggcctgtccaaggaagtcgccggcgaaggcatccgcgtcaacggcgtgcgcccgggctatatctacaccgacttccacgccctgagcggcgacgccgaccgcgtcagcaagctggaatccgccatccccatgggtcgcggcggccgtccggacgaagtggcggaggcgatcatctggctgctgtcggacaaggcctcctattccaccgggacctttatcgacctgggcggcggccgctgagagcctcacgcgtgtagccgctgccgagcccgcgaggctgcgatcgactgcgcagcagtcgcaaggccggacagcacgtctatccaggcagatcgcaagttcaggagttgcggtcgctacgtcggagtgccgcccaaaccgatcgcaggctcggcagcggctccagggggcgcgatcggtgttgccgctgccgcaggctgcaatcggcccggaacgggacgtgctcttgaggccgtcaaaggtcctgcggaccttgtcgcagcctcgcgggcccggcagcggctacagggggcgcgatcggtgtagccgctgccgcaggctgcgatcggcccggaacgggacgtgctcttgaggccgtcgaaggtcctgcggaccttgtcgcagcctcgcgggcccggcagcggctacaggttccacatttacgtggagcgctggcccggcttcagaacgaccgcacgatccgtcccagggtttccatggcctgttccgccgcttcgttccacgggctgccgtagttgaggcggatgcagtttcgaaagcgctgggtcggcgagaagatcggtcccggggcgatgctgatgccctgggccagggccatctggaacagcttcaacgaatccatctgcgccggcagttccagccacaggaagtagccgccggccggctggctgacccgggtctgtgccgggaagtagcgggcgatggcggcgagcatggcgctctgctgttcttccagggcgtagcgcagtttgcgcaggtggcggtcgtagccgccgtgttgcaggtagtcggcgatggccgcttgggccggcatcgaggcgcacagcgaggtcatcagtttcagccgttcgatcttctgcgcgtaacgcccggcggcgacccagccgatgcgatagcccggtgccaggctcttggcgaacgagccgcaatgcatcaccaggccctcggtgtcgaaggccttggccggtttcggcgcctgctggccgtaatacagctcggcgtagacgtcgtcctcgatcagcggcacctgatggctgcgcagcaacgccaccagttcctgcttcttcgcctcgggcatggtcgcgcccatggggttctggaagctggtcatgcaccagcaggccttgatcgggtgccgctccagggtctgcgccagcactcccaggtcgatgccgtcccgcgggtgtacggggatttccaccgccttgagtttcaggcgctccagcacttgcaggctggcgtagaaggccggcgcctcgatggccaccaggtcgccgggttcggtcaccgcctgcaggcacaggttcagggcttccagggcaccgttggtgatcagcagttcttccatgggcagcatcagcccgccgaccatgtagcgcagggcgatctgccggcgcagctgcgggttgcccggcgacatgtcggtgaccaccacccgtgggtccatctcgcggctggcgctggccagggaacgcgacaggcgctgcagcgggaacagggtcgggctgggaaaggccgagccgaacggcacggtggtcgggtccttgatcgagtccagcaccgagaacaccagttcgctgacatcgacctcggtggactcgttgacctggctgctgatcaccggttccgagaacgggctcggcgcatgggtgttgacgaagtagccggagcgcggccgggcgcggatcaggccgcgccgctccagcaggtaataggcctggaacaccgtggacgggctgaccccataggtctggctggcgtaacgtaccgaaggtacgcgctggccggggccgagcaccccggagcggatcagttctgcgatgtcgtcggcgaatttttcgtagcgtttcatggggcggctcgggttggaggctgcggtggctgagcgatttatcgcgagcaagctcgctcctaaaaggaccaatgcgcacctgtaggagcgagcttgctcgcgatagccgcaaagcggcgcccagtctaagggatcaacggttcaagggcgcaacaaaccggctcttggccacgctgtagatctgcggctggtcggcgtcgaccaccttgaaactcagctcttgggaactgctctgcggctggtcggcgatcatcgccaccgacaccggcaggtcgacgatctcgcccgcggccaggctgacttcggtcttgccttgcagctggaagccgtcgccgtccaccagttgcaggcggtaatcctggcgttgctgggtcttgttgatgatcttcaggctgtagatgttctcgatctggcccaggctgttttcgcggaacaggccacggtccttgctgacgtccagcgacaccatcggccgctccaccagcgccagggccagggcgccgatcatcaccagcagcaccgcgctgtagccgatcaggcgtgggcgcagcaggtgggtcttgccaccctgcaactggtgctccgaggtgtagctgatcaggccccgggcataacccatcttgtccatgatcgaatcgcaggcgtcgatgcaggcggcgcagccgatgcattccatctgcaggccgtcgcggatgtcgatgccggtcgggcagacctgcacgcacagctggcaatcgatgcagtcgccgaggccgatattggcgggtttcacgccacgcttgcgcgggccgcggatttcgccgcgggccgggtcgtaggagatggtcagggtgtccttgtcgaacatcacgctctggaaccgcgcatacgggcacatgtgcatgcacaccgcctcgcgcagccagccggcgttgaggtaggtggcgccggtgaagaacagcacccagaacaggctgacgccgccgatttgcagggtcagcagttcctcggccagcggccggatcggcgtgaagtaaccgacgaaggtcaggccggtgagcaggctgatggccagccacaggctgtgcttggccgaacggcggatcagtttgttcaggttccagggcgcggccgcgagcttgatgcgctggttgcgttcaccctcggtgatcttctcgcaccacatgaacagccaggtccaggagctctgcgggcaggtgtagccgcaccagacgcggccggcgaacacggtgatggcgaacaggccgaaggcgcagatgatcagcaacgccgagagcaggatgaaatcctgtggccagaaggtggcgccgaagatgtggaacttactctccgcgaggtcccagagcaccgcctggcggccgccccagttcaaccacacggtgccgaagaacagcaggaacaggaagcccgcgccgctcatgcgcagggtgcggaacaggccggtgaaactgcgggtgtggatcaggttgtcgctggatttggccttcgtctttgggcgcgcaggctcgaatgtttctactaatcggacggggattctttcgctcatggtcgttcgctcatcagcctccatcaggcagacgaactatgcccagcgatctgtttgcataacagactcaggtatcgcaataaaaagcagatcagatgcccgtcaggcgccgccctgcgacaacttgccatacccggccaagcgcccgctatcgggcgccgtcggcgtctggcacaggcctgcgccgggtgccgtgatgcagatcagtcaaatcaccgaatcactgtcgctggcgcgcagatgacgccggccgtcggtggcgcctgctacggtcaatgcgtcggcttctgcttcggtgatgtagatgcgccggccttcgaggtcgaccgccgacatcgacttggccgcgtcggtgatcacggtcacggcgctggctggcaggcgggcgtgaaggtcttcggtgtcgaaatggcagatccggttttcgatgcgcaggctcatggtcgaatcctgttgtgcggtgggtacggtttttagggcccggctgccgtccggggttctgcccgaccgatcaatggtcgcccgctggcggatcgcaccttttgcccggcgtcgctgtcctttgattaaggagggctgcctcgtcgcctgcccgccagccaataagaacctgagaacccgaacggaaaggacctgcgcatgaacgcctggtggcatgaagtctgggacaccctgcaagcggagttcgccgacatcggcgatgcccggcaactcacccagatcaccgtacgccttctgatcgccgcgctgctgggcggcattctcggtttcgagcgcgagcacaagggcaaggccgccggggtgcgcacccatatgctggtggcgctgggggcggcgctgttcgtgctggtgccgcagatgtccggcgcccaggccgatgccatgagccgggtggtgcagggggtgatcgccggtatcggttttctcggcgcgggcaccattctcaagggcaagcaggacgaggaagggcacgtcaagggcctgaccaccgcggccgggctgtggatgaccgcggcgatcggcgtctcggcgggcgtcggccgcgaagccacggcggtgttcagcaccctactggccctggtgatcttcagcgtgatgccctggatagtgcgcaagctggaaggcgacgatgaaccgcccggatgaacgccctaaaggcgtcgcgggcacactcgccgccagcaatgaagggatgcccgctgccggttggcgacggcagcgacgggcaaccgattgtctacgcttgtcatggtttgggcgtaatgctgtgactggaagcgatgaccggtgccggatcgatcggcggctcctccttgggcggtggggtcgtttcgggtggatcttcctcgggcaccggttgcggctcggttggcggcaacgtcgggtggtcgatgttcggatcgggcgtttccgcggggatcgggatactcatcggcatggcctcctttgtgcttggttttgcacagtctcccaaggtggaccctcgccccggcgatttgattccccgtgcgaagggaggcaaatccgggtgaactttcccggccctggtgtctcggaacctaagtgcttcgctgatccgcgcgggtggttgccgaccctgggggccgctcccaagagagggcccgcgccggaatagaccagcaacagagcgtccatggggcgtaaggagtgatgctcgatgactgccgaaaaaagaccgactgaactgcaatacaacccgaacctgcccctgtcgcaggccttgctgctgccacgcatcgtcatcgagaacacccggccgctgatcgacggtggccagttcgcggtcaaggcggtggaggggcaggtagtgcgggtcagcagcaaggtgttcgccgacggccacgacaagctggccgtgcgcatccgctggtgcgccgaagccgacagccactggcacagcgaaaccatggaagacctcggcaacaatagctgggaaggccagttcacagtgcccagccagggccgctacctgtattgcatcgaggcctggatcgatcagttcgccagcttctgctacgaactgcagaaaaaacaccaggccggcgtcgcggtcagcctcgaattgcaggagggccgcagccatgtgctgcacgccgccgagcgcagcgaagggccgctgcgcgagcagttgctggcgctgcaccatgagctggcgacgctgctcgaagccgagcaggtggcgctgttcctgcacgaacgcagtgcacggctgatgaccgaggccgaccaccgtccctacctgagcctgagcccggaatacccgctggacgtggaacgcgagcgcgcgcagttcgccagctggtacgagctgtttccccgctcgatcaccgatgatccggcccgtcacggcactttcaatgatgtgcactcgcgcctggcgatgatccatgacatgggtttcgacgtgctgtacttcccgccgatccatcccatcggccgcagctttcgcaagggccgtaataactcgctgactgccggccccgacgagccgggcagcccctatgcgatcggcagcgaagagggcggccacgaggcgatccatccgcagctcggcagccgcgaggatttccgccgcctggtggccgccgccgccgagcacggcctggaggtcgccctggatttcgccatccagtgttcccaggaccatccctggctcaagcagcatccaggctggttcaactggcgcccggacggcagcatcaaatacgccgagaacccgccgaagaaataccaggacatcgtcaacgtcgacttctatgccatcgaggccatccccagcctgtggctggagctgcgcgacatcgtggtcggctgggtcgaggagggggtgaagatctttcgcgtggacaacccccataccaagccgctgccgttctggcagtggctgatcgccgatgtgcgggcgcgctacccggaggtgatctttctcgccgaggccttcaccacgccggcgatgatggcgcgcctgggcaaggtcggttattcccagagctacacctatttcacctggcgcaacaccaagagcgaactggcgacttatttcaccgaactcaaccaatcgccgtggcgcgaatgctaccggccgaacttcttcgtcaacacgccggacatcaacccgttctttctccatgactcggggcgcccggggtttctcatccgcgccgcgctggccaccatgggctcgggcctgtggggcatgtattcggggttcgagctgtgcgaggcggcgccggttccggggcgcgaggaatacctggactcggagaaatacgagatccgcccccgggacttcaacgcccccggcaacatcattgccgagatcgcccagctcaaccgcatccgtcggcagaacccggcgctgcagacgcacctgggcttgcaggtctacaacgcctggaacgacaacatcctgtatttcggcaagcgtaccgccgacctcgacaacttcatcctggtggcggtcagcctcgacccgttcaacgctcaggaagcgcatttcgaattgccgctgtgggagctgggcctgcccgacgatgcgcagacccagggcgaggacctgatgaacggccatcgctggacctggtacggcaagacccagttcatgcggatcgaaccctggcagcaaccgttcggcatctggcgcatcagcgttgcctgattcataccggtagccgctgccgcaggctgcgatcggcccggaacggggcgcgctcttggggccgtcgaaggtcctgcggaccttgtcgcagcctcgcggagctcggcagcggctacaggcgcgatcgatgtagccgctgccgcaggctgcgatcggcccggaacggggtgcgctcttggggccgtcgaaggtcctgcggaccttgtcgcagcctcgcgggctcggcagcggctacaggcgcgatcggtgtagccgctgccgcaggctgcgatcggcccggaacgggacgcgctcttggggcccttgaaggtcctgcggaccttatcgcagcctcgcgggctcggcagcggctacaggcgcgatcggtgtagccgctgccgcaggctgcgatcggctcggaacggggtgcgctcttggggccgtcgaaggtcctgcggaccttatcgcagcctcgcgggctcggcagcggctacaggcgcgatcgatgtagccgctgccgcaggctgcgatcggcccggaacgggacgcgctcttgaggccgtcgaaggtcctgcgggcattgcgcagcctcgcggagctcggcagcggctacagggcagttacacagccacggaccaatgaatttttcaggagttacccatggcgaagaaaaccaggtcagccaccttcatcaaggacccgctctggtacaaggacgcggtgatctatcaggttcacgtcaaatcctatttcgactccaacaacgacgggatcggcgattttcccgggttgatcgccaagctcgactacatcgccgacctgggggtgaacaccatctggctgctgccgttctatccctcgccgcgccgcgacgacggttacgacatcgccgaataccgcggcgtcagccccgactacgggactctggccgacgcccggcggtttatcgccgaggcccacaagcgcgggttgcgggtgatcaccgagctggtcatcaaccacacctcggaccagcacccctggttccagcgggcgcgcaaggccaaggctggctccaaggcgcgggacttttatgtgtggtccgatgacgatcagaagtacgacggcacgcggatcatctttctcgacaccgagaaatccaactggacctgggacccggtggccggccagtacttctggcaccgcttctattcccaccagccggacctcaacttcgacaacccgcaggtgatgaaggcggtcctgtcggtgatgcgctactggctggacatgggcatcgacggcctgcgcctggacgccattccctacctgatcgagcgcgacggcaccaacaacgagaacctgcccgagacccacgacgtgctcaagcagatccgcgccgagatcgacgccaactacccggaccgcatgctgctggccgaagccaaccagtggccggaagacacccaattatattttggcgatgtgaagggcgacgacggcgacgaatgccacatggccttccacttcccattgatgccgcgcatgtacatggcgctggcccaggaagaccgcttcccgatcaccgatatcctgcgccagaccccggagattcccgccaactgccaatgggcgatcttcctgcgcaaccacgatgagttgaccctggagatggtcaccgaccgcgagcgcgactacctgtggaactactacgccgccgaccgccgcgcgcggatcaacctgggcattcgccggcgcctggcaccgctgatggagcgcgaccgccgccgcgtggaactgctcaacagcctgctgctgtcgatgcccggcacgccgactctgtattacggcgacgagatcggcatgggcgacaacatctacctgggcgaccgcgatggtgtgcgcacgccgatgcaatggtcgatcgaccgcaacggcggcttctcccgggccgacccggcgagcctggtcttgccgccgatcatggacccgctgtacggctaccagtcggtgaatgtcgagacccaggccggcgacccgcattcgctgctcaactggacccgacgcatgctggcgatccgcaaacagtccaaggccttcggccgcggcagcctgaagatgctgtcgccgagcaaccgccggatcctggcctatacccgcgaatacaccgggcccgacggcaagcacgaaatcatcctctgtgtggccaacgtctcgcgcagcgcccaggcggcggagctggacctgtcggcgttcgccggcatggtgccggtggagatgctcggcgggaatgccttcccgccgatcggccagctgaatttcctcctgaccctggcgccctacggtttctactggtttgtcctggcggcggaaaaccagatgccgagctggcatgtggaaccggcccagagcctgccggacttcaccaccctggtgctgaaaaaacgccttgaggaattgctcgaagcgccgtcgcgcaccaccctggagcagagttcgctgccgacctggctgcccaagcgtcgctggttcgccggcaaggacagcgccatcgaacaggtgcacatcgcctatggcgtgcgcttcggcgatccgcagcatccggtgctgctcagcgagctggaggtcagcggcggcggccagagcgggcgctaccagctgccgttcggcctgctcggcgaagagcagatcggcgccgcgctgccgcagcaactggccctggcgcgggtgcgccgtggccgccaggtggggctgatcaccgacgcctttgccctggaaagttttgtccacaatgtcctgcaggcgatccagacgcacaccgtgctgccgtgtggcgagggcgagatccgcttcgaggccacggagcaactggccgggctcggcctgggcgcggaatccgaagtgcgctacctgtccgccgagcaatccaacagctcggtggtgatcggcggtagcctggtgctcaagctgatccgcaaggtggccagcggcgtgcacccggaactggagatgagcgcctacctgaccgccgccggcttccagcacatttcacccttgctcggttcggtgatccgccgggacgggcagggcgaggagagcctgctgatgattgcccagggttacctgagcaatcagggcgatgcctgggagtggacccagaacaacctggagcgggcgatccgcgacgaactggccgacgccatgtccgagcaggaccagcattacaacgccctgggcgagctgcgcgactttgccggcatgctcggccagcgcctgggggaaatgcaccaggtcctcgcggcgccgaccgccaacccggccttccgcgcgcggccgagtaccgacaaggacgcccaggcctgggccaggcagattggcgcgcaactggaacgggccttgcacttgctcaagcagcatcaggctgagctgacggccgaggatcgacagcgcgtggcgtcgtggaaccaacacaagaaggcgatcctggcgcatatccagggcctggcgaaacaggcggtcggcggtttgcgcatgcgcgtccacggcgacctgcacctgggccaggtgctggtgatcaagggcgacgcctacctgatcgatttcgagggtgaaccggcccggccgctggacgagcgccggggcaagcacagcccgtacaaggacgtcagcggcgtgctgcgctccttcgactatgccgcggcgctggccctcggcggccagagcctcgacgcctcggcccacgccctggcggcccggcagcgggtcaccgagcgttatctgcatgaagcccgcgagtcgtttgtccaggcgtaccggctggcggcagctagtcttgctcatgcctggcaggaaaaaaatggcgaggacgccgcgctggccttgttcagcctggagaaagcagcctacgaagtggcgtatgaagcggaaaaccgtccggcctggctcgcggtgccgctgcgggggctgcatattttgttgagtgatgtgaaacccttttccgatacaaaaagtgctggagagcagtcatgagtttctcgaacaaggaacagggtgaggtcaaacaggcaatgcccgccgcgcgggatgtcgaggcactggtgagtgccgagcaccaggacccttttgccgtgctcggcccccatggcgacggcgccggcggccaattcatccgtgccttcctgccgggcgccctgagtgtgcaggtgctggctcgcgatggcgtgacagtgctgggcagcctggagggcaccgaggtgccggggttgttcgtcgggcactttgcccaggcccagccctatctgctgcgcacgcaatgggccggtggcgagcagattggcgaagacccttacagcttcggcccgttgctgggggagatggacctgtacctgttcgccgagggcaaccaccgcgacctcagtgcctgcctcggcgcgcagctgaaaaccgtggagggcgtcgatggcgtgcgtttcgcggtctgggcgccgaatgcccggcgggtctcggtggtcggcgacttcaacgtctgggacgggcggcggcacccgatgcgcctgcgtcatccgtccggggtctgggagctgttcattccgcgcctgggcccgggcgaagcctacaaatatgaaatcctcggtgcccacggcatcctgccgctgaagtccgacccggtggcgctggccacccagctgccgccggataccgcctcgaaagtcgccagcccgctgagcatcgactggcaggacctcgactggatgcaggcccgcggcgaacgccagcgcgcggatgcgcccttgtcgatctacgaactgcatgccggctcctggcaatgcgaggtggacgatctgggcgaggtggcgcgccagtacgactggcacgagctggccgaacgcctgatcccctatgtgcagaacctggggttcacccatatcgagctgatgccgatcatggagcatcccttcggcggttcctggggctatcagccgctgtcgcagttcgcccccagcgcccgctacggcagcgccgacgacttcgcggcgttcgtcaacgcctgccacctggcgggcatcggggtgattctcgactgggtgccggcgcactttcccaccgacgcccacggcctggcgcaattcgacggcaccgcgctgtacgagtacggcaacccgctggaaggtttccatcaggactgggacaccctgatctacaacctggggcgcaccgaggtccatggtttcatgctggcgtcggcgctgcactggctcaagcatttccatgtcgacggcctgcgggtggatgccgtggcctcgatgctctatcgcgactattcgcgcaacgccggggagtgggtgcccaatcgccatggcgggcgcgagaacctcgaagccatcgattttctccgtcacctgaatgacgtggtgtccctcgaggcaccgggcgccctggtgatcgccgaggagtccacggcctggccgggcgtcagccagggtacccagcagggcggcctggggttcgcctataaatggaacatgggctggatgcacgactcgctgcattacatccagcaggacccggtgtaccgcgcccatcaccacaacgaactgagcttcggcctggtgtacgcctggtccgagcgcttcatcctgccgatctcccacgacgaagtggtgcatggcaaacgctcgctgatcgacaagatgcccggcgaccgctggcagaagttcgccaacctgcgggcctacctgagcttcatgtggacccacccgggcaagaagctgctgttcatgggctgcgagttcggccagtggcgcgaatggaatcacgatcagcaactggactggtacctgctgcaataccccgagcaccgcggcgtgcagaagctggtgggcgatctcaaccggctgtaccgcgagcatccggcgctgcacgaccaggacgacgcaccccagggcttccagtggctgatcggcgacgacgcgatcaacagcgtctacgcctggctgcgctggagcaaggacggcaagccgctgctggtggtggccaactttaccccggtgccgcgccaggcctaccggatcggcgtgcccttcgtcgggcgctggggcgagttgttcaacagcgactccgatacctacgccgggtccaactatggcaatggcggcggggtgttcaccgaggacgtggcgagccacggccaggcgttgtcgctggcgttgaacctgccgccgctggcggtgctgatcctgcaacccgaagcgtgatatcgactggccgctgcgcgcagcggatcgcgagcaagctcgctcctacagaggttgcgcgttccctgtaggagcgagcttgctcgcgatgacatccgcccagacaccctcaagttgtccctgaaaacccaatcccctgtagccgctgccgcaggctgcgatcgggctcgcagagcccgcaacccggacgacgcatatggccgatgctccctttgcctcggctgcgccaccgatcgcagcctgcggcggctacaggtttttaccagcgcatccgcacacccaggctgccgatcagcccgttgaggtcgttgtcatccacgtcgctgctgtagtcggcgctcacatacaggctgacgacgggggtaagcctggccaccaggcccaggccgacttcgaccgtggaggacttgcggctgctgctgatcttgtcgaccttgtccagggtcagggtgtcgccgctgtacaccgtgtgccacaagctggtgcgcacatagggttccaccgagtgcccggcgacgtcgtaacggccttgcaagtgggccccgacgcggccgctccaggcgttcaggttgccggcggagcggctgctgctgtcggcattcgggttgtccaggctgacgcgctggttgatcaattgcgcctggggttcgaccacccagttatcgctgatgccgatgggaatcccgccttgcaccgacagggtcaccgcgctgccttcggcggcttgccgctggccttgctcggtgcggctgaagccgctgacccgggcgccgctggccgacagatcgacgtgccagccctgcgggccggtcaggctccagaacgcgccaagactttgaccctggacactgaaacggtcgttacgcgggtcgctgaaaccgccgggcacgccctggccgttggcctggaactggctctggccgcccagcaggccgatgcgctgggtatgtccgctgctgctttccagggtgtagagcaccgggccgccgggcgtgccgttgatgctgctggcaaaacgcgaaccgaggtagccggcttcggtctgccgcgccgcgggcccgtacagcgggtcccagacctgcgggctgcgttgcacgatacccaggctgttgccctggggctggctggccggcatgggcgtcgcggagggcgcgggtgtcaacaggcggttcaggagcaggtcctggcgataccagagctgcgcctcgtcctcggcaggggacgcttgtacctccatggacgcgcacagcaataccgaagcggaaactgtgcacagaatgatcttgatctcttgtggggtgagtgaagttttcatggagggctaccttgcaatcgcatgccgtgtctcgccgtggcgtctctcctaccccgaatgaggggcgaccgagttcgttgaggcaaggctcggcgacccgctctagagcaggtatccgaggcttgcccctggttgtatttccgggggtagtaagctgtagctaaggagacgactccgttatcgtcaagaaaatgaccgaccaatggcgtaggtaattcaggctgtgtaaccgactgaaaaaaagcgattctctaagttcttgtttgtgcggaaaaacgtcggcagaggcggggaaaagcgattttcggtagcccactaccgactcgtcctttgcgggcgagtcggtaattttcctgggccaagggccgcgtcaggccttggccagcgcgctggccgcttcgtcgatcaggccggcgaccgcggttgccggggaggcgagagtggcctggtggaccgccagacagatgaccctcgatgcctgggcgaaggcatcagaggtgcacttccaccgccagcggcaggtgatccgacaggtgagtccagggcttgtgcccgaggatcttcggtgcgtggctgctggcattgcgcaggtagatgcggtccaggcgcagcagtggccagcgcgccgggtaggtcttggccggcctgccatggtggcgttcgaaggcttcgtgcaggtcgtcgcggcgagcgagggtggcattgccatgcaactgccagtcgttgaagtcgccggcgatgatcaccggcgcatcgtccggtagcgactcgagcaactggcacaacagcgccagttgcagctggcgatggctttccagcaggctcaggtgcacgcagatcgcgtgcacttcggcatgccccggtacatccagcacgcaatgcaacagcccgcggcgctccgggccggtaatcgagacatcgaggttgcggtactggcggatcgggtatttcgacagcagggcgttgccgtgatgaccatcgggatagaccgcgttgcgcccataggcgaagtcgctccacatgctgtcggcgagaaactcgtattgcgactgctggggccagttgccgtagcggctggcgtggcggtcgtgctcgcccagcacttcctggaggaacaccaggtcggcctgggtactgcggaccgcgtcgcgcagctccggaagaatgaaacggcggttcagggcggtgaagcccttgtgggtgttgacggtcaggatgcgcaggcgatggatcgccggggtttcgtctggcgctgccgacgtgaccggacgcctggttgaatcggtgctcacgctcactcctcgtaatcagggcggttactcatgcgactgacactttgccggtcagttcaggttttcccccggccggcctgcatcggggcagccctacatgaaaaagatttcgtaggactggcgcagccgctccagcaccaccggcgtcagggtcggggccaggccgatgcccggatcgccctgcaactggctggcataggcatgcgccgcatggcgcttgcgggccacggtccaggtgtcgaggcgcaacttgcgggcacggtgccagggcagcagctgttcatcgcgcgccggccagtgccaggcccacaccggcacttcgtggaacgccacgccggcctgggccgcggccttggcgctggcccggccgacggcgtcgtgatcgtcgttgccgtcttcgcgccaggtgctgaacaccacgtcatcggggcgtagataacggccaatgaactggctcaactgatgctcgcgttcctgctgcccactgtcggcaaagccgccacgaatccactgcaggctgtgcaggggcaaacccaggcggcgcagcgcctcgacactttcctgggggcggaacacgctcaggcgccgctccgaccacaggtcggagccggggtggctggcgctgccgtcggtgatggaaatcagttgcagcggatggccatggtgggccagtacctgcagcaggccgccgcaggtcagcacttcgtcgccggggtgcggggcaatgaccaccgcgcgaaatccgggcggcaccaggctggcaaggttgatggaggggacgtcgagcagttggcgggcgccgttccagacctgctccggccagttgtcgctcaggggtatggatctcatgggtgtcacatccttgttccgaggcagtcggcgcgcggtgatggaccgggccgcttgggttcgcacccggtatcggtccgggtgccggcgctccataccttggattgccgtcctgcaagagcgttcaatcatacacagccgttggccaccatcgcaggggccagcgattttttccaatggcgacgctcagctgttcaagatagcggggaatcgatatccggcaccatcgtacatatgtctgatgggctggccactgcccgtcatgcaatccggtaaatggccaatgacctgttcaatcgtcatcctcgtgctgcagttcgaacagcagcagcgagcgcccggtcaccgagtaccggtggccgaactcgaagcgttcctggcctttcaccgagggctggttggtgtcgatcatgcaggtccagaagccgccgtcgggcacttccggcaggctgaagttgacgatgtcgtgatgggcgttgaccaccagcagcagcgtcgcgtcggcgccggggcggcgtatcccggtttcctgggcgcggccgtcgagcagcatgcccaggcagcggccgtggctgtcctgccattgttcgatggtcatctcgctggcgtccggggcgagccaggtgacgtccttgaccccgatatcctcgttgtagttgcccaccaggaagcgtccgcggcgcaggatcgggtaggtcatgcgcagcttgaccaggcgcttgacgaacttcagcagcgacttgccgtcctcgtccaggtcccagttgacccagccgatttcgctgtcctggcaataagcgttgttgttgccgtgctgggtgcgggcgaattcgtcgccggcgacgagcatcggcgtgccctgggccagcagcagggtggcgaagaagttgcgcatctggcgcaggcgcaacgcattgatctgcgggtcgtcggtagggccttcgacgccgtggttccacgacaggttgtggttgctgccgtcctggttgtcctcgtcgttggcttcgttgtgcttgtcgttgtacgacaccaggtcatgcagggtgaagccgtcgtgggcggtcacgaaattgacagaggtataaggccgccggccgcgctggttgaacagctcgccggaggcggtcatgcgcgcggcgaagtcggcgagctggccgtcgtcgcctttccagaaggcgcgcacggtgtcgcggaacttgtcgttccactccacccatcccggcgggaaaccacccacctgataaccgccggggccgatgtcccacggctcggcgatcagcttcacctggcgcagcaccgggtcctggcggcaggccacgaggaaactgtggcgctcgtcgaagccatcgtgataacgcccgagaatggtcgccaggtcgaagcgaaaaccgtccacgtgcatttccgtggcccagtagcgcagcgagtcggtgaccatctgcagcacgcagggatggctcaggtcgagggtgttgccggtcccggaatcgttgatatagaagcgtttgtcgtcgggcctcaggcggtagtaggaggcgttgtcgatgccgcgcatggacagggtcgggccttgttcgttgccctcggcggtgtggttgtagaccacgtcgagtatcacttcgagcccggcttcgtgcaggtgcgcgaccatttccttgaactcggcgatcttgccgctggccaggtagcgcgggtcgggggcgaagaaggcgatgctgttatagccccagtaattggtcatgcccttgtgcagcaggtgctggtcattgacgaaggcatggatcggcaacagctccaccgacgacaccccaagcttgcgaatatgctccagcacatcgtcgaccatcagcccggcgaaggtgccgcgcaccgcctccggcactgagggatgacgcatggtgaagccgcgcacgtgagtctcataaatgatcgttttatcccagggcacgctgacccgatgatcgtggccccaggtgtgggccgggtcgatcactttgcatttgggcacgaagggcgcgctgtcgcgctcgtcgaaactgaggtcggcgtcgaggtgcccgatggtgtagccgaacagcgcctcggaccatttcagctggcccaccagctgtttggcatacgggtcgatcaacagtttgttggggttgaagcgatgaccgttggccgggtcgtaggggccatgcacccgatagccgtagatcagcccggggtgggcgtcgggcaggtagccgtggaagatctcgtcggtgtattccggcagttcgatgcgttccagctcgacttcgcccgtggcatcgaacaggcacagctcgaccttggtggcattggccgagaacagggcgaagttgacccccaggccgtcccaggtcgcgccgagcgggaagggcaggccttcgcggatgcgcgagggctcggtggcttgcggggttttcggcgtggcggctgctttggcggtggtcatgggtgctcctgcgaatcagatgggcgaatgggctccctgtggcgctcgggcgcgccacgcacatgggcaaggtcggcagtggagggtggcgcgaacgcctcgcggcagaggcgtcagctggccgctggcttgcgcggtgcccgcggctttttcgccgcactgcttttgcctccgggcggcaccttttctccaggaggcacaaggggtgctgccgccgcgggtttggcgacggccttgggctttgccgcgggcttgccaggcttggcgctggcggcacgggtcgccctgggcggcttgctcggggccagggcctcggcttcggccagcttgcgggccatttcccaatgccggtgttcctggccgtcgggccggccttccgattcccagatttgataggcgaactcacgaatgcgtttgtcgtcggtactcatcgcaatgctcctgaactgaactcaagtttggatgaaaaggttgaccgggaaatcccccaatgcgctgctgatcatcagatccttgtggggtgtgactgcccccgtagaaaaaagtcccttcaggttttgtcctggcgcggcgaatggcagatgcacacgcgtatcgccccaatccggcgcgtcgacccggggttgcgcgccgctttccagcagcccggcgaccagcctgggcacgatcaccacggcgcgctggccctggtgttcgcgcatgaaggccagcaccttgtcggcgtgtcggccctgtaccggcagcggctggtaagtgccccggcgaaacagttgcgggtattcgccccggcgcgctagcgtggcggcgatcagggcctgcttgatgcgcccgtcgcgccagttcgccaacagttccatggtttcgccgcaagggtccagagcctgctgtcgggcggcgaaatccaccgggcgacggttgtccgggtccaccaggctgaagtcccagaactcgttgccctgatacaggtccggcacgccgggcacggtcatgcgcagcaaggattgagccaggccgttgagggcgccagcgggcgcgatgacctggacggctgtgccgatggcgctgcgcaacggcaggccctcggggctgagcaacaggcgctcgataaacccgtgcacggctctttcataggcctcgttggccgccgcccaactgctgtgcagcttggcttcgcgcagggctttttcctgccattgccagaggcgctgagcatagtcgcgcaggccctggcggtcgtcgctgtgcagttccagcggccagctgccgagcagggcctgatagaggatcagctcgtcaccggcgccgggcgcctggggatcgctgcgcagggcctgggccaggccgcgccagtgttccacctgttcgacgtaccaggggccgagttcgctgagcaccgccaggcgcgcgcgggcatcttcgccgcgcttgtggtcgtgggtggcgctggccagcaggttgtcggggaaagcctccaggcgctcgcgacaggcggcgtggaagtcttccaccggggcgcagaactgctcggtggaaaagccgacgtcgttgcgtgacagcagcaccgccgagcgatagagcgcggtgtcttccaccgccttggccgccgccggcgaggtcagttgctggaagcgcacgcaggcatgcttgagcaccttgcgcgggcgccccggtggcagctggcgccagccgtggccgccaagccactgttgcaggtaggccagcaccggccagtcggcttcgcccagggtgtcgcgggcgccttgcagggcctgctggaaaaccccctcgtccgccgccgagcgcccgcaggcaccgatgtaggtgcggtacaccgggaagtgcacgatcagttcctgcaaggcacggcggatggcgccgagggtcaggtcgcggctcattacgtcgttgcgcgccacttgcagcagggcctgggccacgctttcgaagtcgctggccagcgagccgttgagcaattgctggcgcgccagccgggcctcttcgagaaaggccgccgggcgttcgctgtgccggctccagagttcggccaggggggcggcgccttgcgggtcgtgttgcagcagcgacagctggttcatgaactcatagccggtgctgccgtccacgccccagtcgcggcgcagggtttcgccagcgccgaggatcttctcgacgtagatcggcaagtgctggccggggcgcagggcgtcgacccggcgccgcagtttgcggcagtagccgcggggatcggccaggccgtcgatatggtcgatgcgcagcccgtccaccaggccggcggtgatcaactggaagattttgccgtgggtggcctcgaacaccgccgggcgctcgacccgcagcccacccagttcgttgatgtcgaagaagcgccgccagttgatgtcgtccgccgcggtgcgccagctggccaggcggtagctctgctgttccagcagggcgtgcaggcgggcgaaaccctgcggctggcgcgaatcgtagcgcgccaggtgctgctcgatggccgcgcggacctgcggttcacgggcggcttcctgcagttgttgttgcaaggactcggcctgggtgtgggcgtcgggctggtagcgcagggtgctgaaggcatcggccagtggcttgaggcgttcggccggcgtggcgtcggtctcgccctggagccgcagcagctcgccatagtcgctggggcagatcgggaaatgatgctggtagtgctcgacatgaaactcgccccgttcggcatcgaagcacagcttcagcgcgccttcctgcagggctacgccgtagtcgctgccgaggaacggcagcagcaactggccttccatcaaggggtcgggggagtgccactggatatcgaagaattcgccgtaggggctcaggcgcccccagcgcagcaggtcctgccaccagggattgtccgcgccgccgaccgccatgtggttggagacgatatccagcagcaggcccatgtcgtgctggcgcaggctgcggaccaggcgctccagggcggcctcgccacccagctcggggttgacccgggtcgggtcgaccacgtcgtagccgtgcatcgagccggcgcgggcgcacagcagcggcgacgcgtacaggtggctgatgcccaggcgggcgaagtagggcaccagcggcaccgcgtcgtcgagagtgaagccgcgatgaaactgcaggcgcagggtggcccgcatgggcgggctgtggtgcgtggaatccttcatcggtcgcgctcgtgggcctgctgccgggcgcaggccagcagctccaggcggcgcgcggcgtccgggtcgtcgagcaaggccgcgctgctgccggccaggcgccgacgccagttgggatggctgtcgagggtgccgggcaggttggcctgttcgtcgatgcccagggcgtcctccaggggcagcagcaccagcggtgcgcgggtatggccgaggaagcgcacgctggcgtccaccacctggtcggcttcgtgggtgtcttctcgaaagttctgcgggtcgcgactcagggcgtggcgcaggccctcgcgttcgcgctggcgatgttcgcgccaatgggtttcgccgctttcgtccaccaggcccaggcgcgcgctccagtcgatgtcgcggccctgccaccagccgttgagggtcggcaggtcgtgggtgctggtggtggccagggcgttgtccggccagtcgaggatcggccggaaatgcgtgccgtgctcctgctcgaacagcagcacgcgcatgccgagcatggcccgcgcgctgagtttttcccgcaggccgtcgggcaccgtgccgaggtcctcgccgaggacgatcgcctggtgccggtgcgattccagggtcagcaggcgcagcaggtcgtccaccgggtaatacaggtaggcgccgtcgcagggcggggcgccgagggggattacccacagccgctgcaaccccatcacatggtcgatgcgcaggccgccggcatgggcgaagttggcccggagcatttcgatgaaagcgtggaagccattgcgcaccaggccctccggggaaaaggcggagatgccccagccctggccctggcgattgagaatgtccggcggcgcgccgacggtcagcgccgccagcagttcgtcctggcggctccaggcctggctgccgccaccgtcggcgcccaccgccaggtcggcgatcaggccgatgcccatgccgctgctgcgggcggtggcctgcacgcgctccaggcagcgggcgatcagccattggcagaaggcataaaaaccgatatcggcggcgtgctcctcggcgaactgcgccagcgccgggctgcgtggggtgcgccaggcgtcgggccattcgcgccagtcgaggctttcgccacgggcggcgcgctgggcctggatggcttcgaagcggcagtggttttccagggcctcgccgctggcgtggcggaagctggcgaagtcctggtgcagcggatgctcgccctggcagaagccgtcataaagcgcgcgcaggactttctgccgggcctgggccgccaccggccagtcgaccatcggctgttgttccagctgttgcagttgcggcccgaggccgctggcatcgatcgcgctgcgccaggcccgctcgccgagaatggtcccgggcgcggcgtacaggctgttgagaaacagccggctggacggcgaataggggctgtagcggccggtgtcgctgctgaacatggcgtgcagcgggctgatggccacggcctcggcgccccgttcgccggcgacccggaccaggtcttcgagcgcttgggtgtcgccaaaaccaccgtcgccgctgcggcgcagggaatacagctgcacgctcaggccccaggcgcggggtgtggcctggtccacggcgtcggcgacgctgtagcagcgctcgggcgccacggccagggtgaagtgctggccggcgatgctcacctcctggtaacccaccgggaccaggcccgacagcatggagttggcgtccagcctgaggttgagcacgccgccgtcttcgaggtggatttcgcagggcgtgtccggggcgaagtaatgccccaggtccaggccttggccggcgtcggcggtcagcagcggcggcagttgccggctctgctgcacctgtagcagctggcgcaggctggcttcgatctgccggtcgttgtcggccggatggccgaggctggccagcacggctcgcaatacccgtggctcgacccgttgcgggcggccgttggcgtcgatccagtcgacggccaggccggcccggctggcgaggatttccagttgcgcgtcgctcatgggtgttctccgtcaaggtctggcgtgggggcgactgtgccgaggctgaccagcgcgctatagggggcgagagtgccttggcgcaaccgctcgaacgcctgggccgggtattcgaacaagcgctgcgccgcgcttggcggctgttgctcgacattgtgcgggctcaggttgaggtcgatgcgcagttcctggccattgcccaggcgccagcgggcacagagcgcgccttcggccagcacctcggcgcccagggcttcggcgccgggcaggtagggcacgatgtgctcgcggcgcagttgcaacagctggcgatacagcgccagggtctgctcgccctgggccgggtccgcctgcggcctcgacgcgaggaaggtgtccggcgcgttcgggtcgggaatctgctcgcgtttatgcggatcggcgaaggcgctgaaggcggcgaattcgtcgcgccggccctcgcgcaccgcgtccgccagttcgccgtggtggctggtgaaaaacaggaagggctgcggcgccgccagttcgtcgcccatgaacagcagcgggatcatcggcgacagcagcaacagcaccgtggccgcctgcaatgcctgtggctcggccaggcgcaccaggcgctcgccgaaggcacggttgccgatctggtcgtggttctgcaaaaacagcacgaatgcgctgggcggcaaatggctgctgggttcgccgcgaggggtgccgtggagggtgacgtggccctgatagacgaacccctggctcaggcagcgcgccagtttctcggtggggcgctcggcgaagtcggcgtagtaggcgtcggtctctccggtgagcagcacatgcagggcgttgtggccatcgtcgttccactgcgcgtcgaagtgctgctccaacaggctggcctggttgtattcgttctccacggtcagccagacctgtcgcgccgggtcgatccggcggcgtacccgctgcgccagttgttgcaggaagtccgggtcgtcgatggcatgcacggcgtccaggcgcaggccgtcgaagcggtactccagcagccacatcagggcattgtcgataaagaagtcgcgcacgggctggcggcgaaagtcgatggccgcgccccagggcgtgtgccggtcttcccggaagaaggccttggcgtagtggtgcaggtaattgccgtcggggccgaagtggttgtagaccacgtcgagtatcaccgccatgcccaggccgtgggcgctgtcgatgaggtgcctgaggtcgtcgggcgaaccgtaggaggcttccggcgcataaggcaggacgccgtcgtagccccaattgcgatcgccgggaaactccgccaggggcatcagctcgatggcggtgatgcccagctcggccaggcgtggcagatgtttttccactgcgcggtaaccgccgagcacgcccacatgcagctcgtagatcaccgcttcgtgccacggccggccttgccagtgtgggtgccgccagcgataggcccggggatcgaccaccaggctggggccgtcgatgtcgccgtcctgggcccgggacgccgggtcggggacgcgcaggtcatcgttgatcttaaagcggtagcgggtgccgggcgggcactggccgatgagcatgaaccagccgttggcctggggctgcatgggcagtgacacgccgtcttcgagttcgacgctgacgtgttgtgcgtccggcgcccagagggcaaagcgggtgcgctcggcatcgagcgcagtagcgccgtggggccaggtttccagagtccttgacggcatccagggtgccctctcagggtttggccgattttcccaaggccttggccaccagctgttcatagagttcggcgtagggttccaccgccttgcaccagttgaagggcgcggccatggcccggcagcgcatggcgttgagcaactgcggataggcgaacaccttgaaggcgcggcccagggcctcttggtagctggccacggtggattcgtcgaacagaaaaccggtgacgccgttctcgatggtgtcggccaggccgccggtattgcgcgccaccggcagcgaaccgaagcgctgggcgtacatctggctcaggccgcagggctcgtagcgcgaaggcatcagcaggaagtcgctaccggcgaacatgcggcgggcgtcggtttcgttgaaaccgatgttcactccgatgcgcccggggaaacgcgcggccagggcgcgcatggcctgttcttcctccggctcgccgcggccgatgatggcgatctggccgccggacttgacgatgtactcggccacgccttcggtaaggtccaggcctttctggtagaccaggcgcgagaccaccgcgaacagcgggccgctgctggggtcgaggtcgaacatccgccgcacatgggcggcattggcggccttgccttgccagtcgccgatggcgaagggggtggacaggtgcgggtcggtggcggcgtcccagctttcgtcgatgccgttggggatgccgctgagctggccttgctgggtcttgctggcgaggaaaccgtcaagcccgcagccgaaggccggggtggtgatttcctgggcataggtggcgctgacggtggtgatgtggctggcgtaggccatgccggccttgaggaacgacagcttgccgtagaactccatgccttcctgttgcagggcatgttcggggatgcccagctccgggcaggaagccaggctgaccacgccctggtacgccaggttatggatggtgaacagggtcggcgtgcgttgcccgcgccagtgcatataggccggcgccagcccggctggccagtcatgggcgtgcaccaggtccgggcaccagtggatctgtgccaggttggcggcgatgtcggcggcggccaggcccaggcgggcgaagcggatatggttgtccggccagtcgcgaccgttgttggcgccgtagggcgagccttcgcgctcatagagttcggggcagatcagcacatagatcaccaggccgtcgggcatgtccatgcgcccgatcttgcaggccggcagggccgcgtggccgcccagctcgccaatgatatgaatcgggttttcgctgtgcatcacctgccggtagccggggatcagcaggcgtacatcgtgcaggtgcgccatggcgcggggcagggcggccgacacgtcgcccaggccgccggtcttgaccaggtcggcgatttccgaagtgacgaacaggaccttcttgcgattggggttgtggcggatcaagggcagtgacgtcttgccaccaggggcgagaatcgatgtggagaccgtttcaccggccagcggcagaggatgctttccctgggtttgcaatacggcactggtcatctgtttctcccgttttattgatctgttcctggcatctgccggcggtgtcaaaaggccaatccgctggccgggcacaaaaacgttgcgcatgcgaaagccgaacgcagcctcatgcgtcgacgcaaagagggtgaaggggccgttgcaaggattgcaccagtcgcgaaggccctacctttaacctgacccaaggcgtgagccaaaagtttcgactttatttccctgggagtgactgtccggtcacttttcgaattccagtctaggacagaagttagagcgcgggcgtgacgattaggttttctcggggcgaaggttgcgctgccccggaataaagccgacgaaaggcagtctcgcgcaccggccgggggcgaggctttttcgccttggcgcgaaaacggtgaggggctgcaagggagcggtgcggggcgaaggcgccggcgctcgatgatggtgcagggcagtgctggcgcaatgccctggcgtggttcagcccaactggcggatcggctggccggcggcccaggcctggatgtcttcgatcatctgggcgaagaactgccggtagttctgttggctgacataaccgacatggggcgtggccagcacgttgggcaggcggcgcaacggatgatcgaggggcagcggctcctgctcgaacacatccagcgccgcgccggccaggcgcccgcgttcgagggcgctgatcagcgccgcttcatcgacgatcggcccgcgggcggtgttgaccagcagcgccgagggcttcatccaggccagtgcctgggcgtccaccaggccgcggctgcgttcgctgagcaccagatgcaccgagagcacgtcggcctgttcgaacaactgttgcttgttcacgtaggtcacgccggccgccgcggcccgttcggcggtgaggttctggctccaggcgatcacccgcatgccgaacacctggccgaactgcgccacccgctggccgatgctgcccaggccgagaatgcccagggtcttgccgtgcaggtcgccgcccagtccctgttgccagaggccggcgcgcagcgcgctggcttcgctgagcaggttgcgggtctgggccatgatcagcgcccaggtcagctccggcgccgcgtgcttgtaactgtcggtgccgcacacctggatgcccaggcgggtcgcggcggccaggtcgatggcggcattgcgcatgccaccggtgagcagcagcttgagccgcggcaggctgcgcagcagggccgcgtcgaaacggctgcgctcgcgcatcacgcagatcacctcgaacggcgccaggcgctcgctcatggcggcggtgtcgctggggtagtcatggataaaactgacctggccgatgcccgccagcaccgaccagtcgacgacgtcacgggcgacgtcctgccaatcatcgattaccgcgatctgcacactcatgaaggctccggggaaaacgcatcaatgtgacgccagccagcccagcagggcctggtggaattgcgccggttgttccatctgcggggcgtggcccaggcccgggaactcgatcagggtcgagtgcgggataagcccggccacttgcttgcccagcacctggtagttgccgatccgcgccttgaccgccggcggcgcgatatcgctgccgatcgccgtggtgtcggaggtgccgatcaacagcagggtcggcatcttcaggtccttgaactcgtagtacaccggctgggtgaagatcatgtcgtaaatcagcgccgagttccacgccacccgtgtgtgccccgggcccttgttgaggccggcgagcatgtccacccagcgctcgaattccggctgccagcggccgccgtaataagtgctgcgctcatagttgcggatgccctcggccgacagcttgagctcgcgggcgtaccactggtcgacgctgcggtagggcacgccgagggccttccagtcttccaggccgatcgggttgaccagcgccagttgctgcacctgctcggggtattgcagggcataacgggtggccagcatgccgccggtggaatggcccagcaggctgacctgccggacgcccagccgatccagcagttgccgggtgttctgcgccagctgctggaagctgtattgatagtgctcgggcttgctggaggtgcagaagccgatctggtccgcggttatgacccggtagccggcgtcgctcagggccttgatcgaggtgtcccaggtcgcgccgcagaaattcttgccgtgcatcagcagcacgctgcgaccgttgggcgtgcccttggccggcacatccatataccccatctgcaaggcctggccctgggactcgaaggcaaagtgctgcagcgggtagggatagtcgaagccttgcagctcgggaccgtaggccgggccttcggcggcaagggcgggcagggcagcggtcagcaacagaccgggtaaccagcgggtgaggcttagggacatacatgacctccgagagaaatgagccgatcctggtgcggcgtgattagggcgacattaataagcagaggccatcgccagggcgaaacgttcccttcgtggtcatgcttataagccaggagacgtgccccgtcagctcaaccgaaccagccgagggtcatccaggccagcacgccatagcgcgcacccttggccagggtgacgatcagcaggaagcgtttgagcggttcgcccatgattccggccaccagggtcagcgggtcgccgatgatcggcagccagctcagcagcagggaccagtggccgtagcgctggtaatggccgcgggcccgttgcagatggcgtgggccgacggggaaccagcggcggtccttgtagtgttccaggcgctggcccagccaccagttcaccagggaccccaggacattgccgagggtggcgacggccagcagcagccagaccgggtgctggccgttgagcagcagccccaccagcacagcctcggattgcagcggcagcagggtggcggcgccgaaggccgccaggaacaggccgaggcaggcggtgaagatcaatgggccgggtagtccgcgaccaccacgtccttgccgtccctggtcaggccgatgacctggtaggcgtcggcgggcatgccgtccatttccatgccgggcgagcccatgggcatgccgggggcggcgacgccgagcaggtcatcgcgcttgctcagggccagcacctggtcggccggtacatggccttcgacgaatttgccgttgatcaccgcggtgtggcacgacgccaggcgcggggccacgcccaggcgctgcttgacttcgctcatgttgctttcgacgtggtcgttgaccttgaagccgttggcttgcaggtgctcgatccatttcttgcagcagccgcagttggcatcgcggtgcacatcgatcgggatcaggtcggcggcctgggccagggagccgacgagcagggcagacagggctgccaggcgcagagtgttgttcatagggaatctcttgatcatcagggcgccttgggggcgcggtcttgggccgacagggtggcgtattttgctacttttctcgagcgtggcgcggcgcttgtgtttcaacgttataccgagcgctggccattcaggttgtctggtactgcgcattgtcgttcatcgcgggcaagcctcgctcctacagaagcgtgcccgcataggcgttcattcgggagccgggctcaggatgccaagcgtggccaccaggccgacaatcagcagggccgccgccagttccaggagcatgctgcgacgcaaggcgggcagggccgctgcgggtgagccatggtgcagcgcctgttccagctgcgggaccagatggaaacggttcaacgcggcgaacaccagcatgctggcgaacaccgccaccttcaggctgaggagcaggccataggtgctggcgctcaacgttgccgggtccgggccgacgatcagcaggtagttgagcacgccgctgatggtcaggacgatcacgatcagcgtgcccaggctggcaaaccccttcagggcatcgagcaggtggcctgcctgcggttcgtcttcgcaggcgtcacgacgcagcagcagggcgaaagccgccagggctcccaaccaggcgccggcacccagcaaatgcaggatgtcgctgcccagatgcaggtaacgccgggcaccttcgctcattgccccgtggccgccccaggccaggctggccagggctgccgccgcgcacagaatcaggccgtagagggtgaacctcggccagccaccgctgaacagaagcagcacgcccgccagcagcaacgccgccaggcgcagcagccagctttggccgacagcggtttccagcatgagcgcagacagcagcgccgggtccagttcggccaggcttgtcgcgccactcatcgacagcgccagctgcagcagcgcggcgcccgacagcagcgcgcccagcaccagggcggccgccagaggtcggcgaaaacgccagcggctctgcgcaccacgcagaccgtaaaggctgaacagcgccaggccgaacagcagcgtcagatcgaggtacagggcaaaacgcagggcgacgttgatgagttcgcccatggctcagttgacttcgaaggtcaggttgccggtgatcggatgggtgtcggcggacaccgcccgccactcgactttgtagctgcccttcgcgagcggggcgacggggctgatgatcatgcttttcggatcgctgccgccggccacgctggccttgaccggcatcggtgcgtggctcatcccgggcatgccggtcatcagcagccgagccccggaaaacttggtggtgaggggttccgagaattgcagttcgatcttcgccggtgccgcgcccttggcgccttcggctggggtcgaggccagcagcttggggtgcgcctgggcgacgccggcgagggtcaggccggcaccgaaagtgacggcgatggcgagatgcttgaggtaggacatgcaaggctccaggcggcattggccgcgtgatgtttttagttatctattgaagggaagtcagaaccacaggcgcacaccgagcaccaggcgggcttcgctgctgtcttcgccttcttctcgggcgtagtccgcggtcttgccatagctgcggctccaggtcacgccgacgtagggcgcgaactggcggtgcagttcgtagcgcaggcgcagaccggcctccagcgaggagagccccgagccgatgccccgttgcgggtcgttcttgccgtacaggctgacctccgcgttgggttgcaggatcaggcggttggtcagcaggatgtcgtattcggcctggaattccagggcgctctggccgccttcgccgaggtaggcggtggcctggctttcgaagttgtacagggccatgccttgcagcccgagggcggcccaggtctgtggcgcgccgggcttgaagtcctggcgcacgccactgaccacatcccaccaggggccgatggcatggccccagagcgcttcgacctgggcgttttcggtccggccgttagtgcgctcgccctcgctgcgcagccacagccggtcgatgtcaccgccaatccagccgttcatttcccaggccagggcactgccgtcatcggcgtcctggtattccaggcgatcgaccagccacagcgagttgatcgccttgtcgtgcacgccgtggccggccaccggcgggaaggcggcgcggcggtcggcgtcggtgagtaccgggatcggcgtgcggctttgggtgggcgccgcgggttccatggtctgcaagggttcgccgtccatgccggtcatctggctgtggtccatgcccggcatcgggttgcctggcatggaggaggccggcatggacgaatgatccatgctggagtgatccatgctttcggcggcctgcagggtgccggcgctgaggccgagcagggtggcgaacagggtcaaggcgtttttcggcatcatgcggcgctcccggcttcgtccacgcgtacttcgcgaaacatgcccatctccatgtggaacagcaggtggcagtgataggcccagcgtcccagggcatcggcggtcacccggtagctgcgcttgctgcccggtggcatgtcgatcgtgtgcttgcgcaccaggaagcgcccctgttcgtcttccaggtcgctccacatgccgtgcaggtggatggggtgggtcatcatggtgtcgttgaccagggtgatgcgtacccgctcgccataggtcaggcgcaggggctcggcgtcgctgaacttgatgccgtcgaacgaccaggcgaatttctccatgtgcccggtcaggtgcagctcgagggtgcggctcggttcgcgcccgtcggggtcttcgaaggtgctgcgcaggtcggcgtaggtcagtacccgacggccgttgccgcgcaggccgatgcccgggtcggcgagtttcggcgtcgggctcatggtctgcatgtccaccagcgggttgccgtcttccgaggccgggtggctttgcatggcgccgtggtccatgcccgacatgccgctgtggtccatgccagccatgttgccctgatccatcccctgcatctggctgtggtccatgccctgcatctggccatgatccatgccgggcatggcgcccatgccagccatgctgccgtggtccatgcccatgtcggccatgctgatcagcggccgcgggtcgagtggcggcacgggcgcgctcagccccggacgctggctcagggtgccgcgggcgtagccgctgcggtccatggcctgggcgaacagggtgtaggctttctgcgagccgggctcgaccagcacgtcgtaggtctccgccacggcgatgcgcagttcatcgacgctgaccggctgcacatactggccgtcggcggcgaccacggtcatcttcaggccgggaatgcgcaggtcgaagtagctcatggccgagccgttgatcaggcgcaggcgcagcttctcgccgggcttgaacaacccggtccagttactgcccgggctctggccgttgatcaggtaggtgtaggtatgaccgctgacgtccgccaggtcggtgggggtcattttcatctgcgcccacatcttgcgatcggcgagggtggccgcccagccgtcgcggctgacgtcctcgataaagtcgccgaccgtgcgcttgtggaagttgtagtagccgggctgctttttcaggatgtgcatcaggcgctcgggcgcctcgtcgctccagtcgctgagcatcaccacgtagtcgcggtcgtactggaagggttccggctcgcgggcctcgatcaccagtggcccgtagaccccggcctgttcctgcaagcctgagtggctgtggtaccagtaggtgccgttctgccggaccttgaagcggtattcgtagagaccgccgggggcgatgccgtggaagctcaggcccggcacaccgtccatattggccggcaggatcaggccgtgccagtggatcgaggtgtcctccttgaggcggttgcgcacccggatggtcacggtgtcgccctcgcgccagcgcagcagcgggccgggcaggccgccgttgatggtcatcgcggtgcgcgacgtgccgctgtagttgacctgggattcaccgatgaacaggtcgaactgctggccgctgagggcgggcagctggccgtcttcgctgcgtgcccagagcggctgttgccatagcccggtgccggccagtacgccaccggcggccaggcccttgataaaactgcgtcgtgtgggtttcacatgcatgccccaaggctccctcgatcctgctggtcaggtatgaggcgaccttaagcggcgcggcctgtcagaaaactgaggtgaagattacagatttgtcagccagcgccgcgccacccgttgccggatcagtgggcgatcttttccaggttgcgcttgaggttgaccatggccagttgggacaagtgctcgatacgcgggcgcaggctgagcaggttgaggtcggggcagtagtgcagggtgcgcttgaacagggttccgtccccgtatttgcacaactgatagtggatcgagccgtctgctggcgcagagctgaagacgatcttgaactccttgggaaataccgcgacagtacccggcagttcatgtggatctgcaggccgagcagatcgatggttttgctgaagcgatgccccgccggcaacgagccagccaggccggtgtcggcgcgcagggaagcgggatgccactcgtgccagcgatccggctgagtcacgtagtagtagacggtatcgatcggcgcgtcgatgtagagctcatggaagatgagctcgtccaaaaggtgctgctgacgttgttccatgatgcacctccttgcagtaggagcatcaaatatagttgcctgcgcgcctgccatggaggcgcgtaaatcgaccattcagcgggcttcgaggtggctcatcaagagggtgatgcacggcttttcccgttgtaagggagagggcgccatgcacagttgggtcgtcgcgcggcaatgtcgtggaagatccccgcaagatagcgtcatgaatgcttggaagatcttctgtttgcaactaaccattcggtacattaatggctgtaagttgtcgcttagttgtcacgggttggattgttaagcaattgtttcagctagaaaaaccgtggctttcaggcatttgtatcggaaatgtacaaaaattgtaaaaagccgaaatatttgttggagaggtgctttggcgcgccgatactcacgggcatcgttttccctcaatcaggcttttcagacgcttattagttgaacttgcgcaaccctctagttggctgtgcaagtggatataaggccatggaaaagcccgtacacaggagtcttttatgacaattggatatgtcggcggctggaccagcaaagccggtctgctggtgcaggacactggcacccgcggcaagccggtcagccagagcgtcaaggtcaagcagatgctcgccctggtcggccagaacccgctggcgctgaacgtgttcaagatggacgaaatgaagctgcacaagcagatcaagggtttcgatccggagaatgtcagcgccaagcagctgggcaacatgagcaccttcctcaagcagaaggggctgatcagcgacgtgacggcgatgactctgctcaacgccggcgacaagttcgaccgcttcggcgtgcaggccgacccggatgccaagttcaatgccctggagtacttcgcgatccagctggacaacatccagaccaacaacctcaagggcaacaagtacgccagcgacctgatccccgagtacaagaaagccatctacgtgctgcagaacctgcaaagctacggcaagggcaacggcaccacggtgaccgacaagaatcactccgccaaggcgtgaggcgacaaacaaaggccctcgaccgatcaaccggtcgagggccttttttgtggcgggctgtttaccggtcgagcaaggccatcaccgcttgcgggtaacgctcgccggcggtggcgtcggggctgaagatccgttccagggcctgcagttcgtcggcgccgaggcggacctgcagcgcggcgacattctcctccaggtacttgcgttgcttggtgcccggaatcgggatcaggtaatcgccctgcgccagcacccaggccagggccagttgcccggcggtgatgcccttggccgccgcgagttgcttgacctgttccaccagcagcaggttcctggtgaagttctcaccctggaagcgcgggctgaaacgccggtagtcgtcggcggcgaaatcctccgggctcttcagggcgccagtgagaaagcctcgccccagcgggctgtagggcacaaaggcgatgcccaggcgttggcaggccgccaggcagccgttgtcttcctggtcgcggctccacaacgaatattcgctttgcagggcgctgatcggatgcaccttgtgggcccgctccagcgttgccgccgaggcttcgctgagccccaggtagcggaccttgccggcccgcaccagctcggccatggcgccgacggtttcctcgatggccacgtccgggtcgatgcggtgctggtaatacaggtccagggtgtccacgcccaggcgctgcaaggtgccgtcgatcgcctggcgaatgtagtcggggcggccgttcactccgcgcgccgccgggtcgccggggttgcggacgatgccgaacttgctggccaggaatacctggtcgcgtttgccgcggatcgcctggccgatcaggatttcgttgctgtgggggccgtacatgtcggcggtgtccagcaggttgatccccagttccagggcgcgatgcaaggtggcggtggcttcctgggtatcggtgccggtggtgtagaaatcggtcatgcccatgcagccaaggccgatggctgacacttgcgggccgttcttgcccagttgacgggtttgcataggagaagctccagtggatggggtggcggccattgttctcctcgacaaaaacaagataaaccggctaaaagcgctatcattattcgtgatttctaaataatccgtgacaggccaagccaatggaccgttttaatgccatgcgtgtgttcacccgcatcgtcgacctcggcggtttcgccaaggccgccgacagcctgcagatgccccgggcctcggtgacggtgctgatcaaacagttggaggcgcatctgggcgtgcagctgctgttgcgcaccacccgccaggtcacgccgaccctggacggcgccgcctattaccagcgctgcgtgcggctgctggcggacctcgaggaaaccgaagcggtgttttccgtggcgcgccacaacccgcgcggcaccttgcgcatcgacatgccggcggggatcgggcggctggtggtgatcccggcgttgccggcgttctccgagcgctacccgttgatcgacctggaaatcggcctcaacgaccggccggtggacctgatccgcgaaggggtggactgcgtattgcgcggcggcctgtgcctcgacgactcgctggtggcccggccgttgctggcgctggagcaggtgacgtgcgccagccccgcctacctgcgccagcgcggtgtgccgcagagcctggacgacctggccgggcatcagatgatcgagtatttctccagcgtcagcggcaagcgttatggcctggagttcgaggtgcagggccaggtgctgttgcctgagttgcccaagcaggtgtcggtcaacagcgccgatggctacctggccgcctgcgaggccggctatgggttggtgcagacgccttattatcacgtcgcccagcagctggccgaaggtcgcctgagcgaagtgctccggcacaccccgccacccaggatgccgttgagcgcgctgtacccgccgcaccggcacctgtcgacgcgggtccgggtgttcgtcgactggctggtggagctgttcgcccagccggggattcacaacacccggctggcgtagctcgacagtaaagacagacgcccgcggcgaggcgggcgtcgggcaatttcgtggtgggttacaagggggaaatactggcgctctggatgacttagcggtggtagtagtagccggggccgccgtcgtaatggcggtgatgccagccgtcgtgagggaagatgatgccagccgtcgtgagggaagatgatgcagccggacagggccagcatcgccagcaggggaatcagccgggtgattcgacggaacatcgtgcagtcctcaaagggctctcggggttttaaccgccgcaatgcagcgaaaactcttcggcggctgtaacatgagaccccgtttgcccgcgcccatccccgattctcggtaggcgtttggcatctgtttcgatacagagtcgatacatttacacgcggcattttcaggccgcacctttacaggttcaggaacccgcaatgacccagaagcaacgcttgatctattcgattgtgatttccctggtggtactgggaatcatgcttggcctttcttacctgcagaacgccgggatgatcaccgagaaaatgttccagtacatcgccattggcgtggcggtgaccgtggtcgtgatcaatggcgtgatgcggcgcaaggtcaagccttgagagacaccccccgacggcctcagtcgcggccgtcgagtatggcttcagcctgttgatgcaggctgaagctcttgtccgcattgagggtgatcacgccttcgctgcacagccgcttcaacacctcgcgcacgctgaggaacgacagcgggatatccagctccagcaaatgactgtgaatgcctcgcacccccagggcgcgctggctttcggctgcctgcagcaaggcatcgatgactttcaggcgaatcaggctggtgcgcaggccgaagctcttgagcaggtgcctgatgcgttcgttgcggttgcgctcggcttgcttgccgaagacaccggcgccggcgttcagggaggacgcgggttgtgcggtgtggccatccgttggcagttgcgggtcgtacatgcaaaaactccttttcagagcctgatcaggaaaatgacgggtgctctcacataactagacgaacgagccgcgcaaatcatgaggaatcagttgtagaaaatttgtgagggctttgtcgtcgccaggttggcgggtgatcggcgcccggcgcgagggcgctaaatttttcgtggcggtttcgtctgtaagggcaggcgggctttggctgatgccgggtcgcgccgtcctttaccgggctggtatcccctgtgtgctcatcggcatgccacgccagcctgggttgtgcatcttctttcgatcaggagtcggcgtgattatttccagccagttgcccaggttttgccttgcgggtttgtttctcgggctgagccttgcggctcagggacgcgaggtccagggtggcgaggcaagcgccgatattcgccgcaccggttttggcgtcccgcatattcgcgccgccgacgagcgcgggctgggttacggcatcggctatgcctacgcccaggacaacctgtgcctattggccaacgaagtgctgacggtcaatggcgagcgttcgaagtatttcggcccgcagcagcagaccgtcgaacagcgggaaaacctcaccagcgacctgttcttcaactggctgaacacgccccaggcggtgttcggcttctggcaggcgcagacgccgcaggtgcggcaactgatcgaagggtatgtcgccggctataaccgctccctggccgagcgccgggcccagggcctgcccgagcagtgccagggtgactgggtacggccgttgaccgccctggacctggtaaagctgactcgccggctgttggtggagggcggcgtcggccagttcgccgaagccctggtgggcgcgaccccgccatccgccacggcgcaactgaagccatcggtccaggccttcgcccaggcggatgcccgcggccagcggttcgccctggaccgcggcagcaacgcggtggcggtggggcgcgagcgctcgttcaatggtcgcggcatgttgctggccaacccgcattttccatgggtgggcggcatgcgcttctatcagatgcacctgaccattcccggcaagctggacgtcatgggcgcggcgctgcccggcttgccgatgatcaatatcggcttcagccagcacctggcctggacccacacggtggacacctccaagcatttcaccctgtaccgcctgcaactggaccccaaggactcgacccgctacctgctcgacggcaagtccctgccgttggagaaacaaacggtcagcgtcaaggtgcagggcgaggacggccagctcacgaccgtcagccacagtgtctacagctcgcaattcggcccgctggtgcagtggcccggcaagctggactgggacaaccgtttcgcctacagcctgcgcgacgccaacctggaaaacgaccgggtgctgcagcagtggtacgcgatgaaccaggcccgcagcctcaaggagttgcaggcgtcggtgcatcaactgcagggcattccctgggtcaataccctggccgtggatgaccagggccagacgctgtacatgaaccaatcggtagtgcccaacgtcagcacggaaaaactcgcccactgcagcgacccgcggatcggcacccagctgatcattctcgacggttcccgcgcggcctgtgcctgggacatcgacccggccgccgcgcaaaagggcatctatccggccagccagctgccgcaactgttgcgcagcgattacgtgcagaactccaacgactcggcgtggatggtcaacccggccgcgccgttgcaaggtttctcgccgttgatcagccagcaggacctgccgctggggcagcgcgcgcgttttgccctgaatcgcctgatcggcacgggcaagggcgagccgctgagcgccgccgacctcaagcacatggtgatggacgaccaggtgtaccaggccgggcaggtgatgcctgacctgctgcagttctgtgccgccgacctgggcagcgatgcccaggccctggcgctactatgtgccagcctcaaggcctgggaccgaagcgccaacctgcaaagcgggttgggcctggtgcatttccagaacgtcatggaacagctggaggcgatcgacgatcgctggcgcgtggccttcgacgcgcgggacccgcagcacacgcctcgcggcctggcgatcgaccggccgccggtggccaaggcgctgcgcgcggcgatgctggcctcggtgcaacaggtggccgagtcggacctgaaggccgacagccgttggggtgatatccaggtggtcagcagcggcggccggcagacgccgattcatggcggcccggccagcctgggcgtgtacaacgcgatccagagcgtccccgcggccgacggcaagcgggaggtggtcagcggtaccagttacctgcaagtggtgaccttcgacgagcaggggccgcatgcccagggcctgctggcgttttccctgtccagcgacccggcgtcgccgcactcgcgggaccagaccgaggcgttctcgaagaagcagtggagtgtgttgccgttcaccgagcagcagatccaggcggacccgcagtatcggttgcaggtgattcacgaagtggacgatcggttgcgcaaggtcgcgacccagtaagcgcgttcaatctgccgtcaagcgcaggccgcacccgcgagggtagcggccttcagctttttggcgcggtgcctggcagcgagttgatgaccggattgccgtcctggttgcgggtcaggtacaccggcaacaccttgggcagcgtggtcaccaagctcttgaccgcggtgacgtcgtagatgccgccgacccgaatgttgcccgtggcgctgtcggccagcatcaccggcttgctgaggtagcggttgatcagcggcagggcctcgccgagcgccaggttgtccagcaccagcttgccctggcgccaggccagcgagctgtcgttggcagcggtctggctgatcagtggctggtaatcgccttggcgataacgcgcctgcatgcccggatcgagaggcacgccagcgtcggggtggctgttgtcgctgttcaccagcaccgaaccttcgagcagggtgacccgcacctgatcctcgtacatccagacgttgaactcggtaccggtgacccgcacctggccgctggcggccttgaccacgaacggatgggcgctgtcgtggctgaccttgaagaaggcttcgccttttttcagggtgacccggcgctggtccttgtagttgctgtaggtcagctcggtgcccaggttgagttcgacctggctgccgtcggccagggttacctggcgcatgctgccgtcggcctggaagtgttcgtaggaggagggcagccaacccaggctccagccgctgtaggcggccaggggcagggccagggcgctgatcgccgcggccatgccgtaggcgcgccagggtttgcgcgacgccggcaagggcagggcggtggtggctggcggacgtggcagatggtcggcgacttcccagatttcctgcatcgcttcgtattcgaaggcatgcagcgggtgggcatcgcgccattgctcgaaggcctggcgttcggcggccgtacagtccgcggcatgcagacgcatgcaccactgcgcggcggcatcggtgatggcgtcgtattcggcttctgtgaggtgctgttcgctcattggctcttcctggtttcgcgcattctacccttcgcagccaggcttgtagaaccgccgtcatggctaatgcatatcaaagtgcgggttatttttggagcaaagcctctgaaacacaggacttttgtcagcagtatccacagcgggagtgaaaaaatgatcaaaaacaccctggccgctgtcatcgccactgccaccttgccgagctccggcgcgcgatcctcggctgacggcgagttggtggcggctctgtctcttcctggcatcgcctgtgcaaggccatgcccgaggttgacagggcgcgcgcaaagcgttgtttaatcgtcggacgcactcacctgggtgccttctcatgcgctgtagcccattccaataattaatccggagctccagatgtctgtatcgcccccggctgttgcaacaccgcaggaacacctgtcgctcgaggcactggtgaaactgctggaaacgatcttcctgcgccatggcaccagcgccgaagtggcgcgttgcctggcgcacaactgtgccgctgccgagcgcgacggcgcccacagccatggcgtgttccgtattcccggttatgtctcgaccctcgacagcggctgggtcaacggcaaggctgtgccggtggtcgaagacgtggccccggcctttgtccgggtcgatgccggcaacggtttcgcccaaccggcgctggcggcggcgcgggcgttgctggtggagaaagcgcgcaacgccgggatcgccattctggccatccgcaattcccatcacttcgccgcgctgtggccggacgtcgagccgttcgccgaggaagggctggtcgccctgagcgtggtcaacagcatgacctgcgtggtgccccacggcgccgatcggccgttgttcggcaccaacccgatcgcctttgccgcgccccaggccgggggtaaccccattgtcttcgacctggccaccagcgccattgcccatggcgacgtgcagatcgccgcgcgcaagggcgaacgcctgccgccgggcatgggcgtggacggcctcggccagcccaccgacgatccgaaagccattctcgaaggaggcgcgctgctgccgttcggcgggcacaaggggtcggcgctgtcgatgatggtcgagctgctggcggcggcgctgaccggtggaaatttctcgttcgagttcgactggtccaaccacccgggcgcgaagacaccctggaccggccagttgctgatcgtcatcgatccgagcaagggcgccgggcagaatttcgccgagcgcagccaggagctgatccggcagatgcatggcgtagggctcaagcgcctgccgggggatcgccggcatcgccagcgggaaaagtcccggcaacaggggattgccctggacgccgcggagctcaagcacttgcgggagctggcggggctttaacgcgcggtttcaaaacgcaaggaccaggcgagcatgctgcaagcctggtcctttttttagcggtcgcgggtggcgctggccgttacagaaaaccggttacgaacgacgccccagcaacaagcccaccaccaggccgacgccggcggagatggccacggtctgccacggatggccgccgatgtactgctcggtagcgtccatcactggcttgctgcgctcgcgcacgctggacaccgagtccagtgcctgcttgagtttcaacccgacctgctggcgcaggttctcgccttcctcacccaccagcgatgcgctgcttttcaggagcttttccgattcttcgatcaacgcttgaagctcgctgaattcctggtccttgatttgttcgtcagccgcttgcgcagcagttttacgagccattgagttactccttgcgggtcagtgatgcgatgaacaatggagtcgcggggccggcgaaaagttgcagatattttctccacccgctccatgccggcgggaaaaccccagccgtcacagtgtaagatgtcggctattttacgcagcaggaaattcccatgagcttcaatctggccaacaagactctcgccgagcgtgcagagatcgaagatgaaaagtcccgtctgttcgagctgtggcagagcaacctgggcaaggccaagggcgaagccgcacggttgttcggcgagcgcggcaagcgcaagggcaaatgggccgaatgggtgcgtgccgagctcgacggcatgtcgccaccggaatacgccaacatggtgcgcagtgaagtcaatcgcctgatggcggcgaacaagtaagctcgaaactggcgacgatcgcctcgcgcactttcagcaccaccggatcgatctgcgcgctggtgcgccagcccagctcgatggggtaacgcggcaggtccagcgggcagggcagcagcgccagcccggtcagttcggcgatgctccgcgcggcgtgggccggaatggtcgccaccgcctggctgcccttgagcagatggggcagcgcggcgaaatgcgtggtcgaggcgcagacctggcgactcagccccagggccgccaggccctcgtcggtaatcccgataaagccttgcgacgacaccagcacatgctcgcgggcgacgaactcgtcgaggtcgatggcctgctgtcccggggccaggctcgccgggtccgccaggcacagataactgccttcccccaatacctgacggctgagcatgcgttcggcgaaaccgccggcgctgatggccaggtcgatgctgcgctgcaacagcgcttcgccgacgatctggctgtggctctggcgaaagatcagccgcagcttcggtgcccgccgggcgacttcctcgatcaggcgccgaccgtaggcaatctcgaaatcgtccgacagcccgatcgccaccgagcggccctgataatggctggcatggggatcgaccatggccaggctctgccggcatttgttcagggcctcgctgaccaccggcttgagctggttggcccgcagggtcggcgccaggccgcgcccggtgcgcacgaacaactgatcgccgtacagctcgcgcaggcgccgcagcgccgcgctcatggccgactgggtgacgcccaggcgcaaggcggcgcggctggcgctggattcgtcatgcagggcttcgaaggccttgagcaggttgagatcgacctgggcgatattcatctggttcatatcattcagtatcaggaggggctttctgcatgatcggcgagggccggacaatgggcaacacttcatcgccacaggagtttccccgatgtccaagtccgttgtcgccgcgttgcagatcggttccctgccagggggcaaggccgataccctggagcagatcctgtcctttgaagccgccatcatcgaggccggcgcgcagctggtggtgatgcccgaagccttgctcggcggctaccccaagggcgagggcttcggcacccagctcggctatcgcctgccggaaggccgtgaagcctttgcccgttatttcgccaatgcggtcgatgtgccgggcgcggagaccgaggccctggccggcctggcggcgcgcaccggggccaacctggtgctgggggtgatcgagcgcgctggcagcaccctgtattgcacggcgctgtatttcgatccgcagcacggcctggtgggcaagcaccgcaagctgatgcccactggcaccgagcgactgatctggggcaagggcgacggttcgaccctgccggtattcgacacccaggtcggccgggtcggcgcggtgatctgctgggaaaacatgatgccgctgctgcgcaccgcgatgtacgccaagggcgtgcaggtctggtgcgcgccgaccgtggacgagcgcgagatgtggcaggtcagcatgcgccacatcgcccatgaaggccggtgcttcgtggtcagcgcctgccaggtgcaggcgtcaccccaggcactggggctggagatcgccaactggccggccgagcgcccgctgattgccggcggtagcgtgattgtcgggcccatgggcgaggtcctggcggggccgctggtgggacgcgccggcctgctgacggcgcagatcgatactgacgagctggtgcgggcgcgctacgactacgacgtggtcggccactatgcccgtccggatgtgttcgagctgacggtggacgagcgggccaaggccggggtgcgtttcatctgagacgacgccactcttcgcgggtgatttcccatatatcacggggcaatcgcccgcagacgaagtcgtcttcgtcactgcggatcaggcgcatgccggcgcgttcggaaatccgccgcgaggccaggttcggcgcggccttgggcacccgcatgacctcacgccccagcacctcgaaccagtactcggtgaccgccgtgctggcctcgctcatatagccctggccctgccacgccggagccagccagaagccgcggttattgtcggcctggtccatcaggctgacattgccgatcaattgttccggcgcgcttttcaggcggatcgaccagtgccattcctcgccgcgctcgatggccggcagcgccaggtcgcgcaggtaactcagggcaccatcggcgggatagggccagggcacccgcgcgttgagatattgcaccacttgccagtgcgcaaactgctgttggatggcctcggcatcggccagttccagcggacgcaggatcaggcgttcggtgtagagggtgggtatcggttgcatgcttgcggcacattccttgtgattggccttataagggcgtttcagcgtccgcccaacaccaggcgttcgctgagaaagtcgacgaacactcgcagtttcggcagcagatgtcgactgccgggccagagtaccgagaacttgccgctgtcgatctgatagtcgtccagcaccgacaccagcgagccgtcggccagggcgtcacgcactacgaagtccggaacgaaggcgatgcccaggccctgggtggcggcgtggatcagcgattccaggttgttgctggtcagggcgctgcgcagcagcagcggtggggcgtcggcgggcaggcgcagtttccattcctgcaattgcacagtgccgggaaacttgtagcgcaggcaggcatgttgctccaggtcccgggggcactcgggcaggccatggcgggcgaagtagtgaggggcgctgaccaggacgaaacggaagggccccagggtgcgcgacttgagctgggagtccgccagctcgccgctgcggatcaccgcgtcgacgccttcggcgatcacgtcgatcagccagtcgttgaagtccaggtccagttcgatctccgggtagcgttcggcgaactccggcaggatcggcagcagcatgcgatagccgatggcgggcaggctgacccgcagcttgccgcggggcttgtcgctgatacgcgccagctcgacttcggcgtcttccacctcgccgacgatgcgctggcagcgctcgaagaacagcgtgccttcgtcggtcaggctgatgcgccgggtgctgcgattgagcaggcgcacgccgagccgttcttccaggcgtgccaggcttttgcccaccgccgaagcggagatgcccaggcgctccgccgcgccgacaaaactaccggcctgcaccgtgcgcacaaaggccagcatgccactgaggttgtccatgggaatctcgattggagcgttaatgtccgtaaagagcggactttagccctgtttgtgggcgattgcggcgaatctaccattgatcgcaccctaacgttccccctgaggtgccgatgaattcgccaaccgatgtgcctgctgccttagatcacactgtcgccagcggttcttcctacgcggtgctggccgcggtgtgcctggcggcgctgatcctgccgctgaccttcgtcggcgtggccgtggcgaccccggccatcggccgcgagctgggcggcggccccctggccctgagctggatcaccaatgccttcatgctgagtttcggcagcgcgctgatggccgccggcaccctggccgacgagtacggacgcaagcgcgtgttcagcctcggtgtcggcctgttcgccctgacgtcgctggccctggctttcgcgccttcggtgctgtggctcgacctgttgcgggcggtacaggggctggctggcgcggcggcgctggcgggcggctcggctgctttggcccaggcgttcgagggcccggcgcggacccgcgccttcagcctgctgggcaccaccttcggcgtcggcctggcattcgggccgatcctcgccggggtgctgatcgaagcctacggctggcgctcgatcttcgtctccgggaccttgatcggcggcctgtcgctgctgttcggcgtgccgcgcatgcctgagtcccgcgacccggacgcggcgggggtcgactggcccggcaccttgagtttcaccgcggcgctggtggcgctgacctggggcattttgcaggcgccgcaaagcggctggggcagcccgctggtctggggtctgctgctggtggcgctgctggcgttgctgctgtttatcgtggtggagctgcgggtcaagcggccgatgctcgacctgtcgctgtttcgttacccgcgctttgtcggcgtgcagctgctgccgatcgccatctgctattgcttcgtggtgttgttgatcctgctgccgatccgctttatcggtgtggaaggctacagcgagatcgatgccgggctgatgatgatcgccctgtccgcaccgatggtggtggtgccgttgctggccgcgtggctgacccgctggttcggtgccgggaccctgtccagcgtcggcctggtgattgccgcgctcgggctctatctgctcagccggatcgccccggggcagtcaccggcggccaatgtcttgcccatgctgttgatcggcttcggtgccggtttgccctggggcttgatggacgggctgtcggtcagtgtggtgcccaaggaacgggcggggatggccaccggcatcttcagcaccacccgggtggcgggcgagggcattgccctggccctggtggtggccctgctggccggcttgctgcaactgtccatggccgcggcgctgccggaacatccgcagctgtcgctggccgcgcagcaactggccagcggcaacctgcaggccagtgcggccttgttgcccgagctgggccgggagctgctgctcgggctctatgccaaggcctttacctggctgctctatgcgctgatcgccatcaccctggtcgcggcgctggtggtgcggctgatgctgcatgagccgcgccggacttgagggcgttcaacgaaactcgaagaactcgtagtgcaggttgcgctcgggaatcgcgtattcgcgcatcaacgccttgacccgtgccagcaagcccttaggcccgcagaaactgatctggatctgttgcggatcggtttcgctggccagccgttgcagggtttcgcccaggcggtcggcgccgtcggtgtggccgatgaaagccaccccgcgctgctcggccaggccctgcaaggtttcgaggctggggaaggcccgtgacgggttgcagcagtacaccagggtcgcctggtcgaagcgcccggcggcggcatcctgcagccatgagataaagggtgagatgcccacgccaccgccgatccagatttcccggccggcatcgagccggcgcttgaagcggccatagggcgcgtagaggtcggcgagcatgccgaccttgacctgctggcgcagcttctgggtgtagtcgcccagggcgcggatcacgaactcgatgcgcccgtcgctggcgtgggcgctggcgatggtgaaggggtgcggttcgcgcaggcctttttcgcgcatggcgagaaaggcgaactgcccggccttgaaggcgaaaccgcggtgcagcggggtcagctccaggtgcagggagtttttctccagggtcacggcgctgacccggtattcgccggccttggccagcaacggatagagcagcagcttgtacagggcgccaagcaggcccaggccgcagagcgcggtgagccagatacccgaggggttatccagggcgatcggcgacttgaagctcagccagtgcaggatgacgatcgcgaacagcggcccggacagcttgtgccaccagcgccactggccgtagggaatgttgcggttcagcgccagcagcacgatcaggccgagggcgacatagctcagttggcgcactatgcgcgtccagtacttggacagctcgatgatcggcacgctttgccagagatccaggttggccttgaacaccaggtgatagctggcgaaaaccagcgcccagatgcccagccacttgtggctttcatagacccggtcgaggccgccgaacagccgctcgacccagcgccagcggctggccagcaggcaggacagggccatataggccagcgccgtggcgccgaggaccaggctcagggtggcggaggtcagccaggtatcgctggggatttccagcagcacggtgagggtggtgatcagcaggacgccgaccaccgagtaccaggttctcaagggggacacctccagaaaaatggcgccagtgtcggcgcataggatgggtcgcaggctgcgggcgggtcagggcgcagccaggtgagggcgcattttactggcgaagcggcagtcctgggctgatctgcatcagcgcctgctcagcgcgggtcgggcaaggggttttccaccagccaggcctgggcgaaatccaggtaggcgcggacgatgttcgagggcgggcgctggttcggatacagcaggtgcagctgttgttccggcatcggcaggcgcggcagcagggcttgcagacgaccgtcgcgcacggcttcggcggcgagaaaggccggcagctcggtgaccaccttggcggtcagcgccagttggcgcaggtgcaggtaatcgttggcggcgaacagcgggtcggggctgtagtactggtcgcccagttgccactgttcccgcgcatcggcctggcgccaccagacggcacaggggaatccgcgaaggtcggcgggggtttgcggggtgccgaggcgctccagcagcagcgggctggcgaccagcatatgccggtagctgccgagcaggcgcgccgggcgctcctcgtcgaacagcggcccggcgcgcaaggcgacgtcgatgccgtcttgcgccaggtcgctttcccgctcactggtatagaccgcgacctggacctcgggatggcaccgctggaactcggccagcagcttccaccagctctcgaatgccgccggcaccgacacactcaggcggccctgcaagtgcattcgatcatttctgacagcctgttcgccctcggccagggcttcgataccgcggctggcgtgttcatagagctggctgccggcggcggtcagccgagtgccgcgggtggagcgttccagcagttgcacgttgaggctgcgttccagttcacgaatgccccggcggatggtggccagcggtagttgcagcaggttggcggcggacgaaatgctgccgcattggaccacgctgacaaacatcctggcggcgttgagatccatgagcgctccctgtcgaatgtagtggaaagcctatcagctgcggctctgcccgatcaaaaatgcgcggtccgcgggcgattttcatcgacggttttttctcccgcgcgggggcggtgcgagggaccgtgccagggatggccacgacaactgtgttctcgacccggcggcgtgcgtctagcagcggtagcttcgcggcggtgcgaggcacgaagtgcgagtctgaacatgcaagcgttgttgaacgagatcctcgacgaggtccgtcccttgattggccagggcaaagtggccagctacattccggcgctggccgacgtgccggccaaccagctggggattgccgtgtatggcaacgatggccaggtgttcagcgccggcgatgccgatacgccgttctcggtgcagagcatttccaaggtgttcagtctggtgcaggccatcggccattccggcgaggcgatctggcagcgcctggggcatgagccttccgggcagcctttcaattccctggtgcagctggagttcgagcgtggccgtccgcgcaacccgttcatcaacgccggggcgctggtgatctgcgatatcaaccagtcgcgtttcgccgcgccggcgctgtccatgcgcgatttcgtgcggcgcctgtccggcaatatgcaggtgctggtggacggccgcgtcgccgattcggaataccagcaccgcgcgcgcaatgcggcgatggcctacctgatgcagtccttcggcaacttccacaacgacgtcgaggcggtgctgcgcagctacttcagccactgcgcgctgcgcatgagttgcgtcgacctggcgcgggccttctgcttcctggccaacgacggcttctgcaagcacagcggcgagcagatcctcacggcgcgccagacccagcaggtcaactcgatcatggccaccagcggcctgtacgacgaagccggcaatttcgcctaccgcgtcggcctgccgggcaagagcggcgtgggcggcggcatagtcgcggtggtgccggggcagttcacggtgtgcgtgtggtcgccggagctgaacgcggcgggcaattccctggtgggcatggcggcgttggaattgctgagccagcgcatcggctggtcggtgttctaagggcgacgggagcattgcggccggctgcgggtgctgcgcacccggtcgcaggctgcgctcggtttgggcggcattccgacgtagcaaccgcaaagcctgagtccacgatctgcctggataagcgtgccggttggttttgcgcgcccgattaccaggtgaagttggcggtcttgggcaggctcagctggcctttttcgacgaaacgcatcgtgccgaacgggccgccggcgagcttgccgcgcagcacatagggcaggtcgtcgaggctttgcgtctggctcaggcccagggtctggcgcagcacggcgaaggccgagacgctgaccggcaccaccagcacaccctcggagaaacgcccgatgctgccactctggtcgctgaccccggaggccagcggccggccgttgacctccaggtccagggccacaccgttgtagttgatcgcggtttcgttggggttctgcaggcgcagcttgatcgcgaagcgtacttccaggtcctggctgggcaggggctcgatgccgaccacattgatattcagcggatcatgctggggaaacagggcgcaggcgctcaggctgagcaacagcaaggaaagggtaaggccgaggaatctgcgcattggaagctctctgcgggaaaggaggcagtagcgaatctagcgcgaccaggtctgcaccacaaaccggggatgcttgaagggcgccatcttctgtaggagccaggcttgccggcgattgggccggcagggctgatatcaggcttgggcccaggcgtctagtggtgtcgccaccgacgccatcgcgggcaagtttcgctcctacagatgctcggggtcaggcgctgggcttggcgcttacatccgggtcctgcatgaccttgagggtcgccgcttccgggtcgaactcgtcttcttccagctcgatgaattcttccggcaggaagatgttcagcaggatcgcgcacatcgcgcccacggtgatcggcgattcgaagatgttgtgcagcgccttgggcagttcgcgcaggacttccggcaccgccgccacgcccaggcccatgcccagggaaatcgccacgatcagcacgttgcgccgatgcagcccggcttcggcgaggatcttgatcccggccacggccacggtgccgaacatgatcagcgtcgcgccgcccagcaccggcttgggcatcagttgcagcaccgcgccgatcaccgggaacagccccagcagcaccagcaggccggcgatgaagtacgccacgtagcggctggccacgccggtcagctgaactcaccccgttgttctgggcgaaggtgaccatcggcaggctgttgaacaccgccgccaccatcgagttgaaaccgtcggccagcagcccggacttgatgcgcttgatgtacagcgggcccttgaccggctgctgggaaatcatcgagttggcggtcaggtcgccggccgcttccagcggcgagatcaggaaaatcaccgccagcgggatgaaggcgatcaggtcgaaggagaaaccgtacttgaacggcaccggcacgctgaccatcggcacgtccggcatcgtcgccaggtcgacccggcccagcagccaggcgaccacgaagcccagggtcaggccgatgacgatcgagcccaggcgcagcatcgggtggctgaagcggttgagcaccacgatggtcagcagcaccagggcggccaggccgaggttgctggcggcgcccaggtccggcgcgccgaagccgccggccatgtcggtgaccgccaccttgatcagcgacaggcccatcagggtgatgatggtgccggtcaccaccggggtgatcagcttgcgcagcttgccgatgaactggctgaggaacatctcgataaaggccgcgcagaagcagatgccgaagatggtcgagaggatgtcctcattgctgccgccacggcccttgaccatcaggccggcgctgagcagcacgctgataaaggagaagctggtgccctgcacgcacagcagcccggagccgatcggtcccaggcgccgcgcctggacgaaggtgcccaggcccgagacgaacagggccatgctgatcaggtagggcgtttcgttctgcaggcccagcacgccgccgaagatcagggtcggcgagatgatgccgacaaaactcgccagcacatgttgcagcgcggcgaagatcgccgcgctgaaatgcgggcggtcctccaggccatagatcaggtcggacttgtagcgcggcgtggagcgatcaggtgcggtcatgggaaaaagcctgccaatgacgtgtcgatagggcatgaaacacgtggagaaaaggggcgcgacgcgggctgtcggaggatgtaaggcaaaatctgcggacccggtcagaaaaatggaggcgcaggatgccagaaaggcgcccgggccagaagggccagccgcacaatcccccagacacgccggtctctgtagccgctgccgcaggctgcgatcggcaacgcagttgccgcaaaacctgagcctgcggtgcatcagacagagtgcgttgtccggattgcggccgcttcgcggccgatcgcagcctgcggcagcggctacggggtttactactgacagatcctgacagggggctctgctaagctgcgccgatctttccctgtcgagcctgatgccatgtcgcgcaccacgcgtttgttgaccctgttgcaagtgctgcgcggcaagcgctgcccggtgaccgccgcggcgctggcggccgagcttgcggtgtccgagcgcaccctgtaccgcgacatcgccgagctgacggccctgggcgcgccgatccacggcgaggccgggattggctatgtgctgcgcagcggcctgttcctgccgccgctgatgctcaacgccgacgagaccgaggccatcgttcttggcctgcgctatgtcgaccagcgtggcgacgaagtcctcggcaaggccgccgccgatgccctggcgaagatcgccgcggtgctggcgccggcggcccaggaagccttgcacaacccgacggtgctgcccggtccgccggcgtaccgctacccggaaaacgtggtgccgctgaatgtgtttcgccaggcgatccgcgagcaggccaagctgcacatcgattacgccgacgtgaacaagacccccagccagcgcctgatctggccgctggccctgggctttatgaacgaggcgcgggtgatcgtcgcctggtgtgagctgcgcgacgatttccgcacctttcgcaccgaccgcatcgccgccgcgagcgaacagggccagcgttatccgggacggcgcagcgacctgttgcgcacctggcgccagcgcatgcaactggacgatgccgggcgtttcactcctgacaagaattgacgcgacggcgttttagcatggctccagcaacgataaacaaggagccgcagcaccatgtccagcacagccacttctctcgcaccggccatcgccgcctacctcgcggccaccaatggccgggacagttcggccgtcgccagtttcttcgccgaagacgcccaggtgttcgatgagggccagcaccaggcaggcacccgggccatcgcccaatggatggaagacaccgcccgccgttaccaaccccggctcgaggtgctcaaggtccagcagcgcactggcaaggtgctggtggacaacctgatctccggcagttttcccggcagcccgttggaactgcgctacgtattccgcctcgacgagcagggcaagatcgcccggctggatatctcgctgtagccgtcgcgcccgcgctcgctgtagccgctggcgcagcctgcgatcggcaacgcagttgccgcaaaacctgggcacgcggtgtatcaggtagaacgcgcggcccggattacggcaactgcgttgccgatcgcagcctcgcgctgctcggcagcggctacacaggcgccgcgttccctgtagccgcagcggtcgccaggtgaggcatggcatactgcgcggcccatttgcggatgcgtggaccccatgcctttcgattcccccctcagcgcctatcagtacgccctccaggagcgcggtttcgtcgccgacgaggcccaggagcgggcgatgctggccctgcagcagtgtcatgtcgccctgcatgaaggacgacgctcgatcaccggggtttatctgtggggccccgtggggcggggcaagacctggctgatggaccagttctatcagagcctcgaggtgccggcgcggcgtcagcacttccaccatttcatgggctgggtccatcagcgctcgttccagctgaccggcaccgccgacccgctgcaggccctggcccgcgagttgagcgaagaggtgcgggtgctgtgcttcgacgaactgttcgtcaacgacatcggcgacgcgatcattctcgggcgcctgttccaggtgatgttcgagcagggcgtggtgatggtctgcacctccaaccagccgccgcaacagctgtatgccgacggcttcaaccgcgagcgtttcctgccggcgatcgccgcgatcgaggcgcatatgcaggtggtggcggtggacggcgcccaggaccatcgcctgcacccgggggcggccacccagcgttattgggtcaccccggccggccagcccagcgccctgggcccggtgttcgaacagctggcgacggggcaggcggtgtccagcgcggtattgtcggtgggctaccgcgaggtccgggtgatcaaggccagcgagcgggtgctctggtgccgtttcgccgacctgtgcgagcagccgttcgccgccatggatttcatggccctgtgcgaccgcttcagcgcgatcctgctcagcgacgtgcccggactcagcgcgcaacagcgcccggggcggattgcccggggcaccgaggatggcgccgagcgagtggtggcgggcgatcgcgagctgccgcagctgtcggtgcacgatgacagcgtgcggcgtttcatcgccctggtggacgagtgttatgaccgcaaggtgccgctctacctcgaagcgcgggtgccgatggaggcgttgtacaccgagggctacctggagtttccattccgccgtaccctcagtcgtctgaaggagatgcagctgcagcgtttcggctgagcacgcctgatcattacaagggagacctgaccgtgaaccagcccctgtcccatcatctgctgaccatggcttaccagaacgcctgggccaatcaccgcctgggcaaggcctgggaaatactggacccgagcgagctggcggcgccgcgggtgagtttctttcccagcctgaaagccaccctcaaccacatccttacctgcgactggttctacgtcgacgcgctggagcgagagctgcgcggcgaggcgccacgggccgactgctatgtgtttttcgaggtcgaggagcccttcgaccaggccgccgacctgcgccgcgagcaggcgctggtggaccgccggctgatcgcctattgcgaacagcaacgggatgtggaccttgcgcgcatcgtcaccatcgcccgggaaaaaccccagcgcgatacccggttgcgcctgctttcgcacctgttcgagcaccagttgcatcaccgtggccaggtgcacgccatgctcagcggtacccgggtggcgccgccgcagctggacgagttcttctgcgcgggcgaggcggcactgcgcgccgaggattttgccgagctgggctggagcgaagcgcagatctggggcgcggaggcggtcgaggaaaaagaacggtagcgcttgacgcgctagccgttcgtttggtcatgtgccgatgtttacaatcgctctcccggggacccgcccggttcaataactgttgaggacaaacatggacgttgcagacgtattggtactccaggccagctacaccaacccggtacacgccgaggcgatcgccctggtgctcaaccactatgcccaggacccgatgggcggcggccagccattggacgccgatctgttgcggcaattgcccggcgaactggccaagcgcccccacgcgttcagcgtgctggcctttgtcggtggcgaaccggccggcctggtgaattgcttcgagggcttttccacctttgccggccggccgctggtcaatgtgcacgatgtgtcggtgatcgataaattccgcggcctgggcctgagccagaagatgctgcacaaggtcgaggagatcgcccgccagcgcggctgctgcaagatcaccctggaagtgctggagggcaacgcggtggcccaggcgtcctaccgcaagttcggcttcgacgacgccaggctcgacccgagccatggccggatgctgttctggaacaaaaccctgtaagcccctggagcccgccgtccgatgaactcatctcccctggatgcccccgtgacccgccgtgacagtgcctggacggtgttcctggtgttcctgcggctgggcctgagttccttcggcgggccggtggcgcacctggggtatttccgcaccgaattcgtccagcgccgcgcctggctgagcgaggcggcctatgccgaactgatcgccctgtgccagttcctcccggggccggccagcagccaggtgggctttgccctgggctggtcgcgggcggggctggccggcgcgcttggcgcctggctgggctttaccttgccttcggcgctgatcctgattgccctggccatgggcctgagcggtagcggcacagggttgcccggcgggctggtgcatggcctgaagatcgtcgcggtggcggtggtggcccaggccctgtggggcatggcccgtgccttgtgccgcgggccgctgcgcatgctgatcacgcttgtctcggcgatcagtgtgctgctctggccgaccacccttggccaggtctgcgtgatgttgctggcagggatgatcggcgcgggcctgctccagccgactttcgaccaccgcgaggacgggctggcgatcaccgtcggtaagcgcacgggctatctggccctggcgttgtttgccctgttgctggcgggcttgccactgctggccgggctctggcccagcctgtcgctgctgctggccgatggtttttatcgcgccggtgccctggtgttcggcggcggccatgtggtgctgccgttgctgcagagcgaggtggtcgcaccgggcctgctgagcaacgatctgtttctcgccggttatgccgccgcccaggcggtgccaggccccttgttctctttttcggcttttctcggtgcggccatcgacggctggcgcggcgcgctgctgtgcctgacgatgattttcctgccggccatgctgctgatcgttggcgtcctgccgttctggcagaacctgcgccacctgggccgggtccaggccgcgctggccggcgtcaatgcggcggtggtcggcctgctggcggcggcgctgtacgacccgctatggaccagcagcattctcaagccgctggacctggggttggccctgctggccctggccgcgctgatgcgctggaagctgccgccctggctggtggtgctcgccggtggcgccgtcggcctgctgctggaggcctgacgccagtgtcgtcaggtgcgcggtgggtgattgagccgggcaaacaccaggcggaacagggtgaagctgcccggcacgctgctgacctcggtccggccctgatgcaggttcatgatcgagcgcacgatcgccaagcccaatcccgtaccgccttcggcgcgcgagcggctgctgtcgacccgatagaaacgctcgaacaggtgcgccaggtgctgctccgggataccggcgccggggttgcccaccgacagcgacacgctcgattcatgctcctccaccaggatcgaaatactcgacgcccgggggctgtggcggatggcgttggacagcaggttggagatcgcccgctggatcatcaggcggtcgccatacaccaggccatcgccggacaggctgatgcccaggtgcttttcctcggcgctcagggcgaacagttccgtgacccgccgcgcttcctcgcccagggatattgcttcgaacgccacctgggaggccgggtggctgacctgggcgaggaacagcatgtcgctgacgatccgggtcaggcgctccagctcttcggtgctcgactccagcaccgccttgtactcgtggggcgggcgctcccgggacagggtgacctgggccttgcccatcaggttggtgatgggcgagcgcagctcgtgggccaggtcgtcggagaattgcgagagctgctgcacgccgccgtcgagccggtgcagcatgaaattgatgctatgggccagctcggccagctcccttggcaggttgtctggcgacaggcgatgggtcaggtcctgggtggtgaccttggcggccacccggctgaattgctgcaacggcgccaggccacgctgcaccacccaccaggcgccgatgccgatcagcatcagcagcaggggcagggcgatcaccgtggagcgcaggtaggcgctgagcagcgcctggtcgttggcccggtccagggacagcaccactcgcacctgttcgccattgcgcaggctgaccaggctggaggtgctgagcagccggttgccggcgctgtcgagccagtcgaggaataccgggctttccggccgggtcagggcttcgggcagcgggcccaggttgcggttgccgatgttcagcagcgcttcggcctggggatcggcggcgaaaatgctcaggtgcaggttgtcgtggcccatcaccaggtccagcagcgaatgcgggcgggcggcgatatcgccggtcttcaggtcgctggtcagggtgtggcggatctgttcgagtttactgtccaggctttcccgcgccaggctgcccagctcgtggctgagggccaggtaggccagggtcgcgagcagcagcaccaggccggcacccatcaggctgacggtcaggcccaggcgcatggacaggctgctggcggtgcgttgcgcggctttcattggcgcacttccaggacataaccgacgccacggatggtgtggatcagcttgatctcgctggcatcgtcgatcttcgcccgcaggcggctgatggagacctccaccacgttggtgtcgcagtcgaagttcatgtcccagaccagggagatgatctgggtccgggtcagcacctcgcccgattggcgcatcagcacctgcaacagggtgaactccttggtggtcaggtcgatgcgccgcgagccgcgataggcccggtgccggcgtgggtcgagctccaggtcggcgacccgcagggtgtcgctcgccggcaggttctcgctgcgccgcagcagggtgcgcacccgcgccagcaactcgggaaactcgaacggcttgaccaggtagtcgtcggcccccaggtccagccccttgaccttgtcggccaggcgcccgcgcgccgagagcatcatcacccgggcgttgctgtccttgcgcatgtcttccagcacctgccagccgtccttttccggcagattgacgtccagaatcaccagttcgtagttttgctgttcgatcaggtaaagcccgtcgacaccggtggcggcgcggtcgactacataaccgctttcggtcaggccctgatgcagataatcggcagttttacgctcgtcttcgacaaccagaatgcgcatggaaaagtgacctcttgatcattaatacgatttcaatggcgctggatatgaagttgttgttggaccagccataaaacccgcgaagttgctgctgataaatagcctcagccgtttgggtcgggggaatgctcaagcctgaagtggctttagggtcaagatttaaagtgcctgatatcaatggcttgtgcctgttttcgacagccggttagctggctgttccaacagcaagccaagcgaagtgattcaaaccgctcatgtgttatttactgtttcaatatatgtctaagtttggcggaaacttatattaatacagccggtaatgacggttgcttagatggcgtaattgtcattttgacgtcagaaagttgataacccatggtcatgtcgctgatatcgacggcaataaaaaaggcgcccgtgaaagggcgccggaagatcctctctggcaagggagcataatcgccagagaggagtagagctcggggtgtttcaggcgtccggttgcgcgctggcgcgggtcgggtcctcggcgggtgcctggggttttttcccgttctcggaggacgtctgttcgctatcggtgcggggtatctgctggctgatggggaagttatcccagtagtgcttcatgcgttcagcgccgccttcggcgaacgctgcacccgagctggcaatcatcagaccggcgagcaggagtgtggaggctttcatatgcgatgtcccattgacggtgatcggtatccgttgcgtccctgtaacgaagcagtgagggaagtctggcgcgatcttattaactaggggttaacaggacgctgaaggcgggatgacaatgctgtcatcccggatgagaggcgctgacggcccacagatatgagccgtgtaggaagaagggcgggttacagcttccagtccaggctcagggtcagggtgcgcggttcgccccagtagacaccgttatagaagccgacccgttcgtagtacttcttgtcgaacaggttggtgacgttgagtgaggccgacaggtgcgggtcgaactcgtagcgcgacatcagcccggccacgctgtaggcctgctgatggatgcgggtgttttcggtgacgatgcgcccgttgccgtcgcgccccaccggccgccggctgctgccgtagatctcgctttgccagttcaggctgccgccgacggtcagcgcccgccactggcccggcaggcgataggccgtcgacaggcgcagcatgttcatcggctcgccgccgttggcgcgctgtttttcgccatccagagcgtgggtgtaggtgtagccggcggtgaggttccagcccgcgaggatttcacccgagacctcggcctcgaacccctgcaccttgccgcctttgccacccgacttgtagaactcctcgccagtgaccgggtccggcggcaccgagctgtccagttcggcgacgttgtcctgcttgctccagaacactgcggtggccaggttcaggcgctcctccagcaggctgcccttgagccccagctcgtagttgctgccgactatcggctccaggtatttgcggctggcgtcgcgctcggtctggggcttgaagatgtcggtgtagctgacatacaccgtgtattgcggggtgaggtcgtacagcaggccggcgtagggcgtccacatgtcgttgtgctgttggtgggtgtcttcgaggctggtcagctggttgttggcgtcgtagcggcgagaacgactgtgggcgctccaactgccgtaacggctgccgagcaccgcgtgcagctcgtcgctcaggctcaggcgggtcgccaggtagccggccttttgccgggtgctgtcgccggagccgggcaggttggtcacggtgtcgggaaacttggcgatgccgcccatgtatttccagtcggcgatgctggcgtaacccggcggcgtcgggccgtcgacggtgtgtggcgacgattcgcggcgctcggcctcgccgtagcccagcatcagttcatgttcgcggcccagcaggttgtagggaccggccaggttgaagtcgtacacgcgcattttctgcgtgccgatcatatggctggtccaggcggtcatgcccgagcggtcggcctccgggaaaccggcaccgccgtaatagaccttgccgtcgctgtcgctgtcgcggtgggtgtaggcggctttcaggtgccagtcgtggcccaggcgctggtcgagggtggcgaaggcggtcttgtccctgagcggccaggagctccagtgcgccgccatgttggtggagcgcggcaggttggccttgccgcccgcggcgttccagtagggcacggtgccccaggaggtgccctggacctgcttgtcctgatagtcgtagcccaccgccagggtggtgctgtcggtcaggtcggcctcaagaatgccgtagccgacttcccgctgcagctggtagtggtcgcgaaacgactggctgtcgcgataggccagcaccgtgcgcccgcgaaggcgtccgtcgaaccccagggggccgccgacgtcgacgtagctgtagtagttgtcgtagctgccgccgctgacaccggccttggccgcccactcgtgggtcggtcgcttgcgcaccatgttgacggtggccgaagggtcgccggcaccggtggtcaggccggtggcgccgcggaccacctcgatgcggtcgtagatgatggtgtccgcatcggacttcatgcgggtgaaggtgttgagcatgccatcgatctggaagttgttgatggagtagccgcgggaggaatagctcacccggtcggagtccaggtgctggaccaccaccccggtggtttgccccaggacctcggacaaggtgtcgagtttgaaatcgtccatctgctggcgggtcaccaccgacaccgattgcggggtttccttgatcgacaggttcaggcgcgtggcggtgctcatgctgccggtggtgtaggacccggtattttccgtggtggcgcccaggccctgggcggtgacgctggtggcatcgagctccaggggcctggcgccgcggtcggggtcccgggcgggttcgctttcggccagcagctcggggctcagaaccgcgccgcacaggccgaatgtcaaagtcatggaacgggtgaatggcgcgagcatcgctgccgtctccttgtcgtcgagggaaaaaatccgtttgcactgagacgaaaaggcggaagggtatttagcttaaacgagaataattattatcttctggatgcaaaaatgccccatgaaagggcattgagggccggtattacggggctgcgtgagccccgtaggaaaaagcttattctggcatcgcttatttctgcacgacttatttctggaccaccgcggtgggtggcggtgccttgggcttcatcaggctgaagtcgatcagggctttctcgttgcgttcataagggttgccgatcagcagcgggcgcggcttgaagctgtcgctgaccaggctcttgctgcggtccagttcgtcggaactcagcccggccatgtcggcccaggtgtggatcaggtgcgagctgctgtaggggcggccgaggtcgccggcgaagttccagtcatggtcctgcttccacttcggcgaagcccaggcgatgaacggaatggtgtacatcggcgcggtcggcttgccttcgttgcggcccagggtgttgtggccggcggagtcgaacacgtcttcgccgtggtccgacaggtacagcaggaagccgttggggtcggtcttggcgtagtccttgatcaggctcgaaaccacgaagtcgttgtacagcacggcgttgtcgtagctgttgtaggttggcacctggtcgtcacgcacaccggccggcacgccagtgcggtcggtgaacttgtcgtagctcggcgggtagcggtactggtagctcatgtgggtgcccagcaggtggaccacgatgaacttgcgcggcgcgccgtcggccagcgccttggagaacggctccagcacgtcgccgtcgtactggcgggcgttctggttgcggttgttgttcaggtagacctgctcgtccgcctgctcggagaaggtggtgagcatggtgttgcgtttggtcatggtctgctggttggtgatccagtaggtcttgtagccggcctgcttcatcacgctgaccagggacggggtcttgaggtacaggtcggggttttcttcgtcggcgaaggtcagcacctgctgcaaggcttcgatggtgtaggggcgcggggtgatgacgttatcgaagatcgccagctggtccttgagcttgtccagctccggcgtggtctggcgcgggtagccgtagaggctcatgcgctggcggttggtcgactcgccgatcaccaggaccagggtcgaaggctggttggccatgctgtccttgaggttgtgcagcggcgggatcttgctcacgttgtcgagcatgccctgcatgttttccagctgctcgcggtagcgccggtaggccaccaccatctgccacggcaccgcgggctcgatgcgcgtctcgaatttctccaggccgccggcgaagctgccggtgcgcgcggtctgcttgatcagcgggtagccgatgacggcgatcaggatggccatggccgccaccagcgcacggccgcgcggcaggtagaccgggcgcaggcgggtccagaggaagagggcgaaggcggtatgggcgaggaacgccagcaccatccaccaggcgaagtactgggtcaggtactcgccggcttcggaggggttcgactcgaacatgatgaagatgacgctctgggagaactcctgctggtagatgaagaagtaacccaggctggccatggaacaggcccagagcaccacgcctatgacggcggccatcgcgcgggtgcgggccgggaacagcagcatcggcgcgagccagatcgcgctcatgatgaacgcctggcggaaaccggcgaagccggaggtgtcgctcagttggatcagtaactgggtgatgccggagaagtaccagaagaacaggaagagccagccaaggcccgcccagtcaaaccctttcgcggacgtcttgtcgcgtttaaacacagccatcgagcgctccagcttcattgaacatgacattcgccggaaagcttcgactacctcggcgaacgcgcgccgcgcccgtgggggcggcaatattgcgccggagtatccataagaaggtgtgaaaactttgtgagttggtacctgcgtgtcagataatgccgtcgccaggaggcgggtagggtaaaaggcgacgggcaaaaagaagccggcgatccatcgaggactcggccggcttcattaacaacctgttgcaaggaccggccacggtgggcgggctcctcggatcctcaggcgtggagctgggtgacggcagccacctgaccctggttctgcaatgccaggcgcagttgcgccagctcttgcttcaactggtcgcgctcgttcttcagttcgcgcaactcgtcacgacggatagtgacgtagagggtttgtgcaggtcgtgccggtagtactgtgcccattgctcacctcgcaaatggcgtgcatcaactgtgctccggccgattgaattacggggcctgaaacactatcggcggcaattttgatttcttttgccggcaaagggaacttttttattttcagcggtcgttgtgccttcgcggcgattcgcgtcgttatccactcactgcttgggaaacactgctttggaaacttagtccggccgctctggactaaccctcactggcctcgttgggctataaccttttgacacaatttagtagtaaggagcatcagcacatgcaactggggattatcggactgggccgcatgggcgggaacattgcgcggcgcctgatgctcaatgggcatgaaaccgtggtctatgaccgcaacagcgcttttgtcagcaccctgagtggcgaaggcgccaagggcgtcgccgacctgccggccctggtcgccggcctggaaaagccgcgcgcggtctgggtcatgctgccggctggcgcgcccaccgaagacaccatcgaaaccctcagccagttgctcgaaccgggcgacgtgatcatcgatggcggcaacacctactataaggacgacatccgtcgcgcccaggcgctggcggaaaaaggcctgaactacatcgacgtcggcacctccggcggcgtctggggcctggagcgcggctactgcatgatgatcggcggcgacgccgaggtggtgcgccgcctggacccgctgttcgatgcgctggcaccgggcatgggcgacatcccgcggaccaaggaccgggtggctgaagacgatcgcgccgagcgcggttacatccacgccggccctgccggtgccgggcacttcgtcaagatgatccacaacggcatcgagtacggcatgatgcaggccttcgccgagggcttcgacatcctcaagaccaaagcctcgccaagcctgccgcaagatcagcgcttcgacctcaacgtcgccgatatcgccgaagtctggcgccgcggcagcgtggtctcgtcctggttgctggacctgaccgccgacgccctggccagcgatccgcaactcgacggtttctccggcgaagtggccgacagcggtgaaggtcgctggaccatcgaagccgccatcgagcaggcggtgccggtcccggtgttgtcgagctcgctgttcgcccgcttccgttcccgccagcagagcacctatggcgacaagatgctgtcggccatgcgtttcggcttcggcggccacgtggagactccgaaaaaatgacctcctcgcgaaagaagtccaaggctcaacccgctccacccaccacactgtttctgttcggcgcccatggcgacctggtcaagcgcctgctgatgccggcgctgtacaacctcaaccgtgacggcttgctggatgaggggttgaagattgtcggcgtcgatcacaacgcgatcagcgatgtggatttcgccaagaagctcgaggacttcattcgcaccgaggccgccggcaaggtcggcaacggcgcgcaagcgctggacccggcgctctgggccaagctggccaatggcatcagctatgtccagggcgacttcctggacgacagcacctacgacgcgctggcggcgaaaatcgccgccagcggcaccggcaatgcggtgttctacctggccaccgccccgcgcttcttcagtgaagtggtgcagcgcctgggcgcgtcggggttgctggtcgaaggcgacaatgcgtttcgccgggtagtggtggagaagccgttcggctccgacctgcaaacggcgcaagcgctgaacgaatgcctgctcaaggtgatgagcgagaagcagatctatcggatcgaccattacctgggcaaggagacggtgcagaacattctggtcagccgtttctccaacagcctgttcgaggctttctggaacaaccattacatcgaccatgtgcagatcactgcggcggaaaccgtcggggtggaaacccgtggcagcttttatgaaaacaccggcgccctgcgcgacatggtgcccaaccacctgttccagctgttggcgatggtcgccatggaaccgccggccgcctttggcgccgatgcggtgcgcggcgaaaaggccaaggtggtgggggcgattcgtccctggagcaccgaagaggcgctggccaactcggtgcgtggccagtacgtggcgggcaaggcgggcggcaagccggtggccggctaccgcgaagaggccaacgtggccgcggacagcaacaccgaaacctacgtcgccctcaaggtgatgatcgacaactggcgctgggtcggcgtgccgttctacctgcgcaccggcaagcgcatgagcgtgcgcgacaccgagatcgccatctgcttcaagcctgcgccgtacgcgcagttccgcgataccgaggtcgaccacttgcagccgacctacctgcgtatccagatccagcccaatgaaggcatgtggttcgacctgctggcgaaaaagcccgggccaaccctggagatggccaatatcgagctggggttcgcctacaagaacttcttcgagatgcagccttccaccggctacgagacgctgatctacgattgcctgaccggcgaccagaccctgtttcagcgtgccgacaacatcgagaacggctggcgcgcggtgcagccgttcctcgatgcctggaagcaaaaggccaaggtccatatctaccgggccggcgaagacgggccggcggccggcgacgagttgctgacccgcgacggccgtgaatggcacagcctcggatgaggggcgaggggcagcatgccatccagttcctgctcagcgacatggacggcaccttgctgctgcccgatcacagcctgagccagcgcaccatcaccgcggtacgcgcgctgcgcgaagccggggtgttcttcagcctcgccaccgggcggccgccgcgggccatgttgcagcagatcgaagccttgggcgtcgacctgccgaccgcggcgttcaatggcggcaccctcgtcaaccccgatggcagtttcctggtgcgccaccatgtgccggtagcggtcgccaatactgtcctggcgctgctgtcgccgcagccggaagtggaggtctgggtgtttgccgacggtgaatggctgctgcgcaacccccatgggccgatggtgccgcgcgagcagcatggcctgggttatccgccagtggtggtgaagcatttcgacgattacctgccgcgcatcgacaagatagtcgccgccagtgccgacaccgagctgttggtggaactggaagcgcgtttgttggagcaggtcggcgggcaggcgcaaatttcccgttcgcagccggtgtacctggatgtgacggcgctgcaggccaacaaggggcaggcgttgatcaccctggcggagtttctcggggtgccgctggagcgcaccgcggcgctgggcgatggtggcaacgacccggcgatgttccagcaggccgggttgtcgattgccatgggccaggccgaagcggcggtgcagcgccacgccgacctggtgacgggcagcaacgtcgccgatggcgccgccgaggcgatcgagcgatttatcctgccgcgctgaagcaaaacctgtagccgctgccgtaggctgcgatcgacccgcagggtcgcggcggtctccagatcgctgaaggccttcggccttatcgcagcctgcggcagcggctacatccttacagccagtagctcaccgcataccagcccagcacccccatcaccagggtgtaaggcaacgccatccacaccatgcgtccatacgacaggcgcaccagcggcgcgatcgccgaggtcagcaggaacaggaacgccgcctggccgttgggcgtggccacgctcggcaggttggtgccggtgttgatcgccaccgccagggtttcgaagtgttcgcggctcatcagtccggaagcgaaggcctgtttcacttcggtgatgtagatggtggcgacgaacacgttatcgctgatggccgacaacagcccgttggcgataaacagcatgcccggctgctggcccgccggcagcgccagcacccactggatcaacggggtgaacagctgctggtcgtgaatcaccgccaccaccgcgaaaaacaccaccagcaggccggtgaacggcatcgcatccttgaacgcgctgcccaggcgatgctcgtcggtgatgccggtgaacgcggtaatcagcacgatcaccatcaggccgatcaggccgacctcggcgatatgcagggccagcgcggcaatcaggatcagcgcggccacgccctgcaccagcagcgccgcgcgttgccggtcggtgcgttcggcgttgtcttcggcggcgtagttggccagcaccgcgcgcacgttgtccggcagcagggtgccgtagccgaaccagcgcagtttctccagcagcacgcaggtcaccagcccggccaccagcaccggcagggacaccggggcgaccttgaggaagaagtcggcgaagtgccaacccatttcatggccgatcagcaggttctgcggctcgcccaccagggtgcagacgccacccagggcagtgcccaccgcgccatgcatcagcaggctgcgcaggaaggcgcggaattgttcgaggtcctggtgatgcagttgcggcaagtgctggtcgtcgttgaattcgctgtcctggcgcgggtcgttgccggacgccacccggtgatacaccgaatagaagcccaccgcggcgctgatgatcaccgcggttaccgtcagggcatcgagaaacgccgagaggaaggccgaaagaaagcagaacagcaggcccagcagcgccttggagcgcacccccagcaacagccgggagaacaggaacagcagcagctccttcatgaaatagatgccggccaccatgaacatcagcagcaggattaccgggaagttgtgcaccagttcgtcgtacagcgcctggggcgtggtcatgcccagcgccacggcttccagcaccagcaggccgccgggcatcaacgggtagcacttgagggccatggccagggcgaagatgaactcggccaccagcatccagccggccaccaccgggccgacggtgaacagcagcaaggggttgagcagcaggaaggcaaggatgctggctttgtaccagcgcggtgaatggccgagaaagttgtgggcgaaagcctgggccagtgaaccggacattggctgctccttgtattgacgaagcgcgcaacttgccgcaagcaccggtgaagatcaagaaactctgaaatcttttgccacaaccttcggccaggccacggtttgcttgtcgatggtcactggcgcggatgaccctcaggttcagaccgggccttgaggcgagagtgagtggcatcgaccgtctgcgttcatcgaagggaatgccgtggaaactaaagaaacttgtcgcgggtggactaacgtctgggtcgaaatgaaataagaagaggagggagtttatggttggtggacaggtcagcagctggaaaaagctgaaagagttgaactttcagataagactcgaagagtcgacatatatcaactgcgacaaaataacgcagatcacccaaaggtgatctgcgtccgttttttttactctggcatggcccaggattgcagtttgtaaccttcctggctcagttcggcgcgggcctgtttcagcaggtcttccagttgcgccgggtcggagtaggcgctgcttggaatctgtttgcggccaatacgggtattggtgcggtcgatgacggtcaggctcagttcgccgttaccgtcttgtggggcccaggcgacgcattggaatggctggaatgcgcggtcggcgatcaaaagtgcttcgttgatacggagcggggcgttcatggggtcttctctctatgtgcccaatcaaatgatgtgccgtcggttgggcttaccgttcggctggttacttgtactgatgtctcgaaccagggatcaggtcacatagaaagaccagaatttacaacttttgttcacacccgcgattcagagccttcttttgaaagctgaatgaaagattggcgcaggaagttaaaccagcttttggatccatgtaacggttagtccaaatggtgattggcgctataaacaatcgatacaagaccccgtcaagtaattgctaatgttacagccaggtttgccaaactattgtttctaataacttttcctatttttggcgccaaggaacagtcatgcttgaagcgaccgccttacgccgcctcttggtggttgacccgtgcgacgattgccatcgtctgctgcctggattacgcacggtgggctgggatgtcgacagttgtgacctggaatcggccgtcgatcgtggctgtgacgttggcttgctgcgtttgcaggcttttcatctggagcgaccggaagcggtcaaggacctgatcagccgcagcggtaccgagtggatcgcggtgctcagcccggacgtgctgcgcctgcagaaggtcggcgatttcgtctgcgagtggtttttcgatttccacaccctgccgttcgatgtctcgcgggtccaggtgaccctcgggcgggctttcggcatggcccgcctgcgtggccaggggcacatccatgtcgctcagcccgagcatgagctgctgggcgacagccgaccgatccgcgacttgcgcaaactcttgagcaaactggcgcccaccgagtcgccggtgctgattcgcggcgaaagcggtacgggcaaggaactggtggccaggaccctgcaccggcagtcgcagcgccacagcaagcccttcgtggcgatcaactgcggggcaatccccgagaacctgatccagtccgagctgttcggccatgagaagggcgcgttcaccggcgcccatcaacgcaaggtcgggcgcatcgaggcggcccatggtggcacgctgtttctcgacgaaatcggcgacctgccgctggagctgcaggccaatctgttgcgctttctgcaggaaaaacacattgaacgggtgggtggcagccagccgatcccggtggatgtacgggtgctggcggcgactcacgtcgacctcgaggcggcgatcgacaaggggcgctttcgcgaagacctgtattaccgcctgaacgtgttgcaagtggtcaccgcgccactgcgcgaacggcatggcgatatcggcatgctggccagccacttttcccacttctatagccaggaaaccgggcgtcggccgcgcagtttcagcgaagacgcgctggtggccatgggcaagcacgattggccgggcaatgtccgcgagctggccaaccgggtgcggcgcggcctggtactggccgagggccggcagatcgaggcccgggacctggggctgctgagcccgcaggccagcatcgcgcccatgggcacactggaggactacaagcaccgggccgagcgccaggccctgtgcgacgtgttgaatcggcacagcgacaacctgagtgtcgcggccagggtgctgggcgtatcgcgcccgactttctaccggttgctgcacaagcatcagatccgctagggcggtgcgacgaaaaggcccgcggcgagaggatcgccgcgggcctttttttgcctggcgtttagaagtagtaggggaatttcaggctgaaggtgaaatccggcgcatcgtcggtcaggccgatggacaggttgggcactatggtcaggttgtcggtggccgccacggtcatgccgacgttgaagtaaccggcgttggcatcgctggacaccacggactgccagtcgccgccgtcttccttgagcttgctcttgcgctggaccaggtccgagaaggagaacgacatactcatcttctcgttcagggcgaaggcgatgcccatgccgatctggaagctgtcgccgagcttgaccttgcccgggatcttctggttgaccgtggagctgatgtcgtcgaacgactcttccaggttgtgcgtgtaggagagggtaccgaacagcaccgccgggtcgaaggtcttgaccagcgagataccgggggtgatcgaccagacgccgttaccggtcggcaggtcatccgggacgaacaggttggtgttgtcctggacctggcgcagcttgatgccgaagggctcttcgccggtcggcgccttgacgcgcaaggtcaacaccgcgtccggggtattgaccgattcgtcgaggaatttgtaggcgatgccgaagttcacgtcgccgagggtcgggtccttggacacggtcttttcgctggtgacgcccgccgcgccgttctgcgcgccgccggactggtaggtcgattcgcggtagaccaccggtacgttgacgtcgaactgccaacggttgtccaggttgtagcgggccgtaaggtcgagggtccagttgtcggccttgatccggtccaggttgatgttgccgaggaaaatcgagtccagcgccaggaagccgttgagaatcagttgccgggtgtcataacgggagtaggtcaggccggtctcgacactgaacttgccgccgccgaagaagccgctggcttcgtcgtacaggttggacacgctctgcgccggttgcgaatcatccttgagcgattccccgtaggaactgccgccggccggggtcgggcctttgctcgtggttccggccacctgctggttgccacgcatgtccgctggcgacttggccaggcgtttcggtggtggctccgccggttgctcctcgacctggcgcacccgttgttccaataccgccagtgctttctgctgcacttcgtaacgttgcttaagctccagtaattcttgtttcagggcctctatgtcggcatccggcgctgcctgcagcagcgccgccggaaagagcgtgctcaaacatacaactgcgcgcagcgagactgatcgatacatgaataagccgtccctttaagcctaatgatcgagaatcagcgtagttcaatatcccaggttgcgaagacctttgagctgggtcaggttgcagtccaaagcgccggtgctcgccccgttattgttaagcacgacgttcagttgggtcaggttgctgaccaggttgctgtcgcccagcaggcgggtgttctgcagcaagccgccctgggccacttgttgcatggctgagccctggttgttattggcctggatggccatctggatgccgccaccggtggcggacacggccacgctgcccgcggcgttgctgccgctgatggtttgcccgctcatcaacagctggccttgcgccggcaccagcgccggagcatggctggcttccttgacgtcgatggaaacgttgttataggagctattaccatcgcccgccgcgcgtacgctctgggtcaccccttgggtggtggccaggcccgcgccgccgatcacgttgcccgagccctgggtcggcgtcgagccgttgccggtttcgttgatcgtggagacatagaattctggcttgatcgtcgattgctggatctgcatggaggtcgtggcgccgatcagatcgcccgaggcattgcgccaggtgctgctcatgacaatgccgaagctgatgatccgccctggcatgacgtagcgaccgcggagctcggagagttcctggtccttgatttctataggcttgaaccctgcgttggcgtacgcaggaaaacttgtgaccaggcaggcagcggccagccagtaagcgcttttcatctgctgctcccggagcatcctgcccctttatccttagggcgaccctagaagaagtcgctctgaatgaaaccgaattccatcagttctgcgtctttgaccggattgaaggtatccagcttgttcttggcggtcagcgggttgggcgggtcgagcaaggcgttggccttgtcgtagccggggccgacgatggcgaagacgataccgttccagcctttgacaaagtcttcgtgggagtagcgtttatggccgaggacgggatcgccgatatagacccagtctttctgcgcccgctgcatgaccacgaagtgcttgtaaccacgaatgtccatcagcaccaccaccggaatggagaccgcctgcagtttgtcgggaggtatccggtagccccgggcgcgcatgccgatgctttccaggtagcgcttcatgtccagcatggagaagccctgggtacgcaccaggtcctggtcagcggtggccagcatgcctttgatgacgtgctcctcatcgacgtcgagccagtaggcctggcgcagcactgtcgccagcgcggcggcgccgcaactgaagtcggttttctgctcgaccagatcggcgaatttgcgctcccgcacgctctgcacctgcttgtacaccaggttgccgccaggcagcacggccaccggcatctgtgcggcctgagccaggccggtcaggcaaagcaaaagggagaaggtcgccattcgcatgatcgctacgccttgtgggactgtggaaaagccccgtttccggggctttcgtcactctcgtgattacaggcaggctctgcagccggcagcgatggacagcgagttgctttgttggttgccgacacccgccgagacgttggcgccgccgtttccggagaagccgttcatcgagccagacatcgacgcgttgttgatcacagggtttttccagccgtccttggtcagcacttgcttggtccagacgccggaaagttcgatcgtgccttgttccttgaaggtgaacttctgatcgtcgttatcgtggccgccgccgcgacgatcgtcgttgtagccatggtgatcgtcgtcgccttcgatcttgccgtagccggtgcctttgtaggtgcccttggcggagaaagtgctttcaagagtgtcttttttgtaggtacgcacacccctgttgtccacgtccaggccagtggaagtctggtcggccgaagctgacgcggtcgctacgcgtccgccggatacggcgattgccaggttgtttttctgttggttgaagtcgccggcggtgacgttgatgccgatgttgccggagccgctgttgcctgcattgtcgagtgtcgcgctgttttgcgtggaccagtttttcaccgtgttgttggtgttggtctgggtcgcgctggaagtggctaccgcgctgccgaagatgaagctttcatcggcggtggccagggcgacggcgttgtcttgctggttgccgtcgccggcggccacgttggcgcccatgttgccgttggagttgttcatcgagtcgctggcgtcggcgttgttgtgggtgccacggttgctgacgctgttgcccgagctgaactgctcatcggttacgttggccacggcaccggcggtgagttgcagcttggtgttgaggtcttggccgccgccgccatgacctccatggccgccgtggtgaccattgtgaccgccatggccaccgtgaccaccgtggttgtcgtcattaccgcctgcctgtgcagcgatcgccatgaccgcggcgagggcaaagaccagtggcttgagagccattgtaggtttcatggtgtttctccgtgcttatttagttggttaagtgtcggtaccttccaatcgcactgctgcgggtcagtcagcgacccgtatgctcagggtgttagccattcggttccccaccccggcactctggttcacctgaatcactccccggctgccggtgaaggcctggtcgctggtaacgacctggcggctgcctttagaagcgtcagttgctcccgagcctggtaacagcgccacgttctgttgggacaggacgctgtcgtcgatgctttgcggctgggcactgatgctcacccgcattgcgttgaccatctggttgttggccccggctccctggttcacgcccaggaccccgttgccgttgctgaaagcgttgccgccgatgctgctggtggcgtcgatcgcgctgctggccggggtgccgagcttctgccggaccacggtggtggcctgggcgtcggtgccgatggcgatggcgcgtgtgttggtctgttgctgctggtcgccggcggcctggttgacgttgaagttgccgttgtagcgggcgccggagttgtgaagggtggcggtgtccaccgcctggatgcctgggtcggccatcaccgaagcgcagccgaacagagcaagccatacgagggtacgagtcatctcattggcctccggccagtctgcccaaaggagccaggccagaattcaacgagcggttgatggtgccggagatggcgccaccgctgccgccgccgtggccggcgctcatgccggccatgccattggggttggcgacggtgttcagcccctgcaggttgacgccgttgggcatgacgctgctgctgatcgtggaaccgctgctgaccccggcaaaatcgccgtcgctcaattcggtgttgctggtcatctgtttgacccgggccgacgggttggcattgacggtggtcgggtagggatcaggatgcagcggagggcggccgacggtatgaggttggacgtcgcggtcgagaacgatccggccgtccctgatgtcgccggcagcctggaccgggaggctgagcagcgagctgatggcacagccgatcagcaggaggtgggtcagagctgaattgcgattctccacggcagcattcccttcttctgtcgctggccctagccggcgttgcgagggagagagcagaagccgtgccgcctttttgattgtttcaaagattcaacaggttacgaataaccaagggtgttacagggacaggtgtgtttcaacgatgagaccggtgtcgcctccggcagcccggcagtaccgtggcgacgctctggatcgggggctcgcgccgggttgtatcagcgctttaacagatggcagaagggcaatgagaagccctttgatttggccgctttgcgtagcggcgggtgtttcaggagtggacatttgtcctgcttgcagaggagaaagaccgtggacaacaaaggtttcggctaaccctggagcaggcgctcgaccagctcgaatgcccgttgccgacgggcttcccaatcgccgcgaatcacttcgaagggctgctggtgctgcaccagccaatcaccggtggccttgaagaaggccaggcgctcgctcagttcgggttggcagcgctggccgtcgtttctccagccgacatcttccggggagagtagcaggtgcaggtcgtagcagcgagccagcagctcgggttccagccagtccgggcaggcgccgaacagggtctggctccagagcatattgctcagcaggtgagtgtcgagaatcagcagcggcgggtgttgcgcccgggcctggtcttcccaggccagctggccgcgggcaatctccgggatatccgccaggcaggtgtcgcgccggtgctgttcgatgaaatggcggacgtactcgcccacctggatgccaccgaagcgcgcctgcaagtggccgctgagccagcttttgccgctggactcggggccggtcagtaccaggaccttcatgccgggcgcaacgccgggtcggcccgccaggcgcgccagccctgcacggccagcagggtgaacagcccgtacagggccgctgtcaggtacaggtccttgtagatgaacaggccgacaaaaatcacgtcgacggcgatccacagcggccagcattgcacgcgcttctgtgccatccaccattgcgccaccaggctgaagccggtcagcgcggcgtccagccagggttgcgcggcatcggtccaatgggccatggccgctcccagcagcaggctgccgacggctccgaggctcaggccgaacagcatcgagcggggtgccagcaggctgaccggacgcccctgatggctggcgccaccgcgggtccactgccaccagccatagagttgcagggcggcgtagaccacttgcagcagcatgtccgaatacagcttcacctcgaagaagatccagctgtacagcagcaccatgaccaggccgatcggccagcaccaggggttctgtctgactgtcagccagacagcgatcacgccgagtgcggcggcgaacagttcaagcccggacatgaaaactacctggaagcggagaagggtgcggattgtaaccagaagcggccttgcatgttagtgaaggccggcaaccgtggcggggcgtaccccgccacggccagcttcagacccggaactggcgcaacaggccgttgagctgctcgctcagttccttgaggtgcaggctggcggcactggattgctcggccgccagggcggtgctgtgggacaggccggcggcctgggtcacgttctggttgatgtcttcgaccacatgggcctgttgcaacgtggcgctggcaatcgaggcgttcagcccgttgaggttgcgcagggcctggccgatggcgttcaggctttcaccggccagcccggcctgctcgatggtctgctgcgaagcccggctgctgtcgccaatgactttcaccgcggcttccgagtgcccttgcaggcgctcgatcatcgactggatctcggcagtggatttctgcgtccgctgggccagcaggcgcacttcatcggccaccacggcgaacccacggccctgttcgccagcacgagcggcttcgatcgccgcgttgagcgccagcaggttggtctgctcagcgatcgagtggatcacctccagcacgctgccgatctgggtgctttcctgggccagggtgcgaatcacttccacggcctggtcgatggtgcccgagagccggtcgatctgttgcaggctgccgtcgatattgacctggccctgctgggcctgggcttcggcgtcgcgcatctcgctggcggcgtgttcggcgttcttcgccacgtcctgtacgccataggtcacctggttgatagcggtggccaccagttccatctgctgcgactgctgctggctgcgctcctgggcctggctggcgttgctgcccaggtcggcggaggattgcgccagggcgctggccgacacctgcaactggctgacgacaagacgcagcttggcggtgaagccgttgaagtgccgggccagttcggtgacttcgtcctggccgtgggtgtcgagggtgcgggtcaggtcgctttcgccgctggcgatgttggccatggcgtgcacggtttcctgcaacgggcggacgatgctgcgggcgatcagcaataccagcagggccatgagcagggcaatggcgataccgacgaccgaggccttcaccacctggctgcggaactcggcctgcacgtcatcgatgtacacccccgaaccgatgatccacccccagggctggaacagctggacataggaggtcttctgcaccggctcgctggcgcccggtttcggccagcgatagttgaccatgccggcgcccttggccttggcgatggctaccatttcgttgaacacggcaaagccgtccgggtcgcgaatggccgcgaggttctggccgtcgagcttggggttggtcgggtgcatgaccatgaccggagtcaggtcgttgatccagaagtagtcgctctggtcgtagcgcaggttgcgtatggcgctcagcgcctgcttctgcgccgtcgcgcgatcgaggctgccggcgctttccaggccctggaaataggccagcacgccgttggcggtctgcaccacgtgctgggtcttctgcgccttggcctggtacaggtcgtcgcggatctgcttgagcatcagcatgcccagggtcatcagcatcagtaccgctacaatcaggatcagccacagccggcggctgatcgacattctgcgtaagctgttcatgaatctgtcactcccgattgttgttcttgtaatggaaacaccccgtacatccgtcatgcgctccttgcagtcaggtccatcggattctcgcaacgcgacagcgtttatcgagtatgtctgataggatttcggcctcatcgcgaaaaacctgaatccggctgatttttcacggaattttcaggggcgatgatgatcctattgcggctgcgaagtcgcgatgcacgcgtcagtgaacattgaagaaaaactaaaaaggcatgccacggcatgaccttcgggggattgatggagctttggaccgccgtacaggcattgattttagggattgtggaagggctgacggagtttctgcccatcagcagtacgggccaccagattatcgttgccgacttgctcaacttcggtggcgagcgcgccatggcgttcaacatcatcattcagctgggggccattctcgcggtggtctgggagtttcgccgcaagatcctcgacgtagtcactggcctgccgacccagcgcaacgcccagcgtttcaccatcaacctgctgatcgccttcatgcccgccgtggtgctgggggtgatcttcgccgacctgatccatgaatacctgttcaacccgatcaccgtcgccacggcgctggtggtgggtggcctggtcatgctctgggccgaacgccggcagcatgaaatacatgccaacacggtggatgaaatcagctggaaagatgccttgaaggtcggtttcgcccagtgcctggcgatgattccaggcacctcgcgctcgggctccaccatcattggcggcctgttgttcggcctgtcgcgcaagaccgccaccgagttctcgttcttcctggcgatgccgaccatggtcggtgccgcggtctactcgggctacaagtaccgcaatctgttccagccggacgacctgccggtgttcgccatcggcttcatcacctcgttcatcttcgcgatgatcgcggtcaggggcctgctcaagttcatcgccaaccacagctacgcggcttttgcctggtaccgcattgccttcggcctggtgatcctcgccacctggcagttcggctgggtcgactggacctcggtccactcctgatgaacgcacgcaatcagagccgccccggcgaagtcgccggggctcggatccagcagccaaggctcaaggcggtggttttcctgctgctctgtgccttaccgctgtgcggttcgctgctactgggcatgaaggggatttcctgggtgccgctggcggcctacggcgcggtcagcgtgctgacgttcttcctctactggagcgacaagcgcaaggcccgcagcgacagctggcggaccccggaaaacgtcctgcacgccgtggaactggccggtggctggccaggtgccttgctcgcgcagcaggcgtttcgccacaagacccgcaagctgtcctatcaactggtgttctggctgatcgtgctgctgcaccaggtgttctggatcgaccggctgtttctcgagggcagcctgttctcgctgttctaggttctttacgaaaagtcggcgagcgaaggtcaggcaaggcaaaaacaggcgaggaagcggagtttaggggcctaaatgagcattccgagcctgtttttaacgcagcatgaccgagcgcagccacttgtcgtacagaacctagagtaacaacccgacctggacccgcttgggcagcttgctcaccaccaactggtgcgaacgctgcagcaagtcccgcagttcaccggcgcccagcgggtagggcgtctgcatgatgatccagtgtgcccgggccaggtacggcgccgggccgatgccgggacggtcgacatggccgaggaacagctccttgtccaccttgaacgccagtgactcgccccgcaggttctgcagggcgaacatcttgttgccggccacggaaaacacccgcacgccaccccatttgtagtcttcgcgcgcgcctggcaagtccaggcagaattgcgccacatccgcttcagtcatggttttttccttttgtcgcgctgtcacagtgtgcggtctccgcagcctttgaacgcttcgctgacatgctcgatccacgccctgaccgctggcaatacaccgcgccggtgagggtagaccgcctgcagccagccgccgggcaacgaccattgcggcagcagttgcaccagttgcccggcctgcagttcttcctcgcaatacatcatcggcaggatggtacagccaaggccggcgagggcgcaggagcggcgcaccagaaagtcgtcgatgcccaggcgcgcctccaggaccaggtcgcatttctcgccctgggcgtcgagcatgcgcaaatgcaccatgcggtcggcctccagggctcccagcaccggcaccttgtgcaggtcttcggggctgtggattggccattcccgggcgaacgccgggctggcgaccatcacggtctgcgcctggcgcaggcgccgggtcaccagcaagggatcttcgtcgccatgctcgcgaacccgcagcgctacgtcgatgccttcggcgaccacgtcgacccggcggttgagcaactgcatctccagctggacctggggatactgctcgaggaacgagctgatgacgctcggcaacatatgatgggccaggcccaccgggcaggacacccgcaggcgcccgcgaggttcgctggacatgctggccacggcctcgtcggccatttccgcttccagcagcatggcctggcagtgacgcagataacgttcaccgaccgcggtcagcttcaattggcgggtggtgcgttgcagcaaccgggtgtgcaggcgttcttccagttcggcgatacgtcgcgacaaacgggatttgggcacccccagtaaacgcccggcggcggcgaaaccaccggcttccactaccttggcaaagtaataaagatcgttgaggtcttgcatatcctgactcgactgtcctgctgatgggacaaactatcgcatttatgccgactaatcagctattggtttcatctgtaggattatcctcaattgatcgcccggtggcgatcctcacttggagaatcccagatgaaactgttgcatatcgattcgagcatccttggtgacaactcggcttcccgtcagttgagcgaaagcgtggtcaaggcctggaaaaacgccgatgccagcgttgaagtgacctaccgagacctggccgccgatgccatcagccatttcagctccgccaccctggtggccgccggtaccccggccgaagtgcgcaacgctgcccagcagcacgaagccgagctgagcgcttcgaccctcgccgaattccaggccgccgacgcggtagtgatcgccgcgcctatgtacaacttcaccatcccgacccaactcaaggcctggatcgaccgcatcgccgtcgccggccagaccttccgctacaccgaagccggccctgaaggcctgtgcggtggcaagaaagtcgtggtggtctccaccgcgggcggcctgcatgttggccaggccactggcgtggctcacgaggactacctgaaagtgctgttcggcttcctcggcatcaccgacatcgaattcgtccgcgcccacggcctggcttatggcgacgaagtccgcaacaaggccctgagcgacgcccggacgcacatcagcgagcaacttttcgccgccgcgtaaggcttgtgtaaaagtcgcttacgccccaggcaaggccctttaaactctgtattctgatgccctccaggcagcggaatacggagtttttcgcgttcgcgctatttgttctggctcgggttatgcagtggcttgaccaggcccgacagctccaggcaacaggccagcgaattcctggccagtgaagcaatgaaccggcgttttcatcaggtagggaaggtggtgcatccatgatgcgtctttgggcaatgtcactgatctgcctgctcggcggcccgattatcgtgcacgccgcgcccgcgccccatccgcactggagcgtgggcttccacgagatgagctttctcgacccgctggaccagcagccgatgcgtgccattgccttctatccctccaccggcatcgaacacagcagcaaggtcgagggttatcagctcgccgcctcccgggattcgaaggtcgccatcggccgttttccgctgttgatgctgtcccatggcaataccggcacgccgctggccctgcacgacctggccacctcgctggcgcgcaagggcttcgtggtggtggcggtgattcatccgggcgacaactacaaggatcacagccggctggggaccctgagcaatctctatggccggccgatccagatttccgaagccatcaccgcgaccctggccgacccgatgctgtcgcctttcgtcaacgccgggcaggtcggggtcatcggttactcggccggcggcgaaaccgcgctgatcctgtccggagcgacccccgacctggaccgcctgcgtcgctactgccaggagcgccccgacgatcacgatgcctgcaatacccagggtgagctgattgtcgatcgcgacgacctgcaaccggtcgccgacccgcgggtccaggcgttgctgctgatggcgccgctgagcctgaagttcggacgccagaccctgtctggcgtgcatgtgccggtgctgctgtacagcggcgacgtcgacaagctggtggccctggacaagaacgccgcggccttggcccgcaagctgccggtggcgccggacttcaggttgttggccggggccgggcacttcgtgttcatggcgccgtgcaccgaggagcagttgctgagcatgccggccttatgcactgacgccgatggcgtcgaccgcgaggacatccaccgcaatctgatcgccgaggctggccgcttctttgcccaggccctgggcaagccgagccgggccgggatgcagaccgcggatcagtgaatcaggcgtcggcccggcgcttgagcagcagggtcaggcccagggcgctgagcgacagcagcgccgcgcagaagaagatccacgaataccccaggttcaacgccaccgcgcccatcaagggcccggcaatcgccagcgccaggtcgaaaaacaccgcgtaggcgctcaggccggcgccgcggctggtgctgggcacctgcttgatcgcttccacccccagcgccgggtacaccagcgacaggccgaagccggcgagcccggcgccgatcatggcgaacgccgtcgatggcgccagccacagcagggtcaggcccagggtctcgatgctcatgcagccgatggccgcgcgataaccgccaaaccggctgatgctggagatgaacagcaggcgcgagaggatgaagcagataccgaataccgtcaggcaataggccgcgccggtccagccgcggctgaggtagaacagggtaatgaaggtggtcagggtgccgtagccgatggacgccaggctcaggccggcgccgtacggcgcgatacggccgaacaccgcgcgaaacgacaggcgctcgccgcggatcaccggcaccgatggcttgttgcggatcagcagcagggccagggccgccagcagcgatagggccagccccaggctttcgaaaccgtagtcggcgaccatcaccacccccaggggcgcgccgatggcaatcgcgccataggaggcgatgccgttccaggaaatcgagcgcgcggtgtgctcggcgccgacctggcccatgcaccagctgatggtgcccacgccgatcaggccctgggccacccccagcagcaaacgtcccagcaacaggacgctcaggctgagcagcggcaatgtttgcaggagggtggacgccagggtcagcagcccgctgaggaaaatccccgccaggccgtagacgatcgcccgtttggtgccgatgttgtccgacaggcgcccggccatgggccggctgaggagggtggccaggtactgcgagccgatggtcagcccggccaccaccgcgctgaagcccagttcgccgtggacgtaacccggtagcaccgcgatcggcaggccgatgcagagaaacgcgataaaggtatagaagacgatagagacgatctgcagggtgatcgccatggagctgggcacgggctgttgttgcgcagacatgagggctcgttcgcgggcgggcggttggagaaccgcatcatggcgcgggtcggaaataaaaggaagcaggctaacgatttctttatggctgggtatttgcggtaccagggaccagctcagcgcgagtcgctgcttttatataaggcataaaaaaggttcttcacggattaccgggaaagacgctcttgatcttcatgaaaaagaattcgctgtcccggtaaccgtacgccatccgcttgatgaccttgattcgattgttgatgccttccaactggcccgtatgcattggccagcgcacccggctgacgatgccccgccagtaacccttcagtcgtttggcaaactggatcagaggcggtatgtcgctttcatgcgcatggcgcagccattgtcgccaggctgatcgccagccccaggcggtgctcggtgtccaaagcgttttgagttcagccttcatcaaatagaccgtcatcaacgcttggttggccgccagcagatcctccaggcggacttgttgttccggcgttttcaggttctgccgattgcgcagcaacagccatcgcgcctgcttgatgaccgtgcgggcaggcttgtcgtgacgtagccgattcgcttcatcgacgcggactcgatcaatcacctctcgaccatacttggccaccacatggaagaggtcgtagaccacgcgcgcttttgggcagtgctgacgaacctccaggtcaaaggcagtgttcatgtccatcgccaccgcttcgatgcgagcgcaaccctctgaccccagctcttcgaaaaagggtctgactgccgcccggctgcggccttcgccaatccacagcactcgccgggtatcggcgtccagcactacgctggcgtaacgatgacctttgaacagggcaaattcgtccatgaccaagcgctgtggctgcgcctttggcaaaacactcaatgccgcttgcaaggcgcgacgttccagcaagcgaacgctgtcccaatgcaacccgaacagttgggccacgtgtagcgtgggaaggcgctcgcaggcctgaatgaccgcatcggccaggcggcgcgtcatgcgggcatagcgatccagccaactgacggcctccatgcgtttgccacagtcccgacagccgacacgccgaagcaaaacgctgaggcgcactgctcggccaagaatgggcagatcgcggatgactcgctggcagtactcatgcgtggttgaacagagtttttggcagccgccacaggaagggaatcgggtggcgtggggaatcagatcgatctggagcgcgtcaccatcaggcttgatcgtgacgacagaaaagccctcccaaaagggaaggaaagtattaatatcacgcataagaacgccggtttgttagatgtgtttgctcgcacgaacatcatcaatcaaatcggcgttcttgtttctgtgtttcccgggattccgtgaagaaccataaaaaagccccatcaccaggacggggcttgcagactggcaaccaacgggcgttccttagaacaccacgccctggctgcgcaggtagtcgtcgtaggtgccgctgaagtcggtcacgccgttcgggctcagctcgatgatgcgagtggccagggacgacacgaactcccggtcgtggctgacgaagatcagcgtgcccgggtagttttccagggccaggttcagcgcctcgatggattccatgtccaggtggttggtcggttcgtccatcaccagtacgttgggcttttgcaggatcagcttgccgaacagcatgcgaccttgctcgccaccggaaatgaccttgaccgacttgaggatctcgtcgttggaaaacagcatgcggcccagggtgccacggatgatctgttcgccctgggtccattggcccatccagtcgaacaggctgacgtcgtcttcgaagtcatgggcgtggtcctgggcgtagtagcccagctccgcgctttcggtccacttcaccgaaccggcgtcgggggtcagctcgcccatcagggtgcgcagcagggtggtcttgccgatgccgttcgggccgatgatcgccacgcgctcgccggcttcgacggtgaagctgaagttcttgaacagggtcttgccgtcgaagcccttggacatctgctcgatggtcacggcctggcggtgcagcttcttggtctgttcgaagcggatgaacgggctgacgcggctcgatggcttgacctcggccagctggatcttgtcgatctgcttggcgcgggaggtggcctgcttggctttcgaggcgttggccgagaagcggctgacgaaggtctgcagctcggcgatctgggctttcttcttggcgttgtccgacagcagttgctcgcgggactgggtcgccgcggtcatgtactcgtcgtagttgcccgggaacaggcgcagctcgccgtagtccaggtcggccatgtgggtgcagacgctgttgaggaagtgacggtcgtgggaaatgatgatcatggtgctgttacgcgccgtcagaatcgtttccagccagcggatggtgttgatgtccaggtggttggttggttcgtcgagcagcagcacttccggatcggagaacagcgcctgggccagcaagacccgcagcttccagcccggagccacttcggtcatcgggccgaaatgctgttccaggggaatgcccaggcccagcagcagttcaccggcgcgggattcggcggtgtagccgtccatctcggcgaagtcggtttccagctcggccacggccatgccgtctgcttcgctcatttccggcagcgagtagatgcgatcgcgctcggccttgaccttccacagctcttcgtgacccatgatcacggtgtcgatcacggtgaattcttcgtaggcgaactggtcctggcgcaatttacccaggcgaacgttcggctccagcatgacctggccgccggacggctcgaggtcgccgccgaggattttcatgaaagtcgacttgccgcaaccgttggcgccgatcaggccatagcggttgccgccgttgaacttgaccgaaacgttctcgaatagcggcttggcgccgaactgcatcgtgatgttagctgtggagatcaattactttacctatcaaggggttgcgagcatcgtgtgggctcttgggccattcccggggcattctggagcttttccatttcgccagggtcgagccaggggcgagccagcgagcataagtagacagcaacatctggacgctatggccaagttgctgggcaataaaggtgggaggtcatgttggaatttggcgcgcattgtcgcatatgtgcgccggcagttgtatgacagtgacccacggatttttcatccaggccggtaagcgtcaagcgttgtaaaaatcaccgctgcggatttgtcccgggcaatgcgacttaggtcgtggcacggcgggcggacacattttcacaaatcggagttaacctttggttacaaactgtggctaaaatgccgaccagttgccacatgccatcattggcatgggctcagggacgtgccttcaggacctcttatcgctttcggacgctgcatatgaccccggcccaggtggcctacgtgggggcgcagtatgttctcttctgacatgtgacgatttccgtgaaactcatcattgccgctgtttacgttttatccattgcgtatgtgcacctgcgtggtcgcgtgcgccataaactgggccgtcagctgagtgatcactcgaccttcctggcgcccatcaactgcttcctttatctgttctcgaagatccccaaccgcccgtacctcgatccggccgactttcccgacctgagcccgttgcaggcccactgggaagaaatccgcgccgagggccagagcctgctcagggccggggagatcaagcgctcggagcagtacgacgacgtcggcttcaactcgttcttcaagaccggctggaagcgcttctacctcaagtggtacggcgacagccatccttcggcgatgaagctgtgcccacggaccaccgaactggtgcaaagcatcggctcgatcaaggcggcgatgttcgccgaactgccgccgggttcgaaactggtgcgccaccgcgacccttatgccggttcctaccgttaccacctgggcctggaaacgcccaacagcgccggttgctacatcaatgtcgacggtgagcactatcactggcgcgacggcgaagcggtgatgttcgacgagacttacatccactacgcggaaaacaccaccgagcagaaccgcatcatcctgttctgtgacgtcgagcggccgatgaagtaccgctgggccgccgccttcaaccgctggttcagccgcaccgtgatggccgccgccggttcgcccaacgatgccggcgaccgcaccgggggcctgaaccgcgccttcaccaggctgtacaagatccgcctgcgcggtaaagagctgaaaaagcgcaaccgcaagctttattacctggaaaaatgggcgatcttcgctgcgctgttgctgctgttcatcttcatctgattcgccgcacggcgaatcgctgatcgcgggcaagcctcgctcctgcatgagctctgcaggaacgaggcttgcccgcaatcacttcctcaaggcttgtccgcccccaattgctgccacatcttcgcggtgatccgctgccgatgggcgtagccgtgccacggatcctcggtcaaggcctccaggcgctgactcaggttcgccacattccactgctgggcatgtcggacatcgcccagctcatcccgggcgataggcaccgagaccggcagtcccgggcgggcccgtaccgaataggcggccacagtgctggcgccgcgggtgttgcgcaggtaatcgacgaagatcttgccgacccggtttttcgggcccatggtcgcggtgatgcgttccggcaactgctgcgccatgaactgcgcgacggccttggcgaagcccttgaccgtttcccagtcggccttgcgcgccagcggcacgatcaggtgcatgcctttgccgccgctggttttcaggaaggcctgcaagcccagctcatcgagcaccgacagggtcagttgggtggcttccagcatgcttttccagggcagggccgggtccgggtcgaggtcgagcacgaacaggtccggggtttcgatctggtcgtgggtcgcgccccaggtgtgcagctcgatggtgcccatctgcactgcgccgatcagcgccgaagtactgtcgatttccatcagtcgtgcgtggccggggtccagcgtcgggtcgaggtgacggatattggggatggccaggtgctcggcatgtttctggaaaaactgctcgccttccactccctcaggcgcccgcagcaacgacaccggccggtcgcgcaggtgcggcaggatctgctggtcgatgctggcgtagaactgcgccagttgcagcttggtggtgccggactgctggtcgatgacccgttccgggtgagtgatcttgactccggcgacgctgtgggcggccgacttatccgaacgggcgggcgtgctccggctgtggggctcgacggccttggaggtctgtggccgctcgcggacgatttcgctggccggcttatcgctgcgcagggcgatgaaggctgcctggcgcaccacctgttcgcgggtccactcggcgaactcggcttcggccaccagttgcggttcgatccagtgcacgccgcgggcctgggccgcggtcaggggcttggccaggggcgatgaatcccgttcaagttcctgcatccgctcatgcagctgcttcaaggtcttctggtcgaaaccggtgccgacccggccggcgtacaccagtccgctcgcgtcgttgacccccagcagcagggcgccaaagccgctgcgcgaaccttgcgggcgggtatagccgaccaccacgaactcctggcgcagccggcatttgagcttgatccagtcggcgctgcggcgcgacacataggggctgccggcccgcttgccgatgaccccctcgagggacagggcgcaggcgctttcgaggacgtcctggtgatgggcggcaaaggcttcggaaaagcgcaggactttgctcgatttgcgcccgagcgcctgcttgagcgcctgacggcgttcttccaccggcgtttcgcgcaggtcctcgccctgcagaaagggcgcgtcgaacaggtaataaatgatgtccacgctgcgaccgatatcgaaggcgttctgcaatgcctggaaatccggcaggccttggtcgttgagcaccaccatttcgccgtccagccagctgtccttgagcttcagggcggccagggccttggcttgctggggcaggcggctggtccagtcgtgaccgttgcgggtcagcaggcgcacctcgtcgtcctggatccgcgccaggatccggtagccgtcgaacttgatctcgtagcgccagtcgccgctgggcgccttgtccaccagggttgccagctgcggcgccaggctttgcggcaggaccacggcttttttacccgacggtttcttttcggctttttttgtggcctggggcttggcgctcttgttgtcgcccaccgtggcaccgctgagcacgctcctgggcagggcctggaccacgtcgtacttgtcgctcggtcgcgcccgggcatcctgctccttgatcagcagccactgttccttgtcgccgctgccgcgcatatgggtgcgcaccagggtccagtcgccgccgagcttctcgccgatcagggtgaacttgagcttgcccgcccggtagctggcctcggggtcgtcatggggttgccagacgccatggtcccagacgatcacgtcgccggcgccgtattgcccggcggggatgctgccttcgaaattgccatagctcagcgggtggtcttcgacatgcaccgccaggcgtttttgcgtggggtccaggctcgggcccttgggcaccgcccagcttttcaggctgccgcccagttccaggcgaaagtcgtagtgcaggttgcgcgcatcgtgcttctggatcacgaagcgcagggccgaggcggccttggcggactggccggagggttggtccgccgccggctcggaagtgatcgcgaagttgcgcttgcgctggtattcattcaaggatctggccatgaccgactacctcgtatggcgagccgcgtggttcaggcgcgggagctcttcgtggttttcctggtcttgccgggtttgtccgggctggcgggcgccttgctcctggatctgcttcccaggctgcgcttgagcatctcggtcaggtcgatgacatcggcgctcttgcgttgctcttcgccggtgctgctttccacgtcctcgatcttgccggcctgggcctttttctccaccagggccatgattttgtcggtgaagctgtcgcggtattcctccggctgccaatcggtgctcatgtccgccaccaggcgcttggccatgtcccgctcgcccttggtcaggtccggcttggccacctccggccccagggccagttcgtcgaggctgcgcacctcggccggccagcgcagcattaccagcaccagcgccgactccagcggcatcagcgccgccagatgctggcgggtgtgcagcaccaccagggccagggcgactttcgaggtgctctgcagggtttcgcgcagcagcgcatagaccttgccgccacgcttgtccggggccaggaagtaaggggtgtcaatgttctgcagcgggatctgctggctgtcgacgaaggcgaagatgtcgatggtctgggtcgacagcgggtgggccgagcggatctcgtcctcgctgagcagcacatagcggcctttctcgtacgccacgcccttgacgatatgttccttggtgacttccttgccggtgaccttgttgatccgcttgtaacccaccgggtccatggtgcgctggtccagccagtcgaagtcgacgccctgggaggaggtcgccgagaccagcgccaccggaatgtgaaccaggccgaaactgatcgcgcctttccagattgcccgtgccatgagcctgtccccgtattgactgtgaaatcgctatgcagcgactggttttcaggtgacccgtggcgtggcgcgaaagtttccccggggtgccggcttgcaggggcgagccgataactcgtgttacatgtcgggcggattatttaattaacaaggccgaacctgcgacgtagcctggactcgaatgcgataactcgtcgccatccaagagggtcgtcatgaacaacctgcttcgcggtcttgccgtgttcgccctgatgagcggggccagcaccgcggcgttcgccgcgccccaggtgcacgcggacagcagcccggcgcccgccatgctgctggcgcagaacctgcccgccagcaacaatccctacaacagcccgatacgccgggccaaccccaacagcatgcagggcacccagcccagtgcaccggctgttcgtggggttaatccggtgccggtgcaacgccctccgaccctggagaacggcggcatcggcaacggttacccgcgcaccatcacccagccgcggatcatcgacccgacacccgtgaccccaccgcgtaaccaacagcagcgataaacgctgaccgcccgaggccgacgccggctccgggcgcaaacctttttatcgacagaaggaatcgtgcatgttgcgtaaaaccctcttggcgacagtctgcgccagccttgtcctgagtagcgcgctaccggccacggccgccacccgccaacagttgcagagcgagcagggcccgctgagcgtgaccccgctgggcgaggacctggatcatccctgggccctggcgttcctgccggaccgccagggcatcctggtgaccgagcggccgggcaacctgcggctggtcggcgccgacggcaagctctcggcgcccctgggcggggtgccgcaggtctgggccaagggccagggcggcttgctggatgtggtgctgtcgccggacttcaagcaggatcgcctggtctatctgtcctacgccgaaggtggcggcgagggcggcacggcggggacggcggtggggcgcgggcggctgtccgaggacctgaagacgctcaaggacttccaggtgatcttccgccaggcgcccaagctctccaccggcaaccatttcggttcgcgcctggtgttcgaccgcgacggctacctgttcatcaccctgggggaaaacaacgagcgcccgaccgcccaggacctggacaagctgcagggcaagatcgtgcgcctgtatccggatggccggatcccgcaggacaaccccttcgtcggccagccgggcgtgcgcccggaaatctggtcctacggccaccgcaacccccagggcgcggcgttaaacccctggagcggcaccctgtgggataacgagcatgggcccaagggcggcgacgaaatcaacctaatcgagcgtggcaagaactacggttggcccctggcgacccatggcatcaactattccggtgcgccgattcctgaagccgagggcaagaccgccccaggcaccgtggggccgcggcatgtctgggagaagtctcccgctatcagcggcatggccttctacgatggcgaccgtttcaaggcctggcaacacaacctgtttatcggcgccctggcgtcccgggaactgatccgcctgcaattcgacggcgacaaggtggggcacgaagagcgcctgctgggcgaactcaaggagcgcatccgcgacgtgcgccaggggccggacggttatctgtatgtgctgaccgacgacgacaagggcaggctgtacaaggtcggcctggagtaacccagtccctcttgtgtaagagcagggggacgcccagttcttgctcgcgaaaaagtcttcaacgataacgcgtgttggcaggatgaatcgccgcttcgtggctatcgcgagcaagcttgtgcgcctgaggtttcaggccggttgcagggtcagtacctcaaagccgttgcgggtcaccgccactgtgtgttcccattgcgccgacaggccgttgtcgcgggtgaccacggtccagccgtctttcaggccgcgcacccgggcgctgccctggttgatcatcggctcgatggtgaacaccatgccttcgcgcaactccaggccggtgccggggcgaccgaaatgcaggatttgcggctcttcgtgcatctgccggccgatgccgtggccgcagtactcgcggaccacgctgtagccctgggtttcggcgtgtttctggatggcgtggccgatatcgccaaggcgcgcgccggggcggaccaccttgatgccttcccacatcgcctcgaaggtggtgctcaccaggcgctgggcctgggggctgacgttgccgatcaggtacatcttgctggagtcggcgataaagccgttcttttccagggtgatgtcgatgttgatgatgtcgccgtccttgagaatggcctgctcatggggcatgccatggcacaccacctcgttgatcgaggtgttgatcgagtaggggtagtggtactggcccttgctggccgggcgggcaccgaggtcgtggcggataaagcgctccaccgcggtgtccagttccagggtggaaaggccgggcgcgaccaggtcgtcgagaaagctgaacaccgtcgccagcaggcgcccggattcacgcatcagcgccagttgctgcggggtcttgatcagggcctgggtcatgcgctgcgcccccggatcaggtcgctcttgttcagcagcagtttgttgatcaggtcgttgtaggccaggtgcggattgagctcggccaagaggcctatcttgatccagaactcggcctgggcgttgatggagcgatccatggcgtcgctggcgacgcggatctgttcatgcagttgatctgaaatcttgacgatgcccacggggtttctgtcctggtaaatatgcgaagcatatacgtttcgtatatttttcgacaaatggcagatagctcgacctgtcattggccattgactcaccagcaacccgccggttaatttccggccatgactttttccgcattgcgttcccagccaagcattattaccgccattcctgattggcgggtctgacactgcacccaacccgccctagaggcgggttttttctttctgtctccggggctttcaacacagccaggagagccgtatgaaccatcccgccgagcccgacacgcaattggacctgcttgagcactacgtgaagaagattctcgcggcgccggtctacgacctggcggtgcgcacgccattgcagccggcgccggccctgtcggcggcgctgggcaaccaggtgctgctcaagcgcgaggacctgcaaccgaccttttccttcaagatccgtggcgcctacaacaagctggtgcaactcagtgacgagcaaaagcgccgcggggtaatcaccgcctccgccggcaatcacgcccagggcgtggcgctggcggcgcgggagctggggatcaaggcgaccatcgtcatgccttccaccacgccgcagctgaaggtgcagggcgtcagcagccgcggcgccgaggcggtgctgcagggcgagagttttccctttgccctggcccatgccctgcagctggccgagcgcagcggccagactttcgtctcgcccttcgacgacccggacgtgatcgccgggcagggcacggtgggcatggagatcctgcgccagcactccgggcgcctggatgcgatcttcgtcccggtgggcggtggcggattgatcgccggcatcgccgcctatgtgaaatacctgcggcccgaggtgcgcatcgtcggcgtcgagtccgaacactccaactgtctgcaacaggcgttgcaggccggggaaagggtggtgctgcccagcgtcggcaccttcgccgacggcgttgccgtggcgcaggttggcgcccattgtttcgagttgtgccgagtgctggtggacgaggtgatcacagtcagcaacgacgaactctgctgcgcgatgaaggacatctacgacgacacccgctccattaccgagccgtcgggggctctggcggtggccgggatcaagcagtacgtggcccgcagcggggcgcagggcgaaaccatggtggccatcgattccggggccaacatcaacttcgatcgcctggggcaagtggccgagcgtgcggcgttgggcgcggttgcgctggtataagaagggagcagggcctctgtagccgctggcgaagcctgcgcacgagcgcgaagcgctcgccagccgaatcactgatacaccgcgttgcctggcctggcggctacatcacctgcgatgtagccgctgcgaaggttattccgcgcgggccttctcgaccttgtccgcggcggaccacaggcggtagcgcacttcgacgtccttgggggcgtagatcacgattggcagcttgctgttgtagcgcagcacgaagccttcgccgaccaccggcacgaacgcctgcttgctggtgccctcggggcaggccatcaaggtactcatcggcccgctgaccttgtccaggcggtagtaggggtaactccagccttccaggttcttctcttccagggtgccgcccaggcgctgacggttgcagtcgacggtcaaggtcttgccggccaggacctcgaccttgaagtcctcttccttggcctgcttgggcagatggatcacctggcgcacaaaaccttcttcagccttggggtagggcgccacgtcttcgagtttggccgcatggctcagggtggaaataccgctcaacagcacagcgatggcggtggaaacaggaaaaaagcgcataaggcctccttgcaggttgatcgacggctctcccaatggagggagccgttgcttgaaacgccgggcagtttgactggggaaggtccggtcatgcaaaccgtggccatttcgctccggcaaattgccgggtgaccaacggcaaatccggcaatctgcacgacgcggtcctccgatggggctttataacctgatgatttatcacggcatgacaatgagtacgaagacggcacgcttaatgctccattcactatcagcgagaagccggccgcacccgtccgcaagaggtcaggaggtatcggggcatcacgtgaaaaaagcccactactcagagcaaaatagaatttagtagaagcgcaaatacggcctagtctaggaattggttttctcttccagggaggtttagtcacgccgtacgccgtatttcgggggtggaatcccgagacgatattcttgccatcattgaatggccactgcaccaacggagagatctgccatgttcttatctgccttggaactgcgcaatatcattgaatgcagcttcctgcccaaacgctgcgagtgcaccctgagccccgacctgcacatgaccgtgaaagtctatggcgaccatgaaaccgaccgcgtggacctggtggtcaccggtatcgatgcggcgagcctcaacggctgccgggaaatcaacgatttgatcgccgagttgcgctacgacctggcgaaccatccgggaagccaacccatcgccctgaaatccagggctcattgatcggcggctttgccaatgcctgtgttgcttgcctggcctggataacctccgggccaggcgcaagctcgatcttcaccgcaaataaaatccctgcctgaatctcacaaagctgcctgcaaccttgcacgcggtagagcagggcagtcttcagttctgataactgcaagcatccgacagcttgcggtaactgatggcttccagcttgcccgccttgtcgataaaggtcatgtccgcggtgaccaccttgcactccggcgtcgcgggctcggtcatcgacaccaccttggccaccttcagcggcatgccatagtgataaggcaccggctgcacctgggccgtgtccgcctgagccacacccacgaccccgacaaacgccagggccccgatcagcaaaatacgcatgttcatgagcgttctcccgataaacccgacaaaaccgccatcgagcgcgccgcggaggggcgacaggggattctgcgctgcgcggtcgcgtacagttttgggcggcgggattaatcggagattaagtagggggctaatggtttttgtggggcgtgctgggttgcgtatagtgggagggcagaagatcgggggtaatggcattgaactgattatgagatctaggcaacgttgcttggcgagtcgctacttttggggagtgagccactaaaaacccagctttggaggaaagaacgagagcggaggatgggttttcttccattcggaagagaatttttcagcctcggtaatttgcaagactgtcatctttgactttatttcaggcaaaaccaaatctacgaacttcaatactccaccgccgccgtccagttcttttaaaagagatattagagcgtaccccttaacaacgtttgctttaaagcctaaagcgtcaggttctactgctaagaaatatccataagcgtagacaccactttcataaccggtttcagctgcgcgctctagccagtaacgagcttcagccacatcatttttggctcttagtagcccaaagtattccatcattgccttagggctaccgccttcggcagcttgctttaataaattttcggtagcttgtgagcgcgtccaaggaaaaacaaaaaagccttttccttctttatacctattggccaacaatctttgtgcaggagcatagccagtggaagcagatttttttaaccattccaagtctgcttttgtgctgtacatgacagccatcgcttcaccgtcaccattttgcactagtggttcaacagtttgccaaagcagttttagccaatcctcggaagtcctggttccgcttggacagtttttgattacactgcacaagtcagactgagcggtggccaggcgggacattgcgtagtaatctccttgctcggcagaggctacataccattgatgtgctgtagtggtctaatgaaaccggacacccatttaggcgagaatgctcgccagatagaggtgtctgatgaccaagcaacgtcgttccttttccgctgagttcaaacgcgaggccgcaggcctcgtgctcgatcaaggctatagccatatcgaagcctgccgttcactcggggttgtcgagtccgcgttgcgtcgctgggttaatcagcttcagcaggagcgcaccggcgttactccgcagagcaaggcgctgacgcctgaacagcaaaaaatccaggaactggaagctcgaattgctcgccttgagcgggagaaatccattttaaaaaaggctacggcgctcttgatgtcggaagaacacgagcgcacgcgctgattgatcagttgagtgcacaagagccggttgattggctttgcacagtctttgaaatcactcgttcgtgctactacgcccaccgcctcagacgtcgaactccgaacgttgaacgacttcgattacgcagtcgagtcaacgaactgttcacgcaaagtcgcagcgctgccggcagccgcagtatcgtgtcgatgatgcaggaagatggcgagcaaatcgggcggttcaaggtacgtggcttgatgcgagaactggaactagtcagcaaacaacctggctcacatgcctataaacaagcgacggtcgagcgtcctgatattccgaacaccctgaaccgggagtttgaggtatcggtacccaatcaggtctggtgtggcgacatcacctacatctgggcgcaggggaaatggcattacctggcggtcgttctagatctctacgcgcgtcgaattgtgggttgggcgctgtcgaacaagccggatgcggatctggttatcaaggcgttggacatggcttacgaacagcgtggcaggcctcaaggcctgctgttccactcggatcaggggtcgcaatatggaagccgtcagtttcgccaacggctctggcgttaccgcatgcgccagagcatgagccgccggggaaactgctgggataatgcgccgatggaacgcgtgtttcgcagcctgaaaactgaatggataccgactgagggctacatgacaacccaagaagcgcaccgggacatcagccattatttgatgcatcggtacaactggattcgaccacaccaattcaacggcggactagcgccagctcgggccgagaaaaaacttaacgtcgtgtccgggattagttgaccactacagtgcctccgttgtaatgtattgattttcctttcttaactcttccgccaaataatactgagattctcgatcacctgcttttgcagcgattgttagttcgggttttgcgaatttatattgattgtagagaatccgccctcgatctttggcgatctgctgctctgcagataattgtgcattagcttgagtgataaaaagcaccaaaaagagaccggcaataatgaggggagctctcatagcgcaatcaacgactcagcttgaaaggaaaaaaagaaaggggagggtgtgatgctttccaagcagacgatattttctctgcttcaactatctgaagtggtgtcattttctcctttattttaggaagaacatattcggcatcgtctttggcggtgccaccaccatcaagctcaagaagtagcgaaagcaaagcataggacttcaccagatccacgggaaagccatattccggatatttgcctgaaaggtaatacccgtagccaaatataccctcggcatatcctgtctccgcggccttctcggtccactttctgaaaccttctagatcttttttatcatagagaaccgctgcaaagtgggtcatgcctctgggataccctccctctgcagaagctttcatccatcgttcaacggcctctgcacggctggaagacagaagaaagaaccctccaccttccctgtattcgactcccaataaatactgcgcgagcgcaaaaccattctctgccgattgttcgagccatttcttatcggcagtaagctcgtacataagatacatagactcagcattaccattcgcagcttgctcacctgcatgctggttagccatctgcagccactcccttggctctttacggctttcagggcagtttcccatgactacgcagagatcatcggcattcccggccagccggatcattgaatagatatcaccttgcagggccgctgcctcgtaagcacgttgcgcttcaggggtgatgtatcttttgctcttgcgaattgcctcgcctaaaaaatactgtgactctgaatcaccagcgtctgcagctgctcttagataaggaactgccgaaatggctttgaactggttgtatagaaccaacccttgttctttagctgtctgctgctccgcagaaatctgtgcatgagcttggctgagaaccatccacaagataacagtaatgcagtaagggactctcataagagttactggcttagcatgtcaggaaaaaaagatagaggtgggtggctagccttccactttttggatgcttctattgcttcctctatttattgtggggtcattttttttgcaatttgagggagtttgtactcaacattttcttgcattccaccgcccccgtccaactcctttaaaaggtagatgagggcatacccttttatagggtcgaaaggaaaaccataagtatcgggttcatgggcaagatcagagccataaccatatactgtcggggcataaccagttaaagctgctttttcattccactgacgaaagccctctgtgtcacccttttcaaacaatatggccgcatattccatcatcgcttttgggtaaccaccctcagcggatgccttaaaccacttctcaactacttcggcacggttccacggaaaaagaaaaccttcaccctgcttgtacagtattcccatccagtactgggcaatcgcatgaccgttagtggcggctttttcaagccaagtgttgtccagtgtaaggtcgtacattacatacatcgcttctgcatcctttgcagaagctcgaggttcggcaagctctttagctttatttagccaatcaattggactcttctgttcaataggacagtactttgtcaatttgcagaggtcatccttatcccggccgagttgaatcatcgcgtataaattgccttgagatgcggccgcctcataccactttcttgcttcaggattcatgaaatggttcttttttctgagtgattctgccaagaagtattgagactcatcgtctcctgcctcagctgcaacagtcaaaaaaggagcagccgaaatggttttgaactgattgtatagaatcaatccttgctctttagcggtctgctgctccggtgaaagtcccgcgttcgctagaccggagaacaacaagaaaatagcagtcacgatggaaggtattttcaaaaagttatctccggtccatgtaaaaggcgaggacgttattagtggtgaatgtcaatatccaagcttgtctggaaaatacgaaatgggcgggtgagagaacttccatttcattgcaaactcttttgcttcttcgatttggctgggcgtcatttttgcagcaatttctggaagtacttcttcaaggtaagattgaacgtttccaccgccaccatccaagtcagatagaagagaagttattccgtagccttttacaacatcatatggaaaatcaaatcttgacggtgcatgagccaaatatgccccataactgcttacaccgtcttccaggcctgcttcggcagattttttaatccatttccgtacatcagataagttgccgccattttcatataaaaaaactgcgtactccatcatagctttggggtaaccattttcggcagactttcttaaccattcacctacaatgttatctcgcttccaaggcagaaagaagccttcaccttgccgaatgccaattgccatccagtattgagcaatagcatgatcatgctctgcggatttttccaaccagtctttatttgatgttaattcatacataatgaacatggcttcggcatcgccttgctctgcttttggtttggccaagtcttgagcatgttttaaccattctgatgaggttcgtttccctttagggcagttttttaaagttgcacacagatctcttttactgcgccctagccggatcatggagtaaaaatcgccttgctctgcagatttttcataccatgcttgcgcttctgctgtaatgaactggctagcaaggcgtaactcttcagccagatagaattgggcttctgagtctcctgcttccgccgctattcgtaaatatctttcagcaggcttatattgattaaacaagtttattccatgtttttttgcgtctgcttgttcttggtttatttgagctgaaacagcgctagaaataaaagctaatactaaagctgctatggtgtttgatttaagtaacatatggattccatttactcgctagagccaacgtagtctgcttggccgtgaggtagataggtgcgtccgtaatatgtttttcgtgtgcaaaatccatccaggttggcgccaagtaaactaacatgctttttgtagcgctctctcatgcgatcatttcgtacgttatataagttttgcacgccttcggacataaaattatccattttcaagcggttttcacaatacgcctgtttcggattaggatctttagtgccgaatctactcatgcgcatacatgcatcttcaaactgtttttgggctgtagaaacagttccttgttgattggctctttctactatccaacctaggattcgctcaattgcctgctgttgtaataaatgtgcctgagatttattgtaagtgtgtttgtcttccctcgactcagcttctgagtcagatgcaacatcgataacattgaagctttctgctgctgaaagcagcgtcatcagcattggccctaaagcgctaggagtagcatttagaacccacatctcaagttcagcctgatcacggtaggtcattatggtatgagcgattggtccgcctcgtcctcctcctgtcaaggactcatatagtgacatcgctatatcccaccccatcatataaatcatcgccacattcatcccggcggtgcctataaagttgagtctgtcgataaaggtttcagcttcttgagtaacaaataccagtcggtggccttgattcttatgcatctcacgacgtatcaggttgatcagttctgttactccgtcgtaccccacctcaaactcaaactccccaccgccaccggcacctactatcagcgatgctttgagcctcatgataaagcggccttcgtgcagcgaaatcgttacgtctgcgttagcgccagcgcctagggagccggtgaatcccgcagtgagccttgcgaggctgaaccattggcttgccttattggcattgtctttaccggacataccgggagtcggtgcagtgcgcagtaatacaacttgctgtgggggggcccagttcaaggcgcctgtcagcagaactcccgcctggactccggcaaacaggctgaattcggccttggcaccgtcttcaactttcaaggcactagtgggattgtcctgcatgggggcgctgcgttgggtgaccgctattgctcgttttgcttctggtcgttcggcattttcaatggcttgcaggttcatgccgcctcgaacattgcccgcgcccagttcaatgcttgatgacagaagcaacgatgcgccggcatagccccatgccctggcgcccagatgcaaggaaaagcggccgagattgagcgtctgaggctggtcctggtagtcctgataattgagtacgaactcttttgcccgactgcgttccgggaggtcgacttttaaaagttcaacttcaccacgcgccagatcaatgccgaagctagcttcagcagaggccttgaaaccatcggccagcgtgaactcggggccttcaagctttagctctttgtgaatcatcgactgtgcaggagagaggcacctgatgagctgcgcctgagggcttttatcgaagagcctcaattgactgcgaacctcacccttgaacaacaactggcgcagccgcagaccccattcctgcctgacggaggcatcttcaagcgtactgaccttgtagttcttgctttgcaggtatttatagaaaagttcgacatcaaaccagccttgggtgtcaaaccaattactttcctgatccttgatcgcgatagcgccttgtagacgcagccattcgtggaatgagttgtcggttgtgtctttagtggacttttcgctgctgttaccaggaactttcactagatcttcttcgagatcggctcctattttgctcaagtcctctttcactacttttttgatgccttcaaggttcaacaggctaaagtgcttcaagggcttgttcacggcgctcagcaaactgacttccctcaatgggaaccctgcctttacccgtcgttcttccggtttcggttcgaattgctccggctcccacaacaggtggcggagcggggtggttttggccacggctgcttccgctgttgtacgcaaggcaattctcgattgctggaggcgttcccattcagcctgttcggcatcgatcaaaccagagggggcgggaatgttctgaccgctagcgtcaatccaggctttgtatttgttgcggatccgctcactgacgtcattttgctgttgttccgtctccagataggacttgaactgctcaatgcccgcttcaatggcgccattttccggaatcaacgcgaattcaggcagagccagcccgtagtcagcgactttcaggattgcgtcgatataggcgctgaacttcttctccagcctcttgcgttcttcagcctgcaattccagatagcggcacatttgtgccttgccgtcgctcgcgcagttggtggcatccaaatagaactttttatttttcgccagatcgtccgcactgagcgtggtcagttcgtcgtcgtcaatcagctctttgcgagccttcagataagtttgaacacgtttgcgcgcttcaagtgcttctggggtgaacaagttgccgttttcgtagatgtagccctctttttcagcctgggctacagcgatcttcttgagctttttccactcatgatgcagacgctgaagaagcatgccttcttcgtgggctttgagaaactgatcctgttgagtgctggccagctcgcgactgaggtaggagttgggttgttctttcgccccctgagccttggcagcgtactcggcttctctttttgccgctttgatgcgcatggccatggtgggttggtcgatgtaaggctcctgtttctcgatctccagcatgcggctgcgctgctcgccttcgaggaagttggccagtttgggttccaggaaatactccaatagcccaagcttgttcatggctttctgccgctcttcgggagactttccagctgaaagatgatcctcgagttccttcatagcctccttgatcgaagtcgccgcacgatcaggaagcaggtaaaacatttgctctttggttgcgtaaatcacttccccgaaagtggttgagcaaggcgttttgaccttttcgaaggaggtctcgcaactcttcggcagtttaggttgcgggtccagctgttttggcggtttggccacagtcgtctgagctgccggtttgggagcggctttcgatgcaacagaggtatcagattccataaatgcttccattcgtgcggggcgcggtgaggttcatcaggcgtcgctggcgagttgctgcagctgttcaaccttgatgaacgactcttccttggattgcaggacggtcatggcttgtggccgagttttaaacagtggcccattgaccaccggggccagcttgagcaaatgccggccttcataaatctggtgttccagcagcacgtcgaggttctcggtgatgtctggcaggcgttcatcctcgggttcgccgaaggcggcgtattgctcgtcgatccagtacacccagcccaggcgcgcctggaccctggcggtatcggcggggaggttgaaggctgggccatcggcgttccagggctgctgggcgtcggtactccaggccagccagtggccgttctgtgggccgaaattgcgcggggcagggctgtagacgttctgccaggggccgaacagctgattcgcggtgtcgccggcggtatagaccagggcggcccacaggctggccttgtgatagctcagcaggctctggccgccggagccgtcattggccttcagcagccagcgggcgtgggccagggcctgggcgggatcttcggcggtgagggcgatgccggcgccgttctctgcgcacaggcgcgcggcttcggcggccaggcgactgccccagggagcgaccagccacagcgggccttcgctggccagctcggccaagtcggtattgccgaacagcggctgggtgttcatcggctcgccgacacgataaagaatcgacatggcctcgggctggcggccgcgatcgatgatgaagtacaggctctggctggagccctcgcggggcagttgctcgaaggtataacgcggtgcggccagcagggcgttcatggcgtttacatgcatgtgcaatccttacggctgcaggcgccgttgctctgttttccgcacagcggggtaatacccgactcgttcaggcggctaggcagggggaccttgccggccttgtcgttatcggcgagtttcaaggggcccggcaacagcggcgccgccggcgtacccacgcccggcgcgccgccggaattgaccttcacattcgccccgctaatggtcacgccaccagcatcgagcttgacgaagctgccgccggccttggcggtgagttcggcaccggcttccaggaccacgatgttgccagtcttgtagtgaatctcctggccagcttcgacgaattgcgcggtgccgatgttggcgtgctgggtgacggccacggtcaggtggtcgttggcgcggatttcgctcttgcggtcgaggtgggtaatgcggtgttcctcggccttgagttcggtcagggtgttggcttcgaccgtgtcgtggcgctggttgccgacgcggatccgctggtcgtgctcgacgttctcgtcccagtcgcgctgggcgtgcaggtagatctgttcggcgcctttcttgtcttcgatgcgcagttcgttgtagcccttgccgcccggcgagctgagggtcttgaaggtgctgcgggtcttgttcgccggcaggtcgtaggggaccaggttttccttgtggtacaggcagccggtgaccagaggctggtcggggtcgccttcgaggaaggtcaccagcacttccatgccgatccgcgggatggcgataccgccgtaggccttgccggcccagccgctggcgacgcggacccagcaggaggtgttgtcgtcggcctggccgtcgcggtcccagtggaactgcaccttgatccggccgtattggtcgcaatggatctcttcacccttgggcccggtgaccagcgcagtctggctgcccagggacttgggtttcgggtgttccagcggcgggcggtagtgggcgtcccagggcgtggcgaggaagcggttgcggtagccctggtggaagtcgtccttgttgcgggtgacgtcgctggtgatgttctcgcccagcacctgcggctgcttgccctcgtggatcacttccagcagcagccacaggtcgttccattcgctgcgcgggtgggcggccagggtcaggaagtggccgctgaccaggctcggctcgtcgcctttaccttcggccagccggtagtcgctgcgatggcgttccagggcgcgggtcgccagttgcttgccgcgggcctgctgggtgaacaggccggggtagtcgtagtcttccaggtccggcatgaattcggacttggccgtgccctcgggcagcaggtgcggcttctcgaagtcgtagtcgcggcggctgacgcggctggtgcgggtttccaggcgcaggttgaagcgcttgatcaccggctgttcggcggccatgcccgagtcctgctggtagttcaccgcggccagcttgcgaaacaccgtctggtcgtcgccgaacaccagcttgtggccgctggcgctgtgctggaagtggaagtgaatgccttcttcttcgcacaggcgctggatgaagtgcaggtcggattcgtcgtactgggtgcagtagacccgctccgggtaggtggcgccgagctggaaactgtaggcgtcggccaggatgccgcgggcctcgaggacctgggcgatgatcttcggcacgctgaggtgctggtagatcttctggttgaagttgtggcgcaggtagttgagctgcggagtcaggctgatgctgtagcgggtcagcttgcgcccggaatcgccctgggcgatgcggtacaccaggccgtggatcaggcctttacccgtactgccgaaggtcaggcaggctggtttatgcaggagttcttcgagcttgaggtcgggacgcgcgctgaccagttcgatatcgaagcagaagggctgattgagggcttcgcggccaacgaaactgaggacctgaaggtcgaccgaggcgccttcgatcgtcagggaaatatgggtagcgttagcatccagcatgccgtgaaatccatccattgaataagcagggggcggatggtgcaggaataagccggtcgattcaagccgaggcggccgcggctttccgcccgccggagcattcagaaatgtccgcgataaccattacttatgcctgacaacccatccggctaacgccctacgggcatcagcggagttggctgtaagggatacgccgatggccgctcagggattcccgtgaggacgcgggccggcgaccggccttcgagcggtgagccagcgccgcaatcgccgtcggccagctggcccgcaagggcgacacaggcgtcgccggggcaggtcgttgccgcgtcaggaacgcgggggcagcggcggccggtagtagctctggaaccaatcgacaaagcgtcccaggccctcggccagggggacctgcgggccaaagccggtgacgttctccagggcgctggcatcggcgcagctgttcagcacggtgccgggctgcaacggcaggtactcgacctgtgccttgcgcccgagcagttgctccagggtggcgacgtagtccttgagctccaccgaacgttgcccgccgatattgaacagacgccagggcgccatgctggtggcggggtcgggttgttcgcggttccacaaggggttgcgcactggtggcttgcccagcaggcgaaccagggattcgaccaggtcgtcgatataggtgaagtcgcgctggtgcatgccgtagttgaacagcttcagcggacggccttcgcagatggcccgggcgaacagcaccggcgacatgtccgggcgtccccaggggccatatacggtaaagaagcgcaggccggtggccggcatgtcgaacagatggctgtagctatgggccatcagctcgttggcccttttgctcgcggcgtacagcgacagcggatggtccgcggtgtcgctggtcttgtgcggcagttgatggttggcgccgtacaccgaactggacgacgcgtaaatcaggtgttcgggcggatagcgccggcacatttccagcaggttgagaaagccgccgaggttgttgtccaggtaagccttggggttttccagggaataacgtcccccggcctgggccgccaggttgatcaccacctgcgggcgaacctgggcgaacagccggtcgagggcttcggtattgccgaggtcgaggcggtacagcgggaactgtcccacctgctgctccacccagcgcacccggtcgtgcttgagttgcgggtcgtagtagtcgttgaaattatccagcccggtgacctgatgcccatccttgagcaaacgcagtgcggtatgggcgccgatgaagccggcggccccggtgatcaggatattcatgcgcagagcgcccccggtacgcgccagggcaagccactgcccgggggacacaggcgagcgatgtcccgcgcgatggcgagggcgactgcttgtaccaggccgacatggccggtaccaaaaacgctgacatccaagggaggaacctcatccgtgatgggtaatgcgtgagtttcatggcccactttttaaagaactgaataggtgcaagtccttttcgcgttctttttttgacactaccacagcatggagacggttaattggcgtttcgccgtgttatataaatgacgaaggcgttttgtataaccctatttaagaaataataccgtttaaaatcaaatggataacatgaatgaaaggctcatgaaagccttggggcaattcctgggtaacaaacccggcagggcaaattaatccgacgatcggtagagattttaacgaaaaaacgccatttttatcctggcgcaggcttccttggatccaaaacctctcgaagcacccaatgaatagcgccttggccaagagcctggagaaaggcaaagagtgttggaaatgatcgctttattcgaggcgagggcagcgcgttgaaggagggcgctcatggccaaaggctgtagcagcttcagactaaagtcgggtgtagcccgtcaaagccatctgccatcatttacgatcaacattgatttgactaattcacctggccagaaacgattcgccagatggattgctattgcctttctttcgtccgcgttaccgatgcacagctggagcctttcatgcctttccctttgctgcactcattccgaccactgcgttatccaacggtgggcctcggcgccctgtgcctgtgcgcgggttttaccgcccaggccgaggccgcgggtttcttcgaagacagcagcgccaagctcgagtcgcgcactatctacttcaaccgtgacttccgcgacggccataccagcaacgatcaaggcgcttccaagcgcgaagagtcggcgcaagggttcattctcaacctgcaatcgggctacaccgaaggcaccgtcggctttggtatcgacgcgctgggcatgctcggtttcaagctcgattccagccccgaccgcagcaacagcggcctgctgccgtccagcggccaggacccgcggggctccaaggaccagtacgccaagctcggcctgacggccaaggtgcgcctgtcgcagagcgtgctcaagtacggcgcgctgctgccggacctgccgctgctcaagtacaacgacgggcgcctgctgccgactatgttcaacggcgccatgctcacctccaaagagatcaaggatctgacgttcacggccgcgcggctggacaagtacaccgcccgggactccacggacgcccaggacatccgcgtgcactgcaagaacaagcggtatgcctgcaacgtcaccgccgaccatttcgacatgtacggcatcgactacaaattcaacgaccgcctgaccggccagtatcactacgcggagctggaggacatctaccgccagcacttcatcggcctgctggccaaccagccgctgggccagggcgtgctcaaggctgacctgcgcttgctcaagagcgccgacagcggcgccgaacgcgccggttccatcgacaaccgcgccctgagcggcatgctcggctacgccatcgacggccacaccttcagcgccggctggcagcgcatgagcggcgacaactcgatgccgtacctcgatggcagcaacccgtacctggtcaactatgtgcaggtcaacgacttcgccgccgcccaggagcgttcctggcagctgcgctacgactacgacttcaaggccatcggcatcaacggcctgagcttcctgacccgctatgtcagcggcgaccatatcaaggtcccgggcagcgaccaggaaggccgcgagtgggaacgcgacagcgaactcaagtacgtggtgcagagcggcaccttcaaggacgtcagcctgcgcctgcgtaacgccacctatcgcagcaactacgaaaaatacgcccgggacgtggacgagacgcggctgatcgtcagctacaacttctcgattctctgacggcgctgccggaacctgaatccgcgatcggcctggataaacgtattgactggtttacgactgcttcgcagccgatcgcaggctgcgccaggggctacagggatcgtggtgtttgtgtagccgcagccgagcctgcgaggctgcgatcgactacgcagtagtcgcgatctgcacgcggtcacttcagatagattgcgttgctgggtttgcggctgccttgcagccggtcgcaggctgcgccagcggctacagggatcgtggtgtttgtgtagccgctgccgagcttgcgaggctgcgatcgactacgcagtacgtcgcgatctgcacgcggccacttcagatagatcgcgttgctgggttttgcggctgccttgcagccggtcgcagcctcgcggagctcggcagcggctacagagaatgcggacgcggggagacccgtgtcaggcggttacagccagtgccagaagcggctccagaagccgcggtccagctcttcccggcaactggcgtattgctggccgtacaggctggaacggctttgcactttcatcgccacggtctgcagccagggcttggccgtataggtctgccgacggtagccgccccagccttcgtgatagttcaggtactggcggtaggcgtcctgcttggtcacgccgttgacccgcgtggtctggtccatgtaccagccgataaagtcggtggcgtcggcgaagttggtgcggctggcccagtagttgtcgcccttgcgctggtagtcgccccagacttcgtccttggcctgcgggtagccggccgccgtgctcacccggccccagggaatcacccatagcaggtatttgcgtggcggcaaggcgtcctgcttgaagctcgattcctggtagatgatcgacagcggcacctggatcggcaccccccatttctcttcggtggccttggcggctttgtaccagtcgcttttctcgcgaaagatctcgcagatgtcgttggggttggccggcggcgaggtcgcacagccggtcaggatgagggggaagactacggcggcacaggcaaagcgggtcaaaggcaaggctctattcgggtcggtgggggcgccaatgtggtacgaatgcggcgcccctgcgatcagttcagttggtggcgatagggcaggtccggtccggtcttgccacaggtcagcgccgcggcgcggatggcgaacctgagcatctggtcgatctggtcccggctcaagcccgccacaccctccaacgaatccagctgtcgttcggtcagccaggcaatcaaggcggcctggaaggtgtcgccggcgcccacggtgtcggccatcttaatcggcatggccggcgccgaccagcggccatgcacccggctgaacaccgtcgcgccctctgcgccgcgggtcaggaacaccagctggcagtgatgctgcagccagccttcgatcacgtgctgtgggtcctggtcggggtagagcaggtgcaagtcttcgtcgctgaccttgatcaggtcggccagccggaccagggtgtcgatgcgctggcgccacagctggatgtccggagccgggttgaggcgcacgttggggtcgaggctgatcaggcgctgcccgcgctcgcgacgcaccagcgccagcagggtgtcgccgatcggctgcaccaccagggaaaacgaaccgatgtgcagaccgcgcacctggctgtcgagcggcggcaggtcgctgagctgcaactggcggtcggcgcagccttcgccacggaagctgtatcgcggcgagccgtcggcgcccaccgcgaccatcgccagggtggtcggcgcctcgaggtgcagcaggtagtcctcgcccacgccttcgtcgcacagcacctgcaacaggcgccggccgaggtaatcggtggacagcccggcgaacagcgccgcgtccacgcccaggcggcgcaaaccgaccgcgacattgaaaggcgaaccgccggcgatggcctggaagttgacccgcgacgcccgaccgctggcatcgtcttcgctgaaaaaatcgaacagtgcttcaccacagaccagatacatagtcattcgctcttcaaaagggttgtcacatgctgttggtaacgttcataggcctgctgataggccgcgacattggccgctatcggcaaggtctcgctgcttgtatcgaacctcacgcagcgctggcacaactgcgccaggctctgcggccggtcgctgctgcgggaatagcaccaggccgcctggatcgccgcgcccagggccgccgcttcgctctgctcggtacataccaccggggtgtgcatgatatcggcgaccatctgccgccacagcgggcttttcgaaccgccgccgatcaggcggatgccctggctttgcaggccgttgtggcgcagcaggtccaggccgtagcgcaggccgaaggtggtgccctcgaccaccgcgcggcacaggttggcccgggtcaggttgtcggcggtcagccccagcaggctgccgctggcatggggcagggcggggacccgctcgccgttgaggaacggcagcatgcacacgccctcggcaccgatcggcgcctgcgccaccagctggttgaaggtgtcgatatccagctcgaacagttcgcgcaccgcgccggtggcattggtcaggttcatggtgcagatcagcggcagccagccgccgctggaggaacagaaggtcgccaccgcggcgtccgcgctgacccacggttgctcggcataggcgtacagggtgccggaggaacccaggctcatggtgatcgccccgggctggatattgccggtgccgatggccccgagcatgttgtcgccgccaccgctggacaccagcgcccgcgggttgaggcccaggtgccgggcgagctccggcagcagtgtgccgaccggctggtcggcttcgagcagttccggcaaggcggcttccaggcggccgtcgggatcgatgtgcctgagcagttccaggtcccagtggcggctgcgcacgttgaaatagccggtgcccgaggcatcgccgtattcgctgcagcagcggccggtcagccagtaattcaggtagtcgtggggcagcagcacatgggcgatgcgctggaagatctgcggatgctgttcccgggtccacagcagtttcgacaccgtgtagccgggggcaatcgccacgccgaggcgctccagggagccctgttcgccgcctaggtaatccagcaggcgctggttctgcggggtggattcggtgtcgcaccagagcttggccgggcgcagcacctggccctgctggtcgagcaggaccaggccgtgctgctggccggagacgccgaggccgaggatgtccaggccgctgacccccgccgtcaataacgcacggcgggtggccagggtgaacgcctcgcgccattgctcgacgtcctgttcacggcggccgttggcgccgctgatcaggctgtggggcgccgcgcccaggcccagtactgcaccgctggcggcgtcgaggacgatggccttggtgctctgggtgccgcagtcgatgccgaggaaaagctgttgcgtcgtcatggatgaacctgcacaaaattaatcaagcccactgtagccgctgccgagcctgcgaggctgcgaccggttgcagcgcaaccgcaaaacctgcgtccgcgatttgcctggagaaacgcgttggcaggatttgcgtcggctacgccgccgatcgcagccttcggcagcggctacaggtgcgacgacggtgtagccgctgccgagctcgcgaggctgcgatcgattgcgtagcaatcgcaaaacctgaatccgcggtctgcctggagaaacgcgttggcaggatttacgtcggctacgccgccgatcgcagccttcggcagcggctacaggtgcgacggcggtgtagccgctgccgagcctgcgaggctgcgatcgattgcgtagcaatcgcaaaacctggatgcgcggtctgcctggagaagcgcatcggctacaggcaagcatcagcggtcccgggccaatacccgctccagggtgcgggtcacgccgttgtcgcgcaggctggtgtagcagtgttcgaaggcttcgacaaaggcgggcgagttggggatggcgctgccgaagatctcctcgaccgctaacaatcgctggctgatcagtgcgtcgtccgccaccagcgcctggcagaacgcggcgcgcgggtcgggaatgcggtaggtctcgccgttttcgtccacgcccttgaggtaccgggcccaggcggcgaccaccagggcggcgcgctcggtgtcgcgaccatcggcgatcaggcggttgagggtcggcacgctgaacttgggcagcttcgatgagccgtcggagcagacccgttccaattggtcggcaatcgcccggttggagaaacgcgccaccagggtgtccttgtaggcgcagaggtcgatgcccggcaccggagccagttgtggggtcacgtccaggtccatataggcgcgcatgtacgccacgaacagcgggtcggccatggtctcgtggacaaagcgataacccttgaggaaccccaggtaggtcagggccaggtggctgccgttgagcagcttgatcttcatctcctcatagggcgtgacgtcgtcggtgaattgcacgccgaccttttcccaggccggccggccgctgacgaacttgtcttccagcacccattgcgcaaagggctcgcagaccaccggccaggcgtcgtcgatgccgtgctggtcgtgcagttgcaggcggtgggcggtgctggtcatcggcgtgatgcggtcgaccatggcattggggaaactgacgttggcggcgatccagtcgcgcaggtcggcgtcgcgctgcccggcgaaggccagcagcgccttgcgggtcaccgcgccgttgtgcggcaggttatcgcaggacatcagggtaaaggccgcgaccccggccgcccggcgctgggccagggccgcgcagagaaagccgaacacggtctgcggctgctgcgggtgggccaggtcgtgctggatctgcggcaggtgggccatgaactcgccgctgctgtcgtcgatgcagtagccaccttcggtgatggtcagcgagacgatgcggatctgcgggtcggccagtttgtcgatcagcgcccgggcgccgtcctcggccagcagcatgtcgctaatggcgccgatcacctgcacttcggcggcgtcgctgtcgcccagttcgaacagggtgaacaggtagtcctggccggccaggtcgtcgcgggcgcggcggtcctcggcgcgcaggccgaccccgcagatactccagtccaggccttcgccggtgttcatcagggcatcggtgtagtaggcctggtgcgcccggtggaaaccaccgacgccgatatgcaccatgccttgccgggtctcggccaggtcgtaggcgggcaggcggacttcaggggccaggtggtggaggttgtgtcggttcagtttcatcgttcggttctcgttcaggcggcggcgcgcagcggcctggccacggccacgccgtcggcatcgaagaggtggcagtgttcggcgtccaggttcaggctcagctgctggccataggcgctggccaggtcgccgcggatgcgcatcgtcagggcctcgccggaagtggtgacgacgtggcagaaggtgtcgctgcccaggcgttcgctgacgtcggcggtgacctgcagggtgcagtcgccgggccgggccagctccaggtgttcgggacgaatgcccagggtcaccgggctgtcgacgctcaagtgggcgccgctctgcggcagctggatgcgggtgccggcctccagttgcacctcgcagccctggccatcgacccggctcagccggcccttgagaaagcccatcttcggcgtgccgaggaagccggcgacaaacaggttggccgggctgtggtacagctccagcggcgagcccacctgttccacgcgcccgccattgagcaccactaccttgtcggccagggtcatggcttcgacctggtcgtgggtcacgtagatcatggtcgcctgcagctctttatgcaggcgcgccagctccaggcgcatctgcacccgcagcgccgcgtcgaggttggacagcggctcgtcgaacaggaagatcttcgggttgcgcacaatcgcccggccgatggccacgcgctggcgctggccgccggacagttgcttgggcttgcgctcgagcatcggccccagttcgaggatgcgcgccgcttcgtcgaccttctgttgcacctcggctttcggcacgccggccaggtccagggcaaaggacatgttcttgcgcacgctcatgtgcgggtacagggcgtaggtctggaacaccatggccaggtcgcgcttggccgggctgacctcggtgatgtcgcggccatcgagttcgatggtgccgccgctgacttcctccagcccggcgatcagccgcagcagggtggacttgccgcagcccgaggggccgacgaagaccacgaactccttgtcgcgcacctccaggtcgatgcctttgatgatggaaaaaccttcgaagcctttttgcaggttgttgattttcaggttggccatgacgggcctccatgtttctgaatgtcggtgtagccgctgccgcaggctgcgacaggcaccgaaggggcctcggcgtctgtgcgatcgctggcgagcctgcggctcgatcgcagccttcggcagcggctacggggttttgatcaaggtttggagcagcattgatcaagggtggagttcggtttatttcacggcgccgaaggacaggccgcgcaccagttgtttctggctgatccagccgaagagcaggatcggcgcgcaggccagggtcgagaccgccgagagcttggcccagaacagcccttcggggctggagtaggaggcgatcagcgcggtcagcggcgcggcgttggacgaggtcaggttcagcgaccagaacgcctcgttccagcacaggatcagcgacagcagcacggtggaggccagcccgcccttggcgatcggcagcagcacccggagcatttcctggcccagggtcgcgccgtccagccgcgcggcctcgaggatgtcccgggggatgtccttgaagtaggtgtaaatcatccagactacgatcggcaggttgatcagggtgtagatcgcgatcagcgcgatgcgcgtgtccagcaggccaaagctcttggccagcaggtagatcggcatcagcacgcccaccggcggcagcatcttggtcgacagcatccacagcagggtgcgcttggtattgcgggtctcgtaaaaggccatggagtaggccgccggcaccgcgatcagcaggcacagggcggtggcgctgaaggagatcaccaccgagttccaggcgaaggcgaagtagttgctgcgctcgttgatgtgcaggtaattctccagcgtcggcgtgaagatgaactgcggcggcgtggcaaaggcgtcgatttcgctcttgaagctggtcagcagcatccagaagatcgggaagaagatcaggatggcgatggcccaggccagggtgccgagcagcaggctttgcaggcggcgggattgttgcagggtcatggcgcgtacctcagggtttgtcagtcaggtttttgccgagcatccgcaccaggacgatcgcggcgatattggcgatgaccacggcgatcaggccgccggccgaggccatgccgacgtcgaactgcaccagcgcctggttgtagatcaggtaggcgaggttggtcgaggcgtagcccgggccaccgttggtggtggtgaagatttcggcgaacaccgagagcaggaagatggtctcgatcatcaccaccactgcgatgggccgcgccaggtgcggcagggtcaggtgccagaagatcgcgacggccccggcgccatccaggcgcgcggcttccttctgttcctggtccagcgactgcatggcggtcatcaggatcaggatcgcgaacggcagccactgccacgagacaatgatgatgatcgacagcagcgggtaatgggccagccagtccaccggctgggcgccgaacagcttccacacggcggcgagaatccccgacaccgggtggaagatcaggttcttccagatcagcgcgcccaccgtgggcatgatgaagaacggcgagatcagcagcacccggacaatgccgcggccgaggaactcgctggcctccagcagggcgctgatcagcaccccgaacaccacgctgatcagcagcacgctgcccaccagcagcagggtgttggcggccccgggcaggaagcccgagtcggtgaggaagtagctgaagttctccaggccgacgaactggttctcgccggggtacagcaggttgtagcggatcagcgagaagtacagggtcatgcccaggggcacgatcatccacagcagcaacagcgccaccgaagggctgaccaggaaccagccggggttgggcaggcggcgcttgcgcgcggcctggggcatttgcagatgagcattggcagtcgaggtattcatggcgatcacaaccattccggtgcagatgcgttccctcccgtaggagcgagcttgctcgcgatcacgccgaaggcgtggaaagcatcgcgagcaagctcgctcctacaggtacagggatgggggattacttggggtagccggcgcgtttcatttcgtgttcggtggtctgctgggcggcggccagggcctggtcgaccgtggtctggccgatcagcgcggcggagaacagcttgccgacctgggtgccgatggcctggaactcggggatggtcaccagctggataccgatatagggcaccggcttgagggtcggcctggtcgggtcggcgactttcagcgactccagggtcaccctggcgaacggcgcggcctgcatataggcctcgctgtaggtggaggcgcgggtgcctggcggcacgttggcgatgccgtctttcgcggcgaccagggccccgtattccttggaggtggcccaggtggcgaaggtccgcgcggcgtccttggccttggagctggtggggatcgccagcgcccaggagtacatccaggcgctgcccttgtcggtcacctgctgcggcgcgtaggtaaagccgacgtgttcgctgaccttgctctgcgacttgtcggtgacgaaggaaccggcgacgctggcgtcgacccagatcgcgcacttgccgctgttgaacagcgccaggttctcgttgaaaccgttgctggaggcgccgggcgggccggcctttttcatggtgtcgacgtagaagctcagagcgtttttccattctgacccggtgaattccggctgccactgctcattgaaccagcgcgcgccgaaaccgttggccagggtggtgatcagggccatgttctcgccccagccggccttgccgcgcaggcagatgccgtactgttcctgctcgggtttgttgagcttgccggcgaactcgccgatctgttcccaggtcgggtgttcgggcatgaccaggccggcgtccttgaacaggtcggtgcggtagtaggtcatcgagctttcggcgtagaacggcagggcgtacagcgtgcccttggccgacaggccttcgcggaccgaggggaagatgtcctgcaggtcataggcggcgggcaggtcctgcatcggttgcagccagcccttggcgccccacagtgcggcttcgtacatgccgatggtcagcacgtcgaactgcccgccctgggtggcgatgtcggtggtcaggcgctggcgcagcacgttctcttcgagcaccacccagttcagcttgatgtccggatgctcgctctcgaaggccttcgagagtttctgcatgcggatcatgtcgctgttgttgacggtggcgatggtcacggtctgggcgccaaggctgacgccgcttaaggtcatgcaggtggtgacgagcagggctttgatgcagggtttcatcgtgcactcctcttccgggcccggtgggcggcagaaggacggttattgttgttgtgtcttccggatgctgggaagaatgtggggctgattacagccctcaacgaccgcgctgacaaatcatccctgacactcgaatcgatacttttttgcactgcgatgaaagccttcgcccggcgcaagccgccatggaccaaggatcaacgtgttccggcccggtaaaaccgcggagattgcgtattggtttttttgccgtggcggccggtatcagcgtgtggagagcgggtggcagcgacgaagccccgggccaacgaggcttcgtactgaggggcagggtcagaacgtataggtggccgacataatcgccgcgcgggcgtcgccgtattcgatggccgaggagcgtgtcgtcgagccgctctgctggcgtacccgctccacatagtccttgtcgaacaggttattgacgttcaactgcaggtcgaggttgtggttgaccttgtagccgagcatggcgttgtgcacccagtaggcatccagcttggcgcgggtgctggagctgacgttgcgctcgctgacatagcgagtgccgtaccccagggtccagccggccggcaactcataggtggtccacaggttgagcgagcgcggcggcgtgttgcccagggcctggcccttgcgtgcgatgcccgaggcggtgttcgccgcgttgaggatttcactgtcgaggaaggtgtagttggcgaacacatcccactgctcgctgacatgcccggtgacgccgacttccacaccttgcacccgctgcttgccggccagttgggtcgagccgtcggccatggtttcccgggcgttgctcttctctacgcgaaacagcgcggcgtccagctccaggcgcttgtccagcagctcccacttggtgcccagttcccaggtttcgttcttctccggcgccaggtcctggttgcccttgctcaagccgccgccggtggaggccaggttctcggcggaagggttgaaggagttgccccaggcggcatagatgcgcccgttctcggtcggcttgaacaccagcccggtgcgcgcgctggccttgttcgtgtccgaggccaggctgtcgtttttcacatggctggccgagtacttgtcgacgtcgcccttgatcttgtcgtagcgcaggccgaggttgaggtcccagcgctcgctcagggcgatggtgtcgaacaggtagtacgcctggcccttgagggtggtctcggtgtagccgctggtggccttgttgaccgggccgttccagcgcccgggcgggctgcccagggcgtaaccgttgcgcggatacagggccgtgctcaggccatggttgtaggtcttcaggtcgagggtttcccgcgacagctccaggcccgtcaccaggtcgtggcgcatgccggcgaactcgaagtcgccgatcaggttggtctggttgatccacatctcggtggtggcgtcgcgtccataggcctggggcccggccgggcggtagcgacccgccggaacgccgctggtgttgacatgggacgccgagacgacggtgtcgcgcgaggtgcggctgtagcgcgtgaggttctgcaggcgtaactggtcgttgaagtcatgctcgaagtcggcggtgaaggcgttctgttcgatctcttccttgtcgaggttcttccagccgaaataggcgtcgcgcttgaccccggccagcttcttgccgtccagcgccggtacgccgtagtcgggcaggttgtcgtcggtctggtggaaggcgctgagggtcagccgggtggcgtcgctgaaccccaggcgcaacgacggcgcgatgccccagcgctcgcggtcgatcttttcgcggccgggcacatcgttctgatggcccatcaggttgatccgcaccgcgctgtcctggccgacgccttccagcggctggttgctgtccagtgtcaggcggtagtaattgtcggtgccgaggctgccgcccagacgggtgaaggcctggttcttcggttgcttgctgaccacgttgatgctgccgccggtggtgccggcgccgccgaacaccgagttggggcccttgatgacctccacctgctcgacgttgaaggtgtcggaacggttggtctgcgcgctgtcgcgcaggccgtcgatctgcatgttgctgttggccgagaagccgcggatgttgatgctgtcccccgagccgccaccgccttcgccggcattgaaagtgatgcccgacacgttcgacagcacctggcgcaggctcagtgcctgctgttcctggatcagcttgggtggcaccacggtgatggtctgcggggtgtccagcagcggcgccacgtacttggcggaggccgagcgttcggtgcgggaaccgggttgctcggcttcgaccttgatgttgtccagttgcagggatttctgccgttcgccggcttcggccgcgccggcgcaggaggccagggcaaggcccagggtagaggccagcaggcgatggggtggcaaggcagatggggctttcgtttgcataagaaacgctctctttttggtgagagtgaatcctatttgagattgattgctaagaacggttgcgagggtgctattgcggctatcccgcgaaatttaggacgtttcgcaatggaacccagtaaaagtcaccactgggtatcggacgtatgctgcactttagccaaaagcgctctggctttttaccggtcactgcctaagatgaccggccatttcttcatgcaggaaaccgttcagcgcgatgtcggaaaaagacaccatctccatgcaactggtgcgcgaagcgctgctgcaaagctgcgccccgggtgccgccagcgatgaagtgctgctcaaggccggtatcgacccggcccagctggacgtcagcgccgcccgcgtgcccgcgctggcctatgcccggctgtggcgcctgctggcccggcgcacggacgacgagtttttcggcatggacccgcgcaagctcaaatccggcagcctggagtttctctgtcgcaccgccatggcccggcagaatctggccgcgggcctggaatccgggctgacgttcctgtcgctgatgctcgaacaactgccggcccaactggtgcgccagcagagcctggcggagatcgtcctgctggaggatgagcaggcgccgcgccgcgccttcacctacttcacctactggatgatcgtccacggcgtggcctgctggctggccgggcggcgcatcccgatcctggccatcgagctgcgctgcccggaaccggatttctgcgacgattaccaggtgatgttctcgcagaacctgcgcttcgaccggccccgcacgcggatgatcattgccgccgactgcctggatctgccgatcaagcgcagtgacgaggagctcaagcgcttcctggcccaggcgccggccaacatcctggtcaaataccgcgacccgcagagcctggccagccgcatcaagcatgacctgcgccagctgcccgcggcgcagtggccggagaccgagagcctggcccacagcctgtgcatgtcggcctcgaccctgcgccgccgcctggcggaagaagggcagacctaccagggcctcaaggacggggtgcgcaaggaactggcgatcgcctggctggccgagccgcagatcagcttcacggaaatcgccagccgcctgggcttcgccgacgccagctcgttctacaaggcctttcgcaaatggtccggttccaaccccgggcactatcgcagcctgatcctcaacgacccgacctgagcgcctcccatcgatgtagccgctggcgcagcctgcgatcaaccggaacggtcgcaaaggcgtgcagcgcggtgtctctgatgcaccgcgtcaaggctgatagcgagtcctgcggcctcgatcgcagcctgcggcagcggctacggggaacctgggtagccactgtcgagcagcgcgaggctgcgatcggcaacgcagttgccgcaaaacctgagcttgcggtgcgtcaggcagaacgcgtcgcccggcttgcgaccgctgcgcggtcgaacgcagcctcgcaggctcggcagcggctacagggggttggtcgccatgggattcttggccaaaccagtcacgcaacttgaaagctttgaccattgtcccgcccgggccgtggcgccagtatttgcccgatgtctttgtggttcccattggttcccatcctaataagaacagcgagggattctggcaatgcgcgattacctgtctgccacggcacacttcaattatcagcacaccgtcgacgcggccctgcacggctccttgtcggccctcaatgcctgcgtcgaatgctgtgaccggcacgccttgccggggcgcatcgcgctgttctgggagggccgcgacggtagtagcgcgacctataccttcggcgagttgcaggaccaggccgcgcgtttcgccaacttcctgctggcccagggcgtgggccagggcgacaaggtcgccggcctgctgccgcgcaacgtcgaactgttgattgcggtactcgccacctggcgcatcggcgcggtctaccagccgctgttcaccgccttcggccccaaggccatcgaacaccgcctgaacagctccggggccaaagtggtggtgaccgacgcggtcaaccggccaaagctcaatgaggtggccgactgcccgaccatcgtcacggtcgcgggcgccaagggccagggtatcgtccgcggcgacttcagtttctgggccgagctgggcaattacccggcgcagtgcgagcccgtgctgctgaccggcgaagacccgttcctgctgatgttcacctccggcaccaccggcccgtccaaagccctgtacgtgccgctcaaggccatcgtcgcgttccagagctacacccgcgacgccgtcgacctgcgccccgaagacgcgttctggaacgtcgccgacccgggctgggcctatggcatctacttcggcgtcaccggcccgctgggcctgggccacccgatcaccttctacgatgggcccttcaccctggaaagcacttgccgggtgatcaacaaatacgggatcagcaacctcaccggttcaccgaccgcgtaccgcctgctgatcgccggcggcgacgagttcgcccgctcgatcaagggcaagctgcgcatcgtcagcagcgccggcgagccgctgaacccggaggtgatccgctggttcgccgacaaccttggcgtggtgatccacgaccattacggccagaccgaactgggcatggtcctgtgcaaccaccacggcctggagcacccggtgcatgtcggcgcggccggtttcgcctcgcccggccaccgtatcgtggtgctcgacgagcagcaccaggaactctcggtgggccagccggggatcctcgccatcgaccgcagccagtcgccgatgtgctggttcaacggctaccacggcgtggtgaccaaggccttcgtcggcaactactacctcagcggcgacaccgtggagctgaacccggacggcagcatcagcttcgtcgggcgcagcgacgacgtgatcaccacctcgggttaccgggtcggcccgttcgacgtcgagagcgcgctgatcgagcacccggcggtggtcgaggcggcggtgatcggcaagcccgatccggagcgcaccgagctggtcaaagccttcgtcgtgctcagcccgcagtaccgcgccgcaccggagctggccgaagagctgcgccagcatgtgcgcaagcgcctggccgcgcacgcgtacccccgtgaaatcgaatttgtcagcgaattgccgaaaaccccaagcggcaagttgcagcgcttcatcctgcgcaaccaggaaatcgccaaggctcaagaggccgcggcgcacaaggcttcggcctgaattacccaggaactcatgatgcacatcgaaaacaaggtttttctcgtcagcggcggcgcttccggtctcggcgcggccaccgcgcagatgctggtcaaggccggcgcccaggtgatgctggtggatctcaacgccgaggccgtcgcggcccaggcgcgccagctcggctgccagagcacggtcgccgatatcactgacgaagcggccgccgaagcggcggtgcaggccacgctcaaggcgttcggcggcttgcacgggctggtcaactgcgccggcatcgtgcgcggcgagaagatcctcggcaagcacggtccccatgccctggccagcttcagccaggtgatcaacgtcaacctgatcggcagcttcaacctgatgcgcctggccgcggcggcgattgccgaaggcgagccgaacgccgacggcgagcgcggggtgatcatcaacaccgcctcggcggcggccttcgacgggcagatcggccaggccgcctatgccgcgtccaagggcgccatcgccagcctgaccctgccggccgcccgcgaactggcgcgcttcggcatccgggtgatgaccatcgccccgggcattttcgaaaccccgatgatggccggcatgagcgacgaagtccgcgcgtccctggccgccggcgtgccgttcccgccacgcctgggcaagccggacgagtacgccgcgctggtcgggcatatcattagcaacagcatgctcaatggcgaggtgatccgtctcgacggcgccttgcgcatggcagccaagtaaagaggattgatcatgaaccaggatccgatcgttatcgtcagcgccgtccgcacccccatgggcggcttccagggcgagttgaaaagcctgaccgcgccgcagctcggcgccgccgccatcaaggccgcggtggagcgcgccggggtggccagcgacagcgtcgatgaagtgctgttcggctgcgtgctgccggccggtctcggccaggcgccggcccgtcaggcggcgctgggcgccgggctggacaaggccacccgctgcaccaccctgaacaagatgtgcggctccggcatggccgcgactatcgccgcccacgacatgttgctggccggcagcgccgacgtagtgatcgccggcggcatggaaagcatgtccaacgcgccgtacctgctggatcgcgctcgcagcggctaccgcatgggccacgggcgggtgctcgaccacatgttcctcgacggcctcgaagacgcctacgacaagggccgcctgatgggcaccttcgccgaagactgcgccgagaccaacggcttcagccgcgaagcccaggacgccttcgccgtggcctcgctgacccgcgcccagcaggcgatcaaggacggcagcttcaaggcggaaatcgtgccgctgcaggtcaccgtcggcaaggagcagcagaccatcagcgacgacgaacagccgcccaaggccagactggacaagatcgccacgctgaagccggcgttccgcgacggcggcaccgtcaccgcggccaactccagttcgatctccgacggcgccgcggccctggtgctgatgcgccgttccgaggccgagcaacggggcctcaagccgctggcggtgatccacggtcacgcggcgttcgccgacaccccggggctgttcccggtggccccggtcggggcgatcaagaaactgatgaagaagaccggctggtcgctggatcaggtcgagctgttcgaaatcaacgaagcctttgccgtggtcagcctggtcaccatgcagaagctggaaatcccccacgacaaggtcaacgtccacggcggcgcctgtgccctgggccacccgatcggcgcgtccggcgcgcggatcctcgtgaccctgctctcggccctgcgccagcaaggcctgaaacgcggcgtcgcggccatctgcatcggcggcggcgaagccacggccatggccgtcgaatgcctgtattaaggaatcaccatgctgcctaatgacgaacaacagcagatcagcgatgcggcccggcagttcgcccaggaacgcctgaaaccgttcgccgccgaatgggaccgcgagcatcgcttcccccgcgaggccatcggcgaaatggccgggctgggcttcttcggcatgctggtgccggagcagtggggcggttgtgacaccggttacctggcctacgctatggccctggaagagatcgccgccggcgacggtgcctgctcgaccatcatgagcgtgcacaactcggtgggctgtgtgccgatcctcaagttcggcaacgacgagcagaaggagcagttcctcaagcccctggccagcggcgccatgctcggcgccttcgcgctgaccgaaccccaggccggctccgacgccagcagcctgaaaacccgggcgcggcgggagggcgagcattacgtgctcaacggctgcaagcagttcatcacctccgggcagaacgccggggtggtgatcgtgttcgcggtgaccgatccggcggccggcaagcgtggcatcagcgcctttatcgtgcccaccgactcgccgggctacagcgtcgcgcgggtggaagacaagctcggccagcacgcctccgacacctgccagattctcttcgaggacgtgaaggtgccgctggccaaccgcctgggtgaggagggcgagggctacaagatcgccctggccaaccttgaaggcggccgcgtgggcatcgcttcgcaatcggtgggcatggcccgcgcggctttcgaggccgcccgtgactacgcccgcgagcggcagagcttcggcaagccgatcatcgagcatcaggcggtggcgttccgcctggcggacatggccacccagatcgccgtggcgcggcagatggtgcactacgccgcggccctgcgcgacagcggcaagccggcgctggtggaggcgtcgatggccaagctgttcgcctcggaaatggccgagaaggtctgttccgccgccttgcaaaccctgggcggctatggctacttgaacgactttccgctggagcgcatctaccgcgacgtgcgggtctgccagatctacgaaggcaccagcgacattcagcgcatggtcatttcgcgcaacctctgacttttagcaggagcttgatccatgagttacgaaaccattctgttggagatcaaggaccgcgtcggcctgatcaccctcaaccgcccgcaggcactgaacgccctcaacgcgcagatcgtcagcgagctgaaccaggccctggatagcctggaagccgatcctcggatcggctgcatcgtcctcaccggctcgaagaaagccttcgccgccggcgccgacatcaaggaaatggccgagctgacctacccgcggatctacatggacgacctgttcagcgacagcgaccgggtggccaaccggcgcaagccgatcatcgccgcggtcaacggttttgccctgggcggcggctgtgaactggcgctgatgtgcgactttatcctggccggcgacaacgccaagttcggccagccggaaatcaacctcggcgtgctgccgggcatgggcggcacccagcgcctgacccgcgccgtgggcaaggccaaggccatggaaatgtgcctgaccgggcgttttatcgatgcggtggaagccgagcgttgcggcgtcgtcgcgcgcatcgtgccggccgacgagctgttggacgaggcgttgaaagtcgcggcgctgatcgccggcaagtcgctgccggtgagcatgatgatcaaggaaagcgtgaaccgcgccttcgaagtcagcctctcggaaggcgtgcgtttcgagcgccgggtgttccatgcggccttcgccaccgaggaccagaaggaaggcatggcggcgtttatcgccaagcgcgaggcgcagttcaaggacaaatagtccgggctgtcgctcgccatgaaaaatcgcagccaaggctgcgattttttatgtgcggtgtttgtacggaagctatcgcgggtagtgcgtgtgcctgtagccgctggcgcagcctgcgatcgaccggtacggtcgcaaggcgggcgtcagggctgacagcgagtccttcggcctcgatcgcaggctgcgccagcggctacatctcggcgtgcccgcgatgcttttaggcggtcacaacagatagtgcttcagctcccgggcgatcagcatgcgctggatctcgctggagccttcgtagatctgggtgatccgcgcgtcccggtagtagcgttccaccgggtagtcctcgaggtagccgtagccaccgtggatctggatcgccgaggagcagaccttctcggccatttccgaggcgaacagcttggcctgggaggcttccgacaggcacggctggccggcgctgcgcaggcgcgcggcatgcaggatcagcaggcgcgcggcgttgaggcgggtgtgcatgtcggccagcaggttggcgatgctctggtgctcgatgatcggcttgtcgaactgcacccgttcgcgggcgtaggccagcgccgcctcgaacgcggcgcgggcgatgcccagggcctgggcggcgatgccgatgcggccgccttcgaggttggacagagcgatggccaggcccttgccgcgctcgcccagcaggttggcctcggggacggtgcactggttgagggtcaccgcgcaggtgtccgaggcgcggatgcccatcttgtgttcgctgcgatcgacgataaaacccggggtgtcggtgggcaccaggaacgccgacaggcctttcttgcccagctccggatcggtcaccgcgaagacgatggccagcttggcgcgccggccgttgctgacgaactgcttggcgccgttgattacccactggccgtccttgagttcggcgcgggtgcgcaggttgtgggcttcggaaccggcctggggttcggtcaggcagaagcagccgatcgcctggccgctggccaggtccgccagccaggtctgtttctgctcctcgctgccgtagttgaggatcggcccgcagcccaccgagttgtggatgctcatcagcgcgccagtggcgccgtcgccggcggagatttcttccaccgccagggcgtaggccacgtagtcgacgtaggtgccgccccattcctcgggtaccaccatgcccagcaggcccagctcgcccatcttcgccaccagggcgtcgtcgatccagccggccttttcccaggcctgggcgtggggggcgatttcaccgcgggcgaagtcccgggccatgtcgcggatcatcacctgctcttcgctcaattcaatgtcgtgcatggctcagctccggctcgggtcgaaagcgctgaagaaactcgccacgtgcgcggcgtccagcgcctgcagggtcggtgggttccagcgtgggttcttgtctttgtcgatcagcagggcgcgcacgccctcgatcaggtcgccgcgctcgaaccactggcggtccaggtgcagctccagggcgaaacactgttccaggctcagctggcggccgcgccggagcatttccagggtcacggccatggccagcggcgagcgggtcgccagcaagtcggcggtgctggtagcccattcatgagtatcgcccagggtcacttcgcgcagttgctgcacgatgcccggtacatcggcctgggcaaagaagtgatcgatggccgggcgcagcgccgccagtggcgcgtccggcagttgctgcacaccgagcctggccagcaggccctgcaggtccttgagcggggtgtcgtgccattgcaggttgtcgaggcgctggtccagcaggctcagctggtcgctctccaggtaccagtccgccagcccgcagtacagggcatcggcggcgcgaatctgcacgccgctgacccccaggtagatgcccagttcgccggggatgcgcgacaggaaataactgccgccgacatccgggaaataaccgatggccacttccggcatcgccaggcggctgcgctcggtgaccagccgcaggtcggcgccctggaccaggcccatgccgccgccgaggacaaaaccgtccatcagcgccagcaccggcttgcggtaacggtggatcgccaggtccagcgcgtattcctcgacgaagaattcctcgtgcagggtctggccgttctggtagctgtcgtacagggtgcggatatcgccgccggcgcagaaggccttctcgccggcgccgcgcaggaccaccgcgtgcacctgcggatcctgggcccaggcatcgagctggcgttgcagggtgcgcaccatgccgagggtgatggcattgaggccggcggggcggttgagggtcaggtgaccgatgtggttgcggacttcggccagcacgtcctgttgcgaggcctcgaccgacgtggcgccggcgtctcgcgtggcctgggatggaacctgagcagtcatcactaactccctgcttttattgttctttataggtgtgttcgcgcgcgaacgatgagggatcgtaacagtgcaaatttgccatgtacaacccggataactgcaggttggctgtgcatttttgcatggggcgcagccgccttcgacgctgtttgtggtgcagccgaagccagcatggccggcccgtatttatccgccgtccaggcgcaccggacgacgagcgccgctacaatggcgctcgactttcgtgacccagaggcaacatggacatcgacctggcccgcacctttttgcaaatcgtccgcagcggcagcctgatcgccgcggccgaacgcctgcacctgacccagaccgcgatcagcgcccgggtgcagaacctcgaaggccagctcaactgcaagctgttcgtgcgcaaccgcgccggggcccggctgaccgccgacggcgaagcgttcatcgtctacgccaaccagctggtgcagacctgggaagccgcccagcgcgacctgccgctgctggccggttatcgcaacgtgctgcatatcggcggtgaggtcagcctgtgcaatccgctgatgctcaactgggtaaggcgcttgcgccaggcgattcccagccacgccgtgcgcagccagatcgccgagggtgcgagcctgcaacgccagctggaactcggcgtgctggacgccgcgttggtgttccagccggtgtacgggccgggcttgcaggtcgagcagttgctcgaggaaaagctgatcctggtgcgcctggccggcaagcccgagccttatgtgtacatcgactggggcgaggatttccgccgccagcacgacgcggcgctgccggaccaggccaaggccgcggtgggtttcaacctcgggccgctggccttgcagttcattctcgaaggcggtggcagcggctacttccgcacccgggtggtgcaaagctacctggacagcggcgtgctggagcgggtggaaaaggccccggaattcaacttcccgacctacctgctgtacgcccgcgaacgggattcggcccagctgcagcaggccttcgaggtgctgcgcgaagtcatcgccagcgacaccgactggtcgcagcgttgggatccgatgatctgagtcgtaaaacgcggcgcctggtttacgaccgcttcgcgctcgagcgcagcctgcggcagcggctacagggattgcggagcctgtgtagccgctgccgagcccgcgaggctgcgatcggcaacgcagttgccgtaaaacctgagcccgcgatctgcccggataaccccgatcacacccgcggcgccagcacctcgccaatactgcgccggcgcgcatgggcctcactggcgtggatcagttgctccagatcttgcggggtgacgtcgaagaattcctgcatatcatccagcgccagcttgaggtcggcggcggtgatggccagggtattgctcggcggctgatcggcgggcagttgaggcgcgggttcactctggcccttggggtagcggatgcgggtcaggttgttgtaggccagggcgctgagcaacaggcacagcgccgccagcatcaccgggccaagggcctgccagtcgagggcgatggtggccgggtcggccagcaccatcgtcagggccacggcgccggccggcggatgcaggcagcgcagccagcacatcagcaccagggacatgccggcggccaggcaggcgctgcccagggtgcgcccgagcacatgggccaccagcaacgccaggaccgcggcgcacaggtagccgccgaggatcgaccagggttgcgccagcgcccccgacgacaccgcgaacagcagcaccgccgaagcccccagcggcccgatcaggtgcagcgccacttccataccgaacacccggccgcacaaccagacactgaacagcgtgcccaaggccatgccgatcgcggcgcggctccattccgaggggcgggtattgatggcggcgggtttccagcgagcgagcatgacgaagcgatccagttccggttttgcgggcaaaaagaagggcttgtctggcgcaccagaaagccctgaaacgttccaacatttggggggaggaaccggcacagtttgccgatcaaaccaagcgcctacaaattcataataatgctgtttaagtgcattatttttgtactgtggcggcctgggccacccgccgtccgctcatgaaacacagcaggccgcccagggcggtcaaggtgctcagggcatagaacatggtcggtgccggggtatgcaccagcaggtagccacagatcaccgggctcaaggcgccgcccagggccgcgatgttctgcgcgccgtaatagctgccgcgcagggcctcgggcgccagggtgtcgatgaacaggaattccgccgggtagatgatcatctcgccaagggtgaagacgaacatcgccaggcaccagcccagcaggctgtcggccaggctgaagccgatcaggccgaggatgaacaggctggtgccgacggcgatccagtagcgcaactgttcgcgcttgaggaaacggccgatctggtactgcagcaggatcacgctgatggcgttgcaggccagcagggcggccatggtgtcgagggcgcttttcgcgtcttcggtgaccagcaggtactgcgacaggtacagggtgaagcgcccatggacgatggtgctgagcaggcagccgcaggtgaacatgatcagcgtgcggtcgtttttcagggtcaccagggtgtcgaggaaactctgcggcttgttcagcgagggcaggcccggcgtggctggaatgccgcgcatcagcagggtgctgagaaaggcaatggcgccggcgatcaggaacggcgccagcggcaggtgtccggcgatcaccacgccgagcatggggccggtggcgtagccgatattggtcagggtgtagcgcagggagaacaccctggcccgctgactcaccggcaggttttcactgatgatcgccttggagccgatcaggaacagcgccgaggcggtttcggtgatcaccaggatcgcggtggtcaggtagaggttgtgggcgaaggtcagcagcacaaagccgatgccgctggagagcatgctcaggatcagcagccggcgcttgtccaggcgatcgaggatgtagccgccatacagcgcgagcagtgtggcgatgaataccgcgatccccagcagcaggccgacgtcctgctggtcgaggccgagtttttcgctgaggaacagggtgagcagggggctggtgatggcgcgactgacgacaatggtcagcgagcagatcatcaggcggcggataaccagcgagtaagtggccacggtggtgcacgagtccttgttggctgagtgggcgaaaagatcctgcggcccaggctggccatcctctgacagttgcacgggcagttcaagacaggccagcaccctatctcaactaccgcacccatcttccgtaggagcgaagcttgctcgcgatggtcgttaacgatggcgcgtactcattggatgaacgcggcgcactcaagtgcatcgcgagcaagcttcgctcctacaggtgggcggggtgggcaggcagtgtcaggcgcatggcgcagcgccgggccgctggcaggccgtggcgaatttcctcggccagcacctgttgcaggcgcggtcccagttggtcggcgtccagggtgacgaagccgcagcgctggtagaagggttcattccacggcaattggcggaaggtgctcagggtcagggcactgaatccctgctgacgcgcctgttcgcccaccgtctgcagcaggcggcggccgatgccgcgcccttgggcggcgctggcgaccgagatttcccagacatgcagcgcgtcggcgcaggcttcggcgtcgaggaaggcgcacacctctcgattgagcacggcgacccacacccgctgctggcggatatgcgcgcggtgctgcgcggcatcgggcacctcggcgtcggccagccaggccagttcgggggcgcggcgaaacagcgcggcggcgctgcgttcgatggcggggagcagaatggcatcggcttctgtggccaggcggatttgcagagtcatggggcgcgagtgtaaggagccagggcgcgaccaggcaaccgttcagggttgcgtggtggcaggcaggtgcagcatgacgaagtcgttcttatcgaaacgcccgctgagcaccggggtcagccgcgccaggggcgtggccttgagcgtcgccaggtcactttgatccatgatcacccaggccgggcctggtatggccgcaagggcctcggggcgttcggtgaacagcggctgcaggtcctggtcgaggtggaccatgaacttgatcgccttggcgtccttgcccatggcgtgcaacaccagcggcgccggatcgtgctgtatcagccgttgcgccgcgaggctgaactcccgggtgtcgtacagctggcgttcgacgggctcgaacaccccgatgtaggtggtccacaccgccagtaccgcggtataggccaggccgacggcccgccagcgccgccgggccagcatcagcagcgcggccccttgcagcagcccgaggagcgccagcatcgcggtcaggtccggcagttgctcgggaaacttgcgttgcagcaccagcaacccaccgatcaacagccccggcagcaatagccatatgccttggatcgcaatccgcagccaggccaggaagcgcccctggcgcgcctggaacgggtaggccgcgacaatcgccgccatgggcagcatcggcagcagatagcgggctttcttggcctggggaatcgacaggccgatcatcaccagcagccccgcggcggtgcacaggcgcagcagcttcagcgtcgggtcaggctcgtcgcgccgggccagcagcacgccgatccaggccaggatcgccagcgggtaggccagggcatagttgcccagggagctgctgaagtaatagaacgggccgctgctgccttcgctgccatccatgcgcccggtgaactgcatgcggatcacctcctgcatgaaggccgggccgccactgaatcgggccagccacagcaacagcgccacgcacgccagcagcaggagcagggcactgccgccgaagaccagcatgcgccgccactggccttcgagcaggtaatagctgcacagcatgccgcagggaatcaccaggccgatcggcccgcgaatggcgaaccccgcgaccagcaacgcgaggatcagccacaggcgtcgcggcgcggcgaaatgatcgtgggcataccccaggtagaacaccgccagcgccagggcggcgagtatctggtccagggacacggcgcgggtttcgctgataaaggtattgctgagcagcaacagggcgacgctgagcagggcccaggttcgggaacagggtgccagcagtcgatagatcaggccgactatggtcgccgaagccagggccgtgggcagccaggcgctcaggctgacgacccggccgaacggcagcgagaacagatagatcagcagcgtcgaggcgctgctgtagtcggcatagggctggccataggtggtggggaagaaccccggcccatggcgcagcatttccttggcgaacaggacgaacctggagtcgaaaccggtcaccgcctgctggtagaccccggtgcagaacagcagcagggccagcagccccagccccaacgcttgcctgtgcagtgtctggacggggacggcgcgcgggatcattcaggcttcaaccggtgtgccggcccattgccggtggggaatcggcagctggcgcgactcgccgcggccaatcgggaagtaggtgaagccgccgcgggccaggcgctcggcgtcgtacaggttgcgcccgtcgaagatcaccggggccttgaggcgctgttgcagcagttggaaatccggcgccttgaactgctgccactcggtgcagatgatcagcgcgtcggcatcgttgagcaccgattccggagtgcccatgagcatcagcttcggctcgtcgggatacaggcgctgggtttcctgcatggcctccgggtcgaaggcgcgcacattggcgccggcggcccacagggattcgagcagcacccggctgggggcgtcgcgcatgtcgtcggtgttgggcttgaaggccaggccccagagggcgaaggtcttgcctttcaggtcgccctggtagaaggcgttgatgcgctcgaacagcttgtgtttctgccgttcgttgatggcttccaccgcttgcaaaaggtcgctggagcaatgggcctgctcggcgctgtggatcagcgcgcgcatgtccttggggaaacacgagccgccataaccgcagcccgggtagatgaagtggtagccgatgcgcgagtcggcgccgatgcccaggcgcaccgattcgatatcggcccccaggtgttcggccagctcggcgatctggttgataaagctgatcttggtcgccagcatgcagttggcggcgtacttggtcagctcggcgctgcgcaggtccatgaacatgatgcggtcatggttgcggttgaacggggcgtagaggtcgcgcatcacgtcgcggacctcttcgcgctcgcaaccgacgatgatccggtccgggcggcggcagtcggacaccgccgagccttccttgaggaattccgggttggagacgatatcgaactgcagggcgcgcccgtccagggccttttcgatatgggctttcaaggtgtcgccggtgcctaccggcaccgtggatttctccactaggatcaccggctgttcacggtgccgggccacggcgtcgcccaccgacagcacgtagcgcaggtcggccgagccatcctcgctggacggcgtgccgaccgcgataaacagcacctggccatgttgcaccgcgagcttttcgtcgctggtgaagctcaggcgtttgctttccaggttgtcgcgcaccaggctcgacagcccgggctcgaagatactgacgtgcccctgttgcaactgctggaccttgtgctcgtcaatgtccatgcagatgacatcgtggccgacttcggccagcacggcggcctgcacgaggccgacgtaaccacttccaaatacgctgattttcatggggtattcctgggacttgtcgcgggagcaggtcgtgagttgatggtaatgacgccgaggatgaccagcgccacccccagggttttcgagaggctgaacggttcgttgaacagcggcagcgaggcggccagcaagtagaccagggcgtagctgacgctgagcagggaataggcccggcccagcggcaggtcgcgcagggccagcagccaacagagcatcgacaggacataggcgaggatcgccgccagcaccacacccagcgccagcaggtcgacctggccactggacagcgccgccagccagtgtgccggttccggcaggcgggtcatgctccagcgcatgcccaactgcgcggcgctgaccagcagcacgctgcccatcgcgaaagtgaaaccgcgaacccggctcatgcgtgacgactcaacagcagtacgccagcgagcaccagcgccatgcccagccagtggcggcggtcgatggcttcatggaagacgaagcgggcgatcagggtgatcagcacgaagttcaggctgagcatcggataggcaatgccgacctcgacccgttgcagcaccagcagccacaccagcaagcccaggccgaggctggccagggccagccacagccagggcgagcgcagtttgtcgagggcgccggagggcgggccacgccagctttccacggcaaacttctgcgcgatctggcccaggcaggtcagcaggcaggcggcgagcagcagcaacaggctcatggctggctctgagggaagatcaggatcacgagattgccttggtcataacgtttgaaatcctgcggcaacagatcgatttcgtagtgttcgtcgccattgacccgcatcaccacgcccacctggccttgcttgcgggcctcgggcagccattcgccgaccttgcgcaggtcgatgtaacgatgctgggtgtcaggataggccaggccatatttcacttcgcctgtcgtgttgtacaaggcgatatccgggcgcttgagacgccaggccagggccgaggccgcacccaggtcgttgctcaccagggtgtggctcttcgcgagttcctcggcgtgatcgatgatgaattgatccggcatcttgttgtagaccaccgagttcggcaggccggccggcagcagggcgatgaacagccagctgccgagcgccggcgcggcccacagttgcagcgggcggaaggccggcagcaggttgctcatgttccagccaagcagggccaggaataccagcaccagatgcccgggctcgttgctgtacagcggcttcttcagctggaaatacaccagcgccaacaacagcaacaggcccagcaccaggttgagcaccgcgttgaggcggatgagccgggtctgcccggcgtgcagccggtcgctcaggctattgcccatcaacagcgccagcggcagcaggcacggcaggatataggccggcagcttgcccttgctcaggctgaagaacgccagcggcaggatcagccacagcagcaggaaaccgatgctcgcctgacgccgggtctgccaggcctgcttcaaggcgcccggcagcaccaggacccagggcatgctgaacgccaccagcagcggcaggtagtaccaccatggcgaagcgtgctgggcgtcgtcaccggcaaagcggcggatgtgttcatgccagaaaaagaagcgccagtaatccgcttcctgggcatgcaccgccagcgcccagggcaggctgacgacaatcgccaccagcaccgcgatgccgccgtagacaaacagctcgcgcaggcgcttctgccagagcatgtagggcagggcgaccaacaccggcagcagccaggcgaggaaacccttggtcatgaagcccatgccacaggcgaagcccaggccggcccaggccagcaggcggttgcgtagcgtctggttgtccagggcgaaccacagcgctaccaggctcaggttgacccagagggtgaactgcgggtcgagattggcataaccaccggcgccgaccaccacgcagaaactcatgtacagcagggcgcagaccaggctcttgcgcgggtcgttccacagccgcctggccatcaaataggccagcagcacgctcagacccatgctcagggccgaagccacgcgcacgccgaacaggttttggccgaacagcgcctggctgagggcgatcatccagtagccggcggccggcttctcgaaatagcggatgcccatgaaatgcggcgatgcccagtggccggtcaggagcatttcctggctgatctgcgcatagcgggtttcatcgggaatccacaaaccgtgggtggccatcggcagcaggtagaacaggccgaaggcaatcaatagaagaggcagggcccagcgtctggtcatgcgccttgtacccccagccagccttcgcggccttcgagggcgccacgaatgacctgcccctggggcaggctctgcaaggacgcgggcaacaggttgcccagggtattgaaatgaatgtcgcgctggcgggcttgcgccagcagttggcgaaaatcgttggccatcagaatcccttcgacctcggcgtgaatggtgtagacgttgagcctgtcagggctgaaccggtccaggatgaatgtgttgaagtcgtgggccgcgacggcgggtccgaccacttcgtcaaaggtcggcaggtcgaccggaatctgcggggcacccaggccgccatccgccagccgtggctggaagatcgaggtgccgcggcaatcgctgttgtagcgaaagccgaagccctgcttggcctcgatcaccgactcgtcggcgcgccagccggcggcggccgagcagtcgacgcgctggccgagaatgtcattgagggtgtcgacgccctggcggatctgctcgatcagctgcgcctggttccagcgcccggcattggcctgccagccgtggtgatcccaggcgtgcaggccgacttcatggccggcgtcccgggcctggcgcatcaggtgcccgaggtcgcgaccgatcggcttgcccggccaggcggtgccggccagcaggatgtcccaaccataaaggccggcggcgttggagcgcagcatcttccacaggaattgcgggcggatcaggcgccacaggtggcgccccatgttgtccgggccgacgctgaagaagaaggtggccttgatcccggcctcgtcgagcagttccagcaaccgcggcaccccttcacgggtgccgcgataggtgtcgacatcgattcgcagacctgcctgcatcaatgcttgtccgcgatttcgagcatggcctcgcgcaggaagaagtccagcgtgttgccgatggtttccttcatctcgacgctcggctcccagttcagcaggcgcttggcgttggcgatgctcggcttgcggtgttccacgtcctggtaaccggcaccgtagaaggacttgctctcgacctcgcggaaaccggcgaacggcgggaagttgccacgcagcgggtgggcctcgaactggcgcagcagctcttcgcccaactggcggatgctggcttcgttgtccgggttgccgatgttgatgatctggccgttgcacacatcgttctcgttgtcgacgatgcgcgccagggcctcgatgccgtcggcgatgtcggtgaagcagcgcttctgctcgccaccgtcgaacaggcggatcggcgtaccttccaccaggttgaggatcagttgggtgatggcccgggagctgccgatgcgtgccgagtccaggcggtccaggcgcgggcccatccagttgaacggacggaacagggtgaagttcaggcccttgctgccgtaggcccagatcacccggtccagcagttgcttggacaccgagtagatccagcgctgcttgttgatcgggccgacgatcaggttggaagtgtcttcgtcgaagttctggtcctggcacatgccgtagacctcggaggtcgacgggaagatcacgcgcttgttgtacttgacgcagtagcggaccagcttgaggttctcttcgaagtccagttcgaacacacgcagcgggttgcgggtgtattcgatcggggtggcgatggcgaccagcggcaggaccacgtcgcacttcttgatgtggtactcgatccactcggagtgaatgctgatgtcgccttcgacgaagtggaaatgcggatggttgcgcaggcgctcgatggcgtcgcagccgatatccaggccatagacctcgtacttgtcgtcacgcagcaggcgctcggacaggtgattgccgatgaaaccgttgacgccgaggatcagcacccgggtgcgccgcggggcacgaccggattcggcgccgcgcagcagcgagccatccaccaggcccagctcgttggccagttgcgggccgctgaggtacaggccgttgtcgttgcgctggccgcgttgatcagcagcgagtcctggccgcaggcgatgcgcagcgggtcgacgctgatcacccggcccggggcctggccttcgttgcccttgaccacctcggcgctccagacgatcagcttgtgctcgcccacggcgcagaacgcgcccgggtaaggcttggtcacggcacgcaccaggttgaacagttgctcggccggctggctccacagcagcttgccatccgccgcggtacggcgaccgaagtagctggctttggattcgtcctgggcggtttcgctgaccttgccttgcgccagggcgggcagggtgtcgcgcagcaggctggcggcggcatcgcgcagcttgccgtgcaggctcagcgcggtatcgctgcgctcgatggccacccgctgctgggcaacgatcgccccggcatcagggcgcttgaccatgcggtgcagggtcacgccggtttcgctttcgccgttgaccagcacccagttggccggcgcgcggccccggtagctcggcagcagcgaaccgtgcaggttgaaggcgcccttgctggcggtggccagcagcgcttcgctcaacaggttgcgatagtagaaggagaagatgtagtcggggttgagtttggcgatgcgctcgacccacagcgggtggttggcgtcgtccggggcatgcaccgggatgccttttagcgagcacagttgggccacggagccgtagaaggtgttttcctttggatcgtcggcgtgggtgaagaccgcgccgatttcataacccgcgttgagcagggcttcgatgcccgcgcagccgatatcgtggtaggcgaagacaacagctttatgactcatggcgaaacctgattggagagagtggaagttagaccgtcgaccgtgacagcgggagccggggcggcaggctggctgcgcagaactttttcaatgaagaagcgcgggcgggcacgcacatcgctgtacatgcggcccaggtattcgcccagcaggcccatgccgatgaactggccaccggtgaacacgaacaggatggcgaacagcacgaacataccgtcgccggcccattcggagccgaacaccaggcgcaggaaaaccagcagcagggcgaacagcacgccgaggccagccatgctgaaaccgatgatgctcagcaggcgcagcggcgtggtagtcatgcaggtgatcaggtcgaacatcaggttgatcaggcgcatcgggctgtacttggagtcgccgtgttcacgctcggcgtggttcaccagcacctcggtggtgtggcgggcgaagctgttggccaggatcgggatgaaagtgctgcgttcgcggcaggcgagcatggcgtcgaccacgctgcggcggtaggcgcgcagcatgcagccgtagtcgttcatggccacgccggtggagcgttgcacggcgaggttgatcagcttcgacggccagcggcgccaggcggaatcctggcggttgttgcgcacggtgccgaccacgtcgtagcccagctcggcctgggccaccaggcgcgggatttcttccggcgggttctgcagatcggcgtccagggtgatgaccacgtcgccgcggcactgctcgaaaccggccatgatcgccgcatgctggccgtagttgcggttgaggatcaccgccaccaccgggctgccttcgcggctggcggcgtcctcgaggatctgcgccgattcgtcgcggctgccatcgtccaccaggacgatctcgaaatcgtgcttgagctggcggcaggccgcttcagtgcggcgcagcagttcgggcaggctttcttcttcgttgtagaccggaatgacgatcgacacgaactggattggataaggtttcaaggtttcagtccagacaggttttgatggcgccgacgacccgcgcgacatcgtcgagggtcatgtcggggaacagcggaatcgagcacaggcgtgccgagttccattcggtgttgggtaagtgcacatccgggaaacgctggcggtaatagctgtgcaggtgagtggcgacgaaatggatgccgctgccgatgttctgctcctgcagggccttcatgaagccgtcgcgatcgatgccgcaacgctcggcgtcgatgcgcaggatgaacaggtgccaggcatgttgctgcggatactgcggcaggtgcagcggttgcaccggcaggtcacgcagctgctccaggtaggcgttggccaggatttcgcgctggcgattgatcgcgtccaggcgctgcaactgcaccagggcgatggcggcattgatatccgccaggttgtatttgaagccgggctcgatcacctcggcctggggcttgcgcccgtgggtcaggcggtcataggcgtcgacacccaggccatggaacttgagcatgcgcacccggttggccagggcctcgtcatcgctgacgaacatcgcgccctcggcgcaggtcatgttcttgatcgcatggaaggaaaagatcgccgtgccccgggcgccaatgggccggccacggtaggtggtgccggcggcatgggcggcgtcctcgatcaccgcgatcccgtgtttgtcggccagggcgtacagcgggtcgaggtcgaaggcagcgccggcgtaatgcaccgggacgatcgctttggtccgcggtgtgatcgccgcttcaatcgtcgcggcatcggtcatcagggtgtgcgggtcgacatcgacgaagaccggcgtcgcgcccagcaggcagatcatgttggccgtggaaacccaggtctgcgagggagtgatcacctcgtcgccgggaccgatccccaaggccagcaaggtgatgtgcatgccgccggtggccgacgacagcgccaccgcgtgctggcagccgacccgcgcggcgaattgctgctcgagctcctggtttttcggtccggtggtgatccagccagagcgtagaacctgctcgaccgcagcgatctcttcatcgccaatactcgggcgcgagaaaggaaggaaagcctggttcattgagacctcgggtgaagaaaaacgtcagaggacgaaggggtcaaatgatgtgtgagacgtgcggacggttcttgtttttattgatgtcatgtaacgaagtgcgtgcagtcattggcgcttatccatggttgagtcgctggggcgctccttaccgtgcttgagtaaagaccatattgagcaaaagtaaatacggatcaaggtgttataggtgaaataagatcaatctcagctcgcgttcaggatcttcgtcatgctggatccaggtttcgagggcccgaggttaatcggaaaaatgtgaaacgaacatgaaaaatagggcaagactccgtttatcttcgaagcagacagccagggttcagtttttccgcctgcagagcgctccaggcggtggtgaggacggctttttagaaccttccgcagtcttcttgaagaccccgatggcgctgttttttgtcctttggagtcatgcacctggatgcagccggcgagagtgtcggcggctgcactgtgagtcgaagaggctcaagattcgatccggggaaagatcaggatggtcatgttgccgcgctcgtaacgcttgccgcccaggggcagcaactcgacctcacgcacctcgtcggcattgttgacccgcatcaccacgcccaccgagccttgcttgcgggcctcggccatccattgctggacctggtcgaggcccaccgcgcggggcgctgaatcgggataggcgatgccgtacttcagttcgccgacggtgttgtacaggtccacctgcggacgttgcaggcgccaggccagtgccgaagcggcgcccaggtcgttgctcagcaaacggctggtctggcgcagttcctgctggtgctcggcaatgaattggtccggcatcttgctggcgacgatatgggccggcatcgccgcgggcagcagggccaccagcaggccgatacccaatgcgggcgccgcccacagcgtcaacggccgcagggcctgcagggcgttggtgatgatccagcccatcagcaccaggtagccgagggacaggctgaacatctccgtatgcccgtataccggccgggtgacctgcaggtagatcagcgccgccagcgcgcccagagcgaggccgacattgagcaggccgttgatgcgtatgacgcgcccgcgcgcctggttcaaccgttcgaccagggtgtgccccatcaacagagccaggggcagcaggcacggcatgatgtaggtgggcagcttgccccggcacaggctgaaaaacgccagtggcagtaccagccagaacagcaggaaaccgataccgggatcacgcttctgcttccaggcctggcccagggtggacggcagcaaggctgcccatggcaggctggagaccaccagcatcggcaggtagaaccaccaggggcgggtgtgctgggcatcctcggcggcgaaccggcgaatgtgctcgtgccagaaaaagaaacgccagaagtccggttcctgcccatggatcatccatacccagggcaggctgaccagcacggccaccagcaccgccagcgggccgtagcgcaacagttcgcccaggcgtcgttgccagatcatgtagggcagggcgatcaatgccggcagtagccaggcgagaaagcccttggtcatgaagccgataccgcaggccacgcccagcatcgcccaggccaggatgcgctgacgcggggtggaaccgtcgatggcaaaccacagcgcaaccaggctgaggttgacccacagggtaaattgcggatcgaggttggcgtagcccgcctgcccggcgatcaggccgaagctcatataaagcagggccgcggcaaaggacttgcgcggatccttccacaaacgtcgggcgatcagatacgccagtaccacactcaagccggtactgaacaccgaggcaatccgcaccccgaacaggttgtcgccaaagatcgcctggccgatggcgatcatccagtaaccggcaatcggtttctcgaaataacgaatgcccatgaagtgcggagacacccagttgccgctctgcagcatttcctggctgatctgcgcgtagcgggtttcatcggggatccacaggccgtggaaggtgagggacaacaggtaaaacaaagcgaacgccagaaacatcaacagcagtgtcgagcgtcgggtcatgggcgaacactcccccggtgaggttgttcatggcggacgggcggctgatagtcgattgactggccggacagacagcggaaatgggcgcgtgacatccctcggctcctgacagcagggttaagtttctgttggtcgttaaatgcgcccggcaaggcgttcgacattaatcgacgccgggctgatggctattcaagcttgaaaaacgctggcgtccagttatccgctgaaaaacaagtaacttattgattcaaggcgcgcctttagttgatttctttgaacttggcaaacttaaatgcatgtaagagaactttagttgtatttagtcggctgtcacgattgcgggtttcgtggattctgccgtactcgattgccgattcacggggcttggatcatgggctggtctatctttttccagcaccggcgaggagccgggcagggaaaaataccgctgtcgaaataacgatatgtactccaatgtgggtagccatggatctcaagcaaagcctgaacacgcggatcgtgattgttttcgccttgatgaccgcgctggtcgcaggcttctttgccatcggcatcgtcgccacggtgcatgtggtggaacgcaagctgaccaccatgagcctgggtggcaacctgcaccgcctgctgttgctggacagtcccgagcaatggagtcatcggccggaaaagaacgaactgttcttcgcccaggacggtcgcgtcgacctgatcctggggccgccgctcgacaccttgccggaaggcttccaggaggtgttgttcgaggggcagccctactacgcgatgacccgcgtggtcgatggccgcaaatatgtactgctgcgtgaccaggtcagcctgaaaaaacgcgagcggctgttgttttcggtggtggcggtgggcttcgtcctgagcatcctgctggccatcctcctgggctggctgctggccaaacgggtcatggcgccggtcatacgcctggcccgccaggtgcaccatcgtgatcagttgctggcgctggcaccgccgctggctccggactatgcgaacgacgaggtgggcgaactggcgacctcgttcgaccagaccctgggccggctgcgggcggcgctgggccgggagaaaatgttcaccagcgatgtcagccatgagctgcgcacgcccttgatggtgctggccagttcctgtgaactgctgctcgaaaatctatcgctcgacgcccgctcacaggcgcaggtcgggcgtatcgcccgggcgagcgatgagatgtgccaactggtcgacacctttctgatgctcgcccatgccgaaaatcgcacctcgcatctggggaccagcgccagcctcaaggaagtggcggatgcgctggcagagatctggggcaaactgattcgcgacaaggggttggcgtttatctacagcgtcgaacatgagtcggacacccgctacaacctgaccttcctgcaatcgatcatgggcaatctgctacgcaatgcctggcactacaccgatcagggtttcatccgcctgagtgtgctcgagcgcggttttgtggtcgaagacagcggtatcggcattcccgaggaagcgcgcaacgcaatgttccagcctttcgtgcgtggcgacgagcaacggggagagggcctgggcctgggcttgtccctggtgcagcgcatatgcagtcatcagggctggcgggtgaacctcggcagccgcgagcccaatggctgccggttcagtgtcgatttgacgaaccttggtggaccggatcggcaatccccaggttgatttccaccggcgacgccttcgtgggtgtgacagccatcgtatactgcgccttgctggttttgacgacgaagcactgcccgcaagaactggtttcccagccaggcttatcgttgtcgacagccatggcgaacctggactgtctcgccaccgacccaataacgatatagaaccccaagaggctcgctgtgtgattagagcaacaccagccaaaagcacatcgttcttcaccctgttgctgccattgcttctctcgatcgcaccggctcttaaggcgcacgaggccctcgagtttctgatcccggacgcgccgcccctgaccatactcaatcagggcgatcgtcacggcatggtcggcgacattgtcttgcaggcgctgaaaaacagcggttatgccagcgaacccagaaccctgccgtgggcgcgggcgcagaaatacgccatcgaaaaggacaacgtcctgatcgctccactcagccgcacacccgagcgggaacatcgctacacctggatcgccccgatcatgcagatggaccgggcatttttcagcctcgagcataaagtggcgaacttcgaagaagcccggcgacgtttcaaggccatcgccgtggggctgggcagtgcccaggaagaaatcctgcgcagcaaaggcttcgccccggagcagatctatgcgatcaagatcggcgagaaccccgcgcaattgttgttgaagggcagggtggacgcctggttcaacggagtccaggaaagtcggtatatctggaagcgcgtctcaagccggccgctgttgatgagcccacccatggtgagtcatgagctttacctcgcctgttccaaagtgtgcgacgccaaggtcgtgactcatgttgcgaaagccatagagaccatgcgccgtgatggttatatcgagaaagtcaaagagcgctatctaaataacgaccctttagcaaagtctggcaatttataactggccgcttcaggtttaccgaccctgggtagtaattagagtctgtccggcgagcaagagaagcttattcggacagcgcatcctcgttgagccgaatgacctcattgaggcttctaagggtgttgttgaagttgtccttggcatggctgagcttcttgaattgctccgccagttccctggttttttgctgcaatgcttcttcgcgtttatccagttcgacctgacgcgcttcttgttgcgcccgcaccgtgctgtcggattgccgatcttcgtcaagttgccgttgccgttgctgtaactgctcttccttctgttcgagcgcgcgctctttctcctgcagttgggactctctggagtccagggtctgctgttgcgcctggctgtgcagtttctgttgcttgagccgattggcgatgctggaaaactccatcaggctcgcctcgacatcctgcaggaagtgctcggggtcagtgcccgggaaaggccaggcttcatcctggggttcggcagcgggctgctgttcgtccggtattggcagggggccagcatcggagtagcggatatcggcagcgggcgcgtctggctgggggctttgcgttacgcagctgcccgtagttgcggtggattcgtggtgttcttgctcggcgcggtcatccccctgttcgtcaagctgcgccagggcggcgtcgagttgctggtcatcgatggctgtgggcaaatgctcagccgccgggccgaattgagccgaattctgaaagctcagcagcttggcgatccactctttcttggtgcacaacaggcgatgatccgccgcagcggcggggggcaactgctgtttgttcaggtccagcagatggtagggcacatcgctttcacggtgttcgccggtggcagcctcgcgcaggatctggctgaacacgcgaatcgccagcggcccatcctcgtccgagtccagggcgcccaggcagtaattgcccccttcgttgaataacaaagcgatatagacgcgcaggttatcgtcatcaaggctttcgttcaggctataggcgagaaagtttcgacctgcttctggaacagaaaaactgcagagcaaagccgctgtcagcatttgctgctctttgttttcgatggagatagtgcgtaagagcatatgtcacccagtaagctcaagtaaaaatatgagcgctaggatactaggaaataatgtcagttggcgttaagagcaatactctgggtttgtaggataaatcttataattctattgaatagtcttattcatatggatttacaccctcactaaaaatatcagcgtgtattgtattgcgcccattccgacacaacacagctgttgatcctgttacaactattcaatctcaaccccctgctgaatatgaatggcttttagctgttcgcctcagacttctcttgttgaacctggaagccatgatcgaaatatccaaactaaccaagtctttttccgggcaggtcgcggtcgacgatttgtcctgtcatatcggcccgggagaagttctggggattcttgggccaaacggtgcaggcaaatccaccacgatgaaaatgctcaccggctttctggcgccgacctccggcaccgcgagcatcctggggttcgacatccgcacccagacccgtcatgcccagcagcagatgggctacctgccggaaggcgcgcccagttacagcgacatggcggtacagggctttcttgagttcattgccagtgttcgcggctatcgcggcgcgcagaagcgcgaacgggtggaccgggtgatcgacctgctggagctcggcgacgtccgccggcagaccatcgagaccctgtccaaaggtttcacccgccgggtcggcctgggccaggcgatcctccacgatccgcgggtgctgattctcgacgaacccaccgacggcctcgaccctaaccagaagcaactggttcgccaactgatccaggacttgggtcaggacaagatcgtgatcatctcgacccacatcctcgaagaggtgtcggccgtctgcaaccgcgccctgatcatcagcaatggccgcttgctggccgacagcacgccgtacgagctggagcgcagttcgcgctatcgccaggcggtgaccttgcaggccgacgaaccgctggacctgctggccctggtggtcttgccgggagtggcgggcgtcgaggagaacccggccgagggcagcctgacgctgctggcgcggcctggcgaggtgattttccctcaggtcaacgcgctggtgaccgcgcgtggctggaagatgaagcgcctggaactggaacagggtcgtcttgacgaggtcttccagaccctgacccggggagagtcggcatgagacagttaccggtgattttcaagcgcgagctgggcagttatttcgccactccgctggctttcgtgttcatcgagatcttcctggtgctctcgggtgtcttcaccttctacctgggcaatttctacgagcgcaaccaggcggacctggcgccgttcttcgacgtccatccctggctctatctgttcctgttgccagccctggccatgcgcctgtggtcggaggagcgcaagtccggcagcatagagttgctgatgaccctgccggtgagctgtttcgaagcggtggtcggcaagttcctcgccgcctgggtggtcgccggcatcaccctgctgttgaccctgcccatggtgctcaccgtgaactacctggggaacccggacaacggcgtgatcctgaccggctatctgggcagttggctgctcgccggcacctacctggcgatcggctcctgcatgtcggccatggccaagagccaggtgatcgccctgatcctcgccttcatggtgtgtttcctgttcgttgcctgcggtttctccctggtgctggatgcactcaacccgtgggcaccgcaatggctgttggacttgctggcctcgctgagcctgctgacgcatttcggcgcgatcagcaaaggactgatcgacctgcgcgatccgctgtatttcctcagcgtgatcgtcgcctggctgatggccacggtggtgacggtcaacctgaagaaagccgagtgaggacgattcgatgaaacgcatgctgtattccacttccggcctgttgctgattgccctgctgttcctggccttcaacctggtgacagggctgctgctcaccggtgtccggctcgacctgacccagaacaagctctattccatcagcgttggcacccggcagattctcgcggagctgaaacaaccgctcgacctgtatttctacttttccgacagcggctcgaaggagctggtgccaatgcgcggctatgcccagcgggtccaggagctgctcaaggtttatgagcgcgaggccgacggcaagattcgcctgcacgtcatcgacccgctgccgttttccgcggaagaggacaaggccgccgagttcggcctgcaggccgtgccgctggggcagggcggggcgcccgtgtacttcggcctggccggtaccgatgagcagaacaaagcccaagcgatcgagtttttcgcgccggaccaggaagagttcctcgagtacgacatcagccgcttgctgcagaccctggccaaccccaagcgcccgaccctgggcctgttgagcagcctgccggccaacggtggcttcgatatccgcacgcagagcaagaccgagccgtggatgctgctccaggagctgcgtcgggagttcgatctgcaacagctcaagcccgatacccaggacatcccgaaagacgtcgacatcctgatgttgctgcacccgaaaaaactctcgcagccgaccctgtacgccatcgaccagttcgtgttgcgcggcggcaagctggtggccttcgtcgacccctacagcgagcaggactccggcgaggagtacttcggcatccagagcaaggacaagtcctccaatctcgagccattgttcaaggcctggggtatccatatgcagccgggcaaggtactgggggacaacctctatgccttgctggagacttccgaggaggacgggcgtccgctgccgcggccgttcaccctgggtgtgccgcaagccgccttgagccagcaggacccgagtaccgccgggctggagttcattgccctgaccaccgccggcatcctcgaaccggtggccggcgccagcacgcgcttcacaccgctgatgtacagctccgactcggccaaggccttcgaggcggaccgtttcgacaagccagccgaccgcaaacagatgttgcgcgaccaggaacagcccagccagcgttacgtgatcgccgcccgggtgcaaggcccggtacgcacggcctttgccgacggcatcgagggtcacaaggacggcctcaaggaggcgcagcaggtcaacctggtggtggtggccgatacggacctgttgagcgaccggatgtggctggaaatgcaggacgtcaacgggcgcccggcagcgcggccatgggccgacaacgcctccttcgtgctcaataccctggacaacctcgccggttcggacgccctgaacagcctgcgctcgcgcggcccctatagccgtccgttcgtggtggtggagcaattgcgccgtcaggccgaagccagcttccgcgccaaacgcttcgccctcgaggagagtctcgaggaaaccgaaggcaagctgcagcagttgcagggctcgccggacaagggcgagaccctcagcgccgaacagcaggcgacggtgcgccagttcctgcaggagaaaacccgcattcgcaaggaactgcgcgaggtgcagtaccagctgaacgccaatatcgatgagctgggcaggaccttgaagatgctcaatatcgccgcggttccgctgctgttgagccttggcatgctgctggtctgggccgtgcgctacctgcgccggagcaaggacctgtcgcgcaagtctgcgccgctcggcaaggtagccggctcacggcgagcgtaagtgaccagggcccgacctgccattcatgcggcaggtcgggccagcgccagggcgaggcgctgctacgctgggagcaactccccaacctgcgatcccgacatgactgaccagctcccgcccacgcctgcttgcagcgcccgacaactgctgaccgccctcaacctggaaccgcacacggagggcggttactaccgccggaccttccagacggaccagcggccgatgctcgccagcgcgggcgggcagcggtacttgatgacctccatctattacctgctgaccggggattcgcccattggtcactttcatctgaaccagtccgacatcctgcattacttccacctcggcgatgccctcgaatactgcctggtgttcccggatggccgcctggaaacccgggtgatgggcagcgatgtgctggctggtcagtgcttgcagcttcatgtccccggcggtgtatggaaggcctcgcggctgctgcccggcgcggcgggctacggcctgatcagcgaagcggtgtgccccgggttcgactacgcggacatgcagctgggctgcaagcgccagctcagcgaacgcttcccgcggcacgccaaattgttcgagcggctctgccagccctgaagaaaaccaccacgccgattgctcattgcgatcagtcaagtgtcacttgcgatcattgttgcgcgcggcgcccggcgcttatggtggctcggtcaatcaccgtcgaacgacagctccccggtccaccccttgcaagcgacaggagaacaccatgtccgatctgaaactgcatccccaggccgccgcctccctgcaacgctggcacgccatgctggcccagggtgacctgggcgccttgcctgaactgctggactcgaaagtggtattccgttcgcccatggcccatacgccttatccgggcgcgccggtggtttcgaccatcctcaatactgtgttcaaggtgttcagcgacttcgcctatcaccgtcaactggtcaccgccgatggcctgagcgtggtgctggagttcagcgcaagggttggcgagcggcagatcaagggcatcgacctgatcctcttcgacgaagccggcaagatcgtcgaattcgaggtgatggtccgtcccatgagcggcctgcaggcccttggcgaagaaatggcacgccgcctggcgccctatctggcggcgagcaaggcgtctggctgagcggcggcgagagcagggcggccagccattggccaaccggatgggcgccatgacaggcgcccgttttttatcgggggcaccgatgatcgacgatagcatcacggcgtctgccgacgccggacattgatttgcgcacacggcgacgcggttccagctgttcgccagacaacagtggctgaacactcacgtcgttttgcaacaacccgcttgctccagccaagcccttgaaagccaacagataaagcattttgccacttggcatggtcggtgcattggcccaagggagattgactatacctatagaaactcgcctatttttcaatcaggtggggagcaagaccttgaagcatgtgtctctgacaacagccgcgacaaccgcaacaaccttccgtcattcctctttattcgccgtcggcaccgcggtactcggcctggcctctggggccgcggccgccgagactccggtggccggcgagaagcgcctgggcacggtcacggtcgaggcggccaggcagactgccgcgcaagccgcccaggccgaactggacgagatccccggcggcaccagcctggtgacccaggccgaagtggagaagggccgctcggcgaccctcgaggacaccctggcctatcagcccggggtgtatgcccaggcggccggcggcaacgatgcgatcaagatttccatccgcggttccggggccaatacctcgccgggttacttccgcgagggcaccaagttcctgttcgacggcctggccctgaccggcgccggcggcacgccctatgaactgctcgatacccagggcctgaactacaccgaagtgctgcgcggggccaatgccttcgaatacggcgccttgtccctgggcggcgcgatcaacttcgtgacccactcggggctgaccgcgccgggtaaccggatcaaggtcgagggcggcagtttcggctggcagaaacagaccctcagcaccggcggtgtcgtcggggatggcgactacttcgtcagcgtcgacaactcgcggcgcgacggttaccaggacttcaccttcaccaaggccaagggcgtggtgagcaacttcggttatcgcttcaacccgaaactggaaacccgcctgtacgtgcgctatcgcgaggagtaccacgagaactcggcgccgctgacccgcgcgcagatcaagcgcgattcgtcgaagaccaccgccgccgtgcgcgatgcccggggcgactcgaccaagcgcggctcgacctgggtcggcagcaagaccacctacaccttcgacgacgatgcgaccctcgaggccgggctggtgtaccacaactacccgcagatcctcagtcgccagagcagcgtcaaccccaactactgggactggcgcgacatcaactattcgctcaagtacagccgccacgaccaggtgttcggcctgccgagtaccaccacggtgggctggagcagtaccgagcatatccgctccggggtgcgtacctaccgtggcgacaaggacctgggcgtgctgcagaaacaggtcgaatacgacggttcgttcgatcatgtgttcaccctcggcaacgacctcggcctgaccgacaacctgtacctgtccagcgggctctcggcgatcgagatcaagcgcgatatcaacgtcaccttcagcgaccgcgacaacaccagcggcctgccggaccattaccgctatgacgagtggaaactcgcgccgcgcgccggcctgcgctactacctgaccccggatgtccaggtgttcgccaacgccagccgctccatcgacccgccgagctcctggtccagctccggttccggggtcaccagcaactacgccaagccgctggtgccacaaagcgccaataccgtggagttcggcatccgtggcaagaacgcgattttcgacggtagcctgaccctgtacaaatcctggatcaagaacgagctgctcaacgtcgaagtgctctcggccacccgcaccacggccgcggtggtctccacctcgaacgccacgccgaccattcaccagggcgtcgaggccgggctcaccacgcgcctctggcaaggcggcaacggcgacgtgctgagctggcgccaggcctacaccctcaacgacttccactaccgcaacgatccgctgttcagccagaacgagctgccgggcctgcccaagcatgtctaccagggcgaactgttctaccagtacgccaacggtttctacgccggcatcaacgtgcgcgcggtgtcgagtaccgcggtggactacgccaataccttctatgccccgtcctacaccctgtggggcgcgcgcttgggctacgacgacccgggcaagaagtggcagctgtacctggacctgaagaacctcaccgaccagaactacgtgaccgccgtgctgccgacctacaacgccaacggccgcgacaccgcgtcgctgtatccgggcgacggcttcggtgccttcaccggcatcgcctacaacttctgagccagcgcggctgctgtccggcgcgtcccacgacggcggccgggcggtggcgggagacagcaatgaccctgaccacaaggcttgcccgcctggcggcgctcgtcgccgtgatggcgctggccgcctgcaaaccggccgccgaggcaccgggcagcccgaccgcgcaaggcgacggccggctggacaacggcagcctcagctacgccgccgaggattaccgcgaaagcgcgcccggcaaaccgggcggcaccctgcgggtgtcgacttcgtccgacaccaccaccctcgacgtgcattcgatttcccacggcaatgtgcagtggctggggcggattctgttcgactgcctgctgtaccaggacgagcagggcaatatctcgccctggctggccaagtcctgggaggtttccgccgacggcaagacctacacctttcacctgcgcgacgacgtgaccttcagcgacggcgagaaattcaacgcccgggcgctgcaggtcaacctcgaacacatgcgcgacccggccaccaagtcaccgttggcggcggcctacatcgcgccctatgtcgatggccggatcgttgacgagtacaccttcgaggcgcatctgcgcgaagcctattcgccgttcctcgatgtgctcgcccagtcctggctgagcatgatctcgccgcggcagatcctcgaagcaccgaagaccatcgccgaacggccgatcggttccgggccgttcgtgctggaaagctacacccgcgaccagggcgccagcttcgtccggcgcaagggctaccactgggcgccgccggtcacgcggcaccagggcgaggcctatctggagcgcctcgagctgagcatcgtgcccgagccgatgatccgcttcagcgccctggagtcgggccagtcggatttcaccgtggacgccccggcgcagaatgcccgggccattcgcgccaaccccgaactgcggatgcgcagccagatccgcaaaggcaatccctttcgcagcctgaccttcaacgtcgagcgttttcccttcgaggatgtgcaggtgcgccgggcggtggccaaggccatcgaccgcgaaggcctggcctggatcaccgggtttggcgagtacctgcccaaaggtgacttcctggccaccaacacccgctactacgacccggcgttcaaggacgtgctggcgtacgacgtcgacgccgccaaccgcatcctcgaccaggccggctggagccagcgcgatgcccagggctaccgggtcaaggacggccggcggttggcggcgcggctgttgacctacgaaaccggggctttccccggcagcgtgccggtggcgatccaggccgacctgaagaaggtcggcttcgagctggccatcgacctgttgcctctggcccaggtcatcgagcgccgttacgcgagcaatttccaggcaatcgccggtggctactggcacaccaacaccccggacggcctgttcatcctctaccacagccaggcgatcagcacgcccaagctgatcgggcagaacgtcgggcgcttgcgcgatgccgagctggaccgcgccttgtccgccgcccgccagctgcaggacccggtggcgctggccgcggcctaccggatcgcccaacagcgcctggtggaaaccgtgcctgcggtgccggtgttcgaaagccacgtgctggtggcctatcgcaaacaggtcaagggcctgattttcgacacctcccacaacacaccttttttcaccagcgtctggctggaccaggagacccgatgaacagcctgcgactcgtcctgcgccgattgttgtccgggatcggcgtgctctggggcgccgcgaccctgacctttctcgcgctcaacctcagcgccggcgatccggccctggcgatcctcggcggcccggaagccatgcccagcgccgagctgatcgcccaggtgcgcgccgaatacggtctcgaccagccactgatcgtgcaatacggccagtacctcggccgcctggcccagggcgacctcggcgattcctatcgcctgcggattccggtggtacaggccatcggcgggcaactggcggccaccgtgcagctgtcattggccgcggcggtgctggcggtgttgctggcagtcggggtggcggtgctgaccgccaaccgcgcgcgctgggttcgctcgctggcgtccggcaccgagctggtgctgtcgtcggcgccgtcctttgtcatcggtctggccctgctgctggtgttcgccttcggctggcacctgttgccgccttccggttcgaagggctggcgcgcgttgatcctgccgagcctggccctggcgctgccgatcgccgcggtgctgacccaggtcttgcgccaggagctggaagacatcctcgaacaaccctttatcgccatggcccgggcccgcggcctgtccgagaccggggtacgcctgcggcatgccctgcggcacgcactggtgccgctggtgaccctgtccgggttcgtcttcgccagcctgctcggcggggcggtggtgatcgagctgctgttcgcgcgccagggcatcggccggctgatgctcgacgcggcgaacagcaaggacgtgccgttgctgctggggatcaccctgctggcggcggcgatttatgtggtcgtcaactttctggtcgacctgatcaatcactgggtcgatccgcgcgcgaaagccgtgtgacgccccgcaaggacctgtcatgactgcacatccacccaagcctcagtcttactcggcgttgcacgagcgcttgcgcccgctgttcgagcgcatcgccgccggcgccatcgagcgcgagcagcaacgcagcctggcgttcgacgccgtcggttggttgcgcgaaaccggattcgcggcgctgcgggtgccgcttgcccatggtggcgccggcatcagcctgccagtgctgtttcgcctgctgatcgacctggcggcggccgactcgaacctgccacagatcgtccgcgcccatttcggtttcgtcgaagggcgcctgtccagcggcgacagcgcatcccaggcctactggttcgccaaggtgcgggacggccagctgtggggcgcggccatggccgaacgcagcgacagcaccagcaactcggtacggctcagcgccgccgacccgcagaatcccgacgccggctggctgctggacggcgagaagtactactgcaccggggcgatctacgccgactgggtcgccgccgtggccatgctcgacgaggatttcgtcagcgtggtggtggcggtggacgcccccggggtcagccgcgaagacgactgggacggcttcggccagcgcctgaccggcagcggcaccacccgtttccagcaggtcgcggtgcccaacgagcatgtgctgcgccgcttcaagcccggcgagctgcgcgccgagtcgtacctgtcggccttctatcagctgttccacctggcgaccctggccggcattgcccgcgccgtgttgcaggacgccacgctgttcgtccagggccgcacccgcgccttcggcgtgccgggtcagtccagccccaaggacgatcccctggtgcagcgggtgatcgggcgcctgtcgagcctggcctatgccaccgagaccctggtgctcggcgccgccgaggtgctcgaagatgtgcaccaggccgaactcgccggcacggcgcaggagtccgactacgtcgaggcggatatccgcgtgtaccaggcccagcagatcgttctcgaacaggcgctggaagccaccaccttgcttttcgaagtcggcggggcctcggccaccagccaggcccggcgcctcgaccggcactggcgcaacgcccgcaccctggcctcgcacaacccggcgatctaccgcgagcgggcgctgggcaactactacctcaacggcgtcagcccgggcgccgcctggcgtgccctgcatgagcaggacgcggccagcggcggcgcgcgtgacgaagccagcgcggtctgacccccaccttcgcaggagtgaccatgagccagcctgaacagcagatgagtatcggcatgaacatcctcggcttcggcgcccacgccgccgcctggcgcaaggccgaagtggcggccgacgcttacctggacgtcgagtattactgcaacatcgcgcggatttccgagcgcggttgcctggacgcgatcttcctcgccgatggcccggccctggtcggcgatgtcgcccggcagccggtcgggcggctggagccgacggtattgctgaccgcggtggccctggcgacccggcatatcggggtgatcgccaccgcgtcgagcagctacaacgacccgtacaacctggcccggcgcttcagttcgctggaccatatcagcggcggtcgcgcggcctggaacgtggtgaccaacgccggcgacgccgcggcgcagaatttcggcctggccggcgcgccacggcatgtcgaccgctatgcccgggccgacgagttcatcgacgtcaccctcaagctgtgggacagctgggaagaccacgcgatcatcggcgacgccgggagcgggcgcttcgccgatccggcgaaggtccatgccatcgacttcgtcggccagcacttttcggtcaagggcccgctgaacctgccgcgttcgccccagggccggccggtgctggtccaggccggctcgtcggaaggcggcaaggccctgggctcgcgttacgccgatgcgatcttcaccacccagaccactctggtggacggccaggctttctatcaggaaatgaaacaacgcgcgcggcagtgggggcgcaaccccgagcacctgaaaatcatgccgggactgtccacggtgattggcagtaccgaggccgaggcccaggcgcgtttcgaccagctcaatgcctatcacggcgaagagggcctgctgcaacaggtcgcctcgcgggtaggcctggcggtcgaggaactggacccggacgcgcccttgccgtggcagcggatcggccctatcgaagcgttcgagcgtggctcccatggtttcctcgaagcccagttgaacctggcgcgccgggaaaacctcagcatccgcgaattgtcgcgacgcatcctggtgggccaccgcctgctggtgggcaccccggagcaggtggccgacagcctggaacactggtttcgcgccggcgccgccgacggcttcaacatcatgccggacgtgttcccgtccggggtcgaggccttcgtcgaccacgtggtgccgctgctgcagaagcgcggggtgtttcgccgcgaataccgtggcagcaccttgcgcgaacacctcggcctgccgtatccggccagccagtaccagcagacggccgtcgccgtttgaacccatccatcaccgacccggacagaccatggactaccgcacacttggcaacagcgacctgaaggtcagcgcactcggccttggcagcatgacctggggccaccagaacagcgaggccgaggcccatctgcaactcgacgaggccctggcccacggcgtcaacctgatcgacaccgcggagatgtacccgaccccgacccatggcgagacctggggcagcaccgaacgctttatcggcagttggctggccagccgcgggcgccgcgattccatcgtcctggccagcaaaatcatcggcccggcgcgccaaccgggggcgggggcgcatatccgcgacggcctgacccgccacgaccggcacaacctagtccaggccctggacggcagcctcaagcgcctgcgcaccgactacctggacctgtaccagctgcactggccggaccgcaccaccaatatcttcggccagcgcgaatacccctatgtcgacgaccccgaggcgattgccatcggcgagacgttggccgtgctcgccgaacaggtggcggcgggcaagatccgccatatcggcgtgtccaacgaaaccccgtggggcgtcgcgcagttcctgcgccaggccgagatcctcggcttgccgcggatcgtcagcatccagaatccctacagcctgctcaatcgcctgtacgagggcgggctctcggagttcagccaccgcgaaggcgtcggcctgctggcctattcgccgctggcgttcggcgcgctgaccggcaagtacctgggcggggcgcggccagagggttcgcgcctgtcgtcggtgtaccgcagcttcaaccgctacgacagcccgagcgcgcaacaggcgatcgcaggctatgtcgagctggccaaggagctggcggtgagcccggcgcaactggccctggcctatgtgctgggcaagccctttgtcagcagcgcgctgaccgggcagacctcgctgacccagttgcgggaaaacctcggggccctggcgctgcgcctggatgcccaggcgctggcgcgcatcgagcagatccacgcggcaatccccaacccggcgccctgagcgcccactttcagcctgtggaggtgcccatggcgcccatcaatcaaagcccgccggcgccggtcggcctgatccaggccgtgcccttgttcgccgcccggcgcccgcgggttcgcgcctgggtggcgcgtccgggcctgctgctggccgggctgttcgtggtcctgctgctgatcgccgcgttgcaaccggcctggctggtggctggcgatccgctggcggccaatgcccgcgaggcgtttcgcgccccggacagcctgtactggctgggcaccgacgagaacggccgggacatcctcacccggctggtctacgccgtgcgtccctccctggtgctggggctggcggcgaccgccatcggcctgctggtcggcacgctgttcggcctgctcgccggcctcggcccgcgctggctggacggcgcggtgatgcgcctggtggatgtgctgctggcgtttcccgacttgttgctggccctggtgatcatcacctttttcggccagggccagctcaacaccatcattgccgtgggcatcgccagcgtgccgcgctacgcccggctggtccgcgcgcaaaccctggtggtgcgcggcgcggcctatgtcgaggcggcgaccaccctggggctcgggcgcagcgcggtgatcgcccggcatgtgctgccgaatgcgatcaagccgatcctgatcctggccaccatcggcatcggcggcaacatagtcgccggcgcggccctgagctttctcggctttggcgcggcgccaccggcgccggagtggggcggcatgctcgccatcggccgcaattacctgggcaacgccggctggctggtggcctggcccgccctggccatcaccttgaccgtggtgtcgatcagcgcgatcggccgcgaactgctgcggcgcagcgaaggaaaacacctatgaaccttattccagaaggccccgagccgctgatccgggtcaccgacctgcaggtgcgcttcggcgcccaggccgcgcccacgctcaagggcatcagcttcgaactgcggcgcggcgaatgcctggccctggtgggcgaatccggctcgggcaagagcgtcacctcgcgcaccctggccgggctgaccggggccaacgcgctgatccaggccagccgcctggagttcgccgggcaggacctgcggcgcttcgacgagcgcgcctggcgccggatacgcggggcgcagatcggctttgtcatgcaggacgccctcggctccctcgacccgctgcgcccggtgggcaaggaaatcgccgagcccctggaactgcacagcgcgctggaccgggcgcagcgccaggcgcgggtgctcgaactgctgcgcgcggtgggggtgcccgagcccgagctgcgcgcccgccaatacccgttccagctctccggcggcctgcgccaacgggcgctgatcgcctcggcgattgcctgcaatccacggctgctgatcgccgacgagccgaccaccgccctggatgccacggtacaggcccaggtcctcggcctgctggaatccctgcgcggcgacagcaccgcgatgctgatcgtcagccacgacctggcggtggtgtcgcgcctggccaaccgggtggcggtgatgcacaacggagtgatcgtcgagcagggcagcgtcgaggaggtcctgcacgatccgcggcatccctacacccagttcctgttgcgcgcgggcagggcggtgcactttcgccgtcccgcgccaagcccgcggccgatcctgagcgcggtggcgccggccggggccgaggcgccgccgctgttgcaggtggacaaattgagcaaggccttcaagggcccggacgggcgcctgcgcacggtggtcgacggggtttgcctgcaactgcgccggggccagaccctgggcatagtcggcgagtccggctcgggcaagaccaccctgacgcggatgatcctcggcctggagaccccggacagcggcgccatcgagctgctgggccagccctggctgagcctgacggatgcgcagaaacgccagctgcggcgcagcatccagatggtgttccaggacccgctgagttccttcgacccgcgctacagcgtgcagcgggtgctgttcgaagcgttgcaggtggccgggcatccgcgccgcgactgggcgccccaggccgcggagctgctgggcctggtgcgcctggatgcggccttgctcggccggcgcccgctcgaactgtccggcggccagcgccagcgggtggccattgcccgcgcactggcggccgggccgcaaatcctggtctgcgacgagccggtgtcggccctcgacgtttcggtgcaggcgcagatcctcgaactgctcgacgacctcaagcaacgcctgggcctggcctgcctgttcatctcccacgacctgggggtgatcaaccatgtcagcgacgcggtgctggtgatgaaggacggccgggtggtggagaccgggccggtgcgcgaggtgttcgatcatccgcagcatccctacaccctggccttgctcgacgcgattccacacctggaaagcggccggcgcacgtccttcgaatttctcaagctggcgatctgagccatggccccagcgccggcgctgccgctgcgttttgcctcggactcggccggggcctgaggccgacggtcatcagccacctccagcaggcaggagtcgagatggagaatattgcccaggtcatcaaccccgacgattacctcgagaccgagttcggccgcgagttcacgcccgagcgcaacaagcaggcctgggccttggcgtatgcgcggctggaaacggagctgtcgagggccgccgcgggggcccgcttgtatgtggtcatgggcgtgcagggcgcgggcaagtcgcgctgggtcgcggagaatgccgagcgcctcggcgcccgggcgatcgtcttcgacgcggccttgcccgcccggcggcatcgccagcgcttgctggcgctggcccggcattacgcggtgccggccatcggcgtcttcgtccgcgcgtccctggaacaggcgctgtcgcgcaatgcacggcgcgcctcggacaagcgcgtgcccgaagccgcgctgaaaagtgtcttcgccatgctcgaaccgccctgcgaggcagagggtttcctgcgggtggaagcggcgggcgagggcgacctcgcctgaggcgccgacggcgctgttgctcagccaacagcggctgaacagattgtttgcctaccacctgggcagcgccggccacagtgccggtttacgggttggaaaacccggcatgccttgtgcaatagcctggttcccggacccaaggcctatcagcacccatgcgagaacccgcccagcctctgcaattgcacagcccgcgacccaggtcgcccaggatctatccccccatcgctcccgccaccctttgcagcctgtaacaaaatcgccatctaaccccgaatttcgcacaaggaaatgccatgagcagcttatccgctgtacccgaacgcccgattgtctcggtggaacaactcaatgcccgggccgaccggctgttgccagagatcgcccagggcgccgcgcaacgcgagcgcgaacgacagttgccgttcgacgcggtggcgcagattgccaaggcgggctttttcacctgccggattcccgggcgctacggcggcgcgggcggctcggtcaaggaactgatcgcgctgctgatccgcatcgccgcggtggactccaacgtggcccaggcgctgcgcccgggtttcggcttcgtcgagggcttgctggcctcccgggcgagggcgcggaggccgagcgcgagcgctggttcgagcgttacctgcagggcgcggtgctgggcaacgccggctgggaagtcggcggcgccaacggcacgatcagcgcgcgcatcgttcgcgacggcgcccattaccgggccagcggcagcaagtactacagcaccgggtcgctgtatgccgactgggtcagcgcggtggccctggacgagaacgaccagccggtgtccttcgtcctgccccgcgatcgccagggcctggagctgctggacgatttcgacgccatggggcagcggctgaccgccagcggcaccacccacctgcacaacgtacgggtcaaggccgaggagattcgcacccgcaccgtggaggagggcaagcgcaccatcgtcacgccgttcctgcagctgttcctgggggcggtgcaggccggcatcgcgcgcaacgcgctggacgacgcggtggccttcgccaatgagcacgcgcggccgatcaagcacagcagcgccgcgcgctcggtggacgatccttatgtcgaactcagcgtcggcgacatctcggcgcgggccttcagcgccgaagcggtggtgctgcgcgcggccgagtccatcgaccgcgcctgggccgccgatctcgatccgcaggcggtggaccaggccgcggtggacgtggcccaggcgcaatacatcgccgccgagtcggcgctcaaggcggcggagctggtgttcgacgtcggtggcgcctcgaccaccggccgtgcccataacctcgaccgccactggcgcaacgcgcgcaccgtggccaaccacaacccacggcactggaaggccgcggcggtcggcgcctggcagctcaagggcacgccacctccgacctcgggcttgttctgacaggccagccgttcaatggtcgacgaccgtggacaccgcgggcctgcgcctggtcaggccacggcctgtggggttgaccacgtcgttggccgacattgccagccagaagctggcgcaggccgtggggcttcaatgcatacacacaataacggcggcccgcaggtcggcgaccttcagtatctgcgccaccctggtcgatcaacgcccggcgccttgagccagggggcgcagggcagccagcgccgggtgccgatgatcatcggctgcgcgctgttcatggaactgatcgacgccaccgccgtgctgaccgcgctgccgcagatggcccgcgacttcaacgaacccagcgtgcggatgaacctggtggtgtccctgtacctgctggcggtggcgctgttcgtgccggtcagtggctgggcggcggaccgcttcggtccgcgccgggtattcgtcagcgccatcttgctgttcaccctggcttcggtggcctgtgccagtgccggttcgttgctgcaactgtcgctggcgcgcatggcccagggcgccgccggggcgatgatggtgccggtggggcaggtgatactgctgcgctggtcggcccgggacaacctgctgcgggccatgtcctacctgaccattccggcgctgatcggcccggtgctggggccgcccctgggcggtctgctggtgaccttgctgtcgtggcagtggatattcctgatcaatgtgcccatcggcgtcctcggggtgttgctggtgctgcgctacatccccgactatcccggcgcccgcgggcggcccctggatggcgtggggctgctgctcagtggcgttggcctgggcggcctggtgttcggtttcgaggcgttcggccacggcctgctggaacggcagtgggcgctgatgttgatcgtcgccggggtgctctgcgccgctttgtacgtcaggcacgccaggcgcgtggcgcagccgttgatcgacctttcgttgctgggcatcccgaccttccgcctgagtttctggggcggcaacctgctgcgcatcggcagcgcctcgcagccgttcctgctggtgctgctgttccagctgtgtttcggcctcaatccgttgcaggccgggctcttgagttttgccagtggcgcgggggcgttcctgatgaagctgctggcggtgcggatcgtcagccgcttcggttttcgccgcaccctgaccgtcaacgcgctgcttaccgggctgacgatagccgcctgcgccactttcgatattgcaacgccgtactggctggtgatcctgctactgtttggcagcggcatcatccgctccctgcagttcagtaccctgggcgccttgacctacgccgacgttcccgccgagctgtccagccgcgccagcagcctggcggccatgaccatccagctgagcatgagcctgtcggtgggggtcgcggcggcgttgctcagcctggtcatggcgctgcgcggccacgccagcatcgtggaaagcgacgtggccctggtgatgctggtcggcggcgggttttgtgcgttgtcggcgctggtgttccgcagactttcgccggcggcgggcgccgccgtgtatacaggagataaccgatgattcgcctcgcccgtcccacggatgcgccggccattgcccaggtgcagattcgcagctggcagcaggcttaccctggattgatgcctgacgattacctggcttccctggacaacacccaggagcaacgccagggctggtggcgacagtcgatcgaacagggttcgcccgaggtgttcgtggccctggtcgacgatcaggtcatcggctggatcgcggtcggcggcagccgcgacgaggatgtcgacccgggtacaaccgccgaggtcatggccttctacttgctggccgagcactggcgcagaggcattgggcgcgccctttgggcaaccgccgtggaacatctgcgcgaccagggtttccaggccctgagcttgtgggtgctgctcgacaatacgcgggccacaggcttctaccgcaacgccgggctgcgggccgacaaccgctcgcggcggagcatttccaggggtggccggacgctggagggaatccgctaccgggccacgctttgaccaccgtattgcaacgggcgccagcgcgcccattcttgcctggaagctgcgcggccacaggttttttccaggcaaccatcgctcatgagttcgtcttcctcgccttcgggcgatcgccactaccgccattggcaagtccggcacctgcccgccaggccggcggtttctacgcccagctcaatgcgcgcgcggcgtccagctactacggcgcaagccgcaccgggtgacccgcgcatccggtgttaccacgagcacgttttccgtgcccgacaggccccgtcctggggcgttttcactcgccgtcctggctgccgatcttcttcgccagccttaccggacaagtaaaaaccaagcgaatcaagtacctgtaaatcgggcaggggccttggcacgcaatgtgctgttttggctatatggataattggatacaaaaatacaaaaggtgccgccgatgaaatttgccccagcctataccgagcgccagcccgtgaccgcggaggaggaggcctacaactttctgttggaagcgatctgcaaagggcgctttagcaccggcgagcggctgatcgccgaggacatcgccagcgaaatcaacatgagccgcatgccggtacgcgaagccttccggcgcttggatgccgatggcctggtgaccctgcgaccgaatcgcggggccatcgtgcgtggccttaacatcgacgaaatgcgcgaggtcttcgaaatgcgcagtgccctcgaaggcctggcgatccgggtggcggcgggcaagatcaccgagcgtcacttcagccatctggagcgcttgctcgacgagatggacgactaccgcgaagacggcgccgagtgggtcagccgccatcgcgccttccatgaatacctgtgcagcctgagcgaacgcccgcggctgatgcggcagatctcggcgctgtattcggtgatcgagccgcacatgcgcctgtggctgcagcacgccgacaagccccgcagcgcccgtgacgaacatgcctcgatcattgccgcgctgcgttccggcgatccggacaaggcggcgcaggtggtgtgcgagcacatcgaaggcaccatcccgcggctgatccagttcctggaggcccatcagtaaccacgcactgttcgccgggcgcttcacgcttgaggtgaacgccatccccccttgctacccgacatgactggagtaatgccatgcacaagccttgcgcgtcagctgccatttttaccttgagtctgtgttgttccctgtgggcgcaggccgcccccgagttgccggaacgcctgagcaagagcgagaagatcgtctactgctccggcatggattcgccgccgctggtgtcgttcgacacgcagcagaaaccggtggggttgcaggtggacatgggcgaggcgattgcccagcgcctgggcggcaagcaagtcgaatggcgcatctcgccgttcgccgggctgatcccggcgctgctggcccagcaatgcgacatgatcgtcgaccagctgttcgacaaacccgagcgccgggaagtgatcgacatcgtcaatttcatgtactccagccagtcgatcgtggtgcccaagggcaacccgaaggcggtgaacagccttgaggacctgtccgggctcaaggtggcggtgagcaacggttcgaccatccgcatcctgctcggcgccgagaacgacaagctgctggcggccggcaagccaccgatgaaactggtggtgtacaacgtcgacgccgatgccttccaggcgctgcgcatcaaccaggtggacgccttcggcaccacggtggagtccgccgggcactatcagcaactggccccggacctgttccagtcggcggtgccggcgttcaaccggatcctcaccggtttcggcgtgcgcaagcaggacccacaactgagcgcggcgctgagccaggttttgcaggacatgcgcaccgacggcagctacgccgcgctgctggataaatggcacgtcggcagcgacaaactggactgagggcgagctcgatgaacttcaattgggacgtgttctggcagtacctgttgctgcccagcgatgtctacctgacggggctcgggctgacttgcctgatcagcgtatcggccatgctcctgggctgcgtgctggggttgctggcggcgctgatgaagctgtcgcgcaacccgctgttgcagtacccggtgcgcttctatgtgtggctgatacgcggcacgccgctgctggtgcagatcgtgttcctgtataccgcgctggcggccggggggattttccgtttcgaggacctggacctgggctggttggtggtgccgggcaatatccaggcggcgatcatcgccctgggcctaaacgaaggcgcgtacatggccgagatcatccgcgccggcatcggtgcggtcgataaaggacagtacgaagccgggcgctccctgggcatgaccttccccaaactgatgcggcgcatcgtgctgccccaggcgttccgggtgatcgtcccgccgctgggcaacgagttcaacgtgatgctgaagaacaccacgctggtcagcgtcatcggcgtacaggagctgctgctcagtacgcagatggtcacttcggcgaccttccgggtgttcgagctgtacctggtggtcgccatctacttcctggcattgaccacgctctggggctttttccagcgttggctggagaaccgcttcggccagtccgaccgcccggcgccggcggccagccgcctgttcgggcgtcacaccctgaaactgctgagggggcgctgaacatgccgcacatgaatgaagaactggtcatcgaagccctggatattcacaagtccttcggcgacctggagatcctcaagggcatctccctgcaggtccggcgcggcgaagtggtggtgctgatcggcgcctccggctcgggcaagaccacctttatccgctgcattaatctgctggaggacatccaggccgggcagatccgcgtcgccggccagcccatgggctaccgcacacgggccgacggcagcctggtgcgcgattcggaacgcaacatcgcccgccagcgccgggacatcggcatggtgttccagcgcttcaacctgttcccgcacatgaccgccctggaaaacatcatcgaagcgccaatccacgtcctgggcgtgtcgcgcgccgcggccgaggaacaggcgcgggcgctgctcaagcgcgtggggctggcggagaaggcggggcactatccttcaatgttgtccggcggccagcaacagcgggtggccatcgcccgggcgctggcgatgaagccccaggcgatgctgttcgacgaacccaccagcgccctcgacccggagacggtgggcgaggtgctgcaagtgatgaaggagctggcggaggagggcatgaccatggtggtggtcacccacgaaatgggctttgcccgcgaggtcgccgaccgggtggtggtgctcgatcaaggtgaactgatcgagcaggggccgcccgagcagattttcagccagccacgccacgcccggacccgggcctttctcagccgggtgttgtgaacccgaaccctcaatatgtgtgtgagacctgccatgttcgaattttctgcccacgagtatccctacgcctcccagcggcaaagcgtgttcgccaagcgcggcatggtcgccgcgtcccagcccttggccgccgaggccggcattgaaatcatgcgacgcggtggcaacgccatcgatgccgcgatcgccacggcggcggccttgaccgtggtcgagcccacgggatgcggcatcggtggtgacgcctttgccctggtctggacccaggacaaactgcacggcctcaacgccaacggcgtggcgccccaggccctgagcatcgaggcggtgaaagccgctggtcatgaacagatgcccttgcacggctggacgcccgtgacggttcccggttgcccctcggcctgggccgagctttccaggcgttttggccgcctgccattcgccgacctgttgcaacccgccatcagcctggcgcgcgacggtttcccagtgtcgccggtggttgccctgcaatggcaaagcgcgctggagaacttcaccccgagccgcaacgccgtgctcgacagttggttcgacacctatctgatcgacggccgggcaccgcgggccggggaaatgtttcgcaacccggcgcaagcccggaccctggcggaactggccgccaccggctgcgagagcttctatcggggggccctggcgcaacgcctggaccagcattcgcgggccaccggcggttatctgcgtgccagcgacctcaaggattactgcgcccagtgggtcgagccgatcaaggtcaactatcgcggcgtggacgtctgggagattccgccgagtggccaggggctggtggtattgatgaccctgaagattctcgaaggcttcgacttcgatcatcgcgacagccagcagacctggcaccgccagctcgaggcgatgaagctggcctacagcgacggcctgcactacatcaccgaccccgcgcatatgcgggtcgcggtggaggacctgctcagcgaccgttatgcggcccagcgccgggcgcagatcggcgaacaggcgctggccccgcagccgggcgacccgcacgccagcggcacggtctacctggccaccgccgatgccgagggcaacatggtgtcgttcatccagagcaactaccacggctttggctcgggcgtggtgctgcccgacagcggcatcgccctgcagaaccgtggcgaagaattcagcctcgaccccgcccatgccaactgcctggcgcccggcaagaagaccttccacaccatcatcccggggttcctcagcaagggcggcgtgcccatggggccgtttggcgtgatgggcggctacatgcagccccaggggcatgtgcagatggtcatgaacctggtggatttcggcctcaacccgcaggcggccctggatgcaccgcgctggcaatggctgggcgggctgcaagtggggatcgaacagaacgcctcgcgggacatgaccgccgccctggcgcgtcgcgggcacgaggtgcaggtggcctgcgacctgaccagctacgggcgcgggcagatcattctgcgcgacccgcaaaccggcgtgctgtgcggcggcaccgaaccgcgcacggatgcgcatatcgcggtgttttgagccaaggggggaggcgggcgcgggcgtttgtcctcgccgcgttcccggccggcccgggccgtcctgtggaggccggttcctcgactagactcacgcgatcgatggaagcgagcatgaggttccggtcatggcaaaaaacaaaaagggcgccgccaagggcgctcccgctgaacctgcgaaactgaacaaaaaagactacgaggaccagttgcgccgcttgcatgtcgaactggtcaagctgcaggagtgggtgcgcgaaaaaggcatcaagatctgcatcgtcttcgagggtcgcgacggcgccggcaagggcgggaccatcaaggccctgaccgaacgcctgagcccgagggtgttccgggtggtggcgctgccggcgccgaccgaccgcgagaaaagccagatgtacctgcagcgctacctgccgcacctgccggcggcgggcgaagtggtgatcttcgaccgcagttggtacaaccgcgcgggcgtcgagcgggtgatgggcttttgcagcgaagagcaggcggacggcttcctcaaggcggtgccgctggtggagcgggcgatcgtcgattcgggcgtgatcctgctcaagtactggctggaagtcagccaggaagaacagacccgccgcctcgaagcacggatcaaggacgggcgcaaaatctggaagctgacgccgatggacgtcaagtcatacagccgctggtatgactattcccgtgcccgcgacgcgatgttcaaggccaccgacaccgaacatgggccctggctggtggccgactccaacgacaagcgtcgcgcgcgtctcaatatcatcagcgacctgctcagccgcattccctacaaggaagtaccacgggagaaagtggtgttgcccaagcgccagaaaccgggcagttatcgggaatcggaccatccgctgcgacgggttctgcagcagttctgagcgccaggcatcagcccatctacccgccaaggaccagcgtccgatgaaccattcggggtcttctccgcccgtcccggaacctggccggattgcccgccgggacgccggcgacgaacagcatcgctggagccgctggctgccggggctgcgcatgctgcgcgaataccgcgtggcctggttgcgtcatgacttcgtggccgggctggtgctgaccacggtgctggtgcctgtcggcatcgcctacgcggtggcgtcggggctgcccggcatctatggcctctacgcgaccatcgtgccgttgctcgcctatgcgctgttcggccccagccggatcctggtgctgggaccggattcctcgctggccgcggtgatcctcgccgtggtcctgccactgtccggcggcgacccgcagcgcgcggtcgccctggcggggatgatggcgatcgtggccggagcggtgtgcatcctggccggcatcgcgcgcctggggtttgtcaccgagctgctttccaagccgattcgctatggctacatgaacggcatcgcgctgacggtcctgatcagccagctgccgaagttcttcggtttttcggtcgaggccaacgggccgctgagcaacctgtgggccatcgtcacagcggtgctggagggcaagaccaactggaccgccttcatggttggcgcggcgaccctggcggtgatcctgctgttcagaaaacacaagcgggtgccgggtatcctgatcgccgtcaccgcggcgacggtcgctgtcgcggtgctggaccttgcggcaacagccggtgtgtcggtcctgggttctctgccacaaggcctgccggcgttcgccatcccctggatcagccgcgccgatatcggcccggtgctgatcggcggctgcgcggtggccctggtttcgttcgccgataccagcgtgttgtcccgtgtctatgcggcgcggacccgcacctacgtcgacccgaaccaggagatggtagggcttggcatcgccaacctggcggccggatttttccagggttttgccatcagcagcagctcctcgcgcacccccgtggccgaggccgccggcgccaggacccaggtgagcggagtcataggcgccctggccgtggccttgctgctggtgctggccccgaacctgctggaagatctgcccaccagcgccctggccgcggtggtgatcgcatcggccatcggcctgatcgaagtcagcgacctgcggcggatttatcgcatccagcaatgggagttctggctgtccatcgtctgcaccgtcggcgtggccgtgctgggtgcgatcgagggcatcggcctggccatcgtgatcgccgtcatcgagttcctgtgggatggctggcgcccttactcggcggtcctggggcgggcggaaggggtcaagggttatcacgacatcacgcgctatcccgacgcgcgcctgatccccggcgtggtgctgtttcgctgggacgccccgttgttcttcgccaacgccgagctgttccatgaccgggtgctggacgccgtggcggcctcgccaacgccggtgcgctggctggtggtagcggcggaaccggtcaccagtgtcgacgtgacgtccgccgacatgctggcggaactggacgacaccctgcaccaggccggcatcaagctgtgcgtggcccagatgaaagacccggtcaaggacaagctgaagcggttcgggctgttcgcacgcttcggcgaagcggcgttcttcccaaccatcggcgatgccgtcgacagctacctcgcgcagcatccgctggagggggaagggcgcgaggatcgctgagcggcggtggcgcgactaggtgacaaagtcgcgggtgatcaggtcccgatcttgaccggggactcgccttccaggggcgactcaggcgaagcgcatcgacagttccacgtcgccaccgaagggcacggacaggtagccgctggcgggcgaacggacccgggccaggtagtccgggcagtagtccgtgttgtcggcgacgatcagcgcgcccggccgcaggcggctttcgaccagggccaggatatcggcatacagcgccttggcgccgtcgagcagcagcaggtcgatggactcggggaggtcgaccgccagggtcttcagggcgtcgccctcgcggatttccaccaggtcggccaggccgccttcgagcaggtgctggcgcgcccgctccaccttggacgcctcgaactcgctgccgatcaggcggccgccgccgttgtcgcggatggccgccgcgaggtgcagggtcgagatgccgaacgaggtgccgaactcgacgatgtgccgggcccgggtgctgcgcgccagcatgtacagcagcccgccggtctcgcgggaaacgggcagccagaggtctttcaggcggccatagaaatccaggtattcggtcttgctgtgcatcaggcgctcgcgttcctcgcgggagatgccggcgacggccgggctggtcgctgtattggcctgctcgaacaggcgatcgagcaggggtgcgagtggggaagtggtcaatgtgctggtcatgggggcatcccgtccgaagttgacgccttgcggcgcgtggctaaaatgcgatcaattcgtcgcatttagaggatatgagcaagtgaccccctccgctattcgcattggctgcggccctgtcgagccatcatgagcaatcgccggaccccgcaggtttcctcgcgcaaagcgcctaaacaggcacgctcgacggagctggtggcggcgatcctggaagccgctactcaggttttggccaaggaaggcgcgcagcgtttcaccaccgcgcgggtggccgagaaggccggcgtcagcatcggttcgctgtatcaatatttcccgaacaaggcggcgatcctgttccgcctgcaaagcgatgagtggcaacagaccacagagatgctgcgcagcatcctcgaagagggtggcaaagccccgctggagcggctgcgggtactggtccaggtgtttatccagtccgagtgcgaggaagccaggatgcgtgtggcgctcaacgacgccgcgccgctgtaccgcgacgcccccgaagcgcaggccgtgaaggcgcaaggagagcggatcttccaggctttcatggaggaggcgctgcccgaggcgccgcaggcaacccgcgccctggccagcgacttgatcaccgccacgctcagcagcgtgggcaaggacttttcagaaagcccgcgcaccgccacagagatcaagacctacgccgacgcgatggccgacatgttctgcgcctacctcacgcaactggcgcgccgcgctggctgaccggcaaagccgcgaggttgccggcctggcgcgcgcgggcaagcatcctgacaagggctttattcggccatcggcacctggggtgaaaccacccatgcgctgcaaggcagctggtacagcaactgctctgcagtgctgccgatcaggcgccccaagccaccgcgatggccaaccctgcccatgacaatcacgtcgatgtcataggcttcgacgtaactggcaaggaccttggccgggctgcccatgatcatgtgctggcgttccggcgcaatgccgttgcgttcggccagttcgtcgaaggccgcggcctgcgcgtcgaacagggtcttggccttgcttgtcgagaaaaacgtcgaactctggtcgaagttgaattcatccgcgccgatagaggacaggtcatgggcatagaccacgtcgagctcggcgttgcaggcgctggccagtttgctcgcctcatgcagtatccggtcgttgaagtcctggtactggtcatcgcggtggaacgggtcgaccgccgcgacgatcttgcgcggcaatgcatgctgtaggtggctgacaaaatgcaggggcaccgggcactcgcgcagcaagtggatatccaggggcgtgaagaacaccctcgacagtcgcgattgatgctccagggccttgatcagcagggccatgggctgttctttgagatgcgtcaggatttcctgcagcgggctttcgacccatatcacttcagtggtgacggtgacacccagtttgcgcagcgggcgggcctgttcttcgagccactggcgatggcgctcgacataacccaggcgcatctgctccagggcctgttcgttgaccaggctggccgtagccaggccttccaggtagtcgaaggcgacgatgtgcagggctgcgtcttcggccctggccagggcggcggcccgatcgaaggcggggctgttctccatcagcggcgaggcgaccagcatgaaatgtgattgctcggacatgacaaatctcccgtgggtaatggcaggcaacggcaacgcgtcggtggcgatgaaagcttgctgcgatcctgcctctggccaggggcgcgagtttgacctgtatcaacccggtcagtcgtggagcaggccaactgacgtgcggtcagccgtgagggcgcccattgatgaattattgatcatgtcggcgctttgcgcggggccctgacatggatcagaaccctggaggcgcagagggaggaatctggattgatgcggatgcctttatcaatgggcgtctggcgccgaagccccacctgtctggaggtagatcatgagccagtatcaacggttgctgctgatcatcaatccggctcaacgccattcccatgccataggtcacgccgccgccctggcccaggccagtggggcgagcctgcatatcgcggccttgatgaagtcgctggatattctgtcgttgcttgaagagggcgaccggaaaaaggcccgggaaagttacttgcaggaccatcgcgactggcttaatgcccaggtagaagacctgcatggcaaggggctcgccgtgacgacggaggtggcatgggtcgatgacatggagcaagacatcctcgaccatgtcgtggaaatgcaacccgacctgctgatcaagcagatacagcatgagccgaagctcaagcgcgcgttcttcaccccgctggactggcacttgctgcgccattgcccgataccggtctatctgattggcgggaatggcgacgccttgccccgcaagatcgtggcagcggtcgaggtgtcggataccgagcctgcggacaacgaactcaatgagtggatcatccatcaggccgctggcctcgcattgcagtgtgatgccgagctgcacctgctggatgcctgtgatatttccgcggccttcctggcggatatgggcggtgtcgacctgaccctggcggggcttacccgggagctgcgtgaggatctggaaaagtctttcctcaggctggccgaacgttatggcgtgccatccgagtgtcgacacttcatcagggggcagcccgtctcggtgttgagcgagtttgcccacggccaggatgtggatgtgatcgtgatgggcaggaaccagtcccgtgggctgaccaagctattgggcagcaccaccgaacatatcctgtatcaggcgtcttgcagcgttctggcggtctagggcggccccaggctgattcaaagtgccgccacggagtggagttgctcgcgggcctgcttggcgttcgaaacgtcaagggtgcggggcagggcgacagcgttcttggcggcgaggatctcggccatgacgctcacggcgatctcggcgggggtcttgctgccgatgtagatgccgatggggccgtgcaggcgctggagcgaggcttcggtttcgccgaagtgttcgatcaggcgttcgcggcgcagttggctgttacgccgcgaaccgatggcgccgatgtagaaggccgggctgtgcagggcctcgagcagggccaggtcgtcgagcttggggtcgtggctgacggcgacgatgcaagtgcgcaggtccggggcgaattcgcggacgatgtcgtccggcatgccgaccaactgttccacgcccgccacgctccagccgccgatgtattcggggcgggggtcgcagaccgcgacccggaagccattgaacagcgccatggtcgccaggtattcggccagcgcgccggccccgatcagcagcaggcggtagccggggcccagggtgttgaccatctgctggccatcgaagatgaactgctccggggtagcgctgattgccagggacacttggccgctgcccaggtccaggctgcggcgcaccagcttgccggcgttgagttgggccagcagctgttcgagggcatccctcgatggggtgaattcgaggatcagttccagggtgccgccacagggcaggccaaagcggtgcgcttcgtcggcgctgatgccgtagcgcaccacctgcggcggcccgtcgggcaggccgctgccatcgtaggcgttggtgtagcggtggatcaggtcgtcctcgatgcaacctcccgacacgctgccgaccacccgaccatcgccgcgcagggccatcatcgagcccacgggacggggcgaggagccccaggtgcgggccacggtggcgagcaacacgcgatggccggcctggagccagttatgggcggtgctcaggaccagtagatcgatgctttccatggggacctcggttgttcaggggaggggctgctggcggatccgctcctggccagggggatcgccagcacctcactccttctttcagcgcatgtgcaggatgatcgggctgctgctggccgggtcggtatgcccgcgcagcttaccgaccgcttgcgcatcgaccgcgccacccgaattgccccaggtgccgcgcacgaagctcaggacctcggcgatttcccggtccgacaattgctcgcgaaaggccggcatgcggtaggcatccggcacgccggcggcgaccacgcgctgcgagccgttgagggtgatgttgatcgccgacgcgttttccttggccagtgccgaagtggcgcccgccaaaggcggcatccactcggcctggccctggccgtccaggccgtggcaggaggcgcagcgggtcacgtaggtgtgggctccggggctttccaggcgggtggcggcggacacggcctggtactgccagggcgcgccgtcgcgctgcggatcgccgggcagcgacttgaggtagcgggcgatcgcggccaggtcctcgtcggccatgaactgggtggagttgttgaacgcctcggtcatcgagccgtagaccaccgcgtgctggttgcgcccggtcttgaggaactgcacgatctgcggctcgctccagcggcccaggccggtgttggagtcctggcgcaggctcggcgcataccagccgtcgagcagggcgccggcgaggaacggcgcgccggactcatccagggccttctcgttgaacgccaggccgcgcggggtgtggcagctgccgcagtgacccggcccctggacgatgtaggcgccgcggttccacaacgcatcctgcgccggtttggccgcgtagggcgtgctcggggcgaacaggccgttccacagcgcgatgggccagcgtatgttcagcggccaggggatagcgctggggacgttgggctggctgaccggttgcacgcctttcatgaagaacgcgtacagcgcgcgcatgtcatcgtcgctgagcttgacgtaggacgggtagggcatggccgggtagagccgccggccacccggggcgacgccatggcgcacggcgcggtcgaagtcggccaggctgtaggcgccgatgccggtgtcccggtcgggggtgacgttggtggcgtggatggcgcccagcggcgtggccatttccaggccgccggcaaagggcgccttacccggcaggctgtggcaggccacgcaatcgctgacccgggcgacgtactcgccgcggctcaccaaggcggggtcgaagcgggtcgccgcggcctgttcctgctcgaagggcgaggcgggctcgcgggtgacataccaggccagcaggcctgccgcgaccaggcacggcaaggccagccagcctgcggttcttgcgaatcggctgttattcatgggcagtccttgtcggtcagctgaaggtgtatcggcttaatggcaggctacggatgcgctggccggtcagccgcgccaccgcgttggccaccgctggcgccaccgcgggcagcggtggttcgccgatgccgcccatcttttcgccactctcgacaatccgtacatgcacccgcgccatgcgtgaaggcggcaggatcgggtacaggtcgtagttgcgcgcccggggcttgccgtccacgtacaccgcttcttccaccaatgtctgggacaaccccagggccacggcaccattgacctgggcctcgacgatcgccgggttgacgatgctgcccgggtctatggcctgccagatgtcgtggaccttgacctggccattttcgatcgacacctcggcgatcgccgccgtgtgcgagccgaacggcgaggccatggccacgccgcgggcgcggcgagtgccgtcctcggcggtgaacgggccgcgcttccagccgccggacagttcgcccaccgcctgcagtaacgtggtcaggcgcgggttgtcgcgcagcaggtgctggcgtagctcgtacgggtcgcgaccgcctttgtccgccagttcgtcgaggaaggcttcgtaaaagaagtcgttgagcgaattgcccaccgagcgccagtagccgagcatggccggccccttgacgtagatctgtgcgatgcgcttgttggcaatggcgtaggacttgcccgacaaaccttcgagggcagtggggtcgagtttctcgccctgtttgccggcgatggcctcggtggggccttcggtggcgctcaccgcttcgatggccaccggcagcccttgggcatccagcgcggcctggaacttgaccacggcgaccgggcgcagcacgtcacgcaggaactcttcctcgcggctccagatcagcttgaccgggcggccgacggccttggccagggcgatggcctgtgggtagggactggccgagtcatagaggaaatgccggccgaaaaagccgcccagcagcggcgagtgcagggtgatccgcgagggatcgagaccggtgcgcttggcgatgtcggcgcggaacatgtccggcgcctggttgggcagccagacctccagcgaaccgtcgggattgaagcgcgccagggccgaaggcggctccagctgggcgtggttgaggtactggttgtggtaggtggcctcgacccgggtcttggcgttggccagggcggcggccacgtcgccttcgttttcgtcgtcgcgggccgggccttgctgggaggcgagaaaatcgcggaagccatcgctggaaaaatcagcgggcattggccgtaccttcgaatcggcggacgcttcctgccagtcgacctggatggcttccaccgcgcgcttggcgtgccaccagcgttcggcgaccaccgccaccgcgccgggcagctggtgaacggagtgcacgcctttcatggccttgacctgggcctcgttgcgcaggctgcccaccgtcatgcccaggcgcggcgcgtgctgcacggcggcgtggagcatgccatcgaccttcaggtcgatgctgtacagcgccttgccggtggatttctcgtaggcatcgacgcgccgcaccggcttgccgatccagcggaactggctcgggtcgcgcagggtgatgctggccgggtcgggcaccggcatgtccagggcgcgaccggccaattcaccgtaacccagggagcggccggaagcggcatgcagcacccggccaggctcggtggacagctcggccagcggtacgccgagctgctcggcaccggcctgcagcagcatggcccgggccagggcgcccaggcggcgcatggtcgggtagctcatgcgcaccgacatgctgccgccggtgatgcgcatgccgttctccatgaccacgtaggcttcgccgggcggcgcggcctcgaccacgaaggtggcggggtcggcgtccagctcttcaccgacgatctgcgccatggcggtgtgggtgccttgtccgccttccatgaaggggctgagcaggcgcacgctgccatccgggcgaatctccaggaacgccggcacctgggtcccgcgttccgcggtgctcgccgtggcggccaggaccctggccgaacccagcggcaggccgaaaccgagcaccagcgcgcccacggcggcgccggtcagaaagcgccggcgggacaggttgaccggttcgtccagcggcaggtccaggaggtcttcagcgaaatcgatgggcttgttcatcaggcgctttccttcttggcaggctgggcggccaggtcatgcacggcggcatggatggcgttgtaggtgccgcagcggcacaggttgaccatcgccgcttcgatctgcgcatcgctgggcgcggggctgtgcttgagcagcgcggtggccgccatgacttgcccggactggcagtagccgcactgggccacctggtgctcgacccaggcggcgaccacgcgcttgccgactgcgtccgcctcgatcgcctcgatggtggtgacctcgcggccgaccacacccgccaccggggtgacgcaggcgcgtaccacattgccgtccaccagcaccgaacaagcgccgcactgggccaggccgcagccgtacttggtgccggtcaggcccaggtcatcgcggatcacccacagcaacggcgtgtcggcgtcggcatcgacctgataggtcttctggttgattcgtagttccatggctcacctgctgatcatcggttggtgtgtctttgttttttcttcaggaggcgccaccaggcgcgtccttgctcaagaaacgcgggtaaaggggcggatacgccaatccgctgccccgtgcgccgggctggccgcgagcacgtcggagtaggccggaaggtccagcgagagaaaatgcgaggaggtgtcgagggtatgtgccaggggcgatgcctggccggcgcgggcttgggtcatggcggctggctcctagtgatcggactctagcccaggggccaagggtttcctatccgatacccggcaagctcagaggatcaggcaagtattccagaggaatgcgcaataatgcggaggagggcggctcgaacactgcaaccagatctgggcaattgcttgaaaaggtgctgagccgcaggtgttgtcgttagaacgtcgatttaccgatggacgctccgccatcgacaaacaatgtctggccagtgataaagccgctctgctccgataacagaaaggcgatggccgccgcgatttcatccggctgaccgagcctgcccatgggaacgctcgccagataacgagcttcgccgtcgctgccgggcggattcccggcgcggaacaactcggtttccgtggggcctggagcaatggcgttgacggtgatcccggtggttgccaattccagtgcccaggaccgcgtgaaactgaccagtgcggcttttgccgcggcataggcggtacggtgcgcgattcccagaatggtcaagctggaaatgttgacgatccttccccagcctcgattgcgcatgcccggcagcaatgcttgcgttgcctgcaaggcgctatgcaggttgattcgcatgacctcgtcaaagtcatccagatgtatatcgcccaatgcctgcgggcgcaccaggccaacgttattgatcaagccatcgaagtcataacgtgaaacgagcgccgccagcgttctttcggtttgttcccgattgcccagatcgagggaaatgagggtgccgggaaagtgtggatcgttgctgtcgcgagcgatgccgaccacctggtggcctgcttggaacaactgggccgcgagtgcgcgcccgatgcctttgctggcaccggtgataaggaaggtacgtgttttcattgcagtactccaaacacccggcaacatccgggatcggggaagaggggcatcgccaggatgtgccgcgcaatcgacctgggcggtgtcagaggcgtgttgtttcagtcgcccgagtaatgtccgtacactctattgatgtgtgccttgacgataaaccaccgccaatggaattcatttggaccttgaaggcaataatgccgtgcgctggcgaggcttgagtctggctttgcgacgtcgttagcctcgcgcatcaaagcgtttcgcccattgctgctcgcgggcatgactcaccagcaggtccacgaagacccgcgtcttggccggcagcagtttctgccccgcgaagtacagtgagatgggccccgcgtcgacataccagtccggcagtacccgttcaagggcgccactttgcagatgctcaagcacatcgggaatcgccaatagcgcgacgcccagccccatgagcgcgctctggcaaagtgcttgtgggtcgttgaccagcaaccgtgggcgcaactccagtgccgcacgctgttccttggggccttgcagtgtccagccgcggaccttgccgctttgtagcgagcgcatggccagatgctcgaggtcattcaactgctcgggacgacgtacaagagggtgcctggacagacagtccggcgatgccacgagcaccaaatgcgccggtgacagatcccgggcgatcaccccgggcgaaagctcgatgccgccgccgatggcgacgtcaaatccatcggcgatcagctccacctggcgattgtcgaaatgccactcgggaaccaccgctggatatcgcttcatgaactgcggcatcaacggcagcaggtagtcgcggccaaaagcgggcgccgcggaaatacgcagcaccccagccggttctccggcattgctggttacgtcggcaatcgccgcctggacagtctccagcccaccctcgacgttagccagaaaacgctccccagcctcggtcaaggccagtcggcgagtgctgcgttgaaacaggcgtacccccaggttggcttccagttgggcgacattcctgctcaccgcggccggcgtgatacccaggcgccgcgcggcggcagagaaactgcctgcctccgcgctgcgaacgaaagattgcagattggccagggtttccatgatcgataccttcaagtaaacgttgaaagtgattctagtcactccctactacttgatggaaaaagaaaagcgtttcatagcctcaccaaccaccactcgaggctcacaccatgaaccctgtcacgcttcctctctctggcaagatcgccatcgtcaccggcggctcgcgcagcatcggagcggccattgcccaacgcctggccgcggacggcgccgctgtcgccattacctacaacgcctcgcctgatcgtgccgcggccctggtcgagacgatcaccgctgccggcggtcgagctatttcgctggccgccgacgctggagatcccgaggctgtacgcgccgcggtccagcaggtcgccacgttattcggcaaggtcgatatcctggtcaacaacgccggcatcagtgtgctcggtgctccggaagacatcgctttcgaggacttccagcgcatcctcgcggtgaatgtcaccggtgttttcgtggccacccaggaggcgctcaagcacatggggcagggggggcgaatcattcatatcggcagctccatggtgcaatacgcggctttcgccaccgcctccgcctataccctgaccaagggcgccgtggcgggcttcagccgaggcctggtgcgagacctgggaccccgcggcatcaccgtgaataccgtccaccccgggccgaccgacagcgacatgaaccccgccgaggggccggtggcggacttcgtacgccccaatatcgccgtgggacgctacggggaagggcgggacatcgccagcgcagtggcctatctggccagccccgaagccggtttcgtcaccggtgccgaattgatgattgacggcggcttcaccgcctgaggagacagacatgagcatgagtatcagcatcattggagcaggcgccctaggcagcgcgatcgccaggttactgacgaaggccggcctggacgtgagcatcgccaacagccgtggccctgaaagcctcacatcgctgatcgccgaactggggcccaaggctcaagccgttaccgccgagcaagcggctaccgcagacctggtgttcctggcggtgaactggtcgaagattccatcggcactggccgggctgggaccctgggaaggaaggattgtggtggataccaacaacccgattgaagcgccgctgttcaagccctttgacctgggaggccaaccttccacccaggtcgtggcgcaaatgctacccggcgcccatgtggtcaaggccttcaaccatctatcgccgaatctgctggccaacccgaacgccgaagggggcaagcgcgtgttgtttgtctctggagagcatgcgcacgccaagcagcaggtcagcgagttgatccagcaactggggttccatggcatcgacttgggcgacttgcaacaagggcaactcgcgcaatttcccggagggcctttgccggcgctcaatctggtcaaacatgactgacgacgaggccggtgaataccggcttcactttatgaggactgtattgagagcaggttcggtcggagtttttccagttgccctggaaaggcgttcggaacgatggttttgtgactggatatcttatcggtcacaagttgtcagtccgctatagggtgagtaagctgttcccatgaatcagccatcgatatctccgcccagcgcccgtggcccagccgatcacgacattcgaaaccagattgtcgcggcggccaacgagcacttcagtcagtacggctatggcaaaaccacggtctccgacctggctaaagccatcggcttttccaaagcctatatctacaagttttttgattccaagcaggcgatcggtgaagccatctgcacaaattgcctggcagaaatcgttgcggctgttgaacaggccatcaacggagagaccctttcggcaacggagcgctttcggcgcctggtcaaaacggtgatcgccacaggtgtgaacctgttcttcaacgatcggaaactctatgacatcgcagcgttttctgtgtcggagcgctggtccagttcgcaagtttatgaagcacagatcaagcaattcattttgcagattgtgcgtgaagggcgagaggtcggtgagtttgaacgcaagactcccctggacgagacggtagacgcgatacatcttgctctgcggccattcgtcaatcctctactgctgcagtacaacctcgattttgtcgaagaggcgcccacgctcacctccaatctcatcttgcgcagcctcatgccttgatcttcggctaacgctcgaacgcctgctgctctgggcgaggtattgcccaagcggcttttcactttgcccttcctccaaccgtcgaagggcatttatttatctgttatgtgactgttgactgaaatagtcacatggataagtatgcgtccgttgcttctgctgttttatcccggtgataaccctagagttctaataatgaaaaaaatattgctcatgagcccacttgggctcgctgttgcgctcgcgtcttcttatgtgtctgcgagcggcttcgctctcaatgaacagagcatcagcgggatgggctctggatttgccggtcgttcctcctccgctgaagatgcgagcacggtgttcggtaatccggcgggcatgtcacgcttgaaaagagaacaggtcagcgtaggggcggcgacgcttttcgcgaagtccgacatcagccagacccgcagtacattcgcaggccaggaagacggcgacatggtgcccacgactacggtccctatgggctactacgtcaaacccattgatgagcactgggcattcggtgtcgggttttatgtgcctttcggcctgatgaccgattatggcagcggctttgcggggcgttactacgctaacaaaagcgaggtcacgacattcaccttccagcccaccatcagctatgcctttaacgacaccgtttcgatcgggttcggtcccaccatcaaccgtatcagcggcgagttgtccgggatggtgcccaatccgctcagtcctgggcgcaacgacggaaaactcaaaagcaatggcgacgatacggccctggggttcaacgccggcattctggtacaggctaccgatcgaactcgcctcggattgacctaccattccaaggtcagttaccacctggatgccaagaccaaggtcaccgacggcatctttagcgtgttgggggtgagcggccgcagctatgacgcttcgctggatgtggatacgccggagtcggtggacttctcggtaactcatcagctcagtaatgactggacgctctatctggggagcacctggacccgctggagtcgcttcaaggaattaaccatcgagaacacgggcttacctcctttattgagcggctcgctgggcacggttaccgaagaacaggactggcacgatacgtgggcccacgctatcggtacggcgtacaagctgaacgatcgctgggtacttcgtgccggcttgtcagtcgaccagtcgcccgccaacaacacccatcgtggaccccgtattccaacgggcgaccggacggttatcagcttcggggctggctggactccggcggacaatgtcacgatcgatgtcgcttattcctatctgtgggaggagagcgtgcaggtcaacggtacctccgcgacccggggcgcatacagcgccaagtacaagaacagcgcgagcgggctcggcacttccgtcagctatcgtttctaagatagggcgtcgttctacgataaggggccggccgggagtgcaggttacctcccggccttttaatgcatatttctctcgggggaagccgcgtcgtcgccactcacacgcccatgacgcgtgacatgagctcctgatgaaatcggcgtggcgtggcccaggtcaagacggtgatagccttgttgccaaaacctggcacgacactcatacgtccggcttgcagcgcacggattcccgcacgtacaacgggctcgggctgcatcatgacgcttttcaaggccggcgtgatcttctgcctggcgctttgtgcaaagccggtatccgacatcccaggacaaagggcggtcacgacgacgccagcgcttttgagctcacgatgaagcgcgtcggagaagcgaagcacataagccttcgccgcagagtaaacggcgaaattcttcacgccctgaaaagacagcaggctggcgaccattaggatgtggccacgttgccgggttcgcatgtctgccgcgaagaggcgtgtcagggccgtcaagctggcgatatccagatcgatcatggccagggagttgtccaggggctgttccaggaaggggccctgcaacccatgacccgcgttgttgatcagcacatcgatcacgatgttgcgttcgcttagccgcttgtgcagatcgataaccgccgggatcgaggacaggtctacttgctcgacgatgacctcaacgccaaaacgttcgcgcaactctgtcgatagcgcttcgagcctgctcagcctgcgcgccaccaggaccagtgatttcccttgtgctgcgtattgccgggcaaactcctcgccaaatccgcttgaggcgccggtgatgagcacccaggaattctcgctcgctttcatatcgctgttctctggttggtttatggaatcgtttgggcagctaaccgccgcgcaagcagaacgacgcagatcaatgctcgccagccggtcacgcgaagcccgctctcgagctggtagtcgcgtgtgcgcataaagcgccgcgtcgcctggtcaagtcatcgagtcgccacggaccgtgtgtcaggaggttgccagccaccaccgagggccttgaacgctgcgaccgccgcccgtgccgattccgttcgcgcctgcgctcgggcatcggaagcctgcagcatcgtttcgtcggcgtgcaggacatcgatcaggctggccgtgcctttctggtaggcgatgaacgacgattggcgagcctgcgtcagggaggcttcgccttcggtcagggtggttgcctggacttcccgattcaccagggcggaaaaggcattctcgacatcctcggtggcgcgcagtacggactggcggtaagtggccagtgcttcggcttcctggcccttggcttgatcgatttgagcgtttatgcggccaaagtcgaacagtctccagcgcagccccaacacgcccgccgactgattggcgccgccggtgaaaagattgccgccggataccaccgtggcgctacccagcaatgcgctgagggagaatttcgggtagtactcggcaatcgctaccccgatgcgcgcgttggaagccgcaagctggcgctcggcgatgatgagatcgggcctgcggcgtagcagatcggccggcgttcccgtggcctttatctgcggcgcaagaggaatgctccctgcattggccagttgcgcgcgatgagtgccgggcggtgtaccgagcatgacatccagtgcattcatggcagcatccagtccggtctgcaggaccggcacggtcgcctggacctgcgatagcgcgccctcggtctgctgaacctgatagttggcagcgaggcctttgccgtaaagcaagcggactttctctagcagctcctgctgcgttttgacttggcggttggcaatgtccagccgggcctgcaatccgcggagggtgatgtagatatcggcggtctgcgcggcgacggccagtcgtgtggcggcggcgcccgcctcggaagcctggtactcggcgagtgcggcttcgcgtccgcgccgcaggccgccaaagacgtcgacttcccagcccgcaccgaggttaacctcgtaggagtttccataccgatcatagccaggcgttgagttcaacacctggccgagcggggtctcgatcgattggtaggaacgcgcggcctggccactgatgttccccgagggcagcaaggcggcatttgcggcacccaatcctgcccgagcctgcgtgactcgcgccgatgcctgcgccagatccaggttctgttcaagcgccttggagacgaagtcggtcagcacgggatcaccaaaaccttcccaccaggccacaagactggccggcgtcgccacaggcctctgctcgacggcagattgacccaggtaacgatccagcagcggggcgtgcggacgttggtagtccggaccgaccgcgcagcctgccatcaagctggcgcttacccaaagggcaatggggcggaggggaggcattgaggctccttaaatcgaggatatttgtgaccatgttacgttatggtcacatcctgtcaatcagcacaatttgatcggcttctaaagtttgctcaatgaatacggcgattttcgcgtgatcctatagaatcttgatacgtcacagattgtgaccattgacagatatagtcactatactgagaatgtgctgcatgtcctattgttcaagtaagggaacctatgcgccggctccgacctgtccccattgctgcttgcctgttgcctctattcctgacggcgtgtggcgactcatccaccgttgaagatccacgcacgcaggcccctctggtgaggtcctctgcggtgcagggggcgtccggtgtttcacgctctttcactggcgtcgtggcggcccgcgtccagggcgacctgggttttcgggtatcgggcaagatacttgagcgcttggtcgacacgggccagaccgtcaagcggggtcaaccgctcatgcgtctcgacccaatcgacctgggattgcaggcgcgagcgcagcaagagtcggtcatcgccgctcgggcccgagccaagcagacagccgatgacgaggcgcgctatcgcgacctggtcgctgcgggggctatttctgcatcggcctatgaccaggtcaaagccgcagccgataccgcaaaggcgcagctcagcgccgccgaagcgcaggctgatgtagcccgcaatgcttctggttatgcggtgctgtttgccgattccgatggcgtggtggtggagacgctggccgagcccgggcaagtcgtcagcccggggcagcccgtggtgcgactggcgcgggcagggcagcgcgaagccatcgtgcacctgcccgagacgctacgcccggcagcgggatccaccgcgcaggcgacgctgtatggcaacaccacggaggctgttacagcgaagctgaggttgctttcagactcggccgaccggatgacacgcaccttcgaggcgcggtatgtgcttgagggcgcgctagccaatgcgcccttgggttcgaccgtcaccctgcggatcgccgagggcagcgccaatggacaggtgctgcaagtgccgatcgccgccattcatgacccgggccagggcactggcgtgtgggtcattgctggcacaccggcgaaggtggcctggcgacctgtccgggtcctgggcttgagcgacgacgcagcgcaagttgccggcgatctcaaggccggcgagcggattgtggccttgggcgcgcatctactgcgcgagggggaggaggtgagactggctcaacagggtgacgtcaacgttgccgggagccatccatgagccaggggcgcttcaatctctcggcgatcgccgttcgcgaacgttcgatcacggtattcctgatcttcctgatcgctgttgctggcaccctggcgttcttcaagctggggcgggcggaagatccgccgtttacggtcaagcagctgacggtcattaccgcgtggccgggcgccaccgcgcaggagatgcaggaccaggttgcggagcccctggaaaaacgcctgcaggaactgaaatggtacgaccgcacggaaacctacacgcgtccaggtctcgcgttcacgatggtgtcgttgcttgacagcacgccgccctcgcaagtgcaggaagagttctatcaggcgcgtaaaaagctcgacgacgaggccatcaagctaccggcgggtgtcattggtccgatggtcaacgatgagttctcagacgtgacatttgcgcttttcgccttgaaagccaaaggcgagccgcagcggctgttggtgcgcgatgcggagtcgttgcgccagcgcctgctgcacgtgccaggcgtgaagaaggtcaacatcatcggcgagcaggccgaacgcatctttgtctccttctcccatgatcgactggccacgctgggcgtctctgcccaggatatttttgccgcgctgaacaatcagaacgcgctcacgcctgccggctcgattgaaaccgacgggccgcaggtcttccttcgtctcgacggcgccttcgataaggtgcagaagattcgtgacactccgattgtggtccaggagcgcacgctcaaactctctgatgtggcaactgtcgaacggggctatgaagatccagcaactttccttgtgcgtaataacggggaagaggctctgttgttgggcgtcgtgatgcgagacggctggaacggcctggacctgggcaaggcgctggacgccgagacgagcaaaatcaatgaaggcatgccgctgggcatgacgctgaccaaggtcaccgatcagtctgtgaacatcagctcggccgtcgacgagttcatggtcaagttcttcgtcgccctgttggttgtgatgcttgtctgctttctcagcatgggctggcatgtaggtattgtggtggccgccgctgtgccgttgacgctggccgtggtgtttgtggtgatggcggccacgggcaagaactttgaccgtattaccctcgggtcgctgattctggcgcttggcctgctggtggatgacgccatcattgccatcgagatgatggtggtgaaaatggaggagggctacgaccgcatcaaagcctccgcgtatgcctggagtcatacggccgcgccgatgctctccggtacgctggtgaccgccattggctttttgcccaatggcttcgcccagtccaccgccggcgagtacaccagcaacatgttctggatcgtgggcatcgccctgatcgcctcctgggtcgtcgcggtggcctttaccccctatctgggggtgaaaatgttgccagacatcaagccggtcgaaggtgggcatgcggccatctacgacactcctaattacaatcgctttcgccggattctgacgcgggtcatcgcccgcaaatggctggtggccggcacggttatcgtgacctttgtcgtggcgattttcggcatgagcctggtcaagaagcagttcttccccacctcggaccgtcccgaggtgctggtcgaagtgcaaatgccctatggaacctccatcgagcagaccagtgccactgccgcaaaggtcgaggcctggctgcacaagcaggatgaagcaaaaattgtcacggcctatatcgggcaaggcgcgccgcgcttctatctggcgatggcgccggagctccccgatccctcgttcgccaagatcgtggtgttgacggacagccaggaggcgcgcgaggccctcaagttccgtctgcgcgaggccattgctgaagggcttgccccacaagcgcgtgtcagggttacgcagttggtgtttggtccgtattcgccattccccgtcgcctacagggtaatggggcctgacccgatgaagctgcgcgagattgccggccgggtacaagaggtcatgcaagcgagcccgatgatgaggacggtcaaccgcgactggggaccactgacgccgacgctgcatttcagcctggatcaggatcgcttgcaggcggttggcctgacatccaatgcagtcgcccagcagttgcagttcctgctggccggggtgccgatcacggcggttcgtgaagatattcgttcagtgcaggtggtgggtcgcgccgcgggtgacatccggctcgaccccgcccggattgaaggcttcacattggtgggagcggcgggtcagcgtatccctctgtcccaggttggagaggtggatgtgcgcatggaggatccgatccttcggcgtcgtgaccgcaccccgaccattaccgtgcgcggcgacattgccgaaggcttgcagccaccggacgtctcgagcgtgatcatgaaggagctgcagccggtcatcgacaccttgcctgccgggtatcgtatcgagcaggcgggggccatcgaggagtcgggcaaggctggccaggcgatcttgccgctgctcccgatcatgattgccgtcacgctgctgatcatcatcctgcaggtacgctcggtctcggcgatgatcatggtgtttctcaccgcgccgctgggattgattggcgtggtgccgacattgctgatcttccagcagccgttcggaatcaacgccctggtcggcctgatcgcactttcaggcatcctgatgcgtaatacgctgattctgatcgggcaaatccatcacaacgcacaagaaggactggatccgctccatgcagtgatggaagccacggtacagcgtgcccgcccggtattgctgacagcgttggcagccatcctggcgttcatccccctgacgcactcggtcttctgggggaccctggcctacacactgatcggcggtacatttgtcggcaccatcatgacgctggtgttcctgccggcgatgtactccatctggttcaagatcactcctgtcaatcagaggcaagccgaaacagcggaactgatatagcaggcgaacccgctagaagagaggacgccatcgccgtcctctcgtggtttcaagcgtggcccgaccgcagggccacgccagcatcgataaggggagggtggtgcagcagcaccgccttgggttgcctgtctccgcctgccaaggtgcgcatcagccgcaggccgacaccgtttttattgtggttcttagaacgttttgttttagaaaaatggcacggcactgatcaccattgacatctttcttcacccactggatgaatttgataaagggcggatcgaagctatattcaccaaggaaagtgatcttaattatttccaaatacgtgttaaatatccgggcaggagccaagagacatgacaggggaagatctgatcagggctataaacaacaacacaacactcatgggattgaagaattgtcctggtgtgccagctcaaatgagctgcgctgtttacgggaaggtgcaagatgatgttggaaatgatgtcatcgacaatgcgagcatgaagtaccaaatcgaacaggcacttttatttcgtggtgatcactcgcagacagctgtttggcactttcttattacgggatcagcggttcatcactttgtcgttatcccttggtacaagcagtcagtcgggacagtgtatacggtctttatggcctacgagcataaaaagggcgacgagtatgggtactcggtggataagtatgtcaaacatatcaatccagcccctggcgagattaaaggctacaagacagtttggacggcaaacgacctaagcaccatgctctctgacttgctaactaagagtaacgcttgggaagaatatttcggcaatgtcggacccgctcaggcagatataattcgctactatcaatacaaaacaacagcactaagctctgcagtttccaacgtgaatcaatacaaagagctctgtcggtaggctatttgaccatcttggcgaccgcctcacgcttggcctgcggttacccaaagcccaccttcagtacttcgatgtgcaggtgggcctcggccagcagcttcttgagtttggtattctccggctcgatctttaggctctggtgcgcgctcaccacgcaagccacgcaccaggcccgtcaataattaccactggccgcttatgagacagccgacgatttcccaaccgctgtattcccaccaggaatttggctattacaaggcgcaaggttctcaggatccgttcgtcctggattacatcgttgaggtgcaggcacaagctgcggcagagtgaatcgaggcctgggcctggcttcaaatctgaacacccagaccccagtcctgcacatgatgattcgcataatgtatattatgttaaatcacatatgttctgtttggttgctccatccttcgggcatcagatctggatcaaaaaacagatcggcctcatttcctcgtcaaccgacatctctatttgcaacaaccgccgacagctacgctgaaggcggttggctggacgcgttcaggtattaaaaccaggtttccatttgtatcccgtattgccacactcctccggcgttgaagtccgtcttgccgaagttgtctgtggaactgtatctgtccagatccgaagaccaattcatgaagcttgcgaacactcgcaattcgggacgtgtgagaaggtctccaacgtcaggcttgaatgtcggtgcgactgtgaatttccagaagttaccgtcgaccgcattgcgctgcaggtagcccttggggtcgagatccatggtttgccaactcatttcgtaggccatctcgaaattgctgttgattgcattggccaaacgcatattcagggtcatccagcggtaattgtcacccttgacgtatctatccttgctctgttcggccaacaaacttgggccgatgcgccaaccaggcgcaatgggagtctcgccgtaaagtgccagacgcagagcgcgggcatcgtcaatcagctcaccatccgagccgacattcttgacctctgcccccagtccttgcccgtagagcagcgccgtcttgaagaagccttccctgccgaaaaagtttttctgatgattggcgatcatgctgtgcaagccggagtccgcaggcgtcagccctgcttcattgctgcgagtgccaatatcatttttctttgagccaatggcgttgaacatccactgccactgaccaccgtcgaagaactggttcgaggtcaggatgtagctttccacatcggcgttgataccgccctcactgaaatccccgtagttacgcccgatcaaagagtaattcgagcgccagttcttgttcatctgcacatcgtagataccacctccggtgccggccagatagaccacgtcggagtccagccaatggatatcgaagttatccctgtcgaatcgtttgcctgcccacaaggtggagttctcgaacactgagttgcctttgaaggcggcgagatgatcgagttcggcaaagacctgacgcacgttcaggttgctctcgtcggccgtccagtcattggagctttccacaccatcggcgatggacaccgtgaatttggaacgggtgccattctgcgcataggtttctttcgacaggtctatgcgcatgtaggtgtcgtcttcgttgccgagtcgcccgactgcaccaccgactgaaccggctggggttgcataagggccgccacgaccaccccccagcccatcgttgatcagcaatccggaacgggcataacccttgaagctgaagccgtccgtgaggtggccgctgctgccctgcttttccatgctttgctggcgggcttcgagtttggccaatcgggtgtccaaagcaggcaccgaaatggctgcggcagtagacgcagcgggctgcaaggcgggagctgcgagtttgatttgctgcaattccctggcaagtgcctgggtctgctgttcggctgcggctgcacgcttttccgctgcgctggcacgggcttcaaacgcggccatgcgttcttccagagtcgcggcctgagacgtcgccgccgatgtgccgagcacgcctgcaagtagccagcttgttgctttctgcatgtggaatccctgttttgtttttattgtttgtcccgcgacggaaccttttttacgtgagttgcgagttgtcgcaatcgacgaaaaaatggatgcctcatcgcaaatacgctgctacatttggcgatgttaacgttaacttttctaaaaacaaaaataaaggtgcccaatgaaacagctgaaatctctcctgccaaccgcggtaatcaccctctgtgccggacttgcatccgtctccaacgcagccgatctgacgatctcgtgcggtgcggtgggtgcggagttacaactgtgcaaggaggccgtcgagacatggtcgaagcagaccggcaacaacgtcgaggtggtttccacgcctaactcggcgaccgagcggttgtcgttctaccagcagatcctcagctcgcagtcgactgacatcgacatcattcagatcgatatggtgtggccgggaatgctggccaaacacctgatggatctgcgtgaggtgcttccagccaacgcgacccaaggctacttccaggcacaggtcgataacgccacggtaaacggacggctggtgacgatgccgtggttcaccgactcgggcctgctgtattaccgcaaggacttgctcgagaagtacaacaagcaggttccccagacgtgggaggaaatgaccgctaccgccagggatgttcaacaggccgagcgcactgccggaaatcccaatgcgtggggttacatctttcaggggcgcgcctacgaggggctgacgtgtaatgcgctggagtggatcagcagccaaccggaaggcggactggtcaatccacgaggcgacatcgtggtcaacagtcaggcctcaaaagcggctttggccctggcgaaaagctgggtgggagacatctccccgcgtggcgtactcaattacaccgaggaagaaggacgtggggtattccaatcgggcaatgcgctgttcatgcgtaactggccttacgtctgggccctggtgcaaagccaggacagtgccgtaaaagacaaggtcggggtcgcccccctgccccgcggcggcgaggccggcagccatgcatccaccctcggaggctggggcctggcggtatcgcgctacagcgcccatcccaaactggccgcggagctggtgagctacctgaccagtgcccaacagcaaaaacatcgtgccctgataggcgcctataacccggttatcgagtcgctgtatcaggatcccgaattgctcgcggccatgccttattacgctcagctgcacagcattctcaacgatggggtcatgcgccccgcctctatcactgccgatcgctatccacgggtctccaatgcgttcttcgatcgagtgcatggcgtgctggcgggcgagttgtctgtcgatcaggcgctggccgaactggaaagcgaactcacacgcatcaaacgtcggaactggtaagccacaaggaaggaaatcaccatgtctgtctctactacccatgcctcctgtgacgagcgcctgctcaccagggaaacgcccatacagcgtcgccgagtacgcgccgcctggctgtttctgacaccgatgttgctgtgtctgaccctggtggcggcctggccgctactgcgcacattctggttcagcctgaccgacgccaacctggcggacaccagtggcggttccttcgtaggcttgagcaattacctgttccacgacggttccagctggtcgggcatcctggtcgatccacaatggtggaacgctgtgcgcaacacgttgtatttcactgtggtgtcagtgggactggaagtcgtccttgggctgttggtggcgttgctgttgaacatcaagttcaccggccgttccctggtgcgtgcgttgattctgattccctgggcgattccgaccattgtctcggcgaagatatggtcatggatgctgaacgaccagttcggcatcatcaatcacctgatgctgagcctcggcctgattggcgctcccctggcctggacggcagatgcggatctgtcgatgtgggcagtgatcatcgtcgacgtgtggaagaccgtcccttttgtcacgctgctgatgctggcggccttgcagatgttgccgagcgattgctacgaagccgccagggtcgatggcattcatccgctgaaagtgttctggcgcgtcacgcttcccctgttgatgcctgcattgctggtggcggcgatctttcgcatcctcgactcgctgcgggtattcgacgtgatttatgtgctgacctcgaactcgtcgagcaccatgagcatgtcggtctatgcccgccaacacctggtggagttccaggatgttggctacggcagcgcggcctcgacgctgctgtttctggtggttgcggtgatcgccatgctttatctctacctcggacgccgtcaaatggaggtccggtcatgagcccgcgcctactgaaaaaatcgctgttgcgcctcggattctggtgcctgatcggggttttgctgctgtatgcggtcttccctttctactacgccatcgtgacttcgctaaagccgtccagcgccttgttcgaggtgagctactggatcgaaaaccccgacttctccaattacgcggcggtacttcaccaagcctcattcctgcgggcaattggtaattcgctggtggttgcgctgtgcgtggtgacgctggcgctgttcctcagcctgaccgctgcctatgccttgggccgggtgaaattccgcgggcgtggcacggtattgatgatggttctcggcgtgtcgatgtttccccaggtcgctgtactgtcggggctgttcgaagtgatccgcgccttgggcctgtacaacacgtcctgggcattgatcctgagctacacgattttcaccctgcccttcaccgtctgggtgctgaccaccttcatgggccaactgccccatgaactggaagaagcggcaatcatggatggtgcttcgccctgggtcacgctgacccgcgtgctgttgccgctgctctggcccgccctggtcactaccggtttattggccttcatcgcagcgtggaacgagttcctgtttgccctgaccttcaccctcaccgacacccaacgcacggtgccggtcgccattgccttgatttccggcggcagcccccatgagctgccttgggggctgttaatggccgcatcggtgctggtcaccgtcccactggtgattctggtgctgatcttccagcgccgaatcgtttccggtctcactgccggcgcgttaaagggttgatgcccaacaaatacaaggaacagcatcgtgatcaaattgaaactggacaacgtgaacaaacaactgggcggcgtgcggattcttcgcgacatcaacctggagatcgctgcgggtgaatttgtggtgttcgtcggcccttcgggctgcggaaagtcgaccctgctgcgactgatcgccggactggattcgatctgcgccggcgacctgctgatcgacgggcgacgggtcaacgacctggagccgcgcgaacgtggcgtcggcatggtgtttcagtcttatgcgctgtacccgcacatgagcgtctacgacaacatcagctttggtctcaaactggccaagaccgaaaagaccagcctgcgcgagcgcgtgttgaaaacagcgcaaatcctgcaattggacaacctgctgcaacgcaagccaaaggaactgtctggcggccagcgtcagcgtgtggcgatgggcagagccatggcgcgggaaccggacattttgttgttcgatgagccgctctccaacctggatgcttccttgcgggtgcagatgcgcaacgaaatcgcccggctgcatgaccgactgggctcgaccatgatctacgtcacccacgatcaggtggaagcgatgaccctggccgacaaaattgtcgtgctcaatggcggtcgcgtagaacaggtcggctcaccgcgcgaactctatgagcgcccggccagccgctttgtcgccggttttctcggttcgcccagaatgaattttctgccggcgcacctgcagacgccaggcgaaaccagcctggtcgataccctcgtatggggcatcacacccctgcccttcgacagctcgaacctggcggcgggcacgccgctgagcctggggattcgcccggagcacgtggcgctcaaggcggcgagtggaaccgccggcgtcgtcgtgaccgcggtcgaatacctgggcagcgaaacctatgtgcacctcgagacaggtcaggacgagccactgatctgtcgttgcgaggtcagcgccggctggcaggcgggcgatcgggttgagctgcagctggacatcgacaacctgcacctgttcgacgccgacggcaccgccttgaggcgccacccaaaagccattgaaaccctgccggatggcgtccctctgcgctcggcacgagtaagcgccctatgactgtgtatttgaatcccatgaacgacccaatgtcttgcgcccttgaccttgcgcagtgtgcgctgagtgacggcctgtctcgcgtcatccacgactatcgacccggttatcatcttgcccctcccgcgggctggatgaacgaccctaacggggtggtgtactttcgtggcgaataccacgtgttctatcaacaccaccccttcgaagcgaaatggggcccgatgtattgggggcatgccaagagtgccgatctggtccattggcagcatctgcccattgcgctggcgcccggcgatgacttcgaccgcgacggttgtttttccggtagcgcggtggtgtgtggcgataccctggcactgatctacaccgggcacacctggctgggggacgtgggtgacgagcgcttcatccgtcaagtccagtgcctggcaaccagtagcgatggcatccatttcgtcaaacagggcgccgtcatcgacaccgcgccgtacaacaccatcatgcactttcgcgaccccaaggtatggcaggaggatgactattggtacctgattgccggcgcacgtctgggcgatgtgccgctgctgccgttgtaccgctccacggatctgcacgtctgggagttccttgactatgtgtccggcggcagcgagggcgatggctatatgtgggaatgcccggatctgtttcgactgagtggacgcgatgtactgctgtactcgccccaaggcatgcaagccgaaggttacgagcgcctcaacaagtaccagacgggttatcgagtgggccgactcgatagcgaatggcacttcacgggagggccttttatcgagctggataacggccatgatttctatgctgcgcaaacgctactggccgctgatggtcggcgccttgtgtgggcgtggctcgacatgtgggaaagcccgatgccgagccaggaccatcactggtgcggcatgctcggtttaccgcgcgaacttgaactgtgcgccgatcgcctttgcgtgtatccggcacgggagctcaccgccctacgcaaggcgccattgccgaatacgccctggtgggatgagacggggtcccggtgggtgccggacgtgaaaggcgatatgctcgaaatccatgtgcatctggacttgctcggctgcaccgacggccacctgggaattgccttgcgctgcagcgacgatggccgtgaagaaaccctgctctactacgatgcatcactgcatcgcctggtgcttgaccgcagccgctcgggtgcgcaagtcacaggccagcgcagcgtatcgatagacccgacacaagtgcgacttgaactgcgcgtgttcctcgatcgctcctccatcgaggtattcgacgaaaacgggcgcttcagcctcagcagtcgcctctatccgcggcccgacagcctgggcgtgaagcttctggctagcgggagtggcgggcgtgtctcgatttccaaagcgtggtctctcggttctggatggctatgaggcagcgtcattcgagtcgcgagaagtccgggccatgtgtcatgattcggcgtcaacctgaccgatttcgcctcacatgacttcagtgaaagacgttgcacagctggccggcgtgtccctgatgacggtttctcgagcgctcaacactccggaaaaactgagcgccgaaacccttctgcgggtgcgtcgtgccattgatgaactgcaattcgtaccgagcctgtcagcgcgcaagatgcgcggcgacaacctccagtcgcgaaccatcggtgtgttcgcgctggacactgcgaccacaccattcgcggtcgagctgctgctgtccatcgaacagaccgcgcagcaagccggctggaatgtctttatcctcaacctgttaaacaacccgcccactgaccagaacatcgacctgatgttgtcgcaccgtccggacggcttgatcttcagcgccatggggtttcgccaggtgtgcattcccgagcgcttgaagagcaaaccactggtactcgccaattgcctgaccgatgacagtcacctggtgagttatgtgccagacgacgaaaaggggcagtatcgagccgtacatcacgcgttaagccaaggctatcggcgcccgctgtgtatcaatctgccaaaacagagcctggcctggggcttgcgacaaaaaggcctgcaacgtgcctgtcagggattcggcctggcgcctgacacactcctgcaatacgacctttccgatcatgacgcctacggtgaaaccgcagccatcctcgaccggcatatcatcgaaggtcgcccccaattcgacattctgatctgtggcaatgaccgtattgccttttgtgcctatcagctgttgttgggccgtggcctgaagattcccgccgatgtcgctgtgctcggctatgacaacatgatcggcatcgccgaactgttcatcccgccgctaaccaccgtgcagctgccgtattacgagatcggtcgcaatgctgcccggcacctgatccaggccctcgaggtatcgggagcccagccagttgattgtccgttggtggtcagggcatcactataagaattagttaattcggtgaagcagttagcgtaccctccccctgacctttttcagttcttcatgaacatacatctgtgaacatgaggttccctacaaccgccaaaacccctagcaatgattggaagtttcggtcactcatgaacagtaaacatcgcccactttgttaaaccagatgctatgtcagaaatgttcatgaggttcatggagatgcggcgccgttacccattctcgtcactgaaacggcacctttcccgcaggtcgattcgcggacccgggaccagaacctgcggttgctcaagcagttcctgtcctggtgtgttactcgttacatcccgcgtgcccgtcagaaggtacggaagcgcggccccgtcctttggggaatcttcgcgcctgatggacgaacactgagctaaaggcgcaattacaggtggaaatcacctgcggcctccggctggtaaagcactttcctgatctcaatccggcgggtccgatcagaaattcgccagtcgatggcgtccccctcctgatagcccaggatggcagcgccgatgtcggaacacacggaatgcttcccggcgctgctgtccgcgtcgtcagggtagaccaaggccacttcgatctcttcgtcgtccaactgcagcaaggccctggagttcatcgtgacgacattgcgcgccacctgctgcggcttgacgacaatggctcgctcaagctcatgttcgagttcaacaacggccgggccttgctcaagcgcgatcagactctcgagcctggccttgtcgatttcagtgatgtagatccccgtggagtcgccaacggcaccttcgcgcaagaactggagatagcgccccgccgtcatggaaaatgacttcaatgctggcgtttcgctctcaagcagaaagccgctgcgcagaaaagctttcagcgagcgagcgttgtccgggtggatcttcgcgatgagcttctcggcccgcatgtcgaggaaggccagtttcatgccttcgcggatcgtgcgggcgccaagatttcggccccatttgtcgctgtctccgatgaccaggactatttcgcaattcgagccggtcttgatgagacggacaaagcccaccggggcgtcatgccggtcataggccatgaagaatcggccaccccggttgaatagatgggtcaggatcggtaattgagtccgatcaatgacttgctcgatggagcgggaaacgtcacgtgaatcgctcagatagcaagtgacgcgctcatcctccaaccaatccttcaacgtcagcgcatgtgcccgagtaatttcagggcacagcgaaatgaaaggcttgttcatcttcaccacacttatttgtaaaggatgaaagcccttcatggctatggccatgacggttctttcggcaaccggctatcttaaggcataacgcgagtaatgccgaacagcctgcgcacttgtccttaataagcggttcagcagcgtcaggaggtaccacacccttccctgcttcaaggatcaaaaaaatgaaaccggggcctctagccgatttttgaaatatgaggacaaaaaccgaagcgccaacctactttcaggccctctcctatattgtcttgcggtttggtggtcgccgcggtaatcgataggcattccaacaacaatttgacgtggagcggcgacgtttggaattaagacaactgcgatatttcgtaaaaatcctcgaacacggcagcttgggacgcgcagctcttgaactggacgtcggcgtatcagcccttagccaacagatcgcgaaacttgaaagtgagctgtcaacccgcctccttaatcgcaccactactggcgtcacacctaccagctccggtatggcgttcctgcaccatgcccagctgtgtttgcggcaagccgaaaatgcgatcatggccgctcaccgtgggcgaatgagtgggtacgttaccgtcggaatggcgcccacgactgccactgttcttgccctgccattgatcaacgcgatgcgagagcgctacccggatattcagttgcacctggtcgagatgctgtccgggcatttggccacacaactcaatgctcgccagatcgacctggccattctgtttcaactcgaaggtggcaagcgctggagcgtgacaccgctgctcgacgaaaaactatttgtcatcagctcaccgcagctgccccacgcaccacaaggaaccagcgtgcaactggcggatctggggcaacttccactagtaatgccgagcgcgcaacacggtttgcgttctacgctgatggttgcgtttgaacgttcgggattggctcccaacatcatcatggaagtggatggtcttgctgtattgatgaacgccgtacgcgcaggtcatgctgccaccatccagcccggtgcggcagcggtgctcaaaggtgagtcggggctttcagtggtggaaatttccgatgctcacgtaggtcgacgaaacctgttggcgacactgcctgatgatgagctgtctcccgctgctctggcggcgcgactggtcatcaccgatgtcgctcgacagttggtcgttgatcaacaatggccgggagcgtcgtggattgaggacgtcgcgtcatgatcccggcacaccctcttcctggtttccaatactggggtgtccgcgccaaagcctttaagaaaactaaacacccccactcatttcgcgcctttcgacaataagctgacagctctatcttctccccactcgagaggagcacttcgttcatgcctccttgcgattgaggaatgatgatgatcgacgtattagtaattggcggcggcaatgccgccttgtgtgcagcgttgatggcgcgagaggctggcgctagcgtgatgctgctggagggcgcaccgaaaatctggcgcggtggcaactcgcaacacacccgaaacctgcgatgcatgcacgaagcaccgcaagatgtattggtcgatgcttatcccgaagaagaatactggcaggatctgctgaaggtcaccggcgggattaccaacgaaaagcttgctcgtattgtcatacgcgcctcgtcgaactgccgtgactggatgcgctcccatggtgtgcattttcagccgtcgttgtctggtgccctacatgttgcgcgcactaatgctttttttatgggcggcggcaaagcgttggttaattcgtacttccgtagcgccgagcggctgggcgtcaagatccgctacaacgctcaagtcactgatattgagatgaagggcggagagttcgtcgcggcgtacatcggtgaacgtgaggtcgatggtcagcgtttacccgccgagcgtattcaggccaaagcctgcgttctggcggctggcggtttcgagtcgaaccgcgaatggctccgcgaagcttggggccaaaacgagcgcggagaatggccctcagacaactttctgattcgcgggacgcgcttcaataccggcgtactgcttcggcgcatgcagagcctgggcgccgactttatcggcgacccaacccaagcgcacatggtggccatcgacgcccgagcccccctgtatgacggtggtatctgcacccgtattgattgcgtatcgctgggcgtggtggttaatcgcgacggcgaacgcttctatgacgagggcgaagatttctggcccaagcgctatgcgatctggggccgcctggtggccggtcaacccggtcaacaggcctactcgatcatcgaccaacaagccctcggccgtttcatgcctccggtgtttgcgggtactaaagccaactccctgcaagacctggcccgccagttgaagcttcccgttacgcaattcgtcaaaaccatcgagcaatacaacgcggcctgccgcatcggcacgttcgaccacaccgcgctggacgattgccacaccgaaggtttgacacccgccaaaacccattgggcccgcccattggtaaagcctcccttctgtgcctacccacttaaacctggcgtgaccttcacctatctaggcctcgctaccgacgataccgccgccgttcacttcaacggcgaggctagccccaacctgtttgtcgcaggagaaatgatggcgggcaacgtattgggcaagggctataccgccggcatcggtatggccattggtaccgcattcggtcgcatcgccggtgtgcaagccgcggctgcggctggcttcctgactccttcctccacggagccccaacatgcagctgtttgatcccaaggcaccgggtaatttgattcccgtactcaaccttgatgaaagcgaagttcagcgacaaatgaccgtttgcaatgcctgccgttactgcgagggcttctgcgctgtatttccggccatgacacgacgtctggagttttcccaggccgatatccattacctggcgaacctttgccataactgcggcgcatgcctgcatgcctgccagtacgccgcacctcatgaattcgaaatcaatgtgcccaaggccatggccaaagtccgcctcgacacttacgccgagtacgcctggccacaggtgatgggcacgctataccggcgcaacggactgactctggcactgtcagccggtgccgggctggcactgttcctgtgtctcacgttgatggtgatgggcaacctgttcacggcgatgcccgggggaaatttctacgggatcttcccgcacaacaccctggccgtaatgttcggtacagctttcggattcgcggtactcgcgttaacccttggcgcgcggcgcttctggcgcaatgtttcaccggccgacgcgcccgcgcaggaaaaaaccgctgctgcgctggaagccacggccaacgtcgcccggctcaaatttctggacggtggccatggcgagggctgcaataacgctgatgatcgattcaccttgtggcggcggcgcttccaccacttcaccttctacggattcatgctgtgcttcgcagctactggggtcgccacgctctaccatttccttctggactggtcggcgccctaccccgtcttgagcttgccggtgatgctgggcatcagcggtgggctcgggttgctggtcggccctgcgggtctgttgtggttgaacctgcgtcgcaaccccgaacacggcgacgaaaaccagaaacccatggatcgcggctttatcgcactgctgttcctggtcagcgccagcggcctggcactcctggcgttccgtgaaaccgcagccttgggcctgttgttggcaatccatctcggcctggtcatggcgtttttcctgacaatgccttacagcaaattcgcccatggcatcttccgtagcgccgcactgctcaagtactccatcgaaaaacgccaacccaacccgattaacgccggaagcgattgatcgtagaaccactcattccaataacaatattgatcacctgggtaattgcactgacttgaccacccatttgcattcgacctaatcagccatgtgcatcggacttgaccagcacatttcgtatccatggccggcagagagcgacccaggttgtgtgaaaacacctgcaatttacgcgagggtatggcgctgctagctatgaggcgttcgcagctgggcctaaaagctgctgcgtccttaagttcgccccaaccgccctcattaccgcaacctgcacacaacaccaccgaagaatcccctcgctgatttcaatcctcaacccgccgcccctttgaccactgtcattgtcgaatccgatgcatcccgccgatactcagccccgtcattcagcgacgcgccagcgcctacactcgatggcaaccggccaggacccgcatcctggatcattgccgtcgatcatcatggatacttgagaaggacactcaaatggtacgtgccgtcactattctcaccgagaatttctccgactgggaacccgcactcatcaactccacggggcgagcctactatggcttcgacactcgttttgccgcccccggtggccagcaagtaacttcatccggaggaatgaccatcatcccgaacctggccatcgaagccatcgagctggacgatgtcgacctgctgatcgtgacgggaggccctgtgtggaaaacagacaaggcaccggcaatcgaggcgctggttcgtgcggtccacgccaggaaaatcgtcgttgccggtatctgtgacggcactcgcgtcctggcccaggccggagtgctggatcacgtgcggcatacgtccaactccgcggagaacctgaagcaggtgcattatcgcggagcggattattaccaggatgtgccctatgccgttgccgaccagggtgtggtcaccgctcctggcagtgcgcctgtcagcttcatggcgcaaattctcagcaccttgggtttgcacgacaagaagctcgatgcctacctggccatgcatgcggctgaacacattcacggctgagcccccttccctctatctcggcggcgactccttcgacgctatccgggtgatgtcgcgcttgtcctgcaacctgcccatcgtgacgcttttcgagcacccgacggccgttgacctggcccggcgcgtcctctgcgaagccactcgacaagccgtgcgcctggtctgttttggcgatgcgcaagccgccgcgggttcgaccgcggtgattgcagtgcctttcggcggcggagacgccacggcctaccgcagcctgtttcaaggcacgcaggatgtgcaggttttcggcgtggatttcggtgacttcaaggtccaggacgctttggacttccatgccctgctcgacacccttgccaccgagatcgaagagatcggcgccgcccgcctggtgatctacggccactgcgccggcgcggccaccgcggcgtgcattgcctcgagcacagcaagaccatgaagatcgatgggcaggtggcctggatcggcaccagcaactggctcggcggttacctggacaattcgcgcaacctggaagtggtgatgcacgacagagcgatggccaggcgcatcggtgagctgcacgcgcaattgtgggatgggccttatgcaaagccgctcgaggtgatggctgagtatccggatccgcatccgggcacgccgtgaagaaaaaggccgagcccctcggaggttcggccttctgcttatggttcagcgttttgacgcaaccatcgcctccaccgtggtcgctctgtccgcactggccgtagcctgccctgccccccgcactgcctgcgcccgtaccgcggccgcatcctgcaggatcacctgcgccgctttctccgccgccacatagatcgaggtgacgatgaagaagccggggattttcgggaagatcgaggcgtccaccacccgcaggttgcccacgccgcgcacgcggaaggcgctgtcgagcacggccatcgggtcgtcgtcggcgccgatcgggcaggtgcaggaggcatggtggccccaggcctggttcatgacgaaggtcctgagctgttcgtcggtctgtaccgcatcgccgggcagttcctcgctggcgatcagcccggcgtctttcagcggctgggccaggttgcgcacgaacttgatgccctccaccaccgattgcaggtcttcgccctgggtgtcgctgccctcctcgaaataatgaaaattgatcagcggggtgtcggccgggtctttcgaacgcagggtgacgtagccggcgttgttgttggtatgggccttgagtatggcccaggtcaggtagttcaggtgctcgacgatcagcttcgagtagccggggaaatagccgcgaaacagcgccagcagggagaaacaaaacaggtccggcagcggccgttgcttcagggatttcttgatgatcgccaggaccgcgccgttggtgctgtagaccccgaccttgcccttggcccactcctcgtactgcggatcgcccttggcgtagcgcgcgtccttgagcacttcccagtgctcgaagttcatccggttgaccaccccgacctcgtagcggtcctgcaggttgcgccctacgcccggcaactcgacccgcaccgggatgtccttggcttccagggtttcgcgcgggcctatccctgagagcatcagcagttgcggggtgttgaaggcgccgccggcgagtatcacttcgcggctggcgtgcacctggcgcagttcaccggtggcattgcgcggcaaggtgcaggcccggtacagccgcgcgcccttgatgtactccacgccataggcgcgctgctggtcatcgagcagcacccgggtcaccagcgcatccagctcgatgtgcaggttgtccgggtggcgcttttgcacatccagcaggcgttcgcgggtcccgtggcgatggtggtgccgggtggtcagcggcggatagcgcaggccgatggcttcctcgcgcaccagccgccagtcgttggggtcgcccacgccctgcaattgccagccgatgcgcttgagggtttcgcccagggtcttgaacgcctgctcggcggacttgacgatcgagcgcaccagcgacaggtcgtcgatcaccgcttccggcacggccttttccacgtgcagccagcccttgaagccatgccgcgacgggttgatgccgaaccaggagagaaaccgctggaacggccggtgatggcagttctccaggcgctggaagtgctcgcgcatggcactggccttccacgacgggtcgccggtgatctgcgcgatatggtcccagtcctggttgtgcgggtagacggtgatcatcgcgttgtgtgcggtgcagccgcccaggcaactggcccgcgggtacagcaccccgtcgacgttctcgccctggaaggtccgggtgaacttggggtcctgcaactggcgggcgtcgttgctgtagtggcggacgaagaagtcccagcgcatcgcatcgttctcggtggagcgcgggtggaacgccggcacttcgtactcctccggcaaccgcggggcggtggtgtccgccgccgccgggtcgctgccagactccagcaccagcaccttgcggccctgttcggccaggcgggcggcgacggtgccgccccctgccccggagcccaccacgatgtactcgtaatccatttcgttgttcatcgctggccacctagaaagttttcagcagggcgatcaaggcccgtttgtctgcatcactcaggggcgcttcttccttgaggaagctggtgccgaagtaatgccccttgtccaccacgaagtccgggcacttgctcacctgcagcagcggcttgaccaggccggcgaagaccttgcgcgcttcttcgtcggtggcaccggccggcagttgcttgaggtcgtgcttgatcttcagcagcaggtccagcacctggtcgcgtttctccaggtcgatgttggacagcaggctcaccggtgtgccttgcgggatcggtccgagctggatgccatcctcgccgaacagccacggcagccagcggccgaacaggccttcgagtttttgcaggaaggtcggcagatagccgctgctgactcgcaggtagctggtctcactggtgacgtcgacggtgcccatgtgagtcttgccggagcgggtcatgacctggaagtcgccggtgcggtgttccggccacagcaacatctcgatcgcgctgtcgaaggacgccatgcggtcttccaccccgcccttccagtggaattgacccaggcggttgttcagcagcagcggcgcggtggaccacacgctgaccagcgaggccggccgcgtataaccacgtccgcccgccggcatcgcgtattcccagggttcgccggtgtaggggttctgcaccagcaccgagcctaccgccggcaattgcttgtacgactccgacgagaagttgtcccagatattgccgcccagggcgttggtcgccagcgggctgcaggcgttggtttcggtcagggtgaccggcacccgcagttcggtggagaggaagttgtcggtcaggaacttctcatccttgacgatggcgcgcatcgccgtcttgaactccggcgtcttgctccaggtccagtaattgttccagcacttgaggtaaccgtcgttcacgcagccatggtcgggaaagaaggtccaggccttttccggcagtttgctggagtggcaacgggcgcaggtgtcggcgaacacttccttgccgcgctccagtaccgccgccggttcgctcaggtgtgccgtgccaccgggggcgttcttcaggtagtccggggtcgccgaggccaggaagaacaacgccaggtccggggtctgcgcctcgttggcgttccagtaggaggagttcttgcgtgccacgtcgatacggaacggggtgatcggcttgccgccgatcagcggccggaagtgggtggtccattcctcgctgtacaggccgatattgatgaacacccggttcaaggctccgagcgcgcccaccgagtcggcgccgtccttgagcacccgtggggtgaatacggtgtcaggctttttgtagaactgcgccagcgggctgtccggcggcacgccgggcacctcgttgaactgacggttgtccagcccgccgccggcgagtttttccttgcccaggttcgaggccagctcgatgcgcgccttgaggttgtagaccgcgttcatggtgcgcgggttgttgatgtagtcggtggagacgaacgaggtgtccagcgctcccggtttcgaggtgtggaacagctggtacggaaagctgctcgggtcctggttccacatgaagatccggtcgacccagaagtactgcgcgccggggttggagttgaggttggaccaggccggatgttcagggtcggccggcgggttggtcgggttcggcccgacatggcagaagccgcaggacatgccgacccggtaaggtttcaccagcttgctgtcgttgtaataagccgggtcttcgtaatagcgcttggcgtcccacttcttctgcgcgtgctcgtcgaagtccgggttggggaacagccgcaggccgacgatcccggtgccgtagccgtaataggagcccaccggcaggttcttgccccgggcgccgatcttcaccccggggtacttggtttcgttctcgaaagggtcggcggcgcaggacgggtcgcgcttgtccagccacaggccgtagcggtcgtcgcgcggcccctcgcccttgacgtagcagggctcgttgaccacccccagcacttgccagcgtttatcgcggttgtatttcaggctcgggtggttggagacggtcttgagcaggtccaggttgccgacgctgtcgcgcgagagcttgtcccacagcgcatcgttgccggcggtccagacgatccagttgttgcgcccgcgggcgaaggcctggagcgcctgctgttcggtaatgccggggatgaagggcgacagtcgctcgaccagcaactgcggttgcctggacacgccgtagtccatgtcggcgaagtaatcctcgtcggcgcctctgaggctgccggcatcgcggccgacgcacttggcttcgtcgagtcgctcgccgggcttgtcgccgcaggggtttttcgtctcgctgctacagccctgtaacagcaccaaaggaaggataatgctcaacatcagcttcacgggtgtcatgcgctgctccttgcatgtgctgcagaccggtccctctgtccttggggacacctgtgtcgcgaccggttctttttctgatggccgaacaaccgactgcctgcgcaccgggccggttaacctcggtgcgccagccgctttaaaacgccctacagccgccatactaggtcatggcgagcgggtcaattcttccatttggcgatgaaaaaccgggggtaattgcgattggctatcggggataaccgggggccgttattcacccttcggcgtcaccggcggtcaggactacactcgcctgtcatacccgttccgaggcgggccactgctacctgccaacgtcaccttttttaccgcgagcgtaactgcccatgaccgacgtgttcgccaaggtggccctggggccgctgttactcgcccagggcctttacacccgctgggtcacccccaggttgccggaggccgaaggcccgcgccaaggcaggcacgccgacgccagcgggccggccctgcgcctgttgatcctcggcgactccgcggcggcgggtgtcggcgcccttacccaggacgaggcgattgccggccggctggtggctggcctcgccggcgacttccagctgtcatggcagctgcgggcacagtccgggctggactcgcggcagttgttccagctgttggaggatggcccggccgagcccttcgatgtggccctggtatccatcggcgtcaacgacgtcaccagccgcatcgccgcggccgaatggcaggcgcggatctcgcgcctgatcgcactcttgagcgagcgcttcgaggcccggcatatcgtcttcctgcccgtgccgcccatgcacctgttccccgccctgccccagccgctgcgctggtacctgggcctcagggcccggcgcttcaaccacctgctggtcgaactgctggccggccaggaacgctgcgcattgctggcgacccgcttccagtcggccgccagcctgatggccggggacggcttccacccttccccggcgctctaccagatcctcgcggatgaagcggcgcaggtgattcgccagcgctgcggccgctgagtcacacctggttgaacccggcacgcctgcggcctgcggatggtcgaaaaacctggaaataatttaaacctttgccgcaggttccctatcaaccgtcaggcgacacctgtcgtgccacgaatggagaaagaacatgaacaacctgctgatgaaacaaatgggcctgttgttcctgctgagcgcaggaagcctttcaagtgcaatggcgatgagctccagcgactttgtcgaagaggccgcgcaagccgggatcaatgaaatcgaaagcagcaagctggccctggaaaaaagcgcctccgcggacgtcaaggcctttgccacgcagatgatcagtgatcacagcaaagccaatcaggaattgctggtgctggcgaaaaaactcgacatccagatcccggacgaagcctcgctgacggccaaggccaagcaaatgatcctggagatgcgcgatgagtccttcgacaaggcctatgccgacaaccaggtagtggcccatgagaaggccgtggagttgttcaagaaagaagtggcgtcttcggacaagccggacctgaaagccttcgccgaggagaccctgcccaagctgcaggaccacctggacatggccaggcacctgcagtccaagaccaagtgaagcacccgcaaaccccgcctgagcgcggggtttgccggctcacgcctgcggatcggcgatcctttgcgccacggcttcctcgatggcccgctcataggcggtgttggcctggtccttgagttcgagccagccggcctggtcgatcacgccgctgcgcagcatgttttccgccgcgtctagcagcgcctgatgccaggcgtcgggcgagtccgcacggtagccgcggtcctccagcaggatcttccaggcctccagtaccgaggccttgcgttcgctgatcatgaccgttctcctctgttgatgaccgatagactttcgagtcccgaccgggcgccaatgttcagctcaacggtccggtgcgcgcctggcccaaccacaaacgcaagccaggcgccgcgccggatcacttcttgtcggcatccggctgggtcatctgcaccgaggatttcgagttgtccttgtctttatcctcggtgttttcaaaacagccttgcaggaccagcaggcagcacagcagcgataacactcgggtcaggttcatggcgtggctccaggggggcaaatcggcgccgcggacaggcggcgccccataagcaaactgactcggggctggcgagcggcgttcagaaaagtttgccgaagacggacagaacgcaccctcgaagccccccgtccctagcggctaaccactcgtcgtacgccgccgaacaaatttcaacttttgaaaaatcccggtactcccaattagtgcttgctgcaattgcgagcgaaattcaatcgaccaagaggtagcgaatcatggccaacaccggacattccaatcccgggaattttgcgaacgatcgtcaaaaagcatccgaagccggcaggaaaggtgggcaggcatcgggcggcaacgttgccaacgaccggcagaaagcgtcggacgccaacaagaaaggcggccaacccagcggtgcccgcggagggcgtagctgatcgttgagccccaccgtgcaagggctccggcccttgcctctcatgccgggccaccacggcccggcctttcgaggagaaccatgatgaagatctctgaagtcatgacccgtgacgtacagaccgcacgtcccgagcagacgctgcgggaagtcgccaacatgatggccagcatcgacagcggcgccatcctggtgaacaacgaagaccggctggtcggcatgatcaccgaccgggacatcgtcattcgtgccgtggccaagggccaaagctgcgatatgccgatcagcagcgtgatgagcagcgacatccgctattgcttcgacgaccaggaggtcgacgaagtggcccgcaacatggccgatatccagctgcggcgcctgccggtggtcaatcggcagaaacgcctggtgggcgtggtgtccctgggcaatatcgtcaaggcccacgatcgtgatgccaacagcaccgtgctgcagggcgtggccaaggcccattgatagcctgggccccagacggctgtggccgagcggccacggccggtgtttacccggtgggccgctgcgcggatcgccatgtagcggccctcgcctggcgcccaggcgatgccggcctgcgctccccgcagtcactatcctttgctgtgctcgggcgacgtcggcccgctacccggcttgattccgcgcgggccggcgatgccccaggcgatcaggcccagcacgggaaagatgacgatgccaaggaaccacatgaccttgaccccggtggacttgctgctgcgaaagacgctgatgattgcccagagatcgaggaggatgatcatcgcggcgacgaagatccaaaaatagctgacaagatctgtcatgacggctactcccttcgggttgatacaacttaggtttcattcccgctcgacgggttcaacctttctcggggcaaccgagcatggcgccggggcgctccgctgccgttacggccgggtgccattcgtctcttcccagcgtcttgcaacgaacgtcccggcgccggaaagacccaatgcataggcatttttgaaagtgcgcgggagtggctatgaaaccggtcgaacgccgtgtcggcctcctgggtcgcgaggctgtcgaggggcccgggtggttacctggcctggcgctgggctcatgccgcggccctggcgcgacaagctgaccggccccttcgaaagtgcgcgtatggacaattcgaagatatcccacgcctcccccgctcaagtggccgtcagcctggcgctcggcatggccctggtcgttgcgtccggtatcgcgccgcacaatcgcgtggattggctcctggaaaatgccctgcctgtcgccttgctgttggcactgctggcgggttggcgatatgtgcgcctgtccccgctggcgtatggctcgattcttttattgctggccatacatgagctcggtgcccactacacctatgccaaggtgccctatgacgagtggctgcgccatgtcaccgggcagtcgctgaatggcgccctgggctgggagcgcaaccaatatgaccgcctggtgcatctgagctacggcctgctgttctatctgccggtgcgcgaactgctggggcgctgcacgccgttgcgtggcttctggctggccaccctcgcgctcagcctgatcctggccacttccgcgtcgtacgagctgatcgaatggatcggtggccagtacctgggcaaggacaaggccaaggctttcctggcgacccagcgcgatccctgggacgcgcaaaaggacatggcgctcgccttggccggagcctgtgccagcgaggtcatccgcgccctcgcggcattcaggcgttgaaccctcgaccttcggtccccgggcgggaacatcgccgccgcgccagcgtctgctctatatcgaccctggccattcaaatcctcgacccgagaggaggcagcgccatgaagtcacacgccaaggacccgcaggcggcccgccaacccggcaccgcgctccaggccttgctgcgccgatacgccgagcccttgcccgccctcgaatccgcggctttcggcgagctgttcgaccgttatgccgatgccagggtggtgctgatcggtgaagccagccacggcacccgtgagttctatcgaacccgcgcggccatcagccaacggctgatcacccaccacggcttcgacatcgtcgccatcgaggccgactggcccgacgccggacacatcgaccggcatgtgcgcgacctgggcccgtccaccgccgggcagcaggcgttcagccgctttccgagctggatgtggcgcaacgtcgaggtgtgcgacttcatccgttggctgcaccgccacaatcgccccctgcccgcgcagcagcgggtcgagtttcgtgggctggatgtctacagcctgcgcaattccatcagcgaagtactggcctatctcgatcgcaccgacgcccggctggcgcatgaagcgcgtcaccgttatggctgcctgacgccctggcaggacgatccggcgctgtacggccatttcgtcgagcgcgggcacgaggcttcctgcgaagaagcggtggtccagcagttgaacacgttgttgagcgaacgccttgccagcaaccctgaagcgctcttcagcgccacccagaatgcccgggtcatacgctctgccgaacagtactaccgggccatgtaccgaagctcggccgcctcctggaacctgcgcgacaagcacatgttcgataccttgcagaccttgctcgcgcaccgcggcgcgggcgccaaggcagtggtctgggcgcataactcgcacatcggcaacgcggcggcgaccgacatgggctggcgcggcgagttcaacatcggccagctgtgccgcacggcctacggcaacgctgcggtgctgatcggcatgagcaccgaccgcggccaggtggtggccgctgacaactgggacggtgacatggggatcaaggaggtgcggccttcccttgcggacagctgggagcagcagtttctccaggcgggcattcccgcctcgttgaccgactggcgtgcccccgagcgcgaagacctgcgccaggcgctgtccgagccgctgctggagcgggcgatcggcgtcatctaccggcccgcgacggagcgccagagccattatttccaggcggtgctgggcgagcagttcgatgcgctggtctggcatgaaacgaccggtgccgttaccccgctgccggtggcgagtagtctcagtcatgaagaagacacctttcctttcggggtataagcctcccccttggcgatgaagaacccctgcgagggccccaccatgaaccacgaatcgtacaatccgaaagcatccacatcgacctccgggaccgcccccgaagaacgccccgggcagccggaccctggcgacgaggaagagcagagccctggcctcgatgacgccgccaggccagaccctgcaaaaggcaacgagcaggaggccgaggatatcgccaggaaaatcgccgagatagaaaggaaggtcgccgacggcaactgagcccctcggcccggcaacactcagcgcccctgcggctcttcgagcatgcgcttggggtgcatgccattgaccatgcccatgaacggcgcgtggatcgagtagccgagcatgcgctggatgtgttcgctgcattgccgggcgacgtggcgcggggtcgacaggatgaagttctcctgctggcgcgcccagggttcgcagtactgcgccgtcagcgccaggcgtggcgcgtcgctgcaattggcgccgccgccgtgccagagggtgccgaggaaaaacaccaccgagcccttgggcatgaccaccggcagcacggcggcctgttcgacggcggtgggcaggcgtccgtcccacagatggctgccgggaatcaccacggtggcgccgttgttgtcggtgaagtcgtccagggccatgatcgtcgccgcgccatagggcggccgcgggcgggccacgggatagaaggcgtcgtcgtaatgcaggtgctgggcgcactcacccggcaggatattgatcgcctgcagctgcgacagcaggtaattgggcgccaggagccggtccagcaggcccaggaccagcgggtgctccaccagcccatcgcagacccgcgttttcgcaatcagcgcatacaaccgctgggtgcgtgcgccctcgaacgagttgcgcccggtctggcagaaacgtcccagcagatcctcgcgcatgcgactaacctgctgctcatcgaacagccgttcgagcaccacgaagccgtcgcgttgcaggcgagccatcagctcgtcgagttgcgcggcgggcacggcgggttgggtaccggcggtcgatcgataagtcctggcgcatccgctgctcatgtagtcgtgccgctcgggcaaggttgtggttgtcatcgactggctcctgggagtgggtcgcatcaatctgccggactctggagtgcccgccaatgacgctttgcctcaaatgacatgacccgcccttacccgcactggatcgtcgccccgaccattcccgcgcgttttgtgcgtgagatgctggggcaactgcgtctcgacgccgacgcacgcgccgcgctgctcgagcgttgcgacctgcccagggaagcccttcgcgacggctatcgcgtggcgccgctcaactaccgcgccttgagtcgcctggccgtgggcgtcggcgccgacgaagccttgggtttcttcgcccgcaccgtgccgccgggcagcttcgaacaattgctgcggttgctggtgcacctgccgaccctggccgaggccttcgaagaggccgcgcgcttctacaaactgttcgacgattcgccgccctggcgcctggaaaaacacgccaggattggccgcctgttgctgacatcgcgccccggggcgcagaccgactcggtgctctggccgcatatgctgctgttggcgctctggcacaccggcagctggctcaccggcgaaaccctgccgctgcgacggatcgtcctgcccgggcatctcagcgccttcaccgcgcaaacacgttttctgttcggccgccaaccggctttcgccacgcaggcatggctggaactgccggcggtgaacctgcaggcgccgctgatgcgccggccggcggaggctgcacgcttcgcccgccacctgttgccggcggtgatcgcccccggcccgctggccagtttcgaagcgcacctgcgcgccttgctgtgcaccgccgagccctttgccgggctgtcggaactcgaggcggccagagccctgggcatttcgcggcagaccctggcccgccgcctggcggcgctcggcgtgaccttcctcggggtgcgcgatgaattgcgccgggacctggcctgcaccctgctcgcccgcggctcggtgagcgtcgccaaattggccgaacgcctgggctactcggaacccagcgccttccagcgcgccttcaaacagtggaccgggctgccaccgggggcctatcgcggcggccggcgcgagtgatgcaggtcaaagggggttccacgactcacgctcaggcggtgatggggcacactgcgaggacgattacttttgacatctacggctgtggggtgtccgttgaaaccgtagcgaaggttcttgaagggctcttcaaaccctagagattcgagtgggagattgtgtaggcacaccatttcgtcgcgcgttgcctgctactgctccgtcattagacgattgaatcaatatcaagcgtgtgtggcgcgccaatggcgtgtccgtagattgaagccaacagaccatcatcaacgtttgcagtgggggccatggccaattgttcgacgactctgttttccgggtgggcattccagcgaggcaggctctcggtcagcaggtcaggctgtgttgaaaccgacccataaacaaacttctggtcaatcgtcactcggcgcagggtctccaaacgctcgagggtcatttgcactttatcgacctcgcgattaagcgcctcgatgactagttcatgggctcgggcatagggaccagggttagcgttgagcatgcggcgcttgaggcgcagttggtcagtgatttttgtcaggtcccctttgacccgttcgacctctccatcggtcactcgcgaacgcttgagctccagggcctcctgccagcgtcgcaatgttgcccagcaaccagggatatagccgccgaccattgaatgattacccccggcaagaatctgcgaaatcaagcccggtctttcaggcaatcccttgttctgttgaatggccagggtgcaggccgcatgctgggtaatggtgtcgcaacctggctcccaaaggatggcggatttctccttgccacccaggtctactggaaagaagtggtacaacgtcccgtgatgctcatagggttctccgctcaggttggtaatacctgctacgaacaccgagaggcccaaggggacgttgacgaaggtcaaggctgcccctgtgccatagacagatgccttggtgttcatccaggtccccggcacgctgggcactgggtcgttatggttgaccatgcggtaatgcactaaatcggcagcaccttttacgaaggtcgcgtcagcggctcttggggagccgtaggtgtagagcacgatgccgacttcatattctttctgacggcgcagcatttcagagagcagcaaggtaattgcccctcccaggctatggccgcaaatgatcagtttctgtccggtgtagaacctttcaagatacttgagcgtgaggctatagaccttcagtgcggcctcatagaatcctcggtgcaccttgcccacaccttgtgtaaatggaacctgaaacgcatcagcatcgcggagcccatccgcgaacttctcattggtgccgcgtactgcaatcagcaccaactcatcgttatgcgtgataaacgcttgggtgtcggtgttatcaatttggttacgatcatcaagaaaatgaattttggctggatgttcttgttcttcttctaaatccgggctattcgatggataaaggtcagggtcaaacggcacgatttccaggcgcttggagtacggcacgtcttcatacagcgggtagtacgccttggcttgcccagggtccaccttccagatttcatcgaacttggccagggcgtcgccaaaccagttacccatgctcggtttctgtaggaaacctacggtcttcttcgtgatcggtgccttatccggctcctggccaaacgggttgtagctcaaggtggccatgatggcgagttgatacagattcagcgcacagaactgtgaaccggtggagagcatcggacgcaaggcccgtaacgggcgaacttccaacacgttgtgcttgttgggcagcagacagacaccacgctcgccatgctcccgcatcagcttggcccatcccggacggagtgggtagtgacactcgacctcaggtggtaaatgcgcgacatgctcgaccaagtgacgaacttcaacttggcagaagaaatccgcgcaggcttgcgccgggttgctttgggtccgtgagccgtctttatgaaagtaacgggtttgctctgcacgaacttgaagctcggttatggggagtgggtaatgtaatctttgttgtaggtaggcataaaactcattattcccttgatacttctcttcgagaatcaaggctattgggccagcaaagtgatcatccacttttcctttgcccgtaccgtcgagttttccggtgtatgtgtagccttccgtatcgatgactttataggaaagtcctgcatatggctgcccctcgccaaactcatcgactaactgaaaactggtccatttaccttgaacagggcaggtaaacatgcggttgtttagcgggtgcttcagttcttcatccaaagtgaccattgagtgatttccttattctgtgcagccagggtaaatggagcattgcttgccatcgggcatgtggaatgtactgaagtctttatagttgccgaagcagaatgcatattggtcttcaaagcttttgcccatgcaacgtttccagccacccgggaccttgacccacgtatcgcctatagctggtttttcctcatcagccagcctgatattcagcttcacggttttacccggtagttgatccaaggtgtaagccccgacgggacgccctttcgtcaccatgccctgaacgtcaacttttttgcattcgaggagctttcttatatatcgcttagggccaacggtacggaacgaccattgacactggccatttatggcgctttccccagcagcatcaaaaattcttttttggtgctcttcaagctgctcacgaacaacaattactgccgtgtcgctgctgaagtctccatagtcttctccataagcagcgtaaatatctaattcgacacgatagatggccagccgacaaccttcgacagtgcgatatatgggaatttcagagtcgggcttgtatctttccttgtaatccaaatgccatctttggttgtagccaacatccgtttttttaaccgtacaggtttctcccttgacgggggcatattgagccagtgcttcgtaagtaaagttagaaggcatatcggtggtaaaggtaaagctttccgatttaccaacagcgcaccctactaccagggccgcacaggaaccccaaaacaggcttttaaatgttcgtgtcattacgaggcgtctccttgccagaattgtgctgtctgataaacccgctggaaatgagctgtcggagtttcctcaggatgcgcctgccagcgcgcggcaagtgtaccgtctgtttcctttaagctctggaccaacaagaactctagttgcgccggcaattgccagccccaagcgtcagccaaggccaactgagcgctgagccataggccgggatcttgttgctcggccatttgggcgtaggcctccatatgctctgccagtagatagcggcgggcattgacctcgcgtaggtgagccgattggtcgccctcggtgggtacgttccaccatgcagggttcttggggactggatggttgcctggggctgggttgctatggatttgccagtgttctccctgccagtagcagacgctgattatgggcccgaggtattcaggaagggcctcgacggtcaagtgccccagtgcgcggcttagcacacggttgtcgtgaaagcggtagagagcttgatgggggcgtatcccgacaatcagccgttcgcgccaatgtctgaccagctcgtttagtcctgcttctggcgcaacactggccaaccaaccccagttcctttcaggggccttgagcaactcgttcagttgtccatcttccgggttgtcgatgaggaacataaagggccctgcatccgccagatcagagaccggtgtctcgctgtacacgctgcaatactggccagcatcctgactgcctgatagaagccggcgagtgttgagttctccctcagagtccagaatcaggcatagcgaatgcccaagacggtgttgttcgatcatccattgctgaggcgccgttctggtcatgccgtggctccttcagtcaggcaaagaccatttttgcaggcctcgcagatcggacagaagtcagggcttttcaccttggagatggccatcagggcattctgggagggggcaatcatcggcgggagtgctggaggggtcgtcagggctgtcagtgccccaggcaatatgggattggccgcagtgcctcctaccggggcgccaccgagttgaatatcggaactgctgaagatccctccagggccaatcacgatgtgttgaccaccggccttcaaggtaatgctggcgcctgcgtccagaatcagattggctccggccttaaggtggacttcctgccccgcttcggcgaccagcgtttgacctacgcgggtatggctgctgttacctaccaacaagtagtcgttggccttgagctggactttgcggtcagcggtgacggtgcgctggtcctcagcttccagcacgacgatgctgttgcccttgatggtttccttacgctcgttgccgacttccaagcggctatcgttttcgactttctgttccatgtcacgttgggcgcgcaggtagatcagctcttggccgctacggtcttccagatgcaattcgttgaagccggtgctgtcgggcgagctgcgactgcggaaaacgctgcgagtcttgtgggcgggcagctcgtaagggacagggttagcgctattactcaagcaaccactgatcagcggaaaatccgggttgccctccaggaatgaaaccagtacctccataccgacccgagggatggtcaccgcaccgtggctggttcctgcccaactggaagcgacccgcaaccagcaactgcttttgtcatcgatcaggcctgcgcggtcccaatggaactggaccttgacccgcccatactggtcacaatggatttcctcgccttgggggccggtgaccacagcggtctgactgccgagtatccggggtttctcgtaggcctgttgcgggcggtagaacacgtcccacggagtggccgtgaaagtgttgcgatagccctgatggaagtcgtccttgcgctcgcgggtatcactgggaaggctctcttccagcacctggggttgcaagccttcgtggcgaattgaagtgagcagccagaggtcattccactcttggcgtggatgctcgcaaagctccagaaagtggccgctgaccagcgagggttgatcgcttttaccttcggcctgacggtagtcggcacgatgtccttccagggtccgttggctcaattgcttgccccgttcgcgctgaaggaaaccaccagggtagcggtaatcttccagatcaggctgcccgtcccgaggtgctgggcgatagtccgcctccagcgtcatgcgggctttctcgaagtcatagtcacgttgcgtggttcgactggtgcgggtcgcaaggcgcaggctaaaacgtttgatcacgggggcatcggcaaccagaccactgtcttgcacataggctgtcggtctgctcagcctggggaatatcgtctggtcgtcacccaataccagtacgtggccttgttgcgaatgttgaaagtggtaatggatgccttcttcccagcacaggcgctgaatgaagtagaggtcagattcgttgtactggacgcaatagtcacgggctgggtagatcgaccccaactgaaactggtaggcattgctttggataccgtgctcttcaagaacctgcgcgatgatgtgcgagacggtttgctgctggaatattcgttggttggtccggtgcgccagataggttaactgcgggaccagggtcaggctgtaacgggtcagacgcttaccggagtcgccttgcgcgatgcgataaacctgtccatgaataccggcgccactgttgttgaaggccagaaaggcctgcttgtgcaatagactttcaatgtccaggtcgggccgtgcactgaccaactccagatcaaatgaatacggcgcgctgatggattcttggccagtgaaggaaaggacctgaaggtcgtgcttgaagtcggtgagggtcaggctgaactgcgtctgtggacttgcattgaacatccaatgctccttttccaatcatgttgcgtggccccatagagggaaggcttctgtgggtaagcaggaagcaaagcgccttcacgctaacaagcgaggaaaaggaaatatttgggagctttcccaaaataccggttgaactatcggtattcaggctgcaccggcccgatccgccacgtccagtcgcctctgggtggattttttcaccgccaccccgttctcgaacgccgcgtaaaccggcatgctgcgccaccctgatcgccacggcagcggaccgcccaccggggaatttatgccgggatggcgcggtctatgctcgtcagggctggtgaacagcaaaagaggacatgacagatgcggcgagtgagacagaaccgctgggggatggggctgttggccctgttgctgtgtattgcgctgccggccttcgcggccccggcgcccgggccgcagagtgttgcccgcaaccagctgccgttgctggccgagggcgcggaccttgagcagctcaacgaccggctggagctgatccgccagagcgtatcggcgagcggtaacgacgacctgctctcggacctgcgccaggccgcgctgcaagtgcagaagcaggccgacagcctggtcgccctgcgcgccaccgatatcgagcgcctggacgaccagctcaaggtcctgggcccaccgttgcccgacgaagcgcccagcctgaccagccagcgccaggtgctgagcgcgcagaaggacaacctgctcgacgaagagcgccaggccactctgctcagccagtccggccgcgacctcgccgcgcagatcatcaacctgcggcgcagcctgttcaactcgcagatcagcacccgctcggcgagccccctcagcccggccttctggtccacgctgatccgcccgaccgaggatgacctcaggcgcctgaaccgcctctccgacgaagtctggaccgcattcgagacggcgctggcccccggcaatcgcgggctgttcattaccacgctggttatcgcggtactgatctgggtggtcggccggcgcctgctggaacgcctggcaatctggtcgatgatccgctggctgcccgaaggccgcttgcgccgcagcgccctggcgctgaccgtggggctggcgaccatcgtcaccatcaatgccgccgcctcgctgctgcgctgggggctggtcaacagcgcgaccctgagcgccgatgtgctcaacctgatcggccagtggctgaccctgctgattttctgctcctttatcgtcggcctcggccgcgccatgttgatgttgtcgcggccgtcctggcgcctgccgccgattcccgatcagatcgccacggccctggggccgttcccgctgatcctcgcgctggcgctgctgctcaccgccggcgaggagcggatcaacagcgtgatcgccagcagcctggccctgaccgtggcggtcaacggcctgacggcgctggtcaccgcgctgatctttttcttcgccctgttgcgccatcgccgtacccgccggcgcttcgaactggagcgccccaccggcatcgccgggctgctgcccttcatcctggcggtctgggtggcggtgatcctgctgtcgctgctcagcggctacctgagcctggcgtacttcctcaccgtcaagctgctgtggatcagcgtggtgaccaccagcgcctacctgctgatcgcctgcttcggcgacctctgcgaaaccctgctgtcgcccaagcagcccggcggcctggcgctggcggcggccctgggcttgtcgccgcgccaccaggcccaggccaccaccgtgctggcgggcatcggccggaccctgctgctgttcaccgcggcgctgctggccttcatgccgtccgggtcgagcccgggggaactgctggaaggctttacccagctggatgtcagcggccggtccctgggcaacctcaacatcgtgccccaggacctgctgctggcggcggcgttcctgatcggcggcatgttcgccgtgcgggtgctcaagcgctggctgagcgagcggttgctgccggaaaccaacatggacgccggcatgcgcgcctcgctggtgaccctggtcggctatatcggttttgtcctgctggcgatcgtggtgatgtcgaccctgcggatcaacctgaccaacctgacctgggtggtcagcgccctgtcggtgggtatcggtttcggtttgcaagccatcgtgcagaacttcatttccgggttgatcctgctcaccgagcggccggtgaaggtcggcgactgggtcagcctggccggggtcgagggcgatatccgacggatcaacgtgcgcgccacggaaatccagatgtccgaccgctccacggtgatcgtgccgaactcgcagttcatctcgcagaacgtgcgcaacgtgaccatggacaacgccctgggcgtggtcggcatcaccctcaccctgcccctggaaaccgatgtgctgcaggtgcgcgagctgttgctgcaggcctatgccgagcacgaggcgattctcaaggcgccggcgacctcggtgtcgttcaaggacctgaccagcaatggcctgatcatcagcgtcagcggctatgtcggcagcccgcgctcggtgtccggcgcccgcagcgacctgctgttcaccatccttgggcgcctgcgcgaagtgggcatcgccctgtcgtcgccgcagaacctgatgttgatcagcgacagccaggacaaggcggctggcgagccaccggcccagcccagcgcatgaaccggcccctgcagggcgcactgccggcgagcgccctgttttttatcttgcggcgggaagcactgagctatcgtggctaaggccctggcaacttttttcaacgagcggcagctgtcatcgaggagcccgacgacagccctgtttcactcccggcaagacaaggaacaccatggacggaaaatccgacatcagcctcgaagacattgccctggagtcgaaacgacttcccgtactggcggtcaccatcgccttcctgatggtggtcgcggtgtcgattctcagcatctatggcatccaggtcatcaacagcaaggcccacgaactggcccaagcccggctgatctccggcaacctggccctgtccatcgcacaacaggcgaccgataccttcgacgaagccaacctgatcctcgaagagctgatcgagcgcctcgacgacctgtcgccccaggccctggaaaaaacccagaagctgctgaaaaagcgtgtgttcactaccgaacagttgcacggcctgttcttctatgaccgggaaggcaactgggtgctcacctcgttcgactacaagccgccaaaggcgaacaactcggaccgcgactacttcaagttccaccgcgagaatgcaaccctgtcccccagggtcggcgcggccctgcgcagcaagaccacaggcgactgggtgatcccgttctcgcgccgggtcaacgacgcccagggcaacttcaagggcgtggtgctggcgaccatcaagatggactacttcgacaccttcttcgatcgtttcaacatcgacgacaagggcgcgatctttctcgccctgccccagggcacgatcatcgccaggcggccgtacgacgaaaagctcatcggtgcgtccctggcccggggcgaaatcttctccgtgcatataccccgtgcccccgcggacacggtcatggtcaagtcgatcatcgacggcgtcgaccgcctgttcggctatcgggtgctgtacaagtacccgctggtggtggcggcggccaattcccaggagtccattctcagcagctggcgcgccgatacctacaagctgaccgcgatgatcgccgtggtgctactgatcaacctgctggtcggcatcctgttgttcaaacaggtgcgcaagggcctgcgggtggaaagccatttgaagaaagcccgctcggtgctggagaccctggtgttgcaggacggcctgacgggcctggccaaccgccagcacctggagcgcaacctggaactggagtggcggcgggcggcccggcaacgctcgtcgatcagcctgatcatgctcgatatcgaccacttcaagagcttcaacgaccgctatggccatgtggcgggcgaccattgcatctgcgccgtcagccgggccatcagccagtgcgtgcggcgcccctcggacctggcggtgcgctacggcggcgaagagttcgcggtgctgctgccggacaccgagcctggcggtgcctacgtgctggccgagagcatccgcctggcggtacaggaactggcgatcgagcatgtcgacaaccccggcggcgtcgtgaccatcagcctcggcgtctacagctgcgtgcccgccacgcccgagttcaagaccctcttgatgcaggccgactcggcgctgtacatggccaagcgcgcggggcgcaaccagaccgtgccgacctcctaggcgctggccgataccgccccgcgctcctccagcaagcgcacgaagtgggtcaggctgcgcgataccgtgccgcggcgccagatcagccaggtctgcaggaaacggaacggctgcgccagctgccagatgctcaccgtgccgcagcccggcatgctttccagcatgctgcgcggcatcagcgccaggccggcgccggcactgacgcaggccagcatgccgtggtaggactccagttcgtggatcttgcccggcaccgcgccatcctcgctgaaccagcgttcgaagtgatggcggtaggagcagttggcgcgaaaggcgtagatgctctcgccgttgacgtcgcgcccgcgggtgataggcgcatgccccagcggcgcgatgatgagcatttcctcgtcgaacaccggcacgccttccaggctcgggtgcagcaccgggccatcgacgaaagccgcggtcaggcgcccggacagcacgccatcgatcatggtcccggaggggccggtggacaggtccagctcgaccttggcgtgcttctggttataggccgccagcaaggccggaatccgcaccgccgccgtgctttccagggagccgagggagaacggcccctggggttcttcgccggcgaccgtcagccgcgcttcctgcaccaggtcgagaatccgccgggcgtagtcgagaaaactccagccggccggcgacaggcgcaggcggcttttctcgcggataaacagctcgacccccaaatcctgctccagctgcttgatccgcgtggtcaggttggagggcacccggtggatgagttgcgccgcggcgctgatgctgccctgctcggccaccgccttgaagatttccagctgcaccaggtccatctcattctccaaacgtgaaagatatgctctttattattcagttttcataagccctgtaccagcctaacctgcggccattccccagcccacaggacgctgccatgaccccggtttccagccagacccacgccctttcgatcaaccccgccaccagcgagcagatcgcccattaccgctatgaatccgccgaggcgctggacgccgccctcgcccgcgccgccggggccgccgcccagtggcgccgcaccggcctggaacagcgctcgacactgttgctggccctggccaaggccttgcgcgacaacggcgaaaccctggcccgcagcatcaccctggaaatgggcaagccaatcgcccaggcccgcggcgagatcgagaagtgcgcccagctctgcgagtggtacgccgccgaaggcccggcgatgctcgcccccgagccagccgcggtgccgaacggcaaggcgcgcatcgagtaccggccgctgggcccgatcctcgcggtgatgccgtggaacttcccgatctggcaggtgctgcgcggcgcggtgccggcgctgatcgccggcaatacctatgtgctcaagcatgcgccgaacgtcatgggcagcgcctacctgctgctggaagccttccagcgcgccggtttcccgcaaggcgtgttcgaggtgatcaacgtcaccgcggacggcgtctcccgggccatcgccgatccgcggatcgccgccgtgaccctgaccggcagcgtgcgcgccggcatggccatcggcgcccaggccggcgcggccctgaagaaatgcgtgctggaactcggcggttccgacccctttatcgtgctcaacgacgccgacctggacgccgccgtgcaggccgcggtcatcggccgctaccagaacaccgggcaagtctgcgccgccgccaagcgcctgatcgtcgagcaaggggtggtcgaggccttcaccgagaagttcgtcgccgccactcgccagctggtagttggcgatccgctggccgacgccacctacatcggccccatggcgcgcttcgacctgcgcgacgaactggacgcacaagtgcaggccaccttgagccaaggcgcgaccctgctgctgggcggcaccaaggccgagggcccgggcaacttctaccaacccacggtgttggctggcgtcaccgaccggatgacctcgttcaagcaggaactgttcggcccggtggcctcgatcatcagcgcccgggatgcgcgacacgccctggaactggccaacgacagcgaattcggcctggcctcgactatttacacccgggatgtcgccctggccgaacgcctgaccgccgaactggaaaccggcggcgtgttcatcaacggctattgcgccagcgatccgcgggtgaccttcggcggtgtgaagaaaagcggcttcggccgtgagctgtcgcacttcggcgtccgcgagttctgcaacgcacagacggtatggctggaccgcaactgatccccctcccccgaccctgcaagagcgagcgtgctcgcttctgcagaagggttatccggcgccgaggcccctggttcaaccgcctgtcgcgctgcgggccactgcgtttcaactttcagcgccgactgttctcccaatagatgtccggaccggtgaaacccggccgtgtcctcaccgacatcgacaggagacacaccgatgaaaacctatcccaaaccacccttcccgcctcaggcccagccagtccctggcagccagtggcaaatgcagccttacccggactgcggcgaacagagttatgtcggctcgggccggctggcgaacaaggtcgcgctgattaccggtgccgacagcggtatcggccgcgcggtggccatcgcctttgcccgcgagggcgcggatgtagccatcgcctacctggacgaacacgaggatgcccgcgagaccgcgcgctgggtcgagcaggccggccgccagtgcctgctgctgcccggcgacctggcgcagaagtcggtgtgcgacaacgtggtcgagcgcacggtggcgcaattcgggcgtatcgatgtgctggtgaataacgcggcctaccagatgacccacgacgaaatcgaagacatttccgacagcgaatggtgcaagaccttcgacatcaacatcaccgccatcttccgcatctgcaaggcggccctggcgcacatgggccaaggcagctcgatcatcaataccagctcgatcaactccgacatgcccaggcccaccctgctggcctacgccaccaccaagggcgcgatcgccaacttcagcgccggcctggcgcaactgctgggcaagcgtggcatccgggtcaacagcgtggcgccggggccgatctggaccccgctgatcgtctcgaccatgcccgaggaccacgtcagccacttcggcgaacagacacccctggggcgcccggggcaaccggtggaagtggcgccgatctatgtgctgctggcttcggatgaggccagctatctatcgggttgccgttatggggtaaccggcggcaagccgatcttgtaagccgcagcggcgctggcgcgcgcctcgggcaaccctcgaggcgcgccagcccgtatcgaggggccgggccccctcagtcataggcaatgatcgatattttcccgttgcgctcgatcaccgcgaacttgatctgttccaggctggtgaggccctggctggcgcgggccgcttcgagtatgtccgcctccaccagacgggcatggcgcatccgcccgcgcaggagccggccatgttcgacgatcacggtcggcccgccgtcgaccaggcgcgagaaaccgtcggagtgcagcttgagcagcgacaggccgacgtcgatgacgatcagcgtgacaatcaccagcagtgcattggtcagggaaaaatcctcgccgagcaaggcctgctgggtcgcctcgccgatcaccatcagcagcaccaggtcgaaggtggtcagctcggccagggaacgccgcccggcgatcttgaacagcaccagcagcaccagatagataaacgccgcgcgcaggaccgaatccatggcatcacctagggataaatgaactgggaaatggacagtggcgggtggtcggccaggcggatccggctgtcatagaaccccaccccggtactgagcagcgtcaggtacagacgggcctggccatcggcgtcggcgcgcagccacaggcggatgccagcgccggcggaactggccttgagcggctcgggttgcagcgcctgcacgctgaagccctgcaacagctcgccggcgatttccacctcgagcaattgccgggcgccgccgcgcaggtgcagggtcagcgaatccgtcgcgccgttgcgcagaaagcgctggtactccacgcgcaggctcccgtccgcgctgctgatgtcccgggtgctcagcgggcccctggaaaacagcccggccagggtcagcaggacgaccaccaccagggcataccaacccactcgctcgaaacgccagaccttgcgctgcagggccatgtcctcctggatcggctggctgcgcggcagcaggtcgtcttcggcggaatcgtccatggtcgcccctagccacgttcgcctttgagcgcggcctggtgaaagtgcggcagttgcagcaggccgtgcagcgacgccagttcctggaccttctcgcgggaaccgaaaaaccgttccttgcgggtgaacagggccatttgcccggcaatcgcgaaggcccaggcgaaacacaccgtgcccgccgggatgccgtcgacatcgtccggtcccagcagcccggtagtggccaccgccaccgtggccgggctgtcgcgcaaggcgcccagggccatttccccggcgacttcgcaactggtgaggttgaaggtctcgatggtctggcggctgacattcagcaggcgctgcttggcctcggacgaatacaccacgtagccgctttcgatcagctcgccgctgcccggcacctgggccagcaaggtcaccatggcgccagcggtgcaggactcggcggtggtcaaccgcaggtgctgctggcgcaggtactcgacaatctgttccacgccgctcatatcgatgggtccctgtggggttgttctgggttgaccgctggcgttcgcccacgttctatcgaggtgcgcggtcaatgaaaaggagctgcccgcggcacgcggcagccctgacagaaacaagcccgccacaccggcgggcttgtttgcgggacgcgtcagcgtcggtcatcggagagtggcgtcggctcgtctggggccggcaggtcggggtccatcggccgctccatatcgtcgtcctgaggcttgttgcgttcggcatcgccgttgacgttggggtcggttaccgggtcgttccgacgggccggttgcagagggtcgggttcgggagtgcggggctcgctgggatcatgcatcgactggttcatggtgcacctcacggcaggcccggggaatccgggccttatcgggttaggcactgggccgggccacggggtgcgaggcaatggatgagtggtcggccaggctgtctggccctggtcaccgattgaaaaacatgatttttcgctgcacggaaccgcgggcgatccaacggtttttccgctgattatttttgcagtcccgcctccagcggccgggtcgaactcttaacgatgcatgaccagcacatggccgcacacccgattgcacagaataaggagaatgtcatgaacagcacccaccagcgtttccagatccgtgcctgccacaagctcgccctggagcagaaccagcgactgttcaaccaggcccgggccctgaatgcccaggcttatgaactgctggagaatgggcgcctggatatcgacacgttcgagcagtaccgccgcctgcgcaacaaggccgaagccaagcagcgcgaagcgatcgaacacctgcgcctggtgaaccaggagttcgccgaactggaaacccggcccaaatccacgcccgacagcgacccggccatcctgcagcacaccgggcgctgagccgttgccgcgttgacagccgccggttcgggcgccgcgcgcctccgcccgtcgctccccatgggtcacgaagaaaccttcgtcgctgcccgggctcaatcgtagagcctgggcacacgatgtgccccacaccgggaggccgtccgatgaccgagcacatcgtgcattttcactgccagatcgaccagggcaccaccgaacgctttcgcgacagttgcctggaagccatcgagcaaggcgccacctcgctgctgctgaatctttccaccaccggcggcagcaccaacttcggtttcaccctctacacctttctcaaatccctgccggtgccgctgtgcgcgatcaacgcgggcaacatcgagtcgatgggcatcatcatgtttctcgccgccaaccgacgcatcaccacgccgcattcgcgctttctgatccacccgatgaactggtacttcagccagagttcggtggatcaccagcgcctgcgcgaatacctctccagcctggacaacgaccttgcgcgctacgtgaaaatctacgagctggaaaccgccgacgcggcgacccagctggacatcttcaaatgcctgtcggccgaggaaaaggtcatcgccgcccatgagtcgctggcctatggcatcgcccacgaggtgcgccaggtagtcttcgccgacgacgtcaagcactggaaagtctcgggcggctgacctgttgccccgggcgccaaggccaccccgtcgtggcgcgagccacggcctcaagcggttttttcgttgtcctgttccggggtttggttgccaggttccgtggcgcccggttcgggctcggggcgattggccgggcccttggcgggctttttctcatccgcggccgcggcccgcccggggtagccaggcaacccgtgggcgtcctgcggttccagcggttcgggggcgcgcgtgcgatcgttctgcggatcgttgcgcggatcaacgggctggcgagtcataagcacctctgtatcggtccgggcggcattgcctgttcttgttcgatgccgaaccgcgccccgggtgcgaagcactggacgaatggccatggcgcctgccgtacggctgcgcggtggaacgtccgggcctgacgggcgtcttcagcttgagggcccgccgcttcgagctggcgagcgctcctgccttgtacgtccgcgctcatgaggatctgtccatgcctgtcgcccccagcccgctcatgatcgccgccgcgctggccgggcccgccaacgctcaaggcagcctcgctgcgcgcgacccgaggccggcatgaccttcattgcctgggtcgcggtcctgggcgcggtgctgctgatcctcgcgctgacctcctcctacctgcgctggatgcccgtgaccacctcggtggtctgcctggcgctggggatcgccatcggccccgccggcctgggcctgctgcaactggacatccaccaggcttcgggctggatggaacacctgaccgaagtggcggtgctgttctcgctgttcgtcagcggcctcaagctcaggttgccgctcaacagccgcagctggcgcatcgccttcggcctggccgggccggtgatgctgctgtcgatcgctggggtcggcctgctgctgcactacggtttgcacatgccctgggggccgtcgctgctgatcggcgcgatcctcgccccgaccgacccggtactggcgaccctggtccaggtcagcgacgcccaggactacgaccgggtgcgcttcggcctgtccggcgaggccgggctgaacgacggcgtggcgtttccgttcgtgatcctcggcctgctgctgacccgccagggcgacgaccccggcgcctggctcggcgattgggtggtgttcagcctgctctgggcagtgcccgcagggctgctcagcggctactggatgggccgcggcctcggccacctgaccctgcacctgcggatcaagtacgccgacagcacggtctcgccgaacgactacctgaccttcgccctgatcgccctggcctacgtggtggcggaactgatccacggctacggttttctcgcggtgttcgccgccgccctggggttgcgccaggccgaggtgcattccagcgaccatgcccgggcgccggccgaacacctggtgcaaccggtggtcggccaccagcatgtcgatccggcgcaggcggtgcatggcgacgtcgaggccctgggcgaaagccaggtcgcggcgggcatcatgctcggcgacatgctggccttcggcggcctggtggagcgggccatggaagtgttcctggtgaccttgctcggcgtggtgctggtcgcccattgggagtggcatgcgctgaccgtcggcgccctgctgttcctgctgatccgcccgctcagcgtcttgctgatcccctggggccgcctgctcgatggccgtcagcgcctgctgctcggctggttcggcatccgcggcatcggtagcctctattacctgttctatgccctcaaccacgacctcgacccggcgctggccgacgccagcgccaacctcaccctgtcggtggtggccttgagcatcctggttcacggcctgagcacccaaccgatgctcgcccgctatgagagcaacaagaaacgccggcgccatcccgaccgaccaccgggataagccagcagaatgcagggcgccaagggcctgcgccatgccgcctgacccctttcctcaccctggcgagctcttttgctcgcgggcccggccttggcgccgggcttttttatgcctgtgccttttgtcttcgggctcaaccgcgccgcttgcgcgtgcccagggcaatccaggcgggcgcgtggtcgctggcgtggggctcgttgcgcacccaggcatcgaccccggcgttctccaggtaaggagccagggcccggttgagcagcaggtggtcgatgcgcaggccggagtttcttggccagtgctggcgaaagtaatcccagaaggtgtagacccgctgatccgggtacagctcgcgcaaggcgtcggtccagccctgtgccagcagccgctggtagcactcgcggctttgcggttgcagcagcgcgtccttgagccaggagcgcgggttgtagatatcgaaatccgtcggcaccacattgtagtcccccgccagcagcaccgggtgcgcgctgtcctgcagggtcgcggcatgcgcgatcaggcgctcgaaccaggccagcttgtagtcgaatttcggccccggttgcgggttgccgttgggcaggtacaggcaccccaccaggacgccgtggaccgccgcctccaggtagcggctttgcccgtcgtcctcgatgcccggcagcgcgcgacggatttccaggggctggctgtcgcgggcgaggatcgccacaccgttccaggacgcctggccgtggttcaggctgccataccccgcggcctccagggccgccttgggaaactcccggtcgagcgccttgagctcctgcaggcagacgatgtcggggcgctcgcgttccagccaggccagcaggttcggcaggcgcgcacggatgccattgaggttgaaggtggcgattttcagcgcgttcatcggcagtgccccctggtcgtatcgacgtatccgcggcgcccggcgagctcaatcggcggtcagcggcacgtcctgaggctggacggcgtttgtctcaccgcctgcgccagcgcctcgatcaattgcagttgggtgtaaggcttgggcacccgcggcaaggccgcggccagcccctccaggcgctgggcataaccactggcgagaatgatcggcaggtccgggcgcagctcgcgcacggcgctcgccagttgcccgccgtccatcaccggcatcgccaggtcggtgatcatcaggtcgatcgccgggtattcggcgaaccgttgcagcgcctgggccccggacatcgcgcagagcacctggtgcccgaggtcttcgagcagcagcgtggtgctggtcagcaccaggctgtcgtcgtcgaccaccagcacgcacagaggctgctgctgcgagtccggagccgacaaacgagccgggacgacgggggtcgcctggctcgccaggggcaaccacaactcggcggtggtgccctgccccttgaggctcttgaggatcagccggccccccagttgctcggccaggccatgcaccatcgacaagccaaggccggtgcccttgcccacgcccttggtggtgaaaaacggatcggccgccagggccagggtctgctcgtccatgccttcgccgctgtcgatcacgcacaggcgcacataacgctcatggggcaggttgacgccggcggcctggccgctgtcgcacagatcggccttgaacaccagggtgccgccgcccggcatcgcatcgcgggcattggttgccaggttgagcactgccaactccagctggttgacgtcggcgagcactgtcggcagggattcgggcagctcggtgaaaatgctcacctggggccccaacgagctgccgagcaagccactgaggttggtcatcagctgcgtcagggccacgggctcggtcttgagttcctggcgccgggcaaaggccagcatgcgctgggtcagcgacaccccacgctcggcgccgaccaccgcgttgtccagcaggcgcgagagtttcgggtcgtcgccgatgcgtttgcgcgccagctccaggttgcccaggatcaccgtcagcaggttgttgaagtcatgggcgatgccgccgctgagctgaccgatggcttgcagtttctgcgcctggaacagcgcctcgcgggcactttccagggccttctgcgcctcgaccgtctcgctgatatcacgggtgaccttggcgaaccccaacagctcaccggcatcgccgcggatcggatcgatgatcacatgggcgaggaactgcgtgccgtccttgcgtacccgccagccctgcttctcgaaacggccttcgcgggtggcgatttccagggcccgccggggcacgccgtcgaggcgatcctgctcggtgtagaagcgcgagaaatgctcgccgatgatttcctgcggcaggtagcccttgatccgctgcgcgccgaggttccagctgctgacccggccgtcggggtcgagcatatagatggcgtagtcggtgacgctctgcaccagcaggcgaaactgctgctcgctctgcctgagggtttcttcggcgatcttgcgctcggtcaggtcgcgggtgatcttggcgaaacccagcagctgcccgctggaatcgcggatcgggtcgatcaccacatggcaccagaagcgcgtaccgtccttgcgcacccgccagccctcgccctcgaaacgcccctcggtgagcgcggtattcaacgcgcgttccggcaacccggcctggcggtcttcgggggtgtagaaacaggaaaagtgcgcgccgaggatttccgcttcctggtaacccttgaaccgcctggcgccggcattccagctggtgacgatgccctggggatcgatcatgtagatcgcgtagtcgaccaccgcttcgaccagcaagcgaaaacggtcctcgtccagaactctgcgcggctgatcagccatatcggtctccgccaggctatttttatgcattcttgcgcatgggccagtagggtcggttgtctggccatcggcacgcggtcaacgcacgtgcggccagccagccggcaaatgccgcgcgtcgttcagttagaccgataggccctccggtcctccaattgaaaatacaacttgatcccgcaggccctataaaccgacttaatgttggacaactgcccgcggccaatcgatcccccgccactcgtcgtcccgcaagaaactttttcaaactttcgtttgcagttttgtttcccaatcttgcgaggtgtcaaatcgctcactatcgaggattgaaaaaaatggctaccagcggaaagaacccactcatgggcaacaaggacactcaaaaaccctcaccggccggcaagaaatccggcggccagggttcggggggcaacatccctgccgatcggcaaaaagcccctgacgcaggcaagaaaggtggcacccaaggctccggcggcggtacccgcaaagcctgatccacaacgccggagtgtcgtccctgacgcactccggctttttttgcccgacagcccatgccagcggcctgcccgcgccggttatcgtcgagcgcgactggctatgcttgcaccacggcgaaaccacgttagccagccctcgatgaaaagcgcgcatgaaaataggcctgatctccgacacccatggtttgcttcgccccggcgcgctggcggcgctgcaggggtgcgcgcacatcctgcatgccggcgatatcggcgacccgcagatgctcgccaccctcggacatctggcgccggtgaccgcggtattcggcaatgtcgatcagccccatgactgggcccgggcattgccccatcacgtcaccgtgcggctcgatggcgtcgacctgctgctctgccatgtcctggccgaggtgccgaagcctctgccgccgggcgtgcgggtggtggtcagcggccactcccaccggccgctgcagttctggcaggacgatgtgctctacatcaacccgggcagcgccggaccgcgacgcttcaagctgccggtcagcctgggctgcctgaccatcgaggccggccaggtcgaaggccggttgatcgaactggcggtctagcggtctagcggtctggctgtctagcggcttggcccgggcccgggcatgaccggctatcggagcgcgcccatcggtcgcgctttgcagggtccacacttaatccagcgattggcggcgttcatgacgaaagccgtgcgaagccacttggccgggccgcgttgcgccctcgagcagaagattccgtacccggccccgcgcccccgagaaggtggcgcgcaaggatggccgagggcgcgcaatgcgcaggagaaaagcgatgaccttttatgtcgtggcccgcctcgaccagttgcccgaagaccgcggcacccgggtccaggtcggcgccgaagccgtgctgctggttcgtaccggcgatcaggtccgggcctaccaggccgattgcccccacgccggggcgccgctggaacagggcgcggtgtatcaggggcgactgatctgcccctggcacaagggcgcctttgcctgcgacagcgggctggtctgcgagccgcctccgctggcgagcctcaagcgctacaaagtcgacatccgccatgacaaccgggtctgggtcgccgaccagcccatggccgaacccgccccgccacggctggccgactcgcgccggctgctggtgatcggcgccggcgctgccggggccgccgcggtagcgaccctgcgggccaagggttacacccggaacctgacctggatcgacaagcaagcgcggcccgcctatgaccgcaccgccttgagcaaatacgtgctggccggcgagatgtcgccggatgaagtcccggcgctgctcgagccggagttctatcgcaagggcgatctacaggtgctacaggccgaggtcctgcgcctggacccaaggcggcgacagatcctgttggccgacggccagcgcctggactacgacgccgcgctcctggccaccggcgccgagccgcgcctgccggccatcgaaggcgccgacctgccaggggtgttcatgctgcgctcgcgggaggatgccgcgcgcctgctggaacaggcccgccccggtaaacgcgtggcaatcgtcggtgacagttttatcggcctcgaagccgcctcggccctgcgcaaacgcgggctgatggtgcacctgatcggtcgccacccggtaccgctgcaacgccagttgggcgaacgcatcggtagcgccatacgggccctgcatgaacagcacggggtgatctaccacgccggttgcgaagcccgggccctggtcggcgagggccaggtgcaacaggtggtcctcgacaacgaccagcgcatcgccgtcgacctggtgctgttcggcatcggcgtcagccctgccacggccttcgtcgaaggcctcgagcgggccgaggacggttcgctcaaggccgatgccggcctggccgtggccgatggcctgtgggcggccggcgacctcgtgagtttcccctgcgacggccgctcgcagcgcatcgaacactggcgcgtggcccagcagcaaggccggctcgccgcctgcaacatgcttggcgagcagctgagtttcagcgtggtgcccttcttctggacctatttctacgaccagaccttcgaggtgctcggccatgcccgccggtggaaccagatcgtcttcgagggcgagccggagcagtaccgctttatcgccctgctgtgtttcaacgaacaggtggagtcgatagtcgcctgcgagtacccgcgggccatggccctgttgtcgcagcgcatgcaacagccgctgtcgcgcagcgaggccctggagctgatccatggcacgccggaatgaagtggctggcgacaaccgctcggcagccccacggaaccccgggcaagggccgattttccaaattcaggcagggtttgactgtctcgaccgcccgctacagcgcaggtcgccgaggcccccagagccaggaagagggatcgccatgaatagccgtacgctgacttgtcttgccgtggttgccctgtgcagcggcggcgccttcgcccagagctgcgacgtggtcacccgctcgcaaagcgccgatgtcgccaatgtcgacacccacacctgttacctcttcgaaggcatgccggccgaagccatcggctggtcgtgcagcaatgagagcacgggcaccctggcccaggagaaacaaaaggtcgccaactgcgacgagtcctacctcgccgtgtgccgggcgcgcctgacccaggaagcgctggccaacccgcgggcgaccgccaaggacccacagggttcatccctgaacatccccgacaaggcccaggtggtgaccttttattaccaggcggaacacctccagcaggccaggaccgactgtgaaatggccggcggcaaatggcagtggaaatgaccctggccggccataggcaggattcagacgaggacgatgcatccatgagcaggacagaacgaatcaaccgggagctggcgcacaacgcccgactgtttgccgaagccgaccgcctggatgtccaggcctatgagctgcttaacaccgaccatgtcgacgacgaccgcctggccctgttcagccaagccaagcagttggcgaacgaaaaatacctggaagcgcgcaacgactggctgcgcatcaagcagttgatggacggcaccgactgaagccccccgcgccggcgggaagatccgggatgctgggtttgcaaccgagcgcagcctcgcaggctcggcagcggctacaggaaccacgttgcctgtgtagccgctgccgcaggctgcgcacgaccgcgcagcgggcgctggaccggacaccgcgtttttccaggcagaccacagactcaggctttgcggcaactgcgttgccgtacgcagcctcgcggactcggcagcggctacatcgccccctgtcgtcaggtcgctagcgggcgtttgcgcagttgttccagcagagcctggagtggatgctgcaggccctgcccctcctggcgcttgacctggctgcggcaggaataaccgtcggccagcagtcggccgccctggccgtgacgcgccaccagcggctgccaggactgttggtagatcacctgcgaagtggccaggttgcggctctcgtggccgtaggtgccggacatgccgcagcaaccgctggccagcacttgcaacttcaaccccatgcgcgcgaacacctgttgccacaggccgatgctgcccggctcgttggtcttctcggtgcagtgcgcgaggaactgatagggctcggcctcggcggtcgggttcgcttcggccgacgcctcactaggtactgcaggcagcacccgggccagccattcctgcggcaacagcacttcgggcgcctgagccgcacccagggtcttgcggtattcctggcggtagaccagggtcatcgccggatcgagcccgaccaggggcacgccgctggcttgcagcttcagcagcgactgcgcgttgcagcgcgcggcccgggcaaaggcgccgaggaagccctggacctgcaagggcttgccgttaggcgcgaacggcgcgaggtagatctggaaacccaggcgttcgatcagctccagccattcggccgccagcggcgtctcgaagaaccgggtaaaggcgtcctgcaccaggatcacgctacgttcgcgctgttcggcagacagcgccgccagttgcgcggcgttggccatgcgcacgttgcgccggcggcacaccgcctggaaatccagggtgctgagcaacgggctgtcgaccatccccgccaggtgttggagcgcccggctcaccggcgccgcgccgatcagcgcgttgtacagccgcggcaggcgcgccagatagggaacgctgaactccagggagccgatcaggtaatccttcagcgggcgcaggtaacggccgtggtacagctcgaggaagcgcgagcggaactccggcacattgaccttgaccgggcactgccccgcgcaggacttgcacgccaggcagccggccatggcgtcgtacacctcatgggagaagtcctcgcgcccggccagccgcgccgcgctgttgtagacgcgccgggccaggttggaaagccgcgcgccaccgccgttcagcacgtccaccccctgctcgccctgcaggcgcagccactcgcggatcagcgaggcgcggcccttgggcgaatgaatgcggttgcgggtggccttccacgacgggcacatggcgtcgtccgggtcgaagttgtagcaggcgccgttgccgttgcaatgcagggcgctgtcatagctctgccagacgcgctcgtcgatggtgcggtcgagctcgccgcgcagcaccacttcgtcgacccgggtcaggcgcgcctctggcaccgaggccggggtggcgatcttgccggggttgagctggttgaacgggtcgaacgcggccttcagggcctgcagcgacggggagagctcgccgaaatagtccggcacgtactgcgagcgcaggcccttgccgtgctcgccccacaacaggccgccgtgcttgtgggtcagcgccgccaccgcatcggagatcggccggatcaaggccgcctgcttggggtccttcatgtcgaggatcggccgcacgtgcaatacgccggcgtcgacatggccgaacatgccgtattgcaggccgtagccatcgagcagcgcacggaattcgaggatgtagtcggccaggttctccggcggcactgcggtgtcttcgacaaagggctgcggccgcgcctcgccctggacgttgcccagcaggcccaccgcgcgcttgcgcatggcgtacacctggttcaccgcctgggcgccgatggccagggtatggcccaggcgcagcaccgagttgtcctgctgcaggtggcggacaaaggcgtcgacccgctgctccagttcctcctggtcgtcaccgctgaactcgatcaggttgatgcccagggtcggggtgtcggcctgctcagggaaataccgcgccacgccgtgccagacgatgtcctgcatggccagcatcagcaccttggaatccaccgtctcgatcgacagcggtttgagcgccatcagcgccttggcatcgcgcagcgcatccatgaagccggcgtaacgcacgttgaccaggatcgagtgccggggaatcggcagcacattcagccgcgcctcgacgataaagcccagggaaccctcggagccgcagagcacgctgttgaggttgaaacgctccggactctcgcgcaggtgcgccaggtcataaccggtcaggcagcgattgagcttgggaaagatcgcctcgatcagctcggcctggtggtcggcgatgtcctgggcgcagcggtagacctcgccgatccgcccgggctgcgcggcctcctcggtcaattggcggttgtcgatcggcgcgctgtccaggcggctgccgcccagcagcacggtgctcaacgccagtacgtgatcgcgggtcttgccgtaggtgcaactgccctggccgctggcgtcggtgttgatcatgccgccgacggtggcgcggttggaggtcgacagctccggggcgaagaacaggccatgaggcttgagggcggcgttgagctggtccttgaccaccccgctctgcacccgcacccagcgctcctcgacgttgatctcgaggatccggttcaggtgccgcgacaggtcgaccacgatgccgtcggtcagcgactggccgttggtgccggtgccgccgccacgaggagtgagcaccaccgcgcgatgttccgggctcgccgccagccgggccagccgctcgacgtccgcgacatcccgggggaagaccgcggcctgcggcagccgctggtagatcgagttgtcggtggccagcaccgtgcgcaggcccaggtcacgggcgatctcgccgcgaaaaccgtccgcggccagggcgtcgaggaagctttggtagtgggccaacgggtcgcgttcgggggcaagcagagcaatcatcaaaaaggcttccaggcagagaaaaggcgcagcggtgcatgcaaaacacgtatgcttgcacgcagcccgaggggcggcggccagccgaaaaagcctattttcctagagccttgcaccttgggcaaatgtatttcatgtgcttttttcatgagttttatgaatgaacccgagacgactcactccgtcgatgtcggtgctggtggccttcgaggctgcggcgcggcatggcagcttcaccaaggccgccgaagaactggcgctgacccagagcgccgtcagccgccaggtccaggccctggagtcgctactggaagtgccgctgttcaaccgtgacggccggcatatcgagctgaccgccgccggcgccctgtatcaccacgaactggcggcggccctggcgcgaatccgcaacgccaccttgcagaccatcgcccacaaggctggcggcggcccgctgcacctggcggtactgccgaccttcggctcgaaatggctgctgccgcgcatgcatgacttttacgccagccacccgggcaccctggtgcatatccattcgcggatcgtcaccagcgacctgtcgaaggacaccgccgacatgcacgccatcatctgcgccggcaccggccactggcccggctacgaggcccatcggctgctctcggaaaagctcacggtggtggccagccccaaggccctgcccgagcacggctcgatgtccgtcggcgacgtggcgcaacagttgctgctgaacgtggtatcgcgtcccgacgcctggcccgagtggttcgagcagaacggcctgcacccgcgggcgatgcgcatgggcccggggttcgagttgaccgcgcacctgatccaggcggtggtcgccggcatcggcatcggcctggtgccgcgcatcctggtacaggacgagatccacagcggcgaactggtggcgctgttcgagccggtggacagcggtcgcggctattacctggcctacccgagccgctatcaacacctgccatcgttgcaagcgttcagccgctggttgctgtcgatcccctttcccgacagctgactcagtcgtattccgcttcctcatgctcgcccagcaaccgccgctggcgcgccgaggccgccgccagcacctcggggttgaaacgccagtgcaggtacggcgaaaacttctgcgccaccatgcgccggccatagtgcacctgcagcagatagcggatgcgttcggcgctgctgttctcgctgccggcatgccacagctcgctgcgaaacatcagcccgtcgccggcctggcacagcacggcctgggcagtttggccatgccaatgttcctcgccggcccgtggcggccgcccggcgcgatggctgcccggcaccacgcgggtcgggcacaggtcctggtcgatatcgtcgaggtacaggtggcaggtgcagatctgcatcggcagctcgaaggccggatcgctgagcaggctgcggggcagctgcatcgccaggtaatccaggtgcaggcccatcccctggaaacctggatggcagcgccaggcggtctggccgatgacatggcaatcgtcacccagcgccgcttcggccagctcgatcacccccggcaggtcgagaaacggtagccacagcgggtcgcggttgaacacgcatttgtagtgttcgagcaagccgctgtagtcccaatgctggggcttgaggccgtcgatggcatggcgcagcaagttgatccggtcagcgtcgagtaccccgggcaacagcacgaagccttcgcggtgcaaggcccgcaggcgttcggcggtcagtgctggcatgcaggccatgatggctagtcgatggggccgatattgatcagccggtcgctacccagccccggcaccctggccagcaccccgaccggcgtggcggcggaaaactcaatgacataacccatgccactgccgtcctcttccatggccaccacccagcgcgccacttcatcggggttcaggctcagcgcccgcgccacccggcgctgacggcgttcctcgagcgtttcgtccagggagtcgtcgttcatctggctcaacctccggcggatagcagcccctccgggcctggcgcggcccttacaacagctgtgaaaaacattgtgggcaaaagttgaatcccgctccgtgcgccgtgacgaacggcagtttttagcgccagaaacggatcgccggttttatcgccggcccacaagcgagttttctttcgagcgtttcagaaagggcctaaagcgccgcgccaggatggccccctagcatgcgtgacttatccagaagccggggccgctcatgcatttactgatttgcgcttactgacatgcgcttgttgaaagcctccgaccggcaggcatggaacgcgcacgatccgtatttcgccgaaacccaggtgcgcatggcgctgcaacgcaaccggtcaagccttgaagggctggacgagctgttgcgcgagcactacagcatcaacagcgatcgggagattctggccgccgtcagaaacggcgactgggtgctggtcaccgacagccccagcgcaggaatcggcaaccagctctgccccgcgcccgaaccgcagccggcctaccttcggcaagacccgtggcccgatcccgttcctcgcaccgacctggtcttcgccaagtccatcagcagcgtcccctggggcaccacccaggcaggcagcgccagcgagcccgcggacaatttcggcaagaccatgctcatggcgtcttcggcgaccgaggtcgggctcggcagggtcgccggcgaacggctcctcaggagcttcgcctggtcagtgcagatggccggcaccgcggccaggaccctcggcggcccggcgggacaggtgttgctcctggccatgaccccgacccggctcgtcgacgacgccttctacagcgaagaacaactgcgcgagctgcgcgccgccaccacccgggtgcgcttccagttccgccgcgaccgccagggtgtgctgcacatccatggcatccacaccagcgcccagtcgggccaggacagcgtcccggtgatcaaggcccactggaacgccgacaaaaacgccatgcaggcccacctcggcacgctcaccatcacctggacaccgcacaacggcccggtggtcaccgccccgaccccctacccgggggtgaccgacgaactggccaacctcatggtccaccccatcgccgaaggcggcgacagccaactccagggcgcgcccatcgacgagctcaaggtcgaagactgcatcatcaccttcccgatcggcagcggaatccgctcgctgtacctggtcttcgccaagcccatggtcaacccactggaagtcggcccggcgaatgatctttccagtagaagcgccaaggatgggttggatattgatcacataccgtcgcagaaggcgttggaagcttttttgaaagcaaacgatccacatatacaaggtgaagatattcaagacaatttacgcaaagccccgagcatcgcgatcccgcgaaaagttcaccaaaaatacagtgcgacgtatggcggtagaaacaccaaggcccggcaggtcgaggatgcctctgacctgcgtgcagccgtagatactaatctcgacgctatgaaaccttatctgctggacgaaggctttaccgaagaacagatcgaaacggcacgcacccacctgcataatctccaccaagaacagggttggtactgatatgaacgcagcaacaattgatgacttggttaaaagtctcggccgtacctatcccgaaatgattgcctccggaatgtatcttccaggtggaccgcctaaaggtattttcgaggacagtgagaccttggcaatgtcacctgagcctggaatcgaattaggtttttgggctaagagtcagcgctttgaaatgctgttcatcagcttactggaaagcttccaagggaagtccctctacaagggaagcctaccctaccaacttaaaagtcaaatgaatcaggggtggataaggtctcgctttggagagccactggagtcaaaagcacctttcaaaatgcccatacggggcatgacgggagggtgggacatttatcgctttccgagcattcccaaaggaacacaggtggtttttaaatacagcgccagaatggaagttgaaacgatagtgttcgaactgaacgagagatcacccgcttaaatgatcgatgacttgattaaaagccttggctgcacctatccggagctgattgcctccggaatgtaccttcccggcggcccgcccaaaggtattttcgaggacagcgacactttatctatgtcgcctgaaccgggtattgagctgggattctgggccagcaatcagcggtttgaagatctgttcattactttcctggaaacctttcccggaaggcccacctacaaaggagggcttccctatcagctcaaaaccaagatgaaccagagctgggttagatcgcaatacggtgagcccctggaatcaaaaggtccttacaaaatccctgtgcgtgggctggtaggcgggtgggaaacctatcgttttccaggcatgtccaaaaacatcaatgtgttgttcaagtacaccgttgagatggaagtggaagggatagtgttcaggctgaacgaaaaatcccacccttagttttacggggcacagctggcacgaatatgaacgccgcaatgatcgatgacctgattaaaaatatggggaggacctattccgagttgatcgcatctggaatgtatctccctggcgggccacctaaaggtatgttcgagggcgatgagacctcgttcatgtcacctgcagccggaatagatttgggcttttcaggcactcagctctttgactctctcgctatctacttgcataagacctccgacgacgactcagtttacgagaatggattgccgtaccagcttcaacgtcgaatgaaccaagcttgggtaaggtcccattacggagagcctttggagtcaaaagcacctttcaaaatgccggtacttggaatgactggtggctgggatacttatcaccttcccggcacggcaaaaaacattacagccgtattccagtacaacactgaaatgaacgtggaagggatcgccttcagactaaaccaggaaccccttctctgacctcgattcaatccccccgaatatagtgctccaactgccgaatcagccccgcctgttcgacaatcgcttccttcaccagatcgccgatcgacagcagcccgatcagttgctcgccttccagcaccggcaagtggcgcaggtggctgtcggtcatcacggccatgcagcgttcgatgctgtgctggctgtcggcggtgaccacgggggcgctcatgatggcgcggaccggggtgcctaccgatgagcggccttgcagcactaccttgcgtgcatagtcgcgttcgctgatgacgccgaccacctgcccggcctccatcaccggcagtgcgccgacgtttttctgcgccatcatctgcagtgcttcgagcaccatctggtccgggccgatgctgtgcacctgacggtgttccacggccttcaacttcagcaactgagcagcggttttcatgggcgtctccgataccttgagcaacagggggtccggccccgcgccacaaggcgcgcaggcatggatctggatcgagtaaggcgcgcgcggcttagcgcacgccgatttccaccacgtcgccacgcagccgcgccggccaggtgcgcaggcgttgctccgggtattccaggcaggtgccgtcagccaggcggaagtgctgcttgtacaggggcgaggcgatcaccagctcatccttgatgcagcccaccaggccgcggccgatcacattgacgccggactgcgggtcgtggttgtcgatggcgtagagggtctgctgcgcggcatccggcaggtagatcagcgccacctgggcgccgtcgtgccagaccaccacgccgctgtggctaaccaggtcctggcgactgcacaccgcctgccactgcacgccgggctgctcggcgaattcactttcgataggttgcgggcttggcgacaggctcatcagagcacctcctcggtgacagggatcaggttgagttcggcggccatgatcggccggcgctggccgcgttcctcgacaaaatgaatgtccgggtcggggcgctggtcgttgacgaaggtgcggaagcgcttgagtttttccgggtccttgagggcgttggcccattcgcattcgtagcggtccaccaccagttgcatctgcgcttccagctcggcgcccaggcccagactgtcgtcgatcaccaccgccttgaggtaatccaggccgccctccaggctttcgcgccacaccgaggtgcgttgcaggcggtcggcggtgcggatgtagaacatcaggaagcggtcgatgtagcggatcagcgtcgggtcgtcgaggtcggtggcgaacagctcggcgtggcgcgggcgcatgccgccgttgccgcagacgtacaggttccagcccttctcggtggcgatcacgccgacatccttgctctgcgcctcggcgcattcgcgggtgcagccggacaccgcgaacttcagtttgtgcggcgagcgcaggcccttgtagcggtcctcgatctccagggccatgcgcacgctgtcctgcacgccgtagcggcaccaggtactgcccacgcaggacttcacggtgcgggtcgacttgccgtaggcatgcccggtttcgaaaccggccgcgatcagttcggcccagatatccggcaactggtgcaactgggcgccgaacaggtcgatgcgctggccgccggtgatcttggtgtagagctcgtatttcttcgccacctggccgatcacgatcagcttgtcggcggtgatttcgccaccggcgatgcgcggcaccaccgagtaggtgccgttcttctgcatgttggccatgaaggtgtcgttggtgtcctgcaacggcaccagggagcggtccatgatcggctggttccagcacgaggcgaggatcgagccgattgccggcttgcagatatcgcaaccgacgtggccacggccatgcttggcgagcatttcgtcgaaactgaggatgccctcgacccgcaccagcgcgtacagctcctggcgggtgtaggcgaaatgttcgcacaggctcttgtcgacgctgacgccacgggtgatcagctcgtgctcgaacacctgcttgagcaggccggcgcaaccgccgcaaccggtgcaggccttggtccgggccttgagttggccgagctcggaacagccgccgtcgatggccgagcagatcgcgcccttggtcacgttgtggcaggaacagaccgtggccgactcgggcaaggcgcccgggccgagggtcggcgcgccggcgctggacggcaggatcaggccggccggctcggcgggcaaggcgatgccgttctgcatgtattgcagcaaggtgtcgtagtagctgttgtcgcccaccagcaccgcgccgagcacctgcttgccgctggcatccaccaccaggcgccggtagctggccgtggcctcgtcgatgaactggtaactgcgcgcgcccggggtcaggccctgggcgtcgccgatggagccgacatccacccccagcagcttgagcttggtcgacatgtccgcgcccatgaagggttcgcccggctcaccgcacagctgcgcggcgacgctgcgggccatctggtaacccggggccaccaggccgaagaggctgccgttccagctggcgcactcgccgatcgcgtagatgtgcgggtcgccactcaggcactggttgtccaccaccacgccgccgcgcgggccgatctccaggacgcaatcgcgggccagggcatcctgggcgcgaatgcccgcggagaacacaatcaggtcggtttcgaggaagtcgtcgccggcgaagttcatccggtagcggtactgctcgccagcgctgatcgactgggtgcccttgcccaggtgcacgccgacgcccagggcttcgatccgcgccttcaacgcacgaccgccctgctcgtccagctgcaccggcatcagccgtggcgcgaactccaccacatgggcttccaggcccaggctcttcaaggcgttggccgcctccaggccgagcagcccgccgcccaccaccacgccgcgccgggcattggcggccgcggcgcggatggcgtcgaggtcttgcagggtgcgatagaccaggcgcgaatcgccctcggcgccctcgatcggcggcacgaagggataggagccggtggccagcaccagcttgtcgtagtgcaccgggccggcggcggtgatgacctggcggtgctcgcggtcgatgcgcagcaccgccacccccaggtgcagggtcaggcccggggcctggtacagcccggcatcgcccaaggccagggattcggcgtcgcgaccgctgaaatactcggacaggtgcacccggtcgtaggcgcgcatcggctcttcgctgaagacgtgcaggcggtactgctcgagggcgccacgcgccaccagctgttcgacgcaatgatgtccgaccatgccgttgccgatcacgatcagggttttgtgtgtgttcaaaggggcaacaatggcattcataaatagcacccgacccaagccaatcacggtttttttaaagcaaaaaaaagcgcctgaaaccttacggttccaggcgcctttgcctgttatttgcggtgtgcgatcgggctgctgtgcctgactcaccgagtgcccatggccggttggccgatcgatccgcgttgaccgagtgggcggcccgcccgcgacatgcgcggtggggcgttagcggctgtcttgcagcctttgtgccaggcggcgccgcacgccttgaaaggccgtgctggcgggcttgcgcggtcattccgtatggctcgcggatacacgacccagggccatgaatcgccttagcctggtgcaccgcgccttataaaagtgcaaatccgcctggttcggcggcaccttcccaagcgcgaagcatgccggcgcaagcgtgcaacccgggcgccggcctctgctcgactggtccgcttaaaaacccacggttgccgagagcaacagagtgcgtggcgtcgccagggtcaagcccggctcgctgtcgtccgaggccccggccgaactccagtaacgcttgtccagcacgttctcgacattggcgcgcaaggtgatgtccttgtcgtcgaacttgaatgcgtagcgcgcgcccaggtcgaaacgctcccaggcgtcgatttccttgctgttggcctggtccaggtactgcgagctggaatagatgccgcgtgcggtcagggtcaggccctggaccttcggcacgtcccattcggcccccaggttgacgttgtacttcggcgtggccggcgcgcggttgccgtcgaaggtgccgttggtggtgtccttcagttcgctgtcgatgtacatcaccccgcccagcaggcggaagcccttgagcggttcgccgaacacgctgagctcgacaccgtcgttctggcgcttgccgttcgggccgaagacccgggtggtggcgttggtctcgtaggccggctgcttgatgcggaacaccgcggcggtcagggcaaaggccccggcgtcgtacttggcgccggcctcgacctggcggctgatgaacggcgggaagatttcgtcttcgttgatcgaggtcgacggcgcgatcttgccctggctcaggccttccatgtagttgacgtacagcgacaactggtcggtggccttgaacagcaggccgcccgaaggcgagaccttttcctcgtcgtaggcggtgtcgcccttgataccgtcgctccagtcgtcgaccttgacccgctgccagcgcgcgccgagggtcagcagcaggcggtcatcgaagaagcccagggtgtcggacagcgccacgccgctgaagcggttctcggtgtagaccttggggtcgaaacgcgtcggccgcgacggggtcggcgtcggccgtgggttatagaggttgctgggggacgcggcatagcgcgcgccgccgttttcaaaatccatgtagaagtagctggccgccaggttgacctcatggcttaccgggccggtgtggaaccagctgcgcacgcccgccgtggtggtgcgcacgttttcgtcgcgggtgaagtcgcgcggctggacgctgaagtcgccggcgtcgttggtgatcgacaccgcatggcggaggaagtcgtggttgcttttgcgcgcgccgacgccgccgtacagcatgatcgagtcgttgacgtcgtattcggcgttgaccgtaccgaaggtgtccttggtgcgtgccttgctccaggactgcgcatagttgtgccgcacatcgtcggcgtccggcaccttggcgttagggcctatctgcacccgctcctggggcgcgtcggtgtcgcgctcggtgtggccgatgtcggtcgacaggcgcaggcgttcgccacggaagtccaggcccagcaccgccatctcgcggtcgacactctggtgatcccacttggtatcgccagactgcttgaccgcgttcaggcgcacgccgaacttgttgtcctcgccgaagcgccggccgatgtccaccgcgccgcccacttggctgtccgaggcgtagctgccggtgagttcggtgatgggcttgtcggtggcccgcttgggcaccacgttgatcccgccgccgacgctgccccgcggcgagatgccgttgatcagctgggtcgggcccttgaggatgtccacccggtcggccatttccatgtcgatggtgtaggtcggcagcacgccgtacaggccgttgtaggcgacatcgctgttgaacaggctgaagccgcggatggtgaactgctcgtagcggccgcccgccgggttggtggcgcgcaccgaggggtcgctggcgatcaggtcgccgagggtccgcgcctgctggttcttcaccacttcgctggtgtaggtggtcatgctgaacggcgtttccatgaagtccttcgagcccagcaggccttgcgagccacggcgcgccacctggccaccggcgaagacgtcgctgtcggtcgcgccgctggcgccgagaatcgaggtcggcgccagttgcaggctgctgccttgcggcgccggggtcaggatgtacgcctgctcgcccaccggctgcagttgcaggccggagccttgcagcaagcgggcaaagccctcctccaccccgtactcgccggacaggccgccgctgttgcgcccgctgaccagctgagggtccaccgacaggttgaccccggcgaggccggcgaaacgggtcagcgcggcactcagcgggccggccggcacctgatagctgcgccgcgcggcgtcgtcggccaggctggcctggatgaataacgggctggaactgagtgtcaggatgaggcccaactgcaacagtccgggggaaaccggacgcaaacggtatggcaatactacgggcatgggaggaagctctcgttttttgttcacttacctggaatgaccggcgaggcgaaaaaaagggacaggcttcagccaatatttttttgcgggggttcttttgccgaaatcagggtgacccaataacgggtgcgcgaatgcacctccagcggcaggctggcggccagcagcgacagcacgcggtcggtgttgtcgagacggaagctgccggtgacgcgcagggcttccagttccggatcccagcgcagcaggcccggacgataacggccgagctcgcgcaggaaatcccccagcggctggttctgcgccatcagcacgccgtcgcgccagcccggcaactgcgcgtcgaaggcatcgatctgcccggcgccgtccacccgcagccgcacccgctggccttcgcgcaacagcagttgcgggccgaacaagggttgcagctgcaccgagccgctgaccaccgacacccggcaatcgtgttcgttgaggcgcacgcagacttcgctgcggctgacgacgatgcggccataaggcgcctggatggtcagcggcgcgctgccggtgaccttgagcgccatctcgccgcgcaccagggtcacctgccgggcgcccaggtcgacgttgaccgcgctggcggtgttcaactgcaaggcgctgccatcggccagggataatttgcgatgttcgccagtgccggtctgcaggtcggcgcgccatacgtccaggggcaactggcgccccagcagccaggcggtcggcaccagcgcggcgacgccgagggcacgcttgaggaccgcgcgccgcgacggctcgggacgccggtccagggtagccatcgccagggccgacggcagcgcggagaaacgctggcgcagcagctgcgccttctgccaggcgctttcgtgacggctgttgctgttgcgccagtgctgcaggcgcgcgtgatcgtcggcgttggccgcgccggactccagcagcgccagccattgggccgcggcgcgggccacctcgcgggtttcgctggacggcgccgagcgcatcacagctccaccagcaggcagtgttcgtaggcctgggccatgtagcgcttgacggtgcgttccgagacgtcgagacgttcggcgatctcgcggtagcccagcccttccagctggctccagagaaacgcccggcgcaccaggggcggcaggccgtcgagcaattcgtcgagggcttgcagggtttccagcaacacccagcgctgttccggggacggcacgctgtcttcgggcaggctggccagcgcgtccaggtaagcctgttccagtttgcgccgggtatagaagttgctcagcaggcgcttgcccacggtcaccagataggcccgtggttcgcgcaggtcgaccagctgttgggagctggtgagcacgcgcaggaaggtgtcctggctcaggtccgccgcatcccaggcgttgcccatgcgctggcgcaaccagctctcgagccagctgcgatgatcgcggtacagggcatgtaggctttgctccggtggcgtcgctgcttcaatcatgtcaagagccctgcgcgaaggattattcaaatgagactgattctaattaatattcattaggcaaaccaagtcctttcgtgtgattgggttctggttttcgtctgctggggaacatcggcgggtgccctggaaccagggtcccagggactgaagagatccaggtgaagcacccggtcggctgttgaaacagcgcccggccccttgcgggccgggcacgattgcgcggtttacacgcccatcaacgggtcgctgatgctgtgcgcaccggtttccaggcgcccggccaggcgccgcagccagccgccctcgccgcgcagggtcaggtcgtaccagccgccgctggcctggcaggcgaacatctggtggacctcgctgcgcccgggcacgtcgaaacgccatggcccctggtgggtgtaggggcaacgctcgatggtgatcgacaccggctccttgcccgggttgctcagggtcagttgcaggttgttgccgcggctgaacatcgacacctcgggctgacgctccagcaggttgccgtggaagctgcggtggaagccgttaggccccagcaaccacagcttgtagcggcccgcggtctgccagctgtccttgagctgcttgcccgcctccaccgtatagcgacggggaatgtccagcaggtgcaggcgatcgtagacatggaacaccgcgccctgctcgccgctgttctgcaggctcagggtcaggctcaacgccttgcgcttggccttggcctcgacattcagccgatacggcaaggcccgcgatggccgggccacgcgctgctgctgcggcagttgctggcggctggggtccggcagcggcacctgggccagttgttcctggcgctggcgcaacaggtccgcggcctggcgggtggtggtgtgcagcggcgggaggatttcgctgttgggattgacgaagttgaaggccgaggtcaggtcgccgcacacggcacggcgccaggcgctgatgttcggctcgcgcacgccgaagcgcttctcgagaaattgcaggaccgaggtgtggtcgaacgcctgggagttgacccagccgccgcggctccagggcgacagcaccagcatcggcacccgcgggccggggccgtagatgccgccgtccggacgcggttgctgggtggtccccggtggcgccgggtgggtgaacacctcgctgtcgaaatccaccgtggacttgccggcgaagctgccgtccagacgccgtgaaggtgccgagggcgacggcaggtggtcgaagaaaccgtcgttctcgtcgtagttgaccagcagcacggtcttgctccagacctcggggttgtcggtcagcgccttgaggatttcctgggtgaaccagccgccctgtaccgggctggacggccccgggtgctcggaataggtggccggggcgacgatccagctgaccttgggcaacttgccctgctgcacatcgttgcgaaacccggcgatcatgccttccaggtcgctgccgctgcgcgccggcaaggtgttgccattgcccttgtacagcggcacccgggcattcagcgcatcgctgtagggcacgaaggcggtgaagccttccggcggctgcgccgggttgcctgccgccacgctggcgcgccggtactggcgaaaaccggccagcgggttgtcgccgaagttgtccggcaggtactggtagatcttccagctgacgccccgctcttccaggcgctcggggtaggttttccaggtgtagccgacgtccaccgcgcccgggccgtcccattcgttgaccaccgccgccacgttggcgccggtcgggccgttggtgccggtccagtggaacaggcggttggggttggtcccggcgtgcaccgagcagtggtaggcatcgcacagggtgaaggtgttggccagggcgaactggaacggcagctcctgctcgcggtagtagcccatcgacgtgttggtcttgaaggtcggccaggcgctcatgcgcccgctgccccaggccgcgtgctcgtcgatccacgaatgcggcgtgccgttgacccgctgcgcgttgccccgcgagctgtccaggtgatacggcaacaccactcgcccgatgccctgctgctcccacaccgaacgcttgccgggcagcgggatggtgaagcggtcgctgaaaccgcggaccccgggcaaggtgccgaagtaatggtcgaaggagcggttttcctgcatcaggatcaccacgtgctcgacgtcgcggatagtgccggtgcggttgttggcggggatcgccagggcctggcggatggagtctggcagtaaggtaaaggccgagccgatagcggcggcctgcatgagcttcctgcgagtgagagtaggcatacgcggttgaattccttgaagttacagggcggaaaatagcgacccacgcaaagtagtgacctcaagtaacaagcaagttacacggcggttgcaggccgcggtcaaggcattcattgatcttgatacagccgcattaactctctaagccgatgatttttaattacatttctaaataaagaatatttcgtgaacttcatcccgagttgctccttgtattcggaaaaatctgacagtgttctgctttaatcctatttgcacaatgccactacttcagtttgcaaggagcaatcatggactcgacccagcactacgagggggaaaggaagcgcatcgagaaccgccgtactgcattgggtctcaaataccttcccgcgccggccggccagcctcccaggatctgggggctggcgctgtccgggggcggcatccgcagcgccaccttttgcctgggggtgctgcaggcgatggcccgggccgatgcgccggaacaggccaacccacgaccgtcgaagacaccgcaagacaacctcaccaccaccctgctgccgcgtttcgactacctctgcacggtcagcggcggcggttatatcggcagtttcttctccagcctgttcatccccaatcgcctgcgccgggagcaggcccaggagcgcgccgaagcctcgcacctgtcgcccgcccagcaagcggccaggaccgcggcggtcaacgcctatgaggtcctgcactacgagccgccgggacgtatcagtacccacaccgactacgccaacgccagcgacaaagacatcggcaaaggccccacggcctggctccgggagaacggccgctacctgaccccgaccggctcgggggacgcgctctacgccctggcgatcacctggcgcaactggctgtcgctgcactttgtcatcggcatgccgattgtcctggtcctgtcgttgctgatgctgttgcaagtgaagtacgtgcccaatctgttcctgctgcccggcgcggtgttcctcctcggcttgctgccctgctgcctggcctactggctggtgctgccgaaaaacagcctgagcaatcctccggccctgagcaacctggcggccgtggcttgcacggtgatggtgctggtcttcatcggtatctgggcgctgctgcaacagccggacgacaggccgaacgtacgctacctgttcctcgggttcgccgccatcgcgctactgggcatcgcctacgcctggctgctgatctggcgcctgaaataccgcacccgcaaggccaacgacgaagacggaatctttaccgtgcgcaactaccgggtcgaggtcacccgggtgctgtcgcagatcatcatggccctcggggtgctgctgttcgccgcgttcctggtgtcgctctccgaagcgatctacctgcacctgcagaccctgacccagggcaccatcggcattctcccggtgctgatctggctggtgcgccgcgtggcgctgttgcgggacgagaagagcctgccgggctggctgcgcctgctgcccctggaggtcatgagcctgatcggcggcgtgctgttgctggcggcggtctgcctggcgtggatgctgttcgtgatatgggtcaccgccgatggcagcatccgcctgcaggaagacgggcatgtgctgcggctggctctgctggccggggtggcggcggccctgacctgggtcagcagccgcttcgtcggtttcctcaatacctcgtccttgcagtcctactacagcgcgcgcctggtccgcgcctacatgggcgccaccaacggcaagcgcttcgacggcacacccgagcaacggcgcaagcacatgagcgtggccgagccactgagcaacgacgacatcagcgtcgagcactactacggcacgccgaacgccggcccgctgcacctgatcaacgtgaccatgaacctcacggtcgaccccgccgagcaactggtgcagcgcgaccgcaagggcaagccgctgtgcctggcgccgggcagcgtcaagggcgaaggggccttcatcctcgacggcaagctctatcagcgcgacctggagaatatccccgcttcggaaatcgcctacccgctgaccatcggccagtggatcggcgtttccggcgcggccttcaccaccggcctggggcgcgccaccagcctgggcatgtcgctgctgctgggcctggccaacgtgcgcctgggcaactggtggcccagccgttttatcgacgctaaaccggaaaaacccaggcaatccctgggcctgaagctgtcgcgctggctgccgacccagacctacctgttctacgaattgaccgcgcacttccacggccatcggcgcgcctatcagtacctctcggacggcggccacttcgagaacacggcggcctatgaactgctgcgccaggaacgccaggtcgagctgatcgtgatgtgcgactgtggctgcgatcccgactaccggttcgacgacctgagcaatctcatccgcctggcgcgcatcgaccacggcctggagatcagggaagacgcagcgatcaccggggacgaggtactgggcaaagtgttcgggcgcatggaggacttcaagatcgcgccgtcgccggcggacccgcattgcgcgctgctgctcaacgtctacgcctgcaccgcgccggacaccctggtcagtcgcatcctggtgctcaagccccggctgatcccctcggtatcgccggacgtgcagaactacgcgctgatcaacacgtccttccccaaccagcccaccgtcgaccagttcttcgacgaggcgcagttcgaaagctaccgccagctcggcttgagcatcggccagcaggtcttcggcaaaggggtcaacggcgatgccatcgcccgggcgctatggcgctacctgcgcgaccaccctgcggcaagcgcgcacgaggatgaccagcccaagccgccgcggccgagccgcaatggccagcgccgcccttcggcagacaggcctccccgtgcatgacactggaaatggcgccgaccctgcgggcccgcggccaggaacagctcaacgctggccgcggcgcagggtctcgctcggcagttccttgaacagcgcccggtagctgctggaaaaccgcccgaggtgccagaacgaccagcgcatggccacctcggccacggtggtttcgtccgggccgcggcgcagcagttcgcggtgcgcactgttcagccggcgcaggcgcagccactgggtcggcgccatgccggcgaaggccttgaacgcgccttgcaactggcgcagggaaaccccggccacctgcgccaactccagcaggttgaggctgtcttccgggccgtccgccgcccactgcgccacccgctgcatgatcgcccgctcctcggcgcgccggcgcaggccgccaccgtccaggcgcacgcaggcgttgtcgaggataaacaggcaatcctcgagcaactgctgggtcagggcttcgcgactcggtgggtcgagggtctgcgacaggcgcgtcagggtggtgctgagccagcggctgaacaaggcgttctgcccgcagttgagcggcgccaggaacaggccgtcgaggcgctgcgcgtcgaggccatggccgcggacgaattccgggccgaacaccacggcgatttcctggtagttctccggggtgatccagatgttgcggctctcgccgttgagcaggtacagggcgttgtcgctgcgatcgaaacagaacgccagggaatcctcgggcgcgctgaaattctgctcgacccgggtgttcatgcattcctcgtagatctgcaccccttgcaggtccagatagcgcacctgcccggcgaaatgcccgggcgacatctgctggtaatgctgcacccaacccggggtggcacggatctgatcggccacatcgaaggtgttgaaggcctggacctggagagctgtcgacgctgtcatgaaggaaccttgcgcactcttttggtgcgctttggtgctgcttaaagtggatagatggaaccgcaaggcttgcccaagatagtcgccaacgcgccacaggggaagccttgccggaccaccccaagcactggcgcgtcaccgacaatcattgacgaggtccttatgaatgcccctttcgatcagctgtctgcctggctgaaagaacacaagattaccgaagtggaatgcgtggtcagcgacctgaccggcatcgcccgcggcaagatagcgcccaccaacaagttcctgcatgagcgaggcatgcgcctgccggaaagtgtgctgttgcaaacggtaaccggggacttcgtcgacgacgacatctactacgacctgctggacccggcggacatcgacatggtctgccgccccgacgccgcaggggtttacctggtgccctgggccatcgagccgaccgccatcgtcattcacgacaccttcgacaagttcggcaaccccatcgagctgtcgccgcgcaacgtgctgaagaaagtcctgcagctgtacgccgacaagggctggcagccgatcgtcgcgccggagatggagttctacctgacccagcgctgcgaagacccggacctgccgctgaaggcgccactgggccgctccggccgggccgaaagcgggcgccagtcgttctccatcgatgccgccaacgaattcgatccgctgttcgaggatgtctatgactggtgcgaagcccagggcctggacctcgacacgctgatccacgaagacggcccggcgcagatggaaatcaacttccgccacggcgacgcccttgacctggccgaccagatcaccgtgttcaagcgcaccctgcgcgaggccgcgctcaagcacaacgtcaccgccaccttcatggccaagccggtggccgacgaacccggcagcgccatgcacctgcaccagagcgtggtcgacagcgccaccggcaagccgatcttcgccgacgccgagggccgcatgagcgagctgttccgccaccatatcggcggcctgcagaagtacatccccaaggtgctgccgatgttcgcgcccaacgtcaattcgttccgccgcttcctgccggacacctcggcgccggtcaacgtcgaatggggcgaagagaaccgcaccgtcggcctgcgcgtgccgacctccggcccggaagccatgcgcgtggaaaaccgcctgcccggcgccgacgccaacccttacctggccatcgccgccagcctgctgtgcggctacctgggcatggtcgagggcatcgagccgagcgccgcggtggaaggccgggcctatgagcgacgcaacctgcgcctgccgatcaccatcgaagacgccctgacccgcatggaagagtgcccgaccatcgagcgttacctgggcagcaagttcgtgcgcggctacgtcgcggtgaaacgcgccgagcacgagaacttcaagcgcgtgatcagctcctgggaacgcgagttcctattgctcagcgtctgaggcctgcgcgccgcgcacaccgtttagccgctgccgagcctgcgaggctgcgatcgatggcgcagccatcgccagaccggcaatcgcgttgtatcaggcgtaccgcgtgcactggtttttgcgtcggctacgccgccgatcgcagcctcgcgttgctcggcagcggctacagggctacagggctacagggctacaggcggcttcatgaatttggcaaacaccataacaaccgcaaaaaggggtatcgctatgcgtctatggaaatcggtggttccgctggccctcacggtgctgttcggcgccacggcccaggccgaatcgacagtcagcgtgtacaactggaccgactatatcggcgagaccaccctcgccgacttccaggcaaaaaccgggacccgggtcatctacgacgtcttcgactccaacgaaaccctggagggcaagctgctggccggccgcaccggctatgacctggtggtgccgtccaaccacttcctggcgcggcaggtcaaggccggggcctttctcaagctggaccgcgcgcagttgccgaactggcagaacctcgacccgaaactgctggccctgctggagcagaacgaccccggcaaccagtactcggtgccttacctgtggggcaccaacggcatcggctacaacgtcgacaaggtcaagcaggtgctgggcgtcgacagcatcgattcctgggcggtgttcttcgaaccggagaacctgaaaaaactcagccagtgcggggtgtcgatgatggactcgccggacgaagtgttcccggcggtgctcaactatatgggcctggacccgcgcagcgaaaaccccgcggactacaagaaagccgaagccaagctgctggcgatccgcccgtacatcacctacttccactcctccaagtacgtctcggacctggccaacggcaacatctgcctggccttcggttactccggcgacgtattccaggccgccaatcgcgccaaggaagccaagaacggggtgaagatcgcctattcgattcccaaggaaggcagcaacctgtggttcgacctgctggcgatcccggcggacgccagcaaccccaaggaggcccatgcctttatcaactacctgctggacccgcaagtgatcgccaaggtcagcgcctatgtcggctacgccaaccccaacccggcatcgcagcaatacatggaccccgagctggtgaacaaccccgaggtctacccaccccaggcggtgctcgacaagctgtacatctccagcacccagagcccgcagaccatgcgcctgatgacccgcgcctggagcaaagtgaagtccaaccaatgaaccggcacagccctgcgcaacacacccgctcctactacgccgcctcggccaacgcgctgccggactacccgccgctgaatgccgacctcagcgccgatgtctgcgtgatcggcggtggtttcaccggggtcaacaccgccatcgaactggcgcagcgcggcctctcggtgatcctcctggaagcccggcgcatcggctggggcgccagcgggcgcaacggcgggcaactgatccgcggcatcggccacgacgtcagcggttttgcccgctacgtcggcgccgagggcgtgcgttacctggaacaggccggcatcgactcggtggcgctggtcggccagcgcgtgcgcgagcacgacatcgactgcgacctgcgctggggcttctgcgagctggccaacaccccggcccagttcgccgcgttccaggccgagcaggaacacctcgcggccctgggctacgtgcatgaaacccgcctggtcgccccgcaggacatggcccaggtggtggcgtcctcggtctatgccgggggcctggtggacatgggttcagggcacctgcacccgctcaacctggtgctcggcgaagccgccctggcccggacgctgggggtgcggatcttcgagcagagcccggtgctggagctgatccacggcgacagcgtgcaggtgcgttgcgccagcggcacggtgcgcgccggcagcctggtgctggcctgcaacgctcacctggatgacctggagccgcggcttgccggcaaggtgctaccggccggcagctacatcatcgccaccgagcccctggcgccggccctggccgccgaactgatcccgcagaacctggcgctgtgcgaccagaaggtcggcctcgactattaccggctctcggcggaccgccgcctgctgttcggcggcgcctgccactactccgggcgcgacccggcggacatcggcggctatatgcggccgaagctgctcaaggtgttcccgcagctggcgaatgtacgcatcgactaccaatggggcggcaagatcggcatcaccgccaaccgtttcccccaggtcgggcgcctgcgccagtaccccaatgtgtattacgcccagggttactccgggcacgggctcaacgtcagccactggaccgcgcgcctgctggccgaggccatccacgccgggcacagccagggcctggatatcttcagcgcagtgccgcacatgaccttccctggcggccccgccctgcgcgcgccgctgctggcgctgggcatgctgtggcatcgattgcgtgaggtgctgggctgacggcaagggcggcggtagctccacagatcccttcagggaacgggtggagccaccgctgattgtgtctacgctgttcgacagggaataccgtcacgactccgccaggaggccttatgtcatcgccttggaactcgctggaaataaccaagctttttttcaatgcgctaaccccgctgacaatcttttccattggcctgatggtgaccgcggccaacgagaaagctcggctggatcaacaggagaaagccaacaacgccgcctatgagcgcgcggtcgttgaaaagaacgaatccaaggaccgggatatcgcaaaaaccgtaatcgaacgcttgcagcgtgacgatgcctgcgcccgccctacccatctgcgggcattgatcgcaatggccaccccggaccgcgcccaatcgctgcaagcattgttctccgagcaatgcagcttgccgcagacagaaacaacgaatacatacgaggtcgctcgaaccaacgaaatcagcggcatattgaccgacctgcgcggctcggcccgcagggccgcccgagaacggctcagaaccctgtttgaagccgacaaggcatttgtcggaccgctgattgccaattacatgagcagcaacctcaacgactatcaaggcatgctcggagctctggtggtgctcggcagcgccaatggcggttggtcaaatgccgatatcgccaccctgctcaaggccctggagggcaacccgaatctcaaggacaagaccttcaagggctggtacgacaaagccatgtccaacaagagttgaaggagctggcacggtgaaacagcttcaaccccgctcgccgcccctgtaacccggctcactccaccaccacgcccctggccgccaccccacgcaaccggcatggcgcgcccaggcggtcgagccgtggccggccgaacaggtagccctggccccattcgccaccgcaggccgtggccagggcgcggtcggcttcgctctcgatgccttcgatgatcacgcagggcgcaagggtcttgcacagctgcaccaggtgtttcagggtctgcacgctgttgggttcgctgcgggcgcgttgcaggtaaccctggtcgatcttgaccatgtcaggaaggctctggcggatgaattccagggtgccgaggccggcgccgaagtcgtccaccgccacccggcagcccagctcgcgcaggcacaggacaaactcgatggccgcctcggtgctcggcggcgtggcgctttcggtgatttcgatcaccagccgcgcggccaccgcaggcgcgtcgcgcaaccgcgcgagggtggcggaccagaacggatcgacgatcgcgctctgcgccgagatgttgcagcccaggcgcagatgttcgtcctccagcaggcgctcgatcacgccccccaccacgctgcggtccagctcgcgcatcagctgatggcgttcgagcatggcgaacgggtagacgccattgccgggctgttcgacatggcgcagcaatccttccaggtacagcacccggctggtgtcgggcagccacaccaccggctggaaggccagcgccagtcgcccctgcgccagttcccgataaaagtctttgacgctttgcatgacagatccgtagtcgaagcggcgacagcgcgccgggtgggcttggccaggatgcgtcggcgcgcccgacgcgccaatggctcattgccacttatgatcccccctgcccggacggctcgaaagtgttcccggatacctttcgtttgtccttggaaacaccgcaccgccctttctcgactgtggcccgaggtttattgcgatcatgcgccagcgccaatgacatcaattagccaccagtccaggaagtactatgcacagaatgaccggcaccagtttccgggtgcttgccgatgtcctgagcgacgcgggagtcaaggtcgaggccttgctcaagcgccacggcagcagccaccaggaggcctgtgaaaaccccatgggcgtcaggctggagctggtctacgcggtgctgcaagacgccgtgcacctgtgcggcaacccggaccttggcctgctggcgtacaccaaggcccacccggccaacctggaagtgctcggctacgcgctgatgtccggcgccaccctgggcaccgcgctgcaacgcctggtggactatcactcgctggtcagcaacggcttctacctgtgcctggagcgcagcccccaggccgtcaccctgatcggcttcgacatcgccctcgaaccgggccaggtaccgcgggccttcatcgatgccggcgcggcgcagaccctgggcctggtgcactggctgctaccgggccacaagccgcaaccgctggcggcgagcttcacttacccgcgaccgcccgacacccgcgccctggagcgcctgctgggcgccaacctgcagttcgacgcgccctacaacagcctgagtttcagcccgcgcgattgcgccatggccctgcccagcgccgacccggccctggacgtgctgcacatggaatacgcgcgaacccgcctcaagctgctgctcgacggctcgatgaccgcgcaggtaaggcgggtgttgtccgagcgcctggcccagggcgggcccagcgacctgcggcatatcgcgcagttggtgggggtcagcagccgcagcctgcagcgacgcctgggcaacgaagacatgcacttctcggccctgctcgacgaggcgcggttgatgctggcccacagtttcctgcgcaactcggcgcgcagcgtcaagtacatcggcgccctgctcggctttcgcgaccagagcagctttcacaaggcctgccgccgctggttcggcatgaccccggggcgttatcgccaggaaggctgaagaccgcaaaacgccggggcgatcccctgtaggaacgagcttgctcgcgatgaactcaagagcgccgcgtttactcaagtaaaaacgcggtgtcgttagccaccctcgcgagcaagctcgctcctacaagatcggcatccggctggtcagatgaaattcagcgatggctggcctgcagttgcggctgtgcctggggcatggccgaagagtggtggttgaggatcttccactggccgtcgatgcgctcgtagaggaaggtgtagcgcgcctggacctggcgggtcgcgccaccggcctcgtgcagggtgaaggtgtagacgccgctgtccatggccgcatccgcgcccaggtggcggatttcccggtagttgatctggcccaccggcttgcccgcgaggaaatgctcgaagtagtcctggatctgcgccggggtggtgcgcacctggttcgacacggtcggctggaggatcgcgttggcggcgtaaagactggttacgttttttgcactgccgctttgcagggccgcgttccagcgatcgaacaggccggcaatctcccggtcttcctgattctgcggctgcgcggcgacggtgcggtacacataaggcgtggcgtccagggcctgggccaggggcgcggtcagggccagcaacagggcaatggcggtggttggcagtttcatcggaaggctccagtgggtttcaatgcgcccactttgcccacccgttgctgcctcgccatcggccaaccggtgccggcggcctatgccattcggcagataggcccacggccggcaaccgggtctaatgcctgctcgcgagcgcacgcccttcacgctggagcctgtttttcatgcaaagcccgacccacgaccccggcagcgccctggccattcgcagccagtatcgccaggcgcaaagccgcgcggcgcgcctgcgcctgctggtggacaccggccaggaactgacccagctgccacccgcggccatgcgccagcgcgccctgcaacgggcctgtgcctttatggcgatggaccacggcctgctgctggaatggcacgccgcccaaccgccccaggccaccgcccagcacggcggcagcgaacgcctggccgccctgcacgagctggccaggtctgcgaccctgcaccccgaatggctgccgcagaccgatgccgccctgccccaggtgctgcgtattcccctgcccggcgccgacggccaggccttcggcgcgctgctgctggccaacagcgtggccctggccgcgcccgacagcgaggacctggaatccctgcaactgttggccaccctgctggcggcgcacctggaaaaccagcgcttgctccaggctctgcaagcccgggaacgcaccatgtcggaactggtgcaccggctgttcagcgcccaggaagacgaacgcaagcgcgtggcctacgacctgcacgacggcctggcgcaaaccctggccgggctgcaccagcgcctgcaggggtttgccgggcgctgcccgacattgcccgaggagctgcacaacgagctgcaaagtatcctgaccctggcccagggttgcgtcggcgagggccggcagttgatcggcggcctgcgccccaacgtgttggacgactttggcctgtacaaggccatcgacaaggaagccgaccgcctgcgcgacgccggtctcgaggtgcactggcggcaacagtccagcgcgcgcctgccgggcgccagcgagatcgccctgttccgcatcgcccaggaaggcatcaacaacatcctcaagcatgcccgggccagccgcgtcgaactgagcctgcacctggccgacggccaggccgcgctggcgctggcagacaacggcgtcggcttcgccctggacagcccgctgtccagctgcggcggccagcacctgggcctggcggcgatgcaggaacgcgccagcctgctgggcggcgagctgtcctggcacagcgcccccggccacggcacccgcctgctggcccgggtgccgctgcccgctgctggagaacagccatgaaccctgccctgcgcctggtgctggcggacgaccatgaagtcacccgcaccggttttgtcgccctgctcgccggccacccggagttcgaggtggtcggccaggcccgcgatggccaggaagccctcgacctgtgcgagcgcctgcaaccggacatcgccatcctcgacatccgcatgccgctgctcaacggcctgggcgccgcgcgcctgctgcaccaacggcaaccggcgatcaaggtggtgatcttcaccatggacgacagccccgaccacctggaagcggcgattgccgccggcgcggtcggctacctgctcaaggacgccagccgcggcgaagtgctcggcgccctgcagcgggtggcccagggcgaggaagccctcaacagcacggtcagcgcccggctgctgcggcgcatggccgaacgcaacgccggcggcagcggcgctgcccaggttgtcgccctgaccgcccgtgaacgccaggtgctggggctggtggccggcggtttcagcaaccgcgagatcggcgaaaagctcggcatcaccaccggcaccgccaaggcccatgtggaacgggtgatcggcaagctcggcgcggcggaccgcacccaggccgcggtgcgcggcatcgccctggggctggtggcgcagcccgcgggagactggccatgaggctcctggccagccggcactggctcgacctgccgctgcgcggcaaggcgctggtggtgatctccctgccgctggtgatcctgctgctgtcgctggtgctgatctacatcaccgaacgccagaccgcccgcgccgaggaagacgtgcgccgggtgctgctggtgcagggcgacatccagaccgtgcacaccctgctggccgaagcggcggccagcgtgcgcggctacctgctgacccgccgcgaagacttcctgcccagctacgaacgtgcccagccgctgatccaggccgccctgcaacggctggacagcaacattcgcgatgcgcgcatgcgcgaccacctcaaggccatcgccccgctgatcggccacaagctcgacggcctggtggccctgcgcaacggccggcccgacgacagcgccagcatcaccgcgatcctgatcgagaacaaacaggtgctcgacgtgctgcgcgagcagatcagcgccatgcgcatccgcgaagacggcttgctcgccgaacgcagcgccgcggcctcggcgacccgtatgcgcctgctgctggccacgctgctggcggcggtctgcggcttgtttggggcgattgtcgcggtgctgttcttgtccaagggcatagtcgcccgggtgcagcaggtgcaaggcaacgcccagcgcctggccctcggccaaccattgcggccgcaagccccggaacaggacgaaatcggccagctcggcacccgcctggtggaagccgggcagctgctggccgagcgcgagcgggccctgcgcgacaacgaagaacgcctgcggctgatcatcgacggggtcaaggactacgggatcttcgccctcgacacccagggccgggtcaccacctggaacgccggcgccgaacggatcaagggctacagcgaacaggaaatcctcggccggcacttctcgctgttctacctggcggaagaatgcccggcgcacccggacatggccctgcgcgaggccacccgcgacggccactacatggaagaggcctggcgctgccgcaaggacggcagccgcttctgggccagcgtggtgatcaccgcgcaatacgacgccagcggcgcgttgcgtggcttctccaagatcacccgcgacatcaccgaccgccgcgccgcggaaatcgccctgcgcaccgcccgcgaggaagccgaaagcgccagccgcgccaagagcgaattcctctcgcgcatgagccacgaactgcgtaccccgctcaacgccatactcggtttcgcccagttgctggacatggactcgccgagcggccaacggccccaggtcggccatatcctgcgcgccggccagcacctgctgactttgatcaacgaggtgctggacatcgctcgcatcgaggccgggcacctggcgctgaatgtcgagccgatcgccctggccgcggtgctgcacgaggccctgaccctggtctcgccgatggccaccgacgccggtatccagctggccgccctgccggcgctgagcgagcacagcggggtgatcgccgaccgccagcggttgatccaggtgctgctcaacctgctgtccaacgccatcaagtacaaccggccccagggccaggtgcggatcgcggtcaaggtgctcgacacccgggtcgaagtggcggtcagcgacaccggcgccggcattcccctggagcgcctggaccagttgttccgccccttcgaacgcctgggcgccgacccgcgggtggaaggcaccggcctgggcctagccctgagcaagagcctgctggaaatgatggacggcagcctgcgggtgcacagcacgccgggccagggctgctgctttaccttgcaactgccctttgtccaggtggccgcggccggcgcgcgcccggccctggagcaacagctattggaacaaccggcggcggtgctgccggcccgggtcgaggccgtggcataccgcggccaggtgctgtgcatcgaagacaacctgtcgagcctggcgctgatcgaaaccctgctgcaacgccgcccgggcattcgcctgctgtcgagcatgcagggccagatgggcctggacctggcgcgccagcatgcaccgcaactgatcctgctggacgtcagcctgccggaccttacaggcctggaagtgctgcgccggctgcgggaatcgccgagcaccgccagcaccccggtcgtgatgatcaccgccgacgccagcgccctgacccaccgcgccctgttgcaggccggggccacggcgatcctgaccaaacccattcatatcccggcgtttctcgcccaccttgagcaacatttaccggagcccgcatgaaccacgatttgcgcatcctgatcatcgacgaccagcgccccaacctcgaactgatggagcagctgctggcccgcgaaggcctgcacaacgtgctgagcagcacccagccgctgcgcaccctggagctgttcaacagcttcgagccggacctggtgatcctcgacctgcatatgcccgagttcgacggcttcgccgtgctcgaacagctcaaccgacggatcccggcccacgattacctgccgatcctggtgctgaccgccgatgccacccgcgacacccgcttgcgcgccctggccctgggcgcccgcgacttcatcagcaagccgctggacgccctggaaaccctgctgcggatctggaacctgctggaaacccgcgccctgtacaaagccctgcgccagcaggtgccggcgcagcagatcgagctgctgcgccggcatcggcagtgaatggcgagcggccctagaggttgtactcatccagcctcggcgagtcgcccacctgctcgatcagcgcggcatcgatgcgcagcaggttctccggctggtaggtcagctggctgccccagggctggtcgtcggccagggagcctttcaggcgaacggccacggagtcatgcacccggactttctgccctggtttatccgtgagaatctcccgcgacctgggtttaccgaacggcggcatcgaaccgtactcacggactcgcttgtgggtcttcgggttccagaccaggcgtggcacccactcggcgatcagccagttgcgggtcagggaatcgtgggcctgggccagcggatcctgtagcaccgaggaggcgggatagagttgcgcgcgacaggcttcgacatcgatgctcaacccggcctccaggcactcgccgaccatccagcgcaaggcaatcaatgccagctgcgattcgccggcggggtaaccgccgcccacatcggcatgcacgccggcgaaccagacctgtttcaggttcacgccctggccttctgtccagaggttctggcggaaaaagctgcggcgttcgtccagggacaccgcatggcggatgatcttcacgtcctcgttccgccgcgtgtagggaacgatcagcgggtcgtacacccagcccaccgaactcacggtgtcgaacagcccgagaaagtgaatgtgcacctttcgggcaaagctggccttgaacgcccccatcaacttgaagtccggttttttgtccgcgctcatgcgccaccaggcataactcatggcgcgttggcgattcggcttggaattatcagcggatttcaagcgagtggtcagcagcgaccaggcaaagtccatcagctggagctgatgggccggcaacaggccgatggtgtgcagcagcgccgccaggacccgcaccgcgtaggagccgcgggagaaaccgaagaggaagatctggtcgccgtccctgtagttctccatcaggaagcggtaggcattgagcacgttgcgcttgatgccccagccgaacatcagcccggcgatgcgcgacggcaccttctgccattcgaacagggtttcgctgagcccgaaggtgcccacgccctggtcgtaataggccagcagcgtttcgctgtccttgggtagcgagcgaaacagccggaccacgttggtcggttcgtcactgaaacggttgttggtgccatcgatgcagacaatcagctggcgcgccttgatccttgtgttgtccacgacctggttccctcgagagtcgtcaagtgaggtccccgcgcggccaatcggccaggcacggaccggtgtcaccctacgtccgtgtcatgacaactgctgcggtaaagcgtgaagggctctccaaggcatagcagcattaacggtgcccggccataaagccccgggcaataaatgtccggaccatgaacccccctccgcaaggaggggccgggcgccgacgagccgtgcctgggcgctagaacctgccgcccaacggatactcgatcgccagccgcagctggtcggcatccagctcggcctgggatttattgccgcggtgcacggcgtggcgcagggtgacggcgaggtttttcgccgggccggactgcaccacgtacttggcctgcaggtcgcgttcccagtgcttgccgccttcgccgtagcccagccaggcgtagccgccgcgcgggtccatatggctgccgtcgatgccgctgccgcgcacgtacagggcgctgaaggtcaggccgggcacgctgtagccggccatgttgaggtcgtagcgggcttgccaggaggcttcctcaggggcgttgaagtccgacagggccacggcgttactgagcaggatcgcgccgcgagtgacgtagtcgtaaggcgtgtcgccgtcgaccttctggtaacccaggccaaaactgtgggcgccgcgcttgtaggtcgtcatcaggctccaggtggtgttgtcgatgcgccccgacagggccttgccggtgtcctgggtgcggtacaggttgaagtcgaacgtcaggtcctggcccgggctcaacggcaggttgtagagcgcgccgaggtactgctggcgccaggtgtcttcgtacagggcgctgaacaggctggcgttgaggcccttgattgccgtattgcgcacaccgatcaggtcgaagctgtcgccctgctggccattggagtaattgaccacgaacccctggtcgtggctggtggcgttgcggtcggtgctttcgttgaagtggccgccgtacagggtggtgtcgctcagctcgcggctggtgaggaaccagccggtggcggtctcgggcagcaggcggctgtcggaggaaccgaacaccggggtcttgacccgctgctcgccgtagcgcagttcggtggaggaaaaacgcagcttggccactgcgccgccgcgactgaattcgtccttggggtggccgtcgttgtccacccccagcaaccgcgccttgccggcccggccaccgccgctgtcgagtttccagccggaatacacatgggcgtccaggccgaagccgagcgtgccctgggtgaaaccggagctgtagtcggccatcaggccgtaggcccactcctcggccaggtcgctgcgttcggcgcggggtttgtaggcgttgcgcgcgccgttgctcaaggagccgtgccgatagtcgcgacggtcgtagaggctgcggttgaacaggctccactggctgtcttcgataaagcccttggcattgtcctgttccgcggccagcgcgagcaggctctggcctccccaatgccaaaaaaatgccaacagcagggtgtgtcgggtcaaggtcttcactgtggaactcccgaaaatcgataaatgacaggcgataggaagcagtgcgccgctatacgggcgcaccaccgggatcccactcagaggtatttgaggatcgcgatatcgcggcgacgctgcttgaggccggcgaaccagcgcgtcgggaagaacaacagcacgccgaggatcaggctccacagccagacgccagacaggttgtcgaagccgtagtaagtgccctggttggcgccccagatggccacggccaccaggtacatggccttgagcacgtacaggtgcagcaggtagaagaacattggcgcgccgccgtagatcgccagttgcgcggtcgaccagcgttcctggaccttctcgaagtacgccaggaggatcagccccaggcccagggtgggcatcaggaacatcagcgacggcgggtacttcttggcgctcatgaagctcatgaaggtgcgcagcgcatcaccggtctgcacccagggtttctcgccgtagacgttcaggtagcggatgaacacgaaggccaccagcaggccgacgccgaccttgagcagccgcgaaatgcgcaccgccggctgcacgtccttgccgaaccacgggccgatggcccagcccagcaggatcacgccgatccacggcagtaccgggtaggtggtgcgggcgcgggtgaactcggtgatgtcgatgaacacccgctggtgcaggatcgaccagggcacgaagaacggcgactcggggcccaccaccacgtcatccagcaggttgtgcccggcgacgatggccacccccagcacgatcagccagctgcgtttgaagtgcagcaggccggccagcacgatcatgcagatgccgatgcaccagatcacctgcagccacagggtcttgggcgggaactcggcgttccaggcaaaacacacgaaggtcagttcgaggaacaccaggaacaggccgcgcttgagcaggaacaccgaggtttccccgaggctgtgtttctggctgtagagccaggccgacaggccggtgaggaaaatgaacaccggcgcgcagatctcgctgagcaggcgggtgaagtacaggtccggggtcacgctcagggcatcgatcgggtcggtgacctggcgatgcaggaggaaggtctcgcgcacgtggtccaccagcatgcacagcatgacgaaaccacgcagggcgtcgatcgccagcatccgcgtattggccttggccacgctgcccgccagcgcaggggacgcaacgcccgcctgccctgccaatccagtagaaagagtcatatcagtcactcatgttgaaggtcgttgaacctgggcaaaaaccctgtcgccgactcggcacagggggtcgggacacggggtcaggattgctttttcaagcgcgcgacttccgaggccggcagcgttgaaggcgcccgtggcaacggcggcttgccctgtggctggtggaacgacagcgtggaactgaagctcttgaggtcgtaggcctcggcctggttgtccgggccctggcgggtgcccggggtgcggtccttgtattcggcggccaccacgtaggtgccctgccacggcagcgcgaagctgaccttgccgtccttgtcgctggtctgggtgaagacttcgcccgagccggtttccaggatcacgtcctgggcggccagcggcttgagttcatagaacacctggaactgcgcctggcccgcgacagccacgccggtggggacgatgtccagcgccagttccggctggcgcgcgcgcaggtcgccgacccagcgggtggcgggcgtccagtaggccttgagggtcttgccgccttcgtgcaggtcgaagatcggatactgcgtgtcctgcgccagcaggctttcgtcggccttgggctgatggccgacactgaacgactggcgttgcaggctcagccccagggcaggattcgccgccgaccagcccttgagctggcggaagcgatcgaggccgccgggggtcacttccagcatgttcttgtcgtactcgccgtaatacagcgtcagggactgccccggcgtgtgctggtaccagatctggtgagcctgggtaccgccggccagcatcagcgcgcccagccctatcaatgtgtttgccgtgctcttgtgcatcgtgttgcgctcctttgtgctctcattcaacgaatcgccgcccccgctctgatggcgttgaacttcccggggagacgatgcgcacctaccactggctggcattacagcgcaggccgttctgtgctttgttccgatttgccgcggcacacgcccgtcgcctgctgttttctcaagacaaacagcgatttatgcggtgtgcgccaggctgaagcatccaggggtcagcggtgcgtggattgtccgatcggggtgcacgcggggcttttcatgcccggtgttgcttccttgcgcgccacccgctgtcactcacgggtccggcaaaaggccggcccagacgcaagcgcgcccggtcaggggcgcgcgtgagggtgattgatcaggcgatcaaaatgttatcagataacatttcattttgagagaagaacgcgtcagtggcgcaacaatttacgcaggggcacgccgtccttgaggaccggcgacttgatgacgatgtagctgaagtacttggaaatgccgatgttcttgtccagcaggctttccaccacctcctggtaatgctggatgctgcgggtcatgaaccgcaccagatagtcgtagccgccgctgatcaggtgacactcgagcacctcgtccaccaggcggatattcgactcgaacttggcgaagtcttcgcgcttgtggtcgctcagggtgatctcggtgaacaccatgaccgagtcggtgatcttggccaggttcaggtgcgccttgtagctggaaatgtagccggccgactccaggcgcttgacccgctgcagacacggactggccgacaaccccacggcgtcggcgaggctgacattggtcatgcgtccgtctttttgcagctcaaccaagatgttgatatcaatacggtccagtttgactaaaccttccatcgtttacctcttgattgctgtgggatgcaatcgacaagcaaaatcagcgccgtaacgatgcctgatgctgggccaccaggtcggccatgctgttgatgcagtagtcggcggcgcagggttgcggattgcggatgccggcgcggcaaatcagacacaggcccgccgtcgcttgcgtcgcggtggccggcggccgggtcacctggagaatgtcctcggcgcgcaggtcgttgttcgccagccactggcgatcctgcagcggctggctggccagggagatgaagtcgtcctgggcgatccccagccgctcgcacaacaacgcgcggtcctcggcatcgcgatcgccctgcaccagcagccgataaaacttgcgcaggtacaacatcgcccccggcgcgtcctcgaacagcgaccagcccgccaccgaacgggcgaagctcatgccctcctcccaggacgccttcaggccccagcgctcggccagctggcgatgggcgaaacacagcaggccgctgaaccccagctcggcgaaacgcgggtacaggccccgcaccgtttcggcgaattcgcccagcacctgttccttgtccgcctgcccgcggcgactgtcgagcaagggctgcaaggcggcccagacccccgagtcgcggtccaccaggaccgcgtcgcagtcgatcagcaacgcacgataatcagtcagccccatggcgtgtacagcctcctatgatgcgttccatcgatccatgctccaaaaatgcccatcggtggcgcccggcagcccggcgccgaccggggcatcagctcagctcaagactcgtgccagcgcggcgtcgagaatcgccagggcttcgtcgatctgctcgggagttgttaccagcggtgccaggaagcgcaggacgttacggtggaccccgcacttgatcaccagcaacccgcccaggcgcgcctggtcgatcaggcgctgcgtcagctcggcatccgggctgcgcgccgcgtcgtccttgaccagttccagcgccagcatgaagccgctgccacgcacatcgccgatgcacgggtacagccgctgcaggcgcagcaacccttcgcgcagacgcaagcccagcgccacgccgcgggccagcaactgttcctcttcgtaggcatccagcaccgccagcgccgcggcgcaggccagggcgttgccgccgtaggtgccgccaaggccgccgggcagcggcgcgtccatgatctgcgccttgcccaccacgccggacagcggcaagccgccggccaggctcttggccacggtgaccaggtccggctggatgccggcgtgctggaagccgaaccagctgccggtgcgaccgaagcccgtctggatttcatcgaggatcaacacgatgccgtggtgtgtggccagggcgcgcaaggcctggaggaattccgccggagcggcgaggaaaccgccgtcgccctgcaccggctcgatgatgatcgccgccacgcgctcgggcgcgacctgggtggcgaacagctcctgcaacgcctgcagggccatctcgctgctgaccccgcgataggcgttcgggtacggcgtatggaacacctcgggagcagtgccgaagttctgtttatacggctggctcatgccggtcagcgtgctgccgagcaaggtgcggccatggaaaccgccgcgaaaggcgatcaccgccggacgctgggtatgggcgcgggcgatcttcaccgcgttctccacggcctcggcgccagaggtgaagaacgctgccttgtagggctcggcgccgccgatcatctggctcagacgccgggccaggtccaggtagggtctgtaggccaccacctggaagcaggcgtgggagaccttctgcaactgcgcctgcaccgccgccaccaccctggggtggttgtggccgatgttcaacacgccgatgccgccaacgaaatccagatagcgctcgccgtccacgtcccacacctgggagccctcggcgcggtcgatgaccagcggatgggcagtgaccaggccccgcggcacgaaccgatcgcgctgctggagccaatgaggtgtttcgtcgaccttgctattcatggcgttcctcatactgagccaggcaaccgggaagcggttgcgatggcttcagattaaggcttcgacggaaccgactcagccgaacttggcccctgagaaatccggatccactgttttcaccccggcaaacggcagattccttcagccccgccgaatctgccggccagggccgcgaagcgtgctgtacaaggctttcggacgcggcctttcgacagatcctgctttgccgttacggcatcatgaaagcatcccccgtcgatcaggagccgcccatggcccttctctataaagctgaccccgtgcgtggcgaacactggcgggcgctgttcgccgaacaggccccggacattcaatggcgcgcctggccagaccttggcaaccccgaggagatccgctacctggcggcctggcaggcaccggacgacctgagcctgttgcctaacctggaagtgctgttcgccctctcggccggggtcgatcaactggacctcgcgcgcctgccgccggacttgccggtggtgcgtctgctggacccgggcatcacccggggcatgtgcgaatacgcaagcttcgccgtgctcagcctgcaccgcgacatgctgcgctaccggcagcaacagctcgcccgctgctggcaggcgcacctgctgcaaccggcggcgcaacgccgggtcggggtcatgggcctggggcaacaggcgcagcagatcctcgccaccctgcggccgctggggttcgccctgtccggctgggcccgcagcacccaccgcatcgacggcgtgcagtgcttcgccggcaaccagcagttgccggcctttctcagccagtgcgacatcctgctgtgcgtactgcccctgaccgaacagacccagggcatcctcgaccgcgagctgttccgtcagctaccccgtggcgcggcgctgatcaatatgggccgtggcggccatctggaggaacaggacctgctcgacgccctggccagcggccagctcagcggcgcggtgctcgacgtcctgcaacaggaaccggccccggccgaacacccgttctgggatcacccgcagatcctcctgaccccgcacatcgccgccatgacccagccgcaaagcgccttcgccgtgctgctggacaatatccgccgccaccagcgcggcgaaccgatgctcgggcagatcgaccggacccagggctactgacccccacgatcgctgtagccgctggcgcagcctgcgatcggcggcgcagccgtcgcaaaaccgctgatcgcggtgtatcaggccgacccgggatacagccttggcgggctagcgcccgatcgcagccttcggcagcggctacaggggccggcgttcgccaggaaaaaccgagatcgatgtagccgctggcgcagcctgcgatcggcggcgcagccgtcgcaaaaccgctgatcgcggtgcatcaggccgacccgggatacaggtttggcgggctggcgcccgatcgcagccttcggcagcggctacagggcttcggcaatcgccgcgccgacgtcttgggtcgaggcctggccgcccaggtccggggtgatcgggccctgggcgatcacctgttcgatggccttgagaatgccgtcgtgggcgtcgcggtagcgctgctcgccattgccgaggaaatccagcatcagcgcgccggaccagatcatcgcgatcgggttggcgatattgcgcccgtagatgtccggcgccgagccgtgcaccggctcgaacagcgacgggaagcgccgctgcgggtcgaggttggccgaaggcgcgatgccaatggtgccggcacaggccgggccaaggtcggagagaatatcgccgaacaggttggaggccaccaccacgtcgaaacgctccggttgcaagacaaaacgcgcgcagagaatgtcgatgtgctgcttgtcccagctgacctgcgggtactgctcggccatcagcgccgtgcgctcgtcccagtacggcatgctgatggaaatcccgttggacttggtcgccgccgtcaggcgcttgcgcggtcgggcctgggccaggtcgaaggcgtactggagaatgcggtccacgccacgccgggtgaacaccgactcctgcagcaccaactcatgctcggtgccctcgaacatcttgccgcccaccgaggaatactcgccctcggtgttctcgcggatcaccacgaaatcgatgtcccccggctcgcgcccggccaacgggcacggcaccccggggaacagccgcaccgggcggatattcacgtactggtcgaagtcgcggcggaacttgagcagcgaaccccacagggaaatatggtccggcaccttgtccggccagcccacggcgccgaagtagatggcgtcgaaatccttgagccgctcgaaccagtccccgggcatcatctgcccgtgctccaggtagtaatcgcagtgcgcccagtccagcacctcgatctccaggtccagccgccacttgtgcgccgcctgccgcagcacccgcaacccttccggcagcacttccttgccgatcccgtcgccggcgatggcggcgatcctgaatgccttgctcatgtcgcatgtctcctcgaagtcggtgcgggcgggtcacaggccgccgatgtggaacgccttgatctccaggtattcgtccaggccgtacttgctgccttcgcggcccaggcccgattgcttgatgccgccgaacggcgccacttccatggagatgatcccggtgttgaggccgaccatgccgaactccagcgcttcgccgaaacgccaggagcggcgcaggtcctgggtgaagtagtaggcacccagcccgtagggcgtggcattggcgatggccagcgcctcggcctcgtcgtgaaagcgcatcagcggcgccaccgggccgaaggtttcttcatgggccaggagcatctcggtgctggcctcgcccagcaccgtgggcagcacgaactggctttcgccctggggaatcgcgccgcacagcagggtcgcgcccttgcccagggcgtcgtcgatatgccgggcgaccttgctcaccgccgcggtattgatcagcgggccgatgctcacgcccggctccaggccgttgccgaccttgagcttggccacctcctccaccaggcgctgggcaaaacgtgcgtagatgccgtcctggaccaggatgcggttggcgcagacgcaggtctgcccggcgttgcggaacttgctctgcatgatcccggcgatcgcctgttccaggtcggcgtcgtcgaacaccacgaacggcgcgttgccgcccagctccaggctcaggcgcttgatgtgctcggcgctctggcgcatcagcaggcggccgaccgcggtggaaccggtaaaggaaatcttgcgcaccgccgggttgccggtcagctcttcgccaatcccggcgggcatgccggtgagcacactgaacacccccgccggaatccccacccgctcggccagcaccgccagggccagggccgacaacggcgtcaggtcggaaggcttgacgacgatcgggcaaccggcggccagggccggcgcgcatttacgggtaatcatcgcgttggggaaattccacggggtgatcgccgcgcagacccccaccggctgcttgagggtcagcaagcgccggtcgccagcgggtgccggcagggtgtcgccgcagatgcgccgcgcctcctcggcgaaccatttgacgaaaccggcgccgtagcggatttcgccctgggcttcggcgaagggcttgccctgttcggcggtcatgatcagggccaggtcgtcgaggttgtcgagcatggcctggtaccagcgctccagcagctgtgcccgctccgccgccgggcgcgcgcgccaggccggccaggcgcgttcggcggcggcgatggcctggcgggtctgcgcgccctgcagggccgggacccgggccaggcattcgccgctggccgggtcgagcaccgccagggtcgcgccatcgtcggcggccacccactgcccgtcgatgtaggccagttccaccaagaggctggggtctttcaaacgattcttgagcatggtcgagtcctgttccgagacagcccccagtctaagcaggcaccgcagcccaggatgctgaaagcgccgggccgacagcgtcggatgctgaaaaacgcggcgtcacagcaggctctaccgagaacctgaacaccgccctgtagccgctgccgaaggccgcgatcggcggcgcagccgtcgcaaaacagataaccgcggtgcgtcagatcgatccgggattcaggcttggcgggctcacgcccgatcgcagccttcggcagcggctacaggggccggcgttcagcaggaaaaccgggatcgatgtagccgctggcgcagcctgcgatcggcggcgcagccgtcgcaaaacagataaccgcggtgtatcaggccgatccgggattcaggcttggcgggctgacgcccgatcgcagcctgcggcagcggctacaggtgacggctcagcgtttcagggaacccagcaagccttcgagaaaacgctggccggcgtccatctggctgacctcgatgaactcgtcgggcttgtgcgcctgctcgatggagcccgggccgcagaccaccaccgggatgtccaggcgctggttgaacaggccgccttcggtgccgaaaccaaccttggcgtagccggtgccgggcgcggcgaagtcgtggaggaaacgcaccgcctcgacactcggatgggtctccagccccgggtagacattcagggtttcgatctcgatggccgccacctcggaaagctggcgcgcctcgcgcacgatcagctcggcgcgttcgcgcatctggtcgaggaactgctcaagatcgtccgccggcaggttgcgcacctcgaaatccagggtgcacaggttcggcactatgttcagcgccttgccgccgccgatctgcccgacgtgcacggtgctgtagggaatgtcgtagtcggcgtcccgcgcgccctgctcgcgcaggcgctgctggctgtcgcgcaaaccggcgatgaaatcgcaggccaggtgaatcgcgttggccgccagcggcgccagggaggaatgcgcttcctggccacggcaatggacgcggtacgagcccttgcccttgtgcccgagcacgaactgcatgtgggtgggttcgccgatcaggcacaggaacggccgcaccggcgccaggtgcagcacgtccagcagccgtcgcacgccgacgcagccgatttcctcgtcatgggacagcgccagttgcagcggccgactcaaggtgcagtccgcggcatcgagcatggcgtctatggccagggcgataaaccccttcatgtcgcagctgccgcgcccgtacaggcgcccgccctgctccgtgacctggaacgccggcaggctccaggcctggcctgcggcgggcaccacgtcggtgtgcccggacagcagaatccccggcagttcccggggcccggtgctggcgaacaggttggccttgcgcccgctttcgtccttgacgatcaacgactcgatgcccttgcccagcagcaactcgcgcacgtattcgatcagcgccaggttcgactccgaggacagggtgtcgaaggcgatcaggcgcttgaagatctccagtacccggggtttcatgaggccttgctccgttgtgcggtggtgccggcgaagcggcgaatcgaaaaggcgtcgatcgaggtgccggtgctgccggtggcgatcagctcggccatcacgtcgccgacgcccgggccgagctggaagccatggccgcagaaaccgaaggcgtagtacaggccgtcgacctggccgctggggcccatgatcggcaacgaatcgggtagatacccttcgatgccgctccacacgcggatgatgttgaggttgccgacgcccggcagcagccggcgcatctgctggatctggttgaggatgctgcgcggttcgacctgggcgcgccgtgtgagcatgtccggtttgctgcggtagccgccgccgatgatgatgttgccgcggggaatctggcggaagtagatcacctcctcggggatcttggtgtagaccccgatcaccgtcggcaaggcgtaaggcaccggctcggtgaccgccatctgcgggccgttggtgtccagcggcaccggttcgccgaactgttcggagagcttctggccccaggcgccggcggtgatcagcaggcgttcggcgctgaactggcggccgtcggtggtgccgaccaggaacccgccgccgaccttctgcacctcgctcacctcggtgcgttcttcgatccgcgccccggcgcgcactgccgcccgggcaaaggccggggccgccaggcgcgggttggcgtggccgtcatggggcgcgtaggagccgcccttgacgtccggcccgagaaacgggaaacgctcgtgcagctcgcggccgcggtagatctgcaggtccagctcacgcgcctcgggcgccgcggcataggtttccagctcggcgatctcgtcctcgcggtagcacacccgcatatgcccgctggcgatgaactccaggtcgtcgtcgatcagttccggcaggcgcttccacagggcccaggaacggttggccagctccagctggccgagataacggccctggcgccgcacgttgccgaagttcaccccgctggcgtactggccgatctggtcacgctccagcagggtcaccgactggccgcgccggcgcaggaaaaacgccgccgccgagcccatcaggccgccgccgacaatcagcacatcggactgttgcacggtcatggcgtcacctccccggtgagcatcgaaaggggtttgaccggggcctggccgcgctgccggcccacctcctgcaccgcgaccccggccgcggcggcgatcacctcggccccggcctgggaacagtagcggccctggcagcggcccatgccgacgcggctgaaggccttggcgcggttgacctcgcaggcgcccttctcacgcacggtgcggcgcagttcaccggcgctgatcatctcgcaccggcagacgatggccgtgtccggcagtgccttggcctgggcgctcggccagggaaaggcctgggccaggccgaggcggaactggtccatcaccgccagggcctggcgctgttcgtccacttccgcggcgttgaccggcagttgcagatcctcgagcagtgccagcgccgagaggcgcccagcgtgttcggcggcgtcggcgccacggatcttcgccccgtcgccggcggcgtagaccccgttgacgctggtgcgcccggcctcgtcgagttccagcagccattggctggacgccgggtcgaaggccaggcggcaaccggcgaggtcggccaactgggtttccgggcgcaggtgatagcccagggccagggcatcgcactcgacatccaggctgtcgcccttggcggtcttgacctgcaccaggctgaccccgccctgggcatcgcccagtacccggatcggctggatgcccaggtgcaccgggacccgggccaggcacagccgcgccagcagcttcatgccggtccagagcaatcccgggcgcgccagcagcttcggcaaggcgccgatgcgcttgcccagcggcgaggtgtcgagcaccgcggcgacctgcgccccggccttgaggtactggctggccaccaggtacagcagcggcccgctgcccatgaacaccacgcggtggccgatggacaccgactgcgccttgagggcgatctgcgcgccgccgaggctgtaggtgcccgccagttgccagccttcgagcggcatcaggcggtcggtggcgccggtgcagaggatcagcgcgtcgtagtccagggtgaagtgccggccctggctgacgcagcacagctgccccggggtcaggttccacgccagggtgtccgggcgatagtcgatgcgcgggcgcaggcgctcgaagctgtcgtgcagggcccgggccttgtgcgcttcgctgccgtacagggtggcgtagtcgcggcggaaaccttcgggctggcgacggtagatctgcccgccgtcacggcggttttcgtcgaccagggtcggcacgataccggccgccagcagggtttcggcgcagcgggtgccggccggaccggcgccgactatcaccacccgcggcgcgctgccggacgggatgttcagccgtgcagtggccataccgcctccggttgtgtggtgagaatgtccaggccctcgcggacctcgctggaacaggcgcgcaggcgctcgccggcgcgggtccagacccagcagtcctggcaggcgcccatcaggcagaagccggcgcgccggccggaatcgaactccgactggcgcagggccgtcccctgggtcagcaacgccaccatcagcgtgtcgccctgcaatgcctcgatgggctccccgtccacccgcagccgtaccggcgcccgttcgcgctcgcccagccgtacaaaacgccccttcatgcgtaggctccctcggtcatgccattgaagttctgttggctctgtagcaactcgccgctgtcgcggtggcagaggatctcgctgccgccgtcgatggcgcggcggttcggcgcggtgcggttgcacaggccgtcgatgcgcaccgggcagcgattgaggaaggtgcacagctccggcacattggccttggcgccgatcggcggcaggctggcgcaggtgctgccgcagctttccagccagccctggcacagctccggcaccgagtggatcagcaggtcggtgtaaggatggaacggcgcctggccgaaggccgcgcggccgccggcctcgaccttgtgcccgctgtacatcaccacgatgtcgtcgcacagcgcgcgcaccgtggaaatgtcgtgactgatgaacaggtaggacacccccagctcctggcgcaggtcgcgcagcagttcgagaatcgccgcgccgaccacggtatccagggccgacgtcacctcgtcgcaaaggatcaggtcgggcttggccgccagcgcgcgggccaggttgacccgctgcttctgcccgccggacagctcgttgggccgccgctgcgcgagcgtgcgcggcagccgcaccaggtccagcagctcgtcgatgcgctggcgcagcgcggcgcccttgaggccgaaatacatcttcagcggccggctgagaatggcgctgacgctgtgcatggggttgagcgcggtgtcggcgttctggaacaccatctggatccgccggaactgctcgtcggtgcggctcgacaggctgccgcccaggggctggccgtcgaaggtcaggttgcccagggccggggccagcaggccggccaccacccgcgccagggtcgacttgcccgagccggactcgccgatcacgccgatggcctggccacggcgcacggtcaggtcgatgtcctccagcacgcggatcatcggcatgccttgcaggttcttgttgccgtagccggcggtcaggcccttgatggtcagcagcggctggtcctcggcgatatcgctgggcgggcgaatggtcgagtccgggcgcgcggccgccagcaggctgcgggtgtaatcgtgggccgggccctcgagcagcggcgcggtggcgctctgttcgaggatctggccgccgttgagcaccacgatctgatcggccatctgcgccaccaccgccaggtcgtgggacacatacaccgccgtggccccgcgttcgcgcaccacccgtttgaaggcgcgcagcacgtcgatctgggtggtgacgtcgagcgcggtggtcggttcgtcgaggatcaccagcagcgggtcgctgatcagcgccatggccgccatcacccgttgcaactggccgcccgagacctggtgcgggtaacgctggccgatgtgttccgggtccggcagggccaggtcgcggaacagctcgatggccttcgcctccaggttggcgcggctgtccaggccatggatcagggcgccctccagcacctggtcgagcaggcgtttcgccgggttgaaggccgccgccgcgctctgcgcgatgtaggacacgcgattgccgcgcaggccctgcaactgttcctcgcccagggccagcatgtcgtgttcgccaacccgcaccaccccggacgccaggcggcaaccgcggcgggcataccccagcagggccagggcgatggtggtcttgcccgagccggactcgccgatcagcgccagcacctcgccctgctccagggcgaagctcacgcccttgacgatctccacttcaccgccctcgccgtcggcgaccacccgcaggtcttgcactcgaatcaactggctcatttcaatgacctcccggacggcggctgcggcgcgacgagatcctgtcgatgaacaggttcacgccaatggtcagggtgccgatggccagcgccgggatgacgatggccggcgcgccctggttgaggccgccgatgttctcgcgcaccagcgaaccgaggtcggcgtccggcggctgcacgcccaggccaaggaagctcatgccgctgagcagcaggacgataaagccgaagcgcaggccaaggtcggtgagcaccgggttgagcatgttcggcagaatctccacgcaggcgatgtacagccggcgctcgccgcgggtgcgggccacctgcacgtattccagggcctcgatattcaccgccaggctgcgggcgatacggaacgccccgggggtgaagctcagcaccgcggtgcacaccagcagcaccaccgaggagccgaaggccgagaccatgatcagcgccagcatcttgctggggatggagataaaggcgtccatcaggcgactgatgacttcatccagccatttcggcgcgaccaccgcgagcaaggcgcaggcggtgcccaggccgctggccaggaccgcggaaatcagcgccaggccgacggtgaagcgcgcgcccaccagcacccggctgagcatgtcgcggcccaggtaatcggtgccgaacggataggccgcgcccatggcgtcgaacacattggcggacaccacttcgcccaccgggtgcggcgccagccaggggccgaacagcgccaccagcagccacagcacgcacatcgcggccccagtcaggccgagccaggaaggcccgtgggacaccttgcccagcgccaggtcaggcgtggccggcgtcgacttcaccatgagattggtcattggtttctcagcctcggattggaaagaatcgcgcacaggtcggcaatcagcaccaagcccaggtaggccgtgcagaacagcatggtgcaggcctgcaccagcgccatgtcgcggttggtcacggcgtcgaccatcaggctggcgatcccgggatagttgaagatggtctcgacgatcaccaccccgcccagcaggtacgacaggctcagcgccaccgcgttggcgatcggcccgatggcgttgggcaaggcgtggcgcagcacgatgcgcaccgggctgacgcccttgagccgggccatttccacgtaggggctgtcgagctggtcgatcaccgcggcgcgggtcatgcgcgccatctgcgcgacgatgacgaagcacagggtcatcaccggcaaggcgtaggtgcgcaggaactgcagcggcgagtgggtttcgccggcgtaggacaaggccgacagccagcccaggttcaccgcgaacaccagcaccgccagggtcgccaccaggaactccggcaccgccaccagggccagggtgatgaagctcaggaggctgtccaggcgcccgccgcggcccatggccgagccgatgcccagggtcagtgccagcggcaccgagaccaccgcggtcaccgccgccagcatcagggtgttgggcacccgtccggccatcagctcgctgaccggcatggcgttggacaccgaggtgcccatgtcgccggccagcaggctgagcagccagtgcaggtaacgcaccacaccgggctggtccaggcccagtttcaggcgcagcgccgccacctgttccggcgtggcgaactgccccagggcctgttgcgccgcgtcccccggcagcaccgcggtgatggcgaacaccaccatggacacgatcaacaaggtcacgaccgcggcgcccatgcgtcgcgcgatcaaccacagtgtgttgctattcatcgcccttccctcctgccttgcagccccgacggaacctgctttcgcccctcacgcgtccagccacacctgctcggcgaacatgtagcccatgaagccgcccagggggttgctgccatagcccttgatgcgctggtcgaccccgtcgatgttgctgatgaacaccgggatgccgatgccgcagtggtcgtgcaccagggtctgcatgtcggcgtacatcgtgctgcgcttggcgtcgtcggtctcgccgcgggccagcatcagcaactggtcgaactgctcgttcttccagcccgactcgttccatggcgcgctggactggaagaactgcgagaagatcacgtcggcgttcggccgcgggttgatgttgccgaagctcagcgggtgcttcatccagtggttggaccagtagccgtcgctgggcaggcggttgacgttgagggtcagcccggcctgcttggccgactgctgcaagagcacggcgatgtccaccgaaccggtggcggccggcgaggccaccagcggcatgctgaccttctccatgccggcctttttcagcaggaaacgagccttttccgggtcgtacggggtctgcggcaggtcggcgttgtagtaacgcgaacccggggcgatcgggtggtcgttgccgaccacggcgtagccacggaacaccgcggacttgacctgttcgcggtccagcaggtgcttcagcgcctgggtgaattccgggctctggccgggcaactggtcctggcgaatgatcaggtcggtgtagttgcccgacggcgcgtccaccacccggtgcccggcgctggcggcgatgcgcgcggtggaacgcgggttgacttcgttgatcaggttcacgtccccggagagcaaggcgttgacccgcgacggctcgtcggcgatggcgatgaactcgatctcgtccaggtacggcaggcctggcttccagtagttcgggttgcgcgcggagaccgagcgcacgcccggcttgaactccttgaccttgaacggcccggtgccgatgccctggctgaagtcggtggtgccttcgggcacgatcagcaagtgcgagaccgcgaggatcgacggcagctcggcgttcggcgccttgaggcggatctgcacctcatgggtgccggtggccttgatctcggcgaactgctccatcagcggcatgaccttggaaccggtggccgggtccttgtgccgcgacagcgagaacaccacgtcggcggcggtcaggcccttgccgttgtggaaggtcacgtccttgcgcagggtgatgatccacaacgtggcgtcggtattgtcgatgcgctcggccagttccagctgcggcaccaggtggctgtcgaagcgggtcaggccgttgtagaacatgaagtgccgcacatagtcggtggacagcgcgccccgggccgggtcgagggtgtcggcggtggaactggacatcccggcgacgcggatgcgcccgcccggcttgcccttgcccggcaccgcgctgtcgctggcgagcaaggtgccggcactgccgaacaggctgccggcgcccgcggcggcgacaccggccacgccgagcatgcgcaaggcgctgcggcgggacatgccacggttcaggccttcgaaaacccgcaggctttcttcgccggaaatcagttgcggatcgactttgttgtcagtcatagcagttctacctgtcgaataatgagagggctcgagtgctcgcggttgaccggagcgtcctgaaaacgcaaaacgacggtgaagcaaactcagtgcagatagtcctggaagcggtagtaagcccctaccagcggcaggaaccagggcttgccgaagtgcccgggaatcgccggccatgccaggtcttgccaggggttgagggatggattggcgccgtccatgacctcggccatgacctggcccatgtgtaccgacatctgcaccccatggccgctgtagcccatggcgtggtagatgccgttgcgttcgccggcccggggcagccggtcgctggtcatgtccaccagcccgccccagcagtagtcgatagcgaccccggccagttgcgggaacatctgcaccatggccgcctgcagcaccttgccgctcttggcatcggaactcgggctggacatggcgaagcgcgcccggccgccgaacagcaggcggttatccggggtcaggcggaagtagttgccgatggtgcgactggtgacataggagcgctgctgcggcagcagccgctcgaccagggcctgcggcagcacctcggtggtcaccacgaagctgcccaccggcacgatgcgccgccggtaccagccgaggtcgccatgctggcaggcgccggtggccagcagaatctgccgcgcctgcaacgaaccgcgcgcggtgtcgagccggtagccgccactgttgccctgccagccttggaccgcgcagtcctgatagatcagcgcgccatggcgcgccgcggcgtgcgccaggccgatgccaaagcgcccgacgtgcatctgcacgccgttgcgctgcaacaggccgccgtgaaaaccggcggaatcgacttcgccgcgcacctgctcggcggacagcagctcgacatcggcatcgacctcgcggcggatcagctcgcaggtgcgcgccagcccttcgtaatgcaggggcttggccgccagcttgagcttgccgttgcgcttgaggtcgcaaccgatgccctcctgcgccaccagcgccaccacgctctgcaccgcccgctcataggcctggtaataggcccgcgcgcgttcggcgccgaggctggcgctgagggcggcgtaatcctgggccaccccggtgttgcactggccgccgttgcgcccggaggcttcgccgatcacccggccggcttccagcagcaccacccgggcgcccttcatggccagcgcacgggccgcggacagcccggtgaaaccgccaccgacgatcgccacgtcgacgctgtccggcagcgcgccgctctgtgccccggtgaaggccggcgcactgtcgagccaataggattcactgcccatgcctgactccctgaccctgccttgaagaacgcccatgaccgatcagagcccgaccagcccagccaggccgccgatgtccgggatctgctggtagccgtagatggcgttggccggctgttcgtggccacgggcgacgaaagccttgtgcttgatcttcatgtcgtgggccggcatcaggtcgtaacggaagctggaggacacatgcaggatgtcttgcgggccgcaaccgaggttgtcgagcatgaactcgaaggccgccaggcgtggcttgtaggcttgcgcctgctcggcggtgaagaccttgtggaacggcgcgccgagcttgtcgacgttggacatgatctggctgtcgctggcgttggagaagatcaccagggggatcttgtcggcgatcttcgacaggccggccggcacgtccggatgagggccccaggtcggcacggcgtcgtagtacagctggccttcgccgcggtactcgacgccccagcgcttgcaggtccgcgccagcgcggtcttgaggatctcgtcgtagggtttccagtcgcccatgacctggtccaggcggtaggccgagaagtccttgacgaactggtccatctgttcagggccgacgcggtcggcgaacagctcgcgggtcatggtgcccatgtggaagttggtcagcgtaccgtagcagtcgaacgtaatgaatttgggacgaagaaagctcattgagtgcggtcctgaagttcgttgaggtcatggcgtgacacgcaagggcgcggctgccggagccctgatgcagcgttgcaatcacagcttcattacaacaccgtgaaatcagcagatggcgttaaaagcgcgggctgctcgatacaaaccaccgtttttcggggtgccctcagcagactttgcggggcgcgccagccttgggcaaagcccgtattcatgcgcttttatggacctttgccggccgccggggctcaagtccgggcccggtcgccgcagaacctgcgccggccccaacgaaaacgggcgcccccgtctggaagcgcccgtttcgctgaatcgcagagtgtctgccggtcgatccccaaccggtggcggccggcctgcggccgcgccggcaggttcaatgcatacttcgtaccgcgccgctcacccgcccctgtcgatcacggttttcagccggcgatatcgatcagcacgctcttgaagcgcaggttggcctcgaaggcttcgcgccccaggtccttgccgatgccggagcgcttgtagccgccggtgggcaggatgtagtcgttgctgcgcccatagcggttgacccacaccgtgccggcttccaggcgccggaccaggcgcagggcgcggttgatgtcggcggtgtgtactccggcggccaggccgtaggtggcatgctcggccagggccagggcctcggcttcgtcgtcgaaggcctgcaccgtcagcaccgggccgaagatctcctcgcagaccgccgggttgcggttgtccaggccggtcagcagggtcggctggtaataggcgccgcccaggccgtcgaacagcccgccgccgcagagcacctcggcgccggcctggcgcgaacgctggacgatgccgtcgatgcgctgggcctgctgccgggaaatgatcggcgacagcgtgctggccgacgaccaggtcggccccgggcgcaattgttcgaagtacgcccgcaggtgctcgacgaagggctgcatgatcgagcgttcgatcagcagccgcgagccggagacgcacacctgcccggcgttgccggtgatggccatggccacggtgcgcgcggtcctggcgaggtccggcacgtcggcgaacaccagttgcgggctcttgccgcccagctccagggtcaccggcttggggccgaccagggcgcaggtggacatgatgctcgaccccgtggcggtggaaccggtgaaggtcaccttggccacccgtggatgacgacacagggcatcgccggtgacccggccgtcgccctgcaccacgttgaagatgcccgccggaaccccggcctgcagcgccagttcggcgaaccgcaggctggaaaacggcgtcagctccgagggcttgagcaccaccgcgttaccggcggccagggccggggcgactttccacgaggccatgctcagcgggaaattccacggcgcgatggcggcgatcaccccgtagggttcggcgatctgcatgcccaggcggtcggtctgggtggcggccagcgaaccgccgtgcttgtccgccagctcggcgaaaaagcggatgccttcggcgacatagggaatgtcccagccgatcacatcctggtgcggccgagtcgaacccaccgcctccagcggcgccaggatcgccgcgtcggcttccaccaggtcggcccagcgccgcatcacccgcgcccgctcccggggcggacggctggcccagtcggagcgggcgaaggcctgccaggcgttgttcaccgcctcgtccaccagcccggcgtcggcgatcggcaactgcccgtaggcctggccgtccgacggtcgcgagacctccagcccgggcgcggcgtcgcggtactggccggcgatgaaatgagcgctgcgcacagcgacaagacgaggatcgaagctatccatggagcactccacttgaaggcggcaataaggtcggcgaaggccggcccggccggtaaaaaccaggcctccatcctaggaaaaaagcccaagcatttgctgccgaccttgggccccttttaagtagttactgtggtctgccggccggtcttttagggattctgccgaatcgccgcggggctcttgccaggcgtgatcgcagatgggatacaggcgcatcgccgacgatcgcgcttatctttttcacggagtcttgccatgtccgccacccctcgccctgcttatgtgtaccgcccgatgactgtcgccgacttgccggcggcccacgccctgtccgtgcaattgaagtggccccatcgcctggaagactgggcgatgttgcagcgggtcggccagggcttcgtggtggaagacggcgagcgcctgatcggcagcgccttcgcttgcctgcaaggggactacgccaccatcggcctggtgatcgtcagcggcgactaccagggccagggcatcggccgggccctgatggaaaaggccctgcacgcctgcgagtcgcgcacgccgatcctcaacgccaccctggccggcgcgccgctgtatgccagccagggcttcgtcgagttcggcgtgatccagcagcatcagggccaggtacgggtgccggaggtgggcgccctgcccgccggtgaaagctgccggccgctgcgcaaggccgaccgcctgcgccagttgagcctggccaacgccggcagcggcctggaccgccagcaggtgctggaagacctgttcgcggtggtcgagcatggcgtcggcatcgaacgcgacggccagttgcgcgcctttgccctgctgcggccgttcggccgtggccgctgcatcggcccggtggtcgcggaaaccgccgagcaggcccggcagatgatcgccagcctgctgagcaaggttgccgatgccttcgtgcgcatcgatattccggccgactgcggcctggccgaatggctggaaaacgccggcctgaaacaggtcgaccaggtcgcgcagatggcccgcggcaccccgccccgggcgctcggcaacgtgcgccagttcgccctggtgacccaggccatcggttgacccacaacgccgcgagcccctgggtcgcggcgccttccccccccttccagagagtcctttacatgtccacacccgccgctttgctgctggcaggcgccgacggccgcttcgacgccagcctgttcacccctgctgccctgggcagtgacgaccccttcggcgccgatcggctggtcgcctataacggcagcgacggcattgccgccggtgtcgtgcgcaccagcggacgttttgccagcgaggatttcccccacatcgaaatgctcgtggtgcacgccggcaaggtgttgctctacagcgccgagccatctggggaactggccctggaactggcccccggcgccagcgtggtgatcggccgcggcagcgccttcaagctcgaggccgagcccggcacgctctgggccttctgcgcggtaaaccgtgccgcggcgggcgccgaaccgggcctgacgctgctcgacccgcgggccatgctctcgccctcggcggctcccgagccgcagatcctgatcggcgcggaaccgcaatgccgctcgcgcaacgccttcgaggacgacgccagcgacctgcggatcggggtttgggattccacgccgtaccgccgccatggccggccgcacaagctcaatgaactgatgcacctggtggaaggcagcgtgaccctcgagggcgcggacggcagccgcctgagcgccggccccggcgctacgctgttcgttgcccagggtacgccctgcgcgtggcacagcacggcctatgtgcgcaagttctatgcggtgaagtaaccccggcacacacgacaacggcgccctcgggcgccgttgtcatatcgggcgaaaagcgcccggcgactcaatcatcatcgtcgtcatcgtcacggtcgcgacgatagcgcccgtccttgtcccgtcggtcgtagcggcggtcgtaacggtcgtcgtcacgatcgcggtcgcggtcgcggtagtaatcgcggtcataacggctgtggtcgcgccaaccgtcatggtcgcgatcgtagcgtcggccgtcgtcccagtgggggtagcagccacccagtagcagcgtggagcaaagggtcagggtgagtgtcgcgagtcgcttcatggcagtgtcctagaacctggggcagaacgatgggttggcaaagctgcccggcaacgcaacgggccctgtgcgaaccggcggcgccggcacctgcaaccacccatgtgactgtaaaaccagcgttttattcgatcctggcgaggcactggcggaccgacggtcatgtcttgtccaatgtgaacggtcacgcctgctcaatgggaattcctgtcccacagccagttccacagccccggcaagcgcaccggctgttcgctgttgctgacagtacgggccatgaccgcccgttgcagcgccgcggtatcgtcgtagaacggcttgggcgcggtcgcaaggccagtggcctgagcgctgtcgagcaggatctgcaggtattcccgggtgtggcgggcggtgtagcgattgaggtcgtggaaggtcaccaccaccgggatcgctccgtccaccgtcggcaactggcccagggcaatgcgttcgcgcacttccgacagctggcgcagcatgttggcccggcgccgtgggctggcgttgaagccccagaccttgccgtcgttggcgctgaggtcggtcagcaacacatgcaggccatgccgttggtaggcggcgaaagtgcgcttgtcgtagttccagaatggcgggcgcaccaggttcggcggcacaccggtgatcagcgcgatatcggcgctgccgttgttcagggacgcctccagttccggcgggtcgagcgagcgatggttggtgtgcctcggcgtggcggtatgaaagcccagcacatggccctcggcatgttcgcgggccatcagccgccggccgatgtcgctgccgccggcccgcgaggcccgggtctggacgaagaacaccgccttgatcgccggttgcaacgggttgtcgagcaggtcgtcgagcacccgttcggtcgggttgtagaaactggaagcgctggggccatcgtcgaaggtcaacagaaagcggatcggcgcctgggcgcgcaggcgttgctcggtctgcgcggtcatttcgatgggagcagcaatgcaaccgcccagaccagcggcgagcaacactgcgcagagaagcttgaagccttgtttcatgttttgccctgtgccggaccgttgcggtcgtcacctcaatggcaaaaatccctcgcccatggatccctcgcccggcctgcacgcagcgccgggcacagcttggaggggcaacggcggttttggttccggagcgcccgcgttcaggcagcccgggccttcatgccgaaccgccttcgcagggtcgctgccaggcgcgctgcaacaggtcgatcacctcctcgtccgaggtctgggcaaagtccgcgtaaccattgccgatcgacacgaaccacaggggcgtgatcgggcagatcaactcgtcgacctcgaaactcagggtgtcgacggtttcctgcggcgccaggggcacggccaccacgatccgcgccagggtgctgcaggcgcgtcgcctgtaccgcggcgtgcatcgaggcgccagtggccagcccgtcgtccaccaggatcaccacctggccacgcaggtcgggcgcgggccggtcgccacggtagacccgttcgcggcgctgcaactcctgggtttcccgtacggtcaccgcttgcagcgcggcatcaccgaggtgatggctgctcaggacgtcctgattgaggatgcggataccaccgctggcgatggcgcccatcgccagttcttcatggccgggcacgccaagcttgcgcaccagcatcaggtccagccgcacctccagggcccgggcgatttcccaggccaccggcaccccgccccggggcaacgccagcacgatcacctcgggccggcgactgtatttctgcaacggcgcgaccagcccttgcccggcggcctggcggttgcgcagggtcatctgcaatgacggatattcgctcatgtctcacctcccaaggcgcccggctacagcgccagcaggctgcagggcagctgatacagcgcgtgctcggtggtgctgcccaccagtttctccaggccctggcgatgcacgcggcccatgaccagcacgtcggcctggctctcggtaacgaagttggccagcacggtgaccggttgtccgaggatgaaatgccggcgttcctcgggcacgccataacgctcggccagttccaggaaggctttttccagggtcacccgcagttcccgggtcaggtccgccaacaccaggccaccgcccccggcatcgcccaggtagaccgacgacacgtcataggcgtgcagcaggtgcagctcggcatcgcattgcagggccaggctgttggcttcgtggatgatccggtcgttgagcccgttgtgctggtactccggccgtgacgggtcgaccgccgcgaccaccatttgcggcaacgtatggccgtggcggcccatgagatacagcggcaccgggcactggcgcagcaggtgccagtccatcggcgtgagaaaggcgcgtttgagcgccggttcgtgctgcacgtccttgatcagcaggtcgggctggatttccgcgacgtgctgcaggatttcctccagcaggtcgtcggcccaggccacctcgccgttgaccgtgacaccatggccgcgcaggcgatgcacctcctcctgcaaccattcctgatgccccaggcggtaacgttcgcgcgcctcattgcgcacgttgtgctcgaacagggaaagaatcgacgccggtttcagcaaggccgcgatatgcaggctcgccccgctggccttggccagggcagcggcacgcgggatcgccggggactggcgcattgccgggtcgatgaccagcagcaagcgttgatactggctcatggcgcacctccagataggctggacgcccacgccggccaccggcgcccgcttctctatacgccagtgcgtcaacgccggatcgaacgccagcatgacttcagacttcccactgacaatgcgcccgtcgcggcgttacggcaagtgcgtccagcgccggtgcagaccacgggccaggctgtccagggcaaagcccagggcgccgatcagcaggaccatggccatcagttccgaataggccaggcggtcgcgggtatcgaggatgaaatagcccaggccggcgctgacgccgagcatttcgcaaggcaccaggacgatccacagtatgccgatggccaggcgcacgccggtcagcacatggcccagcaccccgggcaggatcaccttgcgcagggtttcccagcgggtggcgctgaggctgcggctcagttgcagccagcgcgggtcgagctggcgcaccccggccgcggtattgagcaggatcggccagaccgcggcgaaggccagcaggaagtagatcggctggtcccctacccccatcagcatcaccaccaccggcatccacgacagcggcgagatcatccgcaggaactggaacgccggggtggtggccgcctccaggtggcggtagctgccgatcagcagacccaggggcacgccgaccagcaaggccagggccaggccgaccaggatgcgcttgaggctgaccagcacatgctcgtacagctcggcgcggcccagcagttccagcaggctggccagggtcgctgctggcgaaaagcgcgccgcgagcccgtcggcgctgccaaacaggcgcacccccaaccaccacaacagcagcaggcacaacagccccgccacgcccagcagcccatgcaggctcgatgcggatcgcttggccatcagaggctgaactcctcgctgcgttcgaagctgtcgggcaagccgaatgccttgagcccgcccaccgacgcgatggcgttgcgcacgaagcgctcgtccaccagatcgcgggcggtgtgctgcgggtcgaggctggccaaaaagcccttgtcgccttcgatcagggtgtccttgaggcgcttgactagttcctcggtgtagctggggaacgggtacggctggaaatcgatgcgctgctcgtcccactgcgcgtgctggatcgcgccgtcggccaggtactgctggcgttcgctggcactcggcgccaagacccggctcaacacctggggcgcatgcggggtgtagcggttggcgccgtcgcgggacagcagactggcggcctcggcgcggtggtcgcgggtccacaactgggccttgacgatggcgttgaccaccttctgcgaccattcggggcgattgttcaggtcctgctcgtgcatgaacaccacgcagcaggcgtggttgcgccagatatccccggtaaagcgttgcacccggccgaccttgagctcctcggccagggcattgaaaggctcggcgactatgtagccggcgatgcgcttgctggccagggccggcggcatgtccgacggcggcagcaccagcagattgacctcgttggctgccagcggactgctggctggccggctcaccggggtcaggccgttatcgcgcaacagttgctgcaccaccacgttgtgaatcgagtaccagaacggaatcgccagcgcctgcccacccagttgccgcacctcggtgatgcccggcgccaccgtcaggccggagccgccaacgtggttccaggccaccaccttggccggcaccttactgccatagcgagcccagacggtcatcggcgacagcaggtgaatcacattgacctgcccggaaatgaacgcctcgatcacctgcgcccaactgcgcagcagcaccgggcgctcggagcggatgccctcggcctcgaacaggccgttgttatgggccaccagcaagggcgtggcgtcggtgatcggcaggtagccgatgcgcaccggcgcgtccggctccgcggcggcgcgggcctgcaggctattgagcaacggcaaggcgccgccggcggtgagcaaggcgctgagcttgaggaagtcgcgacggctgtgggtgaagtcatccaggcacatggtgtatctccgatcattcgggcaaggggttgaacccagccattaccgccttttgcggctcatctggctcttccggctcttatgtaggagcgaagcttgctcgcgaatgacctcaacgctgacggggtgtctgggaccctgcgccgcactgaggtttttatcgcgagcaagcttcgctcctacagagacagaggttcaggctgaggcagggcttggggttgtgcagcgcggctcgcccgccgaagggttttgagaatctcgatacgcagggcgcccagttcttccaccagctcggcgcgcggctgaggtaggtcgatgcgccactcgccgagggtccgcgccgggctgttacccagtagcaggatccgctcggaaagcagcagggcctcgtcgatgtcgtgggtgatcagcagcgccgcggtgcggtgctcggcgatcaccttgagcagtagttgctgcatgtcggcgcgggtcacttcgtccagcgcgccaaagggttcgtcgagcaacagcacctgcggctggcgcgccaggcaacgggccagcgcggtgcgctgggccatgccgccggacagctgcgccgggtaatgcccgcggacatgctgcaggccgacctcggcgatcgcctggtcgatccgcgcctggcgctgccgggcgtccagcgccggctggcgggcgaaatcgaggccgaaggcgacgttgtgttccaggttcagccagggcagcaggctggggtcctggaacgccacggccacccgtggatgcggcccgtccagcgtctggcccagcaggctgacgctgccactgtggggcgcctgcaagccggccaggacccgcaacaggctggacttgccgacgccgctggggccgaggatcgacaccacctcccctggctgcaagcgcaggtcgaagccttccagcaccgcttgccagcctgcttcaccggggtagccgaggctgatctgccgggcttcgagcaaggccgcgctcatgccgccgcgtcccgggcctggcgctgcaactcggcgcgcaactgcaccaggctcggcgtgacgatcggcacgaaggccgactcgcgccagcgccgggcaaaaccgccgccatgctcgctcaggtaggccttgccgccgctggcctgcaactccaactgcacggcgttggcggcagcttcggccagggcgatgcgcagccggaacagcgctgctggctgggtcaggaaacgcccctccagcaagccgcgcttgagttcggcgacgctctcttccaattgctggcgttgctcctgcaacggctcgcgcaggatcgaacgcccgctgtgcagatgggtgtgcacttcatccagcgcgcgccgcgccaggccgatggccatgccgcattgcaggccgagaaacgccgggcgcaccgccggcagaaaggccctggcatcctcgtgcagcaaccagtcgtggccgacctcgacctgctgcagctccagcgccgcggtgttgctcgactgcaagcccatcagttgcaaatcctcggaacgttgcaagccggccaggcccgcggggatcgccaggataaagggcgcgccgccctgctcgtgctcgatggccgcggccaccacaaaaccgcttttgcgcagattggtcacccagtgcaggcgcccgttcagattccaaccacccgcccgtggctgcgcgcggacttgcagggcctcgatgccggagaggaacttcatggcgttcgacagcccggtggcccccgccagttcgccgctgagcaggtccggcaacagacgctcgcgcaaggccgcgttggggctgtgcagcaggtattcgataaaggcccgctggccccagaacacaaaggccgccgccagggaacggctggccaccgcggccagcgcctccacggcgtcgcccaggtcgccgtcgctaccgccctgcccggccggaatgccgatgcgcagcacctgcgcctcggccagccgcgccagcacctgctgcgggtcacagtggccaaggtccaaggcctgggcctcggcgtccagccattgactgaatgcggggttgagcatgtggttttctccttttttacgcggcaccggcccaacggccgtgccttgaatcaagccgctgcatcattgctgcggcgcttgccagcggtacttggccagttccgggttcagcggcgtgcgggcgaacacgttggcgaaattgcacagggtcgccaggctcaccccgagtatcacttccagggcattgccctcgctgtagccggcggccttgaacgccgcgaacgtcggttcgctgacgttgccacgggtggcgatcacctcggcggcgaaggcagccaatgcctgcagtttttcctccggcaaggggctgcgctcacgcaacgcgctgatcacttcgtccggcagtttggccttgttctgcgccaccgcagtgtgcccggccacacagaaatcgcaaccgtgagtggtggcggccaccagttgcaccacctcccgttcggccaggctcagctcggccttgccattgagcgccgataccgtaacgtaggtctccagcgccgccggggcattggccaggatgcccagcaggttgggaatgaaccccgagttgttctgagcgttctgcaaaaacggccgggccgcttcgggagcgctttgcaggctgtgtagagtgatgcgcgacatgcggtggactcctgctgtgtaggtgtccggccagtctgttggttataaaaatttcgatccatattctaaagtagcgattacttgctcctgagtgtttccattagatgatttcgtccagcccactggttgattggttattagaaagcctcgaactcgacgccagcctgttccatgtcggccgctactgcggcggctggcacgccagcacccacggcctggcccgggccagcttccacctgatcgtgcagggccattgctggctgcatatcgagggccatgagccggcccagcgcctgaatgccggggatgcgctgttcctgctgcgcgacctggactatcgcctgtccagcgccgaagcgcatggcgccgcccttgaactgccacgcgtggccatgcaggcgctcgacgctcacgcacaagatcaggccgaggatggcgtggggttggtctgcggcttctttcatttcaagtccgggctgtcgtcgctgatcatcgacggcctcccggactggatcgtgctgcgcgccggcgacccgtccctgagcgcggcccgggccctgttcgagttgatcctgcaagagtgccagcgcacgcccgcgccctcctcggcgctgctggaacgcctgagccatctgctgttcctctatgtgctgcgccagcaagtggccgataaccagggccttggcgggttggtggcgctggcccggcacccggccttcgccgcgctgctggaacagctgatcgaacaccccgaacaaccctggcccctggaaagcatggcggcctgcaccgggctgtcgcgctcggccttcttcaagcgcttcaacgaactggccgggcaatccccgggccaggtcctgctggcgctgcgcatgcgccatgcctgccagttgctcaaggccaaccacaccgtggaacaggtcggcgcggcagtgggttatcaatcggtcgcggcctttacccgcgccttcgccaaggccgtgggcgtacagccgggagcttatcggcgccagcacgaagggcgttgaatgcaccggggcctgtgacctggccccggcaaggcgtcactggctcagggcctgggtaaaggaagtgtcgacaacagtcgcggtggccaagggcgccggcagcgccttgaccttgaacaggaagtccgcggtgctttgcaggtcggcggcggcctgcgggtccaccgggccgacgctcatgtgcgcctgacgcagccaatggcgcgagacgttcggatcgaggttggcctttttcgcccacaggtcggcgtactggtcggtgtggctgtcgacccaggcgcgagccagcttcaggcggccgaggaagtcggcgatgacttcacgcttgctgtcgatggccggggtcgaggcggcgatggcgctgaggccgggcatcaggttcttcgcggtgaggatcggccgcgcgccggagaacaggatctgctgcgagatatagggttcccacaccgggaaggcgtcgatgctgccctggggcaaggccgcggcggcatcgatcggcatcagtttgatgaactcgacatggtcctccggcaggccggcctgttccagggcgcgcagggtcagttgctggctccaggcaccgggccagtaggcgactttcttgcccttgaggtcggcgatggtctgcaccggcgaatccttgggcaccagcaaggcgatggtgtccgggttctgccgcgagacgccgatcagcttcaccggcgcctgtttcgcggcgaggaacagaaagcccgaatccccgagaaagcccaggtccagggcgccggtgttcagcgcttcggccagcggtgcggcggcctggaagtgtttccaatcgaccttatagggcgcgccttcgagcacacccgaggcctccaccgaggcgcgcacgttgtagtagttctggtcgccgacctgcagcaccagcggctcggcggactgggccaggggcgccgcgaacagggtgctgaagagcagacggcgcaggcgtcgggagagcgtcatgggaaattcctggatgattggaaaagcggattttctagaacataacgctcttagaatccgattatgaaattctgttaatgcataagctcatagccgcttttgcacccgcaaccggggactgttggcggagaaacagcgcggcaacagactgtcggccaggcaacatcgccagaggctttttcctgttggcaatgcctcgaaaccgcccttccccggctatggcacagagcctgcaatattcctttccagcaggatttattcctgccttccgcgacttttgaaataagcagcggaaataacaacattgccctctcgccgccttgtccggagccctccatgaaacccgtcttgcgtttccccctggcttgcgccagatacctgctcagcgcctgcgtcctggcgctaggcctgcaacccctggcccaggccgcggaaaatccgccggccgaagtgcacctggactacgcctattactcgccggtcagcctggtgctcaagcacttcggctttctcgaaaaggccctgccccagaccaaggtcggctgggtcctcagccagggcagcaaccgctccctggaatacctcaacagcggcggcgtcgacttcgcctcgtccgccagcctggcggcggtgctgagccgggccaacggcagcccgatcaagtcggtgtatgtctacagccgcgccgaatggaccgccctggtggtgcgcaaggattcgccgtaccagaccatcgccgacctcaagggcaagaagatcgccgccaccaagggcaccgatccctacctgttcaccctgcgcagcctgcaacaggccgggctgaaaaaagacgatgtggaactggtgcacctgcagcacccggacggccgtaccgccctggagaaaggcgacgtcgacgcctgggccggcctcgacccgcatatggccgccagcgaagtgcaggccggctcgcgcctgctgtaccgcaacactgccttcaacagttatggcgtgctcagcgtcaccgagcagtacgccaaggagcatccgcagaccatcgccagcgtgcttgccgcctatgagcaggcccgcgaatggtcggtcaagcacccggacgagctggccaaactattggccgacgaatccggcctgccactggaagtggcccggctgcaactgtcgcgcaccgacctcggcaacccgcggttgagcgccgaggatgtgttggcctccaaggccgccgcgccgatcctggtgtccgaggaactggtgcgccgcggggtgaacgtggaccaggtgatcgaccaactgctcgacaccggcgtcaagcaggccgtggcccgtcaataacccaccgcccaggcgacgaccgagcccgcgcctggcgcggattcggcgttgccggagaatcgccatgagcagcgacagcaacaacctctcgacccgcctggccctgtccgcgccgggcaagctcccgcgcttcaaccccgcccgctggcgcctgcgcctcaagggcctggccctgccggtagcgatcatcctgctgctggagttcgtggtgcgcatcggctggctgccgtcgtaccagatgccggcccccagcgagatcgccctgaccctcggcgacctggccgaaggcgcgctgtggaaacacatcggcgccagcctgctgcgggtgctgctgggttttgccatcggcgccggcctggcgctggtcttcgccgcctgggtcggcctgagccgggaggccgaagcctacctggagccgaccttcgccggcctgcgctcgatccccagcctggcctgggtgccgttgctcctgctgtggctgggcatcgacgaaacttcgaaggtggtgctgatcgccatcggcgccttcttcccggtgtacctcaatggcgtggcggcgattcgcgatatcgaccgcaagctggtggaggtcggccacatgtacggtttcggccggcgccggctggtgcggcggattctcctgccggccgccctgcccggcctgttcactggcttgcgcagtggcatgagcctggcctggatgttcctggtggccgccgaactgatcgccgccaccaagggcctgggttatctgctcagcgacggccgggaaacctcgcggccagacatcgtgctggcggcgatcatcgtcctcgcggtgctgggcaagctcagcgacggcctcctcgccggcctggaaaaacgcttcctggcctggcgcgacaccttcaatggccaaggcggcaacgactaacgcacagaggatcgagccatgacccaagccctgctggacatccacgtggaacgcaagaccttcgccgccaccaccgtcctccacgatatccacctgcaactgcagccgcgggaaaccgtgagcctgctgggccccagcggctgcggcaaaagcaccctgctgcgcatcgtcgccggcctggagaaggactttcaggggcaactgcgcagccacaccgaacgcctggcctttgtcttccaggaaccgcggctgatgccctggctgacggtggaacagaacatcggctttggcgacgacgcgcattacgaccgcgcctgggtcgcgcaactgatcgaggaagtcggccttgcgggttttgcccaggccctgcccaaggcgctgtccggcggcatggcgcagcgggtggcgatcgcccgcggcctgtacgcgcggccacaggtgctgttgctggacgagcccttcagcgcggtggacgcctttacccggatgaaactgcaggacctgctgctgcaactggccgagcgtcacgccatcgccctcctgctggtgacccacgatgtcgacgaggcgctgtacctgagcgaccgggtgctggtgatggacaaccgccccagccgtattcgccaggaactggcggtgcaactgagccacccgcgggaccgccgcgacccgctgctggcccggctcaaggcgttgtccctgaccgaattgcacaaggcccatgtgatttgagcgggctttgccacggcccggcatctaagaacacaaaggaattaataaataaataatcagtatttatggttataaatataaccacgtactctcagctcatcccgcccattggtcacgacagtgaagtgccttatgaaaccgactgacaacgttatcgacttcgcccagttccgcaaacgcaagcaggcccagcaactggcccgggccatgtgggagatgtacgcgcgcaatgccggttaccaggcgttccagtgggttcaggcggcccggccgaccaggacctaccacgcgtgagcgcccaggaaccctcgcgctttctggcgagcgccgacgaacccggccttgatttgacccctctggagactcaggaagaagaccccatcagcgaacgggtcgcgcagaacctgcaacgcctgcgcagcaagcgtcatctgtccctggatgccctggcccgccagtgcggggtcagccgggcgatgctggcgcagatcgagtccgggcgcagcgtgccgtcgatcaaggtgctgtgcaagatcgccaagggcctgaaagtgtcggtcgcggcctttctcgaacaccgcgccttcgaaggcgtggcggtgctgccatcgagccggagcaaacgcctggtcagcgccaacggtgcctttgtcagccgcgccctgttccctttcgacgtggcgcgccagtcggaattctacgaactgcgcctgagcccgctcggcgaagaccagtccgaaggacacggaccgggggtccaggaaaacctggtggtgtcccagggcgtactggaaatcagcgtcaaccaagagcgctatctgctctccaccggcgactcgatcctgttctacgccgaccagccgcaccgctaccgcaaccccgccgacagcgaggcggtggcctacctggtggtgacctatccggaacgcctggactgaaggtggagttgcgccacgcaaatctctaccgcgaaaaacacaccacggctcatgagaaggcatccacctgggtcagttcggccgacaggcgccaaagacgttcggcctgttccggatcgacggcatagggccttacgccaacgaacgacgccggctcgctctcgtcgagcctggccacctcgcagtcttcgcaatacaacccacccaggccatccagcttcggcgatgtcgcagcccagacctgggtggcggcgccttgccgagtgttcttgaaggccgggttcgccggattgccctcggcgtctatccagcccagggcgagcatttcttccttgggcaggtaacgctgcagaggtgtggcgatcatgccagggtgcagagagaacgcccgcacgccctgctcgccccccaaccggtccaggtgcacggcgaatagcgcgttggcggttttcgactggccgtaggcaagccacttgtcgtagccccgatcgaactgcgggtcgtcccagcgaatggcggatgagtgatggcccgcggaggacaccatcaccaccctggcgccgccttgcaacgccggccagagccggttgaccagcgcatggtggcccaggtgattggtcgcgaactgcgcctcccaaccgggccccactcgggtttcagggcaagccatgatgccggcgttgcccatcaatatgtccaggtgcgtgccgctcgccagaaacgcctcagagaaacgcttgatgctcgccaggtcggccaggtccaacccatgcacctcgacattggcgagaccggcaacccgggcctgggccgcctggcgatcgcgggccgccactatgacccgtgccccggcgccggccagagcccgagtggtttccaggcccaggccggaatgccctcccgttaccagagccgtggttcgggaaagatcgaggccttcgagtacctcggatgccgtcgaagctgcgctgaaaccggaatgaacaggcgtctgtctatgggtcattgcaatgtcctttacgaatggaaaccaagctgccaatttgaagcgctttcattctgcgagcccgaacctggagcgtgaatgcaatggcgtcctactttctatcgagaacgtccggtttgacacatggatcccctatcagaagtcctcacccagctcagtagccagcattcctttttcggtggtttgaaagccggcggcgactgggccgtgcgcttcccggcaccggaaggcgtcaagttcaacgtgcttgtgcggggggcttgctggctggccgtggaaggagaagcagagccgatatggctgcaagcaggcgactgtttcctgctatcccgcggacgccccctgttgattggcagcgatctttcgctgccagcgatcgctgccgaggagatctatcctcacgccgttaacggcgtggcgcactgcggcagtgatgaagattgctttctggtcggcgggcgtttcgcctttggcgacgaagccgagcttttgttcgacagcctgccaccggtcgcggtgatcaagagcgagtcggatcaggcatccgtattgcgctgggccttgcagcggctggcgcacgaactctccaccccatccccgggcggcgccctgatggtccagcacctgggccacatcatgctggtgcaggtactgcgcatttacctggagcaggaaggaggcaatacaccgggttggctctcagcgctgtccgaaccgcgtatcggtgccgccgttcaggccattcacacccgccctgcccaacgctggacggtcgaggccctggccaaagtggccggtgtctcgcgctcgacactggcgctgcgtttcaaacaggccgccggcttttcgccgctggaatacgtgttgcgttggcgcatgcaactggcgacccggtcattgcgcaacacccacctgacaatttcctcgatcgcccaggccctgggctacgagtccgacagcgcgttcagcaatgccttcaagcgcatcatcaaatgctcgccacggcagtaccgggaacgagcaagggccgtcgcccaaccccagggggaatccgaagttcgagtgggtgcctgaaataaaaaaacccggcgggatcgtcccggccgggctttttctgtgccgctgcgaggaatcagcaggtgcagcacatcatcggcatgccgttgcagctcatcatcatcggcatgccgcagtcgttcatcatcttcatcatcagggcgcagcagcttttcatcatgtccatgttcatgccggccattggcatgatcttgcacatcatgcagtcggcctcgacggtgcactccatcacgcatttcatcgacggcatcggcatgcccatcatcggcattggcatcatggcgcccatcatcggcatagccatgctcgcctgggacatgcacatcatgctcatgttggcgcagtgcatcatcatcggcatgccgcagttcatcatcatctgcatcatttgcgcgctgttcttgaacatggccatgtccatgcccgcggccggcatcatcttgcacagcatgccgtcgtccatcatttcgcagctcatggtcgccatcatcatcggcatgcccatcatcggcatcatcggcatgttggcgttcatcggcatttgcatctgcatggcattcatcatggtgaaactccctaagcgattcgatagttggacgaagctgatggggcggattctagggagtggcgaacgccgcacaagatgccgatcgaacagcaatcgcggctgccgggacagcttcagcgcagccgctcgcgcgggattttccgcttcagcagccggatggatttcatggcggacgggagcaggacaacagcgtgttttccgctgcgatggatatgcgcgaatcagcgcatcccataacccaaagaaataatcattctaaagaggctcgacttttctcgggaacaggcgccttgccagcctcgccggtgccctgtggcagggttcggcgagggtcgcaagcgcggtgcggggcatgacgcgggggtcgggatcgcgagtctcagagcttggcgatcgacacttcggtggatttgacgaaggcgatgacttcgctgccgaccttcaactccaggtcgcgcaccgagcgcgtggtgatcaccgaggtgacgatgcccgaggcggtctgcacatcgatctccgagaccacctggccttcatggatctccttgatgatgcccttgaactggttgcgaacattgattgccttgatggtcatgatgggccttcctgtctggggtgggcactggcgcagcgccgtgcaggcctctaaggtgccctgtgtcttttcatattaaaaggaataaatagtagttattttattccttaaatgaatataaaagtttctcccgtcctcttcgttaccttgaccggcccccgcgcctttgcttctctggatccctaaccctttcaggagattgtcatgcgaacactcgagctggcgggcgtgcccgtcccggtgattggccagggtacctggcgcatgggcgaggagcgccaccagcgcaacgccgagattgccgcgctgcaggctggtatcgaacggggcatgagcctgatcgacaccgccgagatgtacgccgagggcggcgcggaggaagtggttggcgccgccatcaccggccagcgcgaccgggtgttcctggtcagcaaggtgtacccgcacaacgccagccgcaaaggcattccccaggcctgcgaacgcagcctgcggcgcctgggtaccgactacatcgacctgtacctgctgcactggcgtgggcaatacccgctcgaagaaaccgtggaagccttcgagcgcctgcgcgaagacggcaagatcggccgctggggcgtttccaatttcgacctcgatgacctcgaggaactggcgagcccggcctgcgccaccaaccaggtgctgtacaacatcgaggaacgcggcatcgaattcgacctgctgcccgccgcgcgacaacagcgcttgccgctcatggcttactgccctatcgcccaggccggcaagctgctgcgccaccccacgttgcagcaggtcgccgaccgccatggcgtgaccacggcccaggtctcgctggcctgggtcctgcgccaggacggcgtgatcgccattcccaaggcggtacaccccgagcatgtccggctgaatgccgaggcggccgggttgcgcttgcacgacgaagacctggcggccatcgaccaggccttccccgcgccactgcgcaagcagcgactggcaatggtctgagccgctgtcgcgaggcatgccccactgaaaaaacctggcgccggtgccaggtttttttcgtcgtgtatcaggctggaagcggcgaaataccgcgactttaaggatcgtcctatcccggattaatgagggtttatttagagtgggtcaatgagattaaagacctaccttcatcagatcagtcccctattttccagtcctgaagccgccagcaggttgctgcgtcttttcgcgctcattcttttggtcggcatcctcggcgccgtctacaacttcctcaattccaccctcagcaacgacatttcccggcgccgcggctacatgagcagcgccatcgccgaagcccagaccttcttcaccagccgcgaggccttgctggaaagcctcagcctgtccgcggtgcgccgatccaagcaggtccaggggtatccgccttccagcgaagaactgcacctgcaactgggcgacatcgatgatccgtggagcatctggctgagccagcgcatgcgcgaatacttcaaggccaagcaggtcaacctgctctatgtaagccctggccccgaggcccgggtcatgcgcctctacagcagcaacccgacctcccccaacctgcccaggaccatcctctccaagcttgaggtcctgaaccatggggagcatccggacaccgacgagctgtggctgaccgacccgtccacgcagacttcgcagctgtacattttcacccggctcgacgagcgcaccgatgactccggctggctgggcctggaaatggatgggcgggaagtgctcaaggccctcagcgaccagagcgccggcgagttcatgatgttcaactccgaaggcgcgctgctgttcaccaacaccccggccgggcgcctggggcaggccctgcagcaactgcaaggcagcaacttcttcggttttgtcggcagtggctggtggcccgatcacctggtgatccgcaagcaactgatgacctccgactggcaactggtctactccttcagcctgcagtccctgctgatcgcgctctggccgcagctggccggcgccctggcgttctgcctgttcagcatcagcctgatctgcctgctgacccgccgcatcgagcaccgcttcatcacccctgcgctgagccgtatccaggcgctggtcgagagcgagctgttcagccgcgacgtgatccagaccgcgcccgtggccttgtgcgtgctgcggcgcaccgatggtcaggtggtcctggagaacaccctggcgcagcagtggctgggcgatggcgtcgaacgggaaatactctgcgccagctggatccagcaagctttcaagagccacgaaccgaaccgcttcgactacttcgagaccaccgacgggcgtcatctttacctgagttccgcgcccacccgctacaagggtgaggacgtgttgttctgcgccttcagcgacatcagcgcgcgcaagcaggtggaagccgcgctggaagaagcgcggcagatggccgacgccgccaacgaagccaagaccctgttcctcgccaccatgagccatgaaattcgcaccccgctctatggcgtgctggggaccctggagctgctcgcgcgcactcaactggatacccagcagcgcgattacctgcgcgccatcgagtgttcttcctcgaccctgttgcagctgatctgcgatgtgctggacgtgtccaagatcgaggccgggcaactggccctggagctcaatgagttctcgccactggacctggtccacgagctgatccagggctactccgcggcggcgtcgaacaagggcctgctgctgtattcctgcgtggacccgcaaatccccgagcgactgatcggcgacgtcacccggatccggcagatcctcagcaacctgctcaacaacgcggtgaagttcaccgacctggggcgcatcgtgctgcgggtcagcctgctgagccgcgacggcgagcgctccagcatcctgtggcaggtctccgacaccggcaaaggcattgcccaggatcatcagccgttgatcttcgaacccttctatcaaaccggcggcaacgccaacgtggtggcgggcaccggcctgggcctgcctatctgtcagcgcctcacgcaattgatgaacggcagcctgcgcatggtcagcgaactggggctgggcagcagcttctccctcaccctgcccctggaagcggcgatcgatgggccggtcaccctgcccgccacgcagctgctgccggaaaccatctatgtgatgtccagcgtccgcgagctggcggaatccatcggtggctggctgcgccaatggggtgctcgggtgcaactctgccatccctcgaagatcgcgccgaccagcgattgcctgctggtcgaagttcaccccggcgaactggaacaacgcctgcagcccgactggcccggtccgctgatcctcgccaccggggcaggcaacaacgaaccgcaggttcgtgccgggtgctggcatgtgaacctgaaccacctgcgttccattcatcaggcggtcagccaggcccaggggctgtgggtggccaaggccgagaatcacaacgaacactggacgttgaagcaactgaacctgaacgtgctggtggccgaagacaacgtcatcaaccagctgatcctcagggatcagctggaagagctgggctgcagcgtggagcttgcgtcaaacggcgaggaagccctgtcgatgtgggaccccgagcggttcgatctggtcctcaccgacgtcaacatgcccatgatgaatggctatgaactggccaaggagttgcgacgccgtggctgtacggtcccgatcatcggtgcgacggccaacgcgatgcgtggagaagaagagcaatgtctggcggccggaatgaaccattgcctggtcaaaccttttgcattacgcgccctgttcaattacctagcgccctatgaaagagcgaagaatgaagccctgtagcatattgatcgttgaagaccatcccttccagcacatgtacctgcaacatctgttcggtgagctgggcccctactacctggaaggcgcccgggatggcgaagaggcgctggaacgcttgaaatggcgcaagttcgacctggtgctcaccgacctgttgatgccgggaatggatggcgtgcagttcatccagggactggccgccctgcactccaagccggcgctggcgatcatgagctcggcttcgcggcgcatgctgatgagtgccagcctggttgccaagaacctcggggtgaaagtcatcggcctgatctcgaaaccggtgaaccttgccgccttgcagaccctgaccactcaattgagcatttcgcagccgagctcgccgcgccccttgcccacctccatgctcagtcgggcggcgctggcccaggccatcgagcaagagcagttcgaagcctggttccagcccaagaaatcactgttcaacggccgcatcgtcgccgccgaagccctggtccgctggatgcatccgacacagggcatgctgctccccgacaccttcctgcccgccctcaagtccttcgacctcgaggaggacctgctgtggctggtcctgcgccaggcgatccaggcccaggcacgctggcgccagcaggactacgacattccggtgtcgatcaatctgccgacccatctgctcaacagccacgacctggcggaccgcctgttcgactttgtcatggaacaccagggagtaccggggcagatctgtttcgaactcatggagtgttcggtgccccaggacatcagtaacttctatgccggtgcctgccgcttgcgcatcaagggcttcggcctgtcccaggacgacttcggcaagggctacagctcgtacatgaacctggtttccaccccgttcaccgaactgaagatcgatcgcgccctggtccagggatgccacgccagcgaagaactgaccaaggccctgaccagcatcattgccctgggtcgccagctgggcctgaccgtggtggccgaaggcgtggaaagcgccgaggagctggcgctgctgcgcaagatcgactgtagccaggtgcaaggtttcctgatctctcgcgcagtcccctccgaacagtttcaacagttgctggtgaacgacggtccagccgccagttattgacccgaggacatccgccccttcaggattacatgccccacatcactgacaagtcgttgtttaaaggtaaaatcctcaaggcttcgactttttcatgcttttttggataccagtgatgaaccaccaggacacgctcatcgagaatctgaaacgatactcgactcgcctgaacaagggattgttgattttcctcggcttgaccctgttgttgatcgccatcagttactggtcgtcgcacaaactgctcgaagaacaacacggcaggttcaaagcgcattttgcgcggatgatggaagacatccgcgaacatgaagacttcctccggggcgtggccgtacaaagcagcaagatcccccttcacgccaacgactcggtttcatacctgaaaagcgccttgcccgaagaggggccgcacaactacctgggccaggagtttgccttttccacgcccttcagcctctctgtcaatcaccagagcgtcgagcctgacaccttggcccggctggccgacctgggagagcacctgaccgactattacagcgccttctggtccacttcccattaccagtcaccgccgtttttcctgttcgatgccgtgggcaacttcaatatcggcattccggccgccgggcattcacgcgacccgctctggaaaaacgacacccccaacaagaccctcgtcctgcaaacgctcaagcatctgctggcgaaagattcggcacgggccgatggcgtggtcgattggcaacccctcgtcccccatcaggccaacgaggcgcccgtccggctgctggcctatgtcagcacccatctcgggccgcaatggtcacgagtccaggacagcggcaagcagatcggcgtcgcgtcgctgttcagcatggatctggtcaatgacatcaagcgactcatgccgtggtcgacctatgaccatgtcgccctggtcgccccctccggaaaggtgctgagcggttcgctgcaactgggcgtcgtgctgcatgacgggctgaacatcaccagcgacggcatggtcttcaaagtctcgagccattccgccgagccctggagcgccctctacaccatcggtttcaagagctacttcaactacaccctgtggcccttgccggtcttgctggccctgctgatcggcggcattggttgtggctggctggtcagtcgccggtatcagtcgcgtatcgtcaaaccggtctacgaggcttaccaacgcaccgccgagagcgaggccttcagccgggccgtgatcgatagcgcgcccaccggcctgtgcgtggtgcgtcgctcggacttcaaggtcctgctggaaaaccgcaaggcccagcaatggcaaggcagcacaaaactgcggatggccctggagagccggcaggacctgtgcgtcgccggtgaaacccggctggacatcgacggtactcacctgcaggtagggttcgtgcccacccgttaccagggcgaggatgccttgctctgtgccttccacgacgtgaccagccacatcgagggcgcggccatgctggagcaggcgcgacgctccgccgatgcggcgagcgaagccaagaccctgttcctcgccaccatgagccacgaaatacgcaccccgctctacggcgtgctgggcaccctggaactgctcgggctgacgcgcctggatgcccgccagcgcgaacacctgcaaaccatccagcgctcgtccagcaccctgttccaattgatcagcgatgtcctggacatttccaagatcgaatccgggcagatggcgatcgagtcccaggcgttctgcccactgcagatgatcgaggacacgctgcacgcctacagcgtcttcgccgaaaacaaaggcctgctgctgtatgcctgtatcgatgcggcgttgcccgaccagttgctgggcgacccggtgcggatccggcagatcctcagcaacctgctcagcaacgccatcaagttcaccgacaccgggcgcgtggtattgcgcgtcaagctcctgcactgcgtggatggccaggccagcctggagtggcaggtcaccgactccggtatcggcatttcaccggcgcaacaggaacgcctgttcgacaccttctaccaggtacgcgacgcctccagcgaggccggagccggactcggcctggcgatatgccgctgcttgacggaaatgatgaacggccagatacgcgtggtcagcgagcccggcctgggcagcagcttctcgctccggctgggactgaaggtcatgccgggcgcgctggaaggttgcgcggacatcctgccgagcacccaggcggtgtatgtgcgggctcccgccgtggagctggcgcagagcaccagtgactggctgaatcgcctcggcgtggtcgccaagccgttgccggcctttgtcgaagagtcgcgccaggccaacctgctggtcgatgtccaaccctccgacagcctgccggcctgggccgggccacgggtcctgtgcgtcgccggcgaacacccggcaccgccaccgcgaggttgcaccgtggatgcccatgatgtgcgggccatcgccagggccgtgtccctgaccctgcacgggaaaaccatcgcgcccgccgctcccgaatgcgacctgagcaacaggctcggcctgcatatcctggtggccgaggacaacgcgatcaatcaggcgatcatcaaggagcaactcgaagccctcggctgcacggtgaccgccgcctccaatggcgaagaagccttgcagctctggcagccgcaggtgttcgacctggtgctgaccgatgtgaacatgccgctgctcaacggctatgaactgacccgcgccctgcgtgagcgtgaccgggagactccgatcgtcggggtcacggccaatgccatgcgcgaagaaggcgcccgctgcatggctgtcggcatgaatgcctggctggtcaaacccttgagcctgcagactctgcaccagtacctgtcgaatctctgcgcgaatgcgcctgcccaggaaccgcaaccgatgatcgatgcaacgccttcccccgcgaccggcgacacaatgatcgagctgtccccgaaaatgcgtgagctgttcattaccaccatgcgccaggatgtccagagcgtgaccgacgccctcgatgcccaggatcccaagcggctcgccgaacggctgcacagcgccgccggggcgctgggtgccgtgcagttgagcgggctggcgaaaaactgcgccgaactggagtcccggatactgcaaagcgcgatcacctcttccgtgacccttgaggtgaaaagcctgatacaaagcttgacggatattcttaatgcacttgaatgagacgcgacaagatttgatgagcgcaatcctttactctttctccttaccaaccggcgtattacgagtggctagtcatggaaaaatttaaagtagtcatcgccgacgatcatccgattgttctgctcggcgttcgcgagctgatggaacgggaaagcaactttgaaatagtcggtgaggccatcagctcacagggcttgatcgagattctcgaacaacagccggtcgatatcgtcattaccgactacaacatgcccggggactctccctacggcgacggcctcaagctggtcgagtacctcaagcgccacttcccgcgcctgcagatcctgatcctgaccatgatctccaaccagttgatcctcacgcgtctgcatgagctgggggtggtcggagtgatccagaaaagccagctgcacaatgaaatccaggtggcgctcaagaccattgtcgaaagaggttcctatcagagtatcgaacctgcgccgagctcggtcatcgagtccaatgcaagcatcgacgaccggatctccatgctctcgcccaaggagtttgaaatcctgcggctgttcgtttccggcaagagcgtcagtgacattgcccgcagccagaaccgcagttcgaagaccatcagcgcgcagaaaatctccgccatgcgcaagctggaagtcgagagcgaccaggacctgctgacgtactgcatcggtcgcaacatcttcagctgaccccctcttatccagcgaagacagaaggcccgaacgacgatgacccgcgacgaccagttcgacctgcaacagcttcaaggtgcctgggaacaggtggagtacgaggacaacggggtcagcaatccgcctgacgaacatggcgccccgggagctcttaccctgatccaggggcaagggtttcgtgtcgtgacgctcgaaggcgagctgttgctcgcgggcagtttcaccctcgatacccggaccaccccgaaatccattacctgggtcgactccatgggcgccgacaccggcaagcacttgcctgccagctatcgactggacggcgatgacttcgtcttcatcgccgcggacgagggccaccccaggcccaccgagttccgaaccgggccgggtgaaaccctgcgccggttcatccgcgtctcacaggatggaacaggcctcggcagccgctgaggttcgctcgttggccagcatgccgtcaggccctggcccgctgtatttcccgccccgccaactcgccgattgccagcaacgctgcgcaatccgcaccatcctgggcctgtaccgacatgccttgaatgatcgccccgatataccgggccagcgccgctacctgggtatcggcgcgcagttgcccgctggcgatgccctgctcgatatgtgcttcaaaggccttgagggtgttggccctcagggcactgacgaactcacgcagcgcatcgttttccaccgcgcaggtcagggtcgcggtggaaatcatgcagccccgcggccgcccgggcaggctgtattcatgggccgcctcgcgcagcagacggaggaaaccgtccaccacatccgcctcctcgcacagtgcccgctcggcaaaggcgccagtgctgcgctggtaatgcgccagcgcctgctggtaaagctcggccttggacctgaacgcggcatacaggctttgcaccgtgatgcccatggccgccgacaactccggcatcgaggcgccttcatagcccaggcgccagaacacctctgccgcaaggcccaggacctggtcgcgatcaaaggcaatcggccgtccacgacggcgcaccacggcagcagggttatttatcatagtgatcactattgaaattagaacgaatgccggttaatcatagcggacattgtgattatagaggctccccccatggatcgaccctataaaggcctgctcgccctggcagccactctcggcgcttcgctggccagcgccgccacgccggacgaggaactcggcaggcgcatggacacggccatcgaacgcgccatcggcgaacagcggatcgtcggcaccgtggtggtggtgatgcgcgatggccaggtggtgtaccagcgcgccgccggtttcgccgatcgggaggcggcccggcccatgaccggcgacaccatcctgcgcctggcctctatcaccaagcccatggtgtccgtggtcgccatgcgcctggtggaacagggcacgctgtccctggacgatacggtcagccaatggctgccggatttccgcccaaggctggccgacggcacccgcccgccgatcaccctcaagcaattgctcacccacaccgccggcctgagctatggctttctcgaggccgagcacggggcgtatcgcacggccggggtgtcggatggcctggccgagccgggcataagcctggaagacaacctgagacgcattgccagcgtgcccttgagttatccgccgggcacgcagtggcgctattccatggccatcgacgtgctcggcgccgtgctggaaaaggccagcggcaaaagcctgccggccctgaccgaggagctggtcacccagcctttgcacatgaacgacaccgcattctcggtcaaggaccctgcccgcctcggcgcggtttaccgcgatgaccgtccgcggccgagccgaatgcaggacgaggcggcgatcagggtcggcgaaagtaccacgctgttctccctcaagcggatcttcgacccgcgcgcctacccttccggtggcgccggcatggccggtaccgccatggacgtggcgcgttttctcgacaccttgcgccagggtggcggcccgctgctttccgcccgcagcgtgcaggcgatgatgaccgaccaggtcggtgcccaggcgcagacccaggggccgggctggggcttcggctacggctgggcggtgctggacgatccggccctggccggcaccccgcaatccaagggcaccctgcaatggggcggcgcctacggccacagctggtttgtcgacccgcaggccaggctgaccgtggtggcgctgaccaacaccgccttcgagggcatgtcgggggcctttacccgggagatccgcgacgccgcctacccggcgccctgaagcacctcgtcgcccggggcgtcgagcgaccaccagcccggcagcaattgccggacccggggctcggcgaaccggtcgtcgatcagcatcactacgccgcggtcctgctggctgcgaatcacccggcccgcggcctgcaccaccttctgcaggccggggtacaggtaggtgtagtcgtaaccggcgccgaaaatcgccgccatgcgctgtttcaactgctcgttcactgggttcagctgggccaggccgagggtggcgataaaggcgccgatcagccgcgaacccggcaggtcgataccctcgccgaacgccccacccagcacggcgaaacccaccccctggccatcggcgtcgaagcgctcgagaaacccctggcgttgcccttcatccatcccgcgcgactgttgccacagagggatatccgggtgcagttcggccagcaggctggccacctgctgcaagtaatcgaagctgctgaagaacgccaggtagttgccggggcgctggcggaactggctggcgatcagctcgacgatgggcgccagcgacgcctggcgatgggcgaaacgggtggagatccggctgacgatgtgcacgtccagttgcgcggcactgaacggcgactccacgtccacccacaccgtggtttccggcagccccagcaggtcgcggtagtaatgccaggggttgagggtcgccgagaacagcaccgtactgcgcgccgcgctcagccgcggcgccaggaagcccgccggcaccacgttgcgcaggcacagctcggacaggctgcgccgggcattgagttcgcgcttgctgatatcgaacaggaactgctcgtcgaacagttcggccacccgggcgaattgcagggcatcgaaatagaagccctgcaaccggctgtccagcccttgcgggtggtcgcccaggtaatcgccgatcgccgaaatacacagcgacagcgccttgagcaacggggccggcgcctggtcataggcctggtacggccgcagctgttccttgtgcagggcattccattcccggttgagccgttgcagcggcttcttcagcgcctccggcgccgcctggcgcaccgtgttcagctggtactggtcgaggctggcgctgtacatcgagcgcccgcgctccaccaggttatgcgcttcgtccaccagcgcggcgaccttccattggttggcctgcgccaggccgaacagcaaggcgctgaaatcgaagtagtagttgtagtccgccaccagcagatcgctccagcgggccatttcctggctcaggtaatacgggcacagcccatgcgccagggcgatctcgcgcagcgcctgctggtccagcaaggaccgctggctcgccgcctgccgcgccgccggcagacggtcgtagaaacctttggccagcgggcaggactcgccatgacaggccagctccgggtgctcgcaggccttgtcccgcgccaccagttccagcacccgcaacggcagcccggggctgcgctcgaacagcacctgggcggcatccagcgccagtttgcgtcccggggtcttggcggtgaggaagaacagcttgtccagttgctgccccggcatcgccttgagcatgggaaacaccgtgcccaaggtcttgccgatcccggtcggcgcctgggccatcaggcagcgcccggtgctcaccgccttgtacaccgactcggccagcgcgcgctgcccggggcggaagtcgggatggggaaaacccagcgccgccatggcctggtcgcgggcgtgcctgtgggccagttcctgctcggcccattgcaggaacaggctgcattgctggttgaagaactgctccagggcctcggcctcgtgctcttccaccagcgacgtctcgcgctcgctgaggatgtcgaagtacaccagcgccaggcggatgctgctcaactgcaactgctggcacagcagccagccatagatcttcgcctgggcccaatgcagctggcgatggttggccggcatgcgctccaggtcgccgcggtaggtcttgacctcttccagcaggttggcgtccgggtcgtagccatccgccctgcccttgaccgtcaacgcgccgaagctgccttcgaggggcacctcgctccgatagtgcgcgctgcgccgcgccgccaccgtgcgatggccctggatgccctccagcgcggtgggcgacggggtgaagcgcaggtcgaggtcgccgaccttggcggtgaattcgcacagcgcccgtaccgcgatgcggtagttcacccgtcctgctccgcccattgcacgtagcagaccgccaccggcatctggtgctgccgacagaactccagccagcgcagctggttatcctgcaggcggtcgccagggcccttgacctcgatcatccggtaggttttctgctgcggccagaactggatcaggtccggcatgccggcgcggttggccttgatgtcctgcagcaggcgctcgaaccagtgcttgaggtgctcggccggcaggcaggccagcgcctgctccagcaattcttcgtcgagggcgccccagaacacgaaaggcgactgcacgccccacttgtcgaggtagcgctggcggatggtctgcgcataacgcccgtcatccagttccgccaggcaggcctggaacagttcggcgcgacggctgtggaagtcctcgctcaacaggtcggccgggccgcgctggaacgggtggaagaacgccccgggcagcggcgcgaagatcgccggccagcagagcagcccgaacagcgaattgatcaggctgttctccacgtaatgcaccggtgcctgcgcctcgtggagatgggcctgcacatggaactccaccgacagtgccggatcgacccgcggcaggctgaggtccaggcgcagcgtcggctgggtgccgccacgcggcgtggccgggccgcccagcttgcgccgcaacctgggcagcagccgcagcagttgctgctgctcggccgcgttgtgcggagctagcaccgccgcctcggccagggccagcgcctgcgggtaatcgccactgcgctcgaagacgcggatcagccgcgctctcgccccgggatcggcgcaggcctggtagatggcggccgccagcggccattcggctagccgctcgcagtgctgccccagcaggaacagcagcttggcccggcgccgctgcaaccagggattgtcgctggcgaacgcctggatgctcgccagcacctcctccagcgccgcaccgctttcaaaatgctgccgacaatcctccaggtacaggaaaccctcgacgtcggcgcggctgcgcagcgcccgggcgtcgtcgcgaaactcgaccttttcataggtgaagatgcccaggtcggccaacacgaactccgaccagtcctgatgcaggttgccgaagaacatcaggcgcaggcggtcgcacagcgccatgactgtcaggctgcacaccccgtcttccagccccgggcaccactggcccaggctccgcggctcgtcgaacaacggcgccaaggcggccagccagtcggacttgcgggccttcggctgttcgatttccgcgcgaaaaacctggaggatctccgccttctgcaacaggttgaacagttcttccagggtcagcggcgcctgctcgtcgacccagcccaggcgcaccagcggcgcgacggccgcgcgagtatcgccgatttcttcatagaccagccgggacgtgcgaaaatggcagcctttgcgcatgatcatgcgcaccagcaacgcctgggatggctgggccagcgccgagaagtcgtcgatgaagctacgctcttcgggtgacagcacatcggcgtagcgcagcttgagccacgccagcacctgctgaaagttgtgcaggtaataaagagggttttccagagggttggaagtcacaggacaagcgcgccgcaaagaggtggatactggttatgcatacagataacagctgccgacctgccctggcaaacactattggataagtggcgttacaggtttttttacggggccgcagaactttcttgcggttaatcacaccaagggcggatagccatatagtcgcgagccgccaatcatggtggactcacgggattcatgaagagaggtttgtctatgaacgtcaaatacctgggcctgccgttggccgttgcagccttcctggcactgggcggctgtgcctcgccaaccgtggtgacgctgcagaacggcacgcaatacctgaccaaggacatgcctaacgccaagaccgctgacgggttctacgaattcgaagacatcgccggcaagaaaatccgcatcaaggcggccgatgtcgccaccgtccgccaagaggactgaccgatcgaacccggtcgccctcagggcgaccagggtgccgaattctgccccggcacgttgttatcgcaggaaatgtagtgctgctccccgcgcttctgcagttcgccacgcacccgctgacaccgctcgaactcccgggccgccgcattatcgatgctgatattgccggtggtttcaggctttttaccctcccccaaggtcacgctcgcccaaggccgctctgcgtcgatatgaaagcggctgcccggttcgggctgcgctgctttttcggtggcctgcgcggcggccggtagctggtccggggtcacgccgtagcgcttgaggatcgactgctgaggcaagtcctcggccattgcgctgcccgccatcaggaccagcgtcagaccgatgccatacctctggttatcactcaccttgtgtttctcctgctgttcactgttgcattgaatgagcctcggcagcggctgcctgccttgataacgcgcaagctcctgcgaactttaatggcccggagcgcgcacgcggcatccacccgcctggcgacaggccgatgttttatcgagcgctgtgtcacagggggcaggtattggagtcacttccaggctggcgggtcaccctttgggcaaatacccttggttttggcgaaaaaagtgcggtcgagggacacacaaaggcaaacccatgaccgcgcgaggcaaaaatcgccaccccgcgcggtcaggcttcaggcgatggtgatgctcgcgccgttgaggctgtccaggctcacaccgaccagggtcaccgagtcgccgccgaaggtcagcagggtatcgttgcccacggtgctggcgtgggcgcggaagtcgtcgttggcgaccacgcctgcgacgccgaggaacaccagtttgtcgctgctctggtaacccagcacccggtcctggccgaagttgccgctgaacagcaaggtattgctgcccccgcccgcctgcagcaggtcgttgcccgcgccaccgaccagcacatcgttaccctggccgccgatcaggtggtcatcgccgtccaggccgaacagccagtcgccgccggcgtgggcggtcagggtattggccgcggcgtcgcccttcaccgaagcggcgtactgggtcaggttgctccccgccagcaggcccttgtcggtgacgctatgggtcacatcgtccttgaacaggccccagaggaaccccggttccttgctggtgatcgcgccgatatcgcgggttatgctgatgccgccattggcatcgcgcacatacagggtgccggcgccgtcgttggcgaagctgaagttcttcaccgactgctgcaggtccagggtgttgtggccctgcccgcccagtaggatgttgtagccgccggcgtcgcggaaggtgtcgttgccggcgcggccttcgaggtagtcgttgccctggccgccctggatcaggtcgttgctgtcggtgccgatgataaaggtgctgcccttgtgggtttcggcattgcggttgaggtcctggacccaggtggtggctcgcgccgggtccgacaggttggcgacgatgatggtcgagtccttgctcgtcaggtcgtagaacttcgactcgaggatccgtgtcatgccgtcgccgtagccggtgggcaggtgcgacagccaggtcgggacattcaggatggagaacggcagcaggttccaggccgccgaggcgtaatggtcgttgaaactgacgatgttgttggtcgccgactcctgcgccgtgtcatgcacgccgagggacgccaggttgaacgaagagccatcgagggcgcggaacaccggttcgttttcgtagccgatattcagcaccttgtcccccgcgctctgggtcggcgaggcgtaggcgacgtagctggcatcctggtagaaccccgaccagtgatcgccgctcaggtccgccaggctgttgaccgccaggccgccgaggctgtggcctctgaccaggatgtccttgcccgtcaggccgttggcctgggcgaaggccgcgacatcggcgagcagcttgccgaaggcttcgccggcgtagtttttcgcatagtccctgggcccgaacgccgccagcaggtcgttgatcacatcgccgatggagtcgccgatcaccgattcacggggcccgctggtgccgcgaaaggcaatgccgatggaagtcaggtggccctggtcgtcgtacttgccgaggacttcggcctgggccgtggtgtagccggccttttccccgtagtaggtgcccctgaagtcggtcttgccgtcgtagcccagctgggcagcgccgatcggcgtccagccggccttttgcaccgcttccagcgcggctttctccgagtcggggttccagggcagcccgggaatcaccccttgcgagtcgctgctgccgatcagccccgtgaccagggtcgccggcaggccgaggccgaaaccgtacttctgatagccggcggaaaaaccgttgtcgaggttgtggtaggaatacagcgtgatcgccagcgcatcggaaaacagcgcctttgaatcttctgtgccgaggttcttgtagtcatacacacccatggtattgcctctctttgttgttgaactttattcgagatagctcacgcgagcggagcgccttcagctggcgccccgcccttagtgcaatgcctccttgcgttttttatctaggcgaagacgatcccccctgcggaaaggctgtccggcgcgaccccgaccagcgtgacggcgtagtcgccgacgctgagcaaggtgtcctggccgctctgtgacaggtgctgcgtgtagtcgtagccctgccccgcgcccgccacgcccatgaacaccagcttgtcgctgccctggtagccatggatcgcgtcgaagccgaaggcgccgctgaacaggaaggtgttggccccgccgccgctggagtacatcacgtcgttgccggcgccgccgacaaaggtcacgtcgctcttgtcgctgcgcagcacatcgtcgccgccgtgaccgaacagccagtcgccgtcgacgctggccaccagcgcattgccgtaggcgtcgccattgagcgagtggttgtagggggtcaactggttgccggccagcaggccctggtcggtcacgctgtgggtcacctccttgctgaacaggccccaggcgaaacccggctccttgctcaccagcgcgccgatatcgcgggtcatgctgatgccgccgtaggcatcgcgcacgtacagggtgccgtcgccatcgttgaccacgctgaacttgcccagcgactgctgtaggtcgaagacgttatgccccttgccgcccagcaggatgttgtagccaccgtcgtcgcggaaggtgtcgttgccgtcgcggccctcgatgaagtcgttgccgcgcccccccttgagcaggtcgctaccgtcggtgccgaagataaaggtgctgcccttgtgcggttcggcgttgcggttgaggtcctcgacccaggtcttgccccgactggcctcggacaaagtggaaacgatcagggtcgagtccttgctggtcaggtcgtagaacgccgaatccaccacccggttcaagccatcggcgtaacccgcggaaccgtgggccttccacgacagcgggttgaggatgctctgcggcagcaggttctccagggtcgacgcgtagtgctcgttgaagttgacgatgttgttggtcgccgacgcctggaccttgtcgtggctgcccagggacgaagcgttgaaggtggtgccgtcgagcaccctgaacaccggatcgttttcgtagccgatgttcagcaccttgtcccccgggccctgggtcggcgaggcgaacgccacatagcgggcgtcggcgtagaaaccgccccagtgctcgccgctcagctcggccaggctgttgacccccaggccgcccaggctgtggccgctgaccagtacatcctggccactcaggccctgggccttggcgaactcggcgacactggcgaacagcttgtcgaaggcattcttgctgtagttcgccgcgtaacccaccggcccgaccgccgccagcaggttgttcttgatgtcgcccagggtatcgctgaaacccaggccgccagtgccgcgaaaggcgatgccgatcgacagcagcttgccggcctcgtcataacgccccagcacttccacttcggcgctggtgaagcctggctgctcgccgaagaaggtgccctggggcccgaccttgccctgataccccagccgctcggcaccaatcgccgtccagcccgacgccagcggctgcccggtgggcgtgtaggcgtagagcgtcaaggccagggcatcggtgtacaacgccttgcccgcctcgcccttgaaactccggtaatcgaatacacccatgttgtgtctcactcttatggtcattggcccgcaggcctcagaactgccagtccagggtcaggccgaccccgtgactcttgtcccgagaacccagcaggccgttgtagtccaggtttacccgggtatcgcgccccagcaacaggccggcgcgagccccgaccacagcggcgttacggtccagcgcaacgctctgtatgttgaacgaaccaccattggcaaaagccaggtgctgatccgaattggtgtcgctcaggttgtgctgccagccgagggtgccggccagttccagctgccgggcatcggacagggcgaagcgtttgctggcccgcaggccgagggtcgagagcaccgcgtcgcggttgtcatcgccactgcgcaacgcggtagccccgcctttttcgcggaagctgtcgctgcccacatgcacgtagcccaggttgacgaagggctccagcgccacacccggcagcgccacttgccatgctgcttcggtgaacagctgggcggtctgggcgtcacgcttgaccttctgccggtcggagaactcgccgtattgcaggtcgcgcttcacatcgatgcgatgccagctgtaggaaccgccgacgctcaggcgcacggcatccagctgatggcccaggtaggcccccaggtgatagctgtccaccgaggccgaggaatgggtgccgtcgcccatgctcagggaactgtcgctgtagccggtgaacaggccgagacgggtgtcttcggcgatcaagccatcgaccccggcgagcaggccgccgatcgaagtggtgtagttggcatggtcataaccgccatcggccttgccccaggcccccagcaccttgaaccatacgttgttgtcgctggcggcgggcgccgtcgaatcgagcaggccgtcctgacgcagacggtcgcccaccgcatcgcgcagctggcggctgtcgttgatcagcagcgtgccgatggccggatggatctccccggtcagttgctggaaggcttgttgcgcgctggcggcgttctccgacagcagcaggctttcgtacaccggattgcccgcccccagtcgctcggcggcggccgccacggaacgctggttcggggtcaggccgacgtcgctgaaggacgtggcgttacgcgcgacctgtaactgcacgccggtggccgagtaatcgaggctgccacctatgaacaggtagttcggcgccaccgagccgaaacggccttcgatgccaccggccgcctgcaggatgttgtattgccggccgagcaggctttgcgcctcgcgggcactgagcagagtcgggctgttctccagggccagggtcacgttggccccttcgacggtggccttgccgccagcgacgatctggtcgctgctggtcggcgacagctccaccgtgtaggtcgagcccggttgcagggtcacgtcgcccgccacctgcaaggtgccgatggagttgcccggcgccacggtaccgccgcggttggcggtcagcgcggcgatgcgcccgttgccgccgagaatgccgctgtcattgaccgtcaccgccgaggccagcgaaccattgatggccaagcgtccctgattgaccagggtcgggccgctgtagctgttgttgccggtgagtaccagggtgccgatgccctgcttggtcaggccaccgtgtccggaaatgtcgttgcgccagacatccagcccacaagacaggccagtgcacaggcgctcggtgggtttgccagcgtccaccacggcgccgatgccgggcaggtcgaccacgaactggccggagccgtaggcgccttcgacacggaactcctggggaatgtccgcttcggtgacgaacatgcccggaccgtcgatgcccttttgcaggttgatcatgccccagccgtacagcgcgtcgatgccgggatcgcccatgtcggtggcggtggtcctgagcaccgtggcgatctgcgaagcgctcatatacggaaagcgctccatcagcaccgccgccgcgcccgccacatggggcgcggccatcgaggtgccgctcttgttggcatagccgatggtcatgtcgtccaggttggtgccgccgatcaccgcactgtagacccgtgtacccggcgccgagacgcagaagctcgcggtgtagccgcagcgcgaggagaaggtactgagggtatagggattggggctggcggtgtccgggttcttttgcaaggccgccaccgtcatccagttcggcgcgatttccggcacgaaataggccaggccggcgatggcgtccggattgttcaggttgtagtcgttaccggcggcgaagatggtcagcacgccactgcgagcggcgtcgatcgccccgctgtaggcgccaccctggcgggtgcccagcagcggctggatctggtcgaactgcaactgcgcgtcctgcacggtgaaatgcggaaaggccgggtcgcgaccgccctggtcgaagcggtcggtgatgccaatgccccagctgttgttgatgatccgcgcgccgctgttcaccagggcatcccagccggcccggtagaccgcgccgtcgttgccgagaatgatcccgtcctcggggcccgggtcgccgttttcggcactgatgatctgcgcgtcgaaggccacgccatgcatcggcccgccgtcgcggctgccggcggcgatcccgccgacgtgggtgccgtgggagccgagcttgccgtcagagcccaccgagggcgtgccgtcataacggaaggcatcgccggctttgaccggaatgtaggggtcggtgtattcgcggatgccgctggtgaccagggtgatcaccttgttgctgccgctgaattccgggtgctgggcatacaccggctggtcgaagatccccagcttgacgcccttgccggtatagccggcggcatacgcctgctcggcatggatcgcccccaggccccattcggcgttgaactcggcactgcgccaactgccgggatcgcctggctggccgctttcgacataaggcgcggcctgggcgttacccgccacggccaggccacagatcaaagcgccgcaggaggcgcgcaccaggctgttggccgccggagcagcccccgtaaatctgtatttcatcggtaccttccttagttgccttactagaaatagttgccttgctagaaacaccgcgtcagacccggcgcggctggttttaccgaacagccggcccgtcaacggcgagccgtgctgtgccgatagcggctgtcgtgccgacgcgaccttgcgtcaggacggtggtctcgggattcgtgtcagaactgccagttcaggctcaaccccgccccgtggttcttctcacggctggccagctggccgttgtaatccaggctcaggcgcaggtcgcgactcagcgccaggctggcatgggcgccgaccaacgcggcattgcgcggcagcgaggtgctttcgacgctgaacggcgtgccgccggacgcaaaggccaggtgttcctcggcccgggtgttgctcaggttgtgctgccagcccagggagccggaaaggtccaggcgggtttgcccggacagttcgaggcttttcagggcgcgcaggccgagggtgctgagtgcggcttcgcgactgtcgctgccgcctttcaacgcggcggcatcgcccttctcgctgaagctgtcgcggtgcaggtgcacataggccaggttggcgaacggctccagggccagcgccggcaggtcgaggcgataagccgcctcgccgaagacctggctggtgcgggcgtcgaccttggctttctgcttgccgctgacttcgccgaactgcaggtcgcgcttgacgtcggcgcgatgccagctgtgggccgcgcccgcgctcaggtgccaggcgcccagctcgtggccgaggtaggtgcccaggtgatagctgtccacggaggccttggaatgggtgccgccgcccatgctcagggagctgtcgctgtagccggcgaaggcgcccaggcgcgtgctgtcgctgagtgcgccgtcggcccccagcagcagcccgccgatggacgtgttgtaggcctcggtgtcgtggctgccgtcattcttgccccaggcgcccagcactttgagccagaggttgccctcgctctgcaccaccgcgcccggcacctgcagacgctcgccgaccgcctcgcgcagctgacggctgtcgttgagcagcatcgagcccagcgccgggtagatttccccggacagctgctggaacgcctgttgcgccacaccggcgctcggcgagcgcagcaggctttcatacaccgggttgcccgcccccagttgctcggcggcggccgccaccgagcgctggttcggggtcaggccgacactggcgaacgaggtggcgttacgcccgatgctcagctgcacgccactggccgaataatcgaggctgccaccgatgaacaggtagttcggctccaccgagccgaagcgaccgtcgatcccgttcgccgcctggaggatctggtactggctgccgatcaggctttgcgtctgttgcaggctgagcaactgcgggctgttttccagggccagggtgaccccggcgccgttgagggtggccttgccgcccgcgacgatgcggtcgctgctggtgggcgacagctccacggcataggtcgagcccggctggaaggtcacgtcccccgccacctgcaaggtgccgatggaattgcccggagccaccgtggcgccattgttggccaacagcgcgccgatgcggccggaaccgccgagggtgccaccgtcattgaccgtgacactggaggccagcgagccattgaccgtcagcaagccgccgttgaccgtggtcgccccgcgatagctgttgttaccgctgagcaccagccagccggcgccggacttgaccaggctgccttcgtacacccgctgcgccgcggccgcgtcgcgggccatgccgacggtgtagtcggtcttgtcctgctggctggcaccggcgccgaggccgttttcccagcccttgtccttcagggtctgttgccaggccgcgtgctcggcggcgtcttcgccctggcgctgcaacagcgccttgtccgagatatcgttgctccagacatcgccctgcccggcgcccaggttggcgtcgaacgatcccagcaactgcccgggaccgtgcatggcccgctccaggttgggcacgccccagccgacccggctgctgggcgcctcggtgatcgaaccgtccagctgggtggcggtggtcagcagcacctccagggcctgctggttattcatgtagggataacgctccatcaccagggccagcgcgcccgtggcatggggcgcggccatcgaggtgccggacttggtggcgtaaccgccgccgggcacggtgctggagatcagccgcccgggcgcggccacgcaccagtacttggcaatgccgcactggttgtagcgctgctggttgttcgcatccaggccggacaccgccagccagtggccttccagctccggctggaagtacggcagcgccgcgcgcacgctggcgttggcgtaaccgctgttgccggcgctgaacacgttgatcacgccccggcgcgagatatcggcggccgcgtccagccaggtgccctggccatagtgctgggcataggcggcgtgcaagtcgcccagggtctggtagctgacacccggcggctggctgccccagctgttgttgatggcgcgcaccccggcatccgccagggcgccgtacaccgccttgaaatactgcgggtccggggtcgggccgaacaggaaactgtcgttcttgttggtgttgcccacgtagacctgggcattgaaggccacgccgtgcatgccaacgccatcgcgagctgcgcccatggtgccggtgacatgggtgccatggctgtcgttgttgccgttgagcaccccggagacgctgaacggcgtgccgtcgacgtagctgccgctggcggtgaccccgtggaagcgctccggcgaggcttcgccatggctggcgtcgaagcccgagtcgagggcgccgatcttcaccccgctgccggtgatgccggcggcataggcggagctggcgcgcatgcgttccaggccccagtcctgggtgtattcggccgattgccaactggccggcacccccaactggccggtttcctggtactgcgcctggaccaggccgggcagtgccgccgccgacagcgtggaacaggcgagcaacgagcggcgactcagcgccttgagctgataaaagcgtctatccatgcgatgacttctcgttttttgtttttgtcgaaaatgtcaggtcgggccgcccgcggccgcctttttgtcagttcatgagccgggcctgaaggcttcgtcgacccgggccagatcgtcttcacgcagggtgcctgcgtagtagtgcaacttggtccaggccatcaaatagtcgtaacgggcctgcgccaggtcgcggcgcgtggtgtacagctgctgttcggcgttcagcgcatcgaggttgacccgttcgccgccgaggatgctctgcttggtcgagaccaccagggcctcggccgaggtcagcgccttctgataagcgcgcagcttgctgaccccggacaggcaggcgctgaactggcgccgcagctcgatcagggtggtgcgggtctgcgaatccagttcgtactcggcttgctccatggtgcggctggcctggcgggtggccgccgagacgccgccaccggcgtacagcggcatgctgatttcgatgccgatggtgttggtgtcgtagcgctggttgtaggtgttgccgctttccgactcgacccggcgcgaggtggcataggcgctgagccgcggcagatggccggcgcggttgcgctcgatctcgtaacgcgccacttccacggcctggcgctgggaggccaggttcggattgttactgatcgccagctcatgccaagcgtcgtagttggcgggcgacagggtgaaggactcgaagcgctcgcgcagcgggtcgagttcgcggatgtccacggtcggcacgccgatcagcgcgcccagttcgcgcagcgccgcgtcctgctcgtcgcgggcctcgatctcctcggcggtggccagctcgtagcgcgactccgcttcgaggatgtcggtgcgggtgccctcgccctggcgaaacatgtgctcgttctgctggaactgttgctcgaaggccttcttcttggcctgggcgatctcgatctggtcctgggcgaacagcgcctgggtgtagtaggtcagcacccgtaccagcagctcctggctcttgccgcgaaagttctcgtcggcgaacagcgcctgggccacgcccttgcggtaggaggcataggcctcgtagtcgatcagtggctgctgcagggtgaaggtggagccgtagctgtcgtagttgcggttatcgtggctggtgccgccgcggccgtcgggcacggtggcctgggagtcgttgcggcccttgttgtagctgtagttgagtttcggcaacagcccggcgcggccgatgatgcggttctccaggccggcatcgcgctccttgatcgcaccgaggaataccgggtcgttgcgcagggcctgttcgtagacctggaacggccccatggcctgggcgtgggtgcataccagtaaagcgactgtggctccgaagatggaaaactgactcatgcgacggaacatccttattcctcggtcaatgcggaacccgcccggtcgagcaggggtttgaacaggtagttgagcagcgagcgctcaccggtacggacgaacatttccgccggcatgcccggcttgatcaccaggccattgagtttttccatggcctggtcgctgacgctgctgcgcagcacgtagtacggcacgccggtcttttcatcgaccatctggtcggcggagatcaggctgacctcgccggacacccgcggtgtgcggctctggttgaaggcggtgaagaggatgtccaccggcaagtggctgccgaccttgtcgatcaggttcaccggcaggtgcccttccacttccaggcgagtgccctggggcacgatctccagcaggttttccccggggcgcaccacggcgccctcggtgtgtaccccgaggttgaccgcgatgccgtcggccggcgcgaggatttcgctgtgctgcaggtcgaaaccggccgaggtcagttgctgttccagggtcaggcttttcagctgggcctcggccaactggctacgcacttccttctgatattcctcgctgtgctgctgcaacttgagccgcgactcgagaatgccctgctccacccgcccgctttcgccggtgttctgcgccagttcctgctgcacctgggacagctggcgctggtattccatcaggcgattgcgcggaatatagccgttgtccgccaggggctgcaggttggccagctgctgacgcagggactcggcctggttgttcaggtcggtacgcgcgcggcgcatcccggccagttgcgcggtggcgccttcgatattggcgcggatcccggcctgctcgcgggcgaaggcttcgcggcggctgctgaacagttgccgctggccttccagcaccagggccaggcgtggatcgggatcggcgctcagggcctcggggaaattcacctgcttgaggttgtcgcgctcgctctgccagcgcgccaggctggcccaggccatgcggtactgcgcctgcagcgactgcacatcggcttcgacctgggtctggtccaggcggaacagcggctggccctgcttcaccgcctcgccttcgcgcaccaggatccggctgaccaccccgccgctcatggattgcacggccttgcgcttgcccgagaccaccaccgtgccctgcaccgggatgccctggtccagcggcgccagggccgcccagagaaaaaagctgccggcgccggccagcgccagcacccagcccatgcgcgcgaaaaaccgcgcatcgcgctcgggacgctccggcgcgtaaccttgttcgatcatcatttcgctgtccttgctcatgcgcctgggttccgtgtcggggcctgatactggcggctcatgctcaagccgcccggggccgtcggggccgaggttttttcccgctgctgctgttcctggttttgggcctggttttggttttgcgcctgggcaccactggacagcgccttgagcacttcctggctcggaccgaaggcctgcagacgcccttcgttgagcaccagcagcttgtcggcctgggccagcgccgaggaacgatgggtcaccaaaatcacgctggtgccctggaccttcatttgcgcgatggccgacgccagggcgctttcgcccacggtgtcgaggttggagttcggctcgtcgagcaccaccagccgcggctggccatacagtgcccgggccagggccacgcgctgcttctggccgccggacaggccgctgccgtcatcgcccagcagggtgtcgtagccctggggcaggcgcaggatcagttcgtgcacgccagcctgttgcgcagcctgtaccacctgctgcgggtcggcctcctgaaagcgcgcgatgttctcggcgatgctcccggaaaacagctcgatgtcctggggcagataaccgatgtgaggccccagttcgttgcggttccagcgatggatatcggcgccgtccaggcgcacggtgccggccagggtcggccatacgcccaccagcacccgggccagggtggatttgccggagccggaagcgccgagcacccccagcacctcccccgccccgaggttgaaacctgacctgctgcaaggtcgccatgcgcttgcccggcgggccggcgctgacctgttcgaagctcacctggcccttgggcgccggcagcgacatcgccgtgtcgctcggcgggaaggcctgcagcagcgagtccaggcgctggtaggccagcttggcggaactccactgcttccagacggcgatcaactggtcgatcgggctcagcacccggcccatcaggatcgagccggcgatcatcatcccggcggtcatgtcgcccttgatcaccagcaaggcccccaggcccagcaccagcgattgcaggcacaggcgcagggtcttgctcagcgagctgatgaccgcgccggtgtcgctggcctggttctgcaggccgagaaaacgcgaatgcacctcgaaccagcgcttgcgcagcgcgccgagcatgcccatggcctggatggtctcggcgttgtgcagatggctggtggccagttgcgtggacttctgcgaatagccgctggcctcgcccagaggcttcttggtcatggcctcgttgaggtacgccagggcgatcagcaagaccgcgcccgcggtggcgaacacccccagccaggtattgaacaggaagatcacgaacaggtagatggggaaccagggcgcgtcgaagaaggcgaacagcgccggccccgtgacgaactggcggatatgggtcaggtcgcccagggactgcccggcatgcccttcgccacgaaacaggttgcgctcgaacgccgcctggtagacccgcaggttgaaacgccgctccagctggctgccgatgcggatgacgatgaagctgcgcaccacctccagcaggccgatgaacgcgaagaacccgaccaccatcagcgacagcatcgccagggtggtttcgttctgcgaggaaagtacccggtcgtagacctggagcatgtagatcgaggggaccagcatcagcacgttgatcagggcggtgaaacacccgacgctgatcagaatgcctttgtaatcgcccagtgccttgaacagcggtgcagtggtcttcgccatcttcattggtctttcctgagctgtatatcccgtgccaggggcgcaggacaaataaaccgcccgtacttgagtcgggacattattggatatattgcggcggacaggcgaaaggactctaccgccagacgaaatggagttctagttatttagttgtctttaatcgaacgaaggacatcgcgtatatggcactgtcttatacgcttatccatacagatacatttaaagatgcatacagccgcgatgtttcaaggggctcgctgcaatataatcgtgatgcctgatttcaaagtgccttgatataagccttctttctggcgacttagaaagatgatcttcgagccctcttttcccgtcaccgcaataccgtccggctcgggaaaccagccgatggccgaatcgcccagccaggcggaaaaacactcggcgccggcgcccagggtgccattcagctccaggtccagggcacagtggctggcaggttgcgcctgctgcgacagttgccagtgtccggccagttccgcggggtccgccaatctcaggctgcttgccatgcttgtctctccataaaatatcatcagcgtcgcgatcaggtacgcgccggccttagcgatcaaggcagttcgaatcataggggggtcgctccgggccacagcctcaggcagttcgccagtcaatgcaaggtcagagggcgacgcctgggcgccaccctccttcttctaccttacagcaacgactcaggcgacgatgtcagtggtgtagtctgcctggccgacgatattgaccaggaagtccgccacaccgtgcccggagaagtccactgacaaagtgctgttgccagccgaggtgctgaggatcgcgtcgccggcattaccggtgaatgcgttcacgaaatgcagcccggcgcccttggtgatgccggtcagatcgatcttgtccaggccgctgacaaattccatgatctggtcggccgcccccggtgcagagtccgaactagcggcgaacacaaagatgtcggaacccgcgccaccccagagtttgtctgccccaccggcgccatagagaatgtcgttcccaaccccgcccttgagctcgttggccacactattgccaatcagcaggtcgttacccaaaccgccgatggcgttctcgatgatcgcgccctttgcgatggacacgctgcccaccatgccaccaacgtcggagaacgaggcgtcattgaggttgatcttctggttttgggtaaaaccggagaagtccagcgtgtctttgccgcccgcatcccataccgagaacaccagcttgtcggccgacgaactggcgctgaggaagtcgcgcccggtattggagttgaagccataggtggtgtcgccggtacgggtcgtggtgttggccccgtagagcttctggatcgccgcgatatcgtccatcagcgggccggacgaataggcttcgacgccagccttgctgaagttctggtcggtattgctttcgctccagtagctcatgatgctgtagccgcgcgtatcctctgcataggtcgcgtcgttataggtcgggtagccttcgccggcgttgtagtcaccggggtgggccaggcccagggtgtgcccgatctcgtgggtcagcgtctgccggccatagttgttcagaccaggattcttgttctgggtgtaactgctattgatcaggtaccaggacgtaccgtcgtagccagcaccggtgcccggcaggtaggcgaaggccgccgcgccgtcctggccgccgctgtagttgccaaaggtcatgtgaccgtcaccaccgtaggccttttcggtaaaggtgacattggccacgtcggcccaggattgcatggccagcgcagcctgggctttctgctgggcgttgaactggctgaacccggagatgccatgcttgtacagggtgctcgaggacgccgaggtcagaaaggtataggtcagttcgatcttgccgctgccgttgagatccttataggaggcaccgtcgcgcagcagctgggtggctgcctgatcgaccgagtaggagggcttgccattgaccgtcagattgccaccccggtcatactgatggctgaagctattgatctggttataagccgaacttgctgcggccaagggcacgagttcttgttcggcggtcacaatagctttcgctttaactttcgacataaacacacttccttgtaatcaatggaacagtttttgtccgatagcgacaatccctggcgagatcgtcctatcactcgccccattcgggcgtaagcaacctgacacaatttgaaatcaggcgtccactactttttgactcctgatttctgctgttccagcaaactcccgcaaacaatgaccggtgagtcgaaatatcctttaacgctcaatacccgacgataattgtccgacaatctcgaatttaaatattaaataaaggtaaacattgttttgccgactgtgtcgcagttttttagttcatgcaagtttgttccacccagttagtttcatcgcttcaagcaaggcttccccggtcagcgccggaacgctcgcgccactgtccgcggtcatcggctcgcccgccagcaaggcgttgacgatggcctcctccaccgcttcggcggcggcactgaacagggccgagatgtaatcgttgttgagcatcgccaggggcgtgctgaagggcataccctggcgcccataggcgcaaggcggcaggtcgcggttgccggtggcgaaggccaggaagatatcgccgctggagtcctcggtgccgccgccggtgcgggcgatgccgatcgacgcgcgctgcgccaggcgctggcactggtgcggcaacaagggcgcatcggtggccaggatcaccacgatcgagcccatgcccggcgtaccgcgctgggcaaagggcgacggaatgccagtcaattgccgccccaccggataaccgtcgacccgcaactcctcacgcttgccgtggttggcctgcaccagcgcgccgaccgtatagccgccctgctcccccggcacccggcgcgaagccgtgccgatcccgcccttgaactcatggcagatcattccggtgccgccacccaccgcgccctcgcgcaccggcccggactcggcattggccagcgcctcgcgcacctgctgcgggccgacatgctggccccagatgtcgttgagcaggccgtcgtaggtctccatcaccaccggcatgcaccagtattccgaagggtccgccaggcttgtgtgttcttcggcgatcagcgcgtcgcgcaccacgccgacgctgtggctgttggtgatggccagcggcgtggtcagcaggcccgcctcgcggatccactccagcccggtggcatcgccgttgccgttgagcacatggcagccggcgaaacagggttgcagccgggcaaagccttcgcggggctggatcagggtcaccccggtacgcacctgcttgccgtcgaccgtggtcttgagggtgctgtggcctacccttacccccggaacatcggtgatggcattgaaggggccgggagtacccaggcccaggctgatccccaattgacgtgcgcgcatgacttctcctcagagtttctggaacgccgggctgaaccggccgttggtgccatacaggatcaccgacagcgccagcaggccgacgatcaccatgatgtccctgagcgaagcgtccaggaacagattgaacaacagataaccggcgccgatcaccgccagcagcgccggcaacggccacagcggcatgcggtacgggtgggcgcgatcacgcagcagcacccggctcatcagcgcgctgagggcgacgatcaagtacaccagcatgatcagcagcacgctgaacgaggtcaggtcggccaggttcgagctgaagctgagcaccgccgagggaacggccaggaatagcgtggccagccatggcgaatcccagcgcggatgaatgcgggtgaacaggcgattgatgcccggcgtccacaaggcatcgcggccactggagaacaccacccggccgatctggatcacgatggcaacaatcgcattgaacaccgacaggaagatcccggcgctgaccacccgcgacagggtttcgttgccgtggctggtgagcaggtagccgatggggtcgggactttcgagcatggcgctgagggacggcgcgccgatcagcagcgcggtcagcggcaccagttcgatgaccaccaccagcgccagcgaccagagcaccgccttgtgcacgccctgccccttgcatttcatgtcttcggccagcagcaccgccgggccgtagccgttgtaggaaaacaggccgatgcccaccgcgccgatcaccagggcccagggcgccatgtgcaatacgccgttttcgacgatctgcggttgcagcaggatgctcgccggctgcgaggcattgccaaagcccaggaacacgatcaccagcaacgcggcaatttccagcagcaggcaggtgccggtgatccaggcattgagcttgatattgaggatgcccagcgcatagctgcagataacgatcaccagggccacggtctgcgaatcgaagcgcgtgcccagggcattgttcaggtaagtcgccgcgccagtggccagcaccggcgggatgaacagcaacatcaccagcaccgtgagaaaggtcgcgtacccggccatgccgccgaacacccgcttggcgtacacatactcgccgccggcactgttgtgggcgcgacccagttcggcgtagcagaaggcgaacatcagggccagcagccccgccatgacaaaggccaggaacaccccgctgccggcctggtgaatggcgaacggcgcgatgacgaagaccgaactggccggggtcacgcccgatacggtaatggccactacatcgaacacgctcagcgtgggtttcagggcgccttgcggcgcgcagggagagctcatgtcgttatcctcgtggttatttttggtttgaggcagaaacgaagaacgtcaggcggatgcgctctgggtcgcacttgatggaggccactttaggcagccgggggtacagggccaattcccctattggagtactcccccttgacgtggccgggcaaatcgccgaaaccgtgcttccagctggcgcaaagcagcacgccaggccacaacggcatcgacgcggagccacctatttgatcactctgttcagggaaatcggcatgcatgccggactcgggcgcaccctctcgcagatcggcggcgagcgcttctggaagcaactggtgctgttgctgcaccaggccttgccgttcgataacgccctggcgatcttctatccccacaacggcctgcccatcgtcctcgaggaatacgatgccgagccctcggacaagccggcgtcgatgctcacctacctcaacggcctgtacctgctggacccattcttccaggcctgccgcgagggctaccccaacggcctgtaccgcctggaagaagtggcgccggaccatttccgccagaccgaatatttctccagctacttccacgacaacgtgctggaggacgaactgcagttcatcctgcagatcccggaggccggcaccctgtccctgtcgctgggcatgcagcggccgttcagcgccgaggagatcggccagctcaccaccttctcggcctgggtcctgccattgatgcagcagcattggcagcaaagccaccaacgcccgcagccacccgccggggaggaaatggccagccagatccgcgatgccctgagccatttcggctgcggcgtgctgtcggatcgggaagtggaaatcgcccggctgatcctgcgtgggttctcctccaaggccatggccgagcggctgaagatctcgccggacaccatcaaggtgcaccggcgccatctctacgccaagctggatatttcctcacagccggagctgttctcgctgtttatccagtccctggggcacgacctggaaaacccttgagggctgctcaggcgttcagcgaacgggcgcggtaatcccgcggcgactgctcgaaatgcttcttgaaggtgcggctgaagtgcgccgagtcggtgaacccccacttgaaggcaatgtcagtgatcgacgcgtggcgcaggcgcgggttgcccaggtccgccgcgctgcgctcgaggcgcgcgcgctggatgaaacggcagacactgtcgccctgctcttcgaacagccggtacagctggcgcaccgagatattcatctggctggccagtgacaccggggtcaggttgggctcggtgagggactggttgatcaactgccgggcctggctgcgcaggcaaccgccgtgctggctgtcgtagccgtcgagatgggcgccgggcgtctggcgcagggtcgggccgagcaaggcgatcagcgcttcctgcaacgcctggccttcctgcgggtcggcgcaacctggcaacggctcgccgcagatctgctccaccagcaggcgcatcaagcggccactggcgcattgctgcgagagcttgccgaacttgcgctgctgcgccggcagatggcgatacacctcgtcccgggacaaatgcagcgaggcatgttcgatcagcccgtgggggacgatttcgcaagccccggcggagtccagcaaggccatttcccccggcgccagttcgatgcgctcgccaccctggctgatctgggcatggccgctgcgctgcatgatcaggaagcagtgccggtcgtcttcatgatcgacgctggtgcttttgcgcgagatcagtccggcattggtgcggatctgcgccacctcgaggccggcgtagtcgcgcaagccgacttcgccgatgaacaacgccgagttcaacgcctggcgggcgtcgaagcgaccgcaaaccccctgtaatgcgccgatccaggaaccgaaactttgcgaagcaagcactgtgcacctccagaagccggctgagaccgcctttgttgttatggcgatatcattaacatgttatctatttgccgggcaaggaagcgcggcgcaatggatagtccgttatagcctaagcacgggttgtgccagcgcggtaggagcagttcagtgatcgcgcaacagtgaatgcaggcgcttgaacgtcgccagcaaggcgccgcgttgctcggcgctcaggcggatataacggcggaagccgggcagccggttgaccacctcgctggcaccgaaatgctccaggcgcacccaccagccctgctcgtcgcgttgcaattgcaggcgcttgaagtccagcggcaatagtgccgccagcagctgcggatcgctgtgcaactgctgcaacagccccgcccactcatcctgcgcgccctgcttcaggccagcagcgatgccctggcggcggatcgcgccggtatggcgaatatcgatccgcgcctgccgccccggcgaaccgggaacgcgcaggcgaaactcgcagaccaccaggtgcatcaggaactgcgcctgtggcagctcctcgacctcgaagtccaagccctcctcggcccaggtgaagcgcgccagccctggggcctgcggcgcacagtcgagccccggcaggtcgcggcgcaactggttcagggtcacccccgggcgatagcccgagggtggccgccgccagaactcagagaggttttgccgccagcttgtactgctcatcgggcttggctccaggcagggtctgcgcttgggtttcagtggaggattgcaggttgaaggcgttttccagcacctcctccaccggcaccgggcggaacgggttgaccttctgcacgaagaccgtccagaccagcgcataaatcgccgtcaggccgagcatgctgccaaagggcacgtagatgtcccgcgggttcatgcccggcggcgtgatgaaccacatgcccaggaggatgccgatggacgagacgatctgcggcagcgggaaccagggcgacttgtaggcccgtggcaggtccgggcggcggatgcgcagcagcaccaccgccagggtcaccagcaggtaggcggtgctccaggcacagaccgcggccagcaccaggtgcatgatgttgtccgtgctgccgcccagccaccaggcgtgcaggcacggaatcagcaccgccacggcgatgcacagcagcggcgtcttgaagcgcgggtgcaagtaggtgaaggccttgggcagcgcgccgtccagcgccatgccatagaggatgcgcggcagcccggccatcagcgtgttgatagtcgccgccccggcgaacagcaggccgacgcccagccagatccgcccgtacggccccatcacctgctcggcgaactgcgggatggccatgggcgtgtccagcaggtgcacgctgccgtcttcgctcagcgcgatgttcgccacctggcgcttcatcgccgcgccgtagatgaacatgcaggtggccacgcccaccaggcccagggccatggcccggggaatggttttcgccgccttgcgcacctccggcgtcagcggcgtgacgaactcgcaaccgacgaacatgaacatggccatgcccaccagcgagaggatggtggtcaggtcggtgccgaccatcgactcgccgaaccagccgctcagctccaccgccggcgccttgaacaccccgaccacgccgaagatgatcagggtggtccacatgccgaaggtcaggatcacctcggcgcggctgaacgcggtgatgcccacggcgttcagcaggccgaagaagatcaccagcccgacacccaccagccaggcgctgccgctctgttccagcagggtgttgagggattcgaagttcaccagggccatgacgccgctgaggatggtttccgccgtgccggcgaacacatgcacgatcaggtaggcggagatggtcccggtgatcgcgaagaagcgccccaggccgcaggccaggtagtcgtacaccgagccggtggtgggaatcatgcaggctgcttcggcgaaggtcgtcgattgcgcgagcatcatcagcatggcgatcagcatggccgcggcgaacgccccgccgccgatgccgaagccggtggtggcggtgaggatcaccgggctggccatgatcaggccgacggcgctggccagggccgtgggaaagccaaccacgccctggttcaggtggcgggtgagtctgtcgttgaaagacatggtgctggacctcgaaagcatgggtgatgttgttgttctaggcatttcaagggcacgccgggcgtgcgtgttactggctgtctgcgcagcctgaccggttgtgtccgactgtagccgctgccgcaggctgcgataaggccgaaggccttcggcgatcttgagatcttgcgcaccctgcgggcgcgatcgcagcctgcggcagcggctacgggatcagaacgcgatgcacaccgacttgttctcggtatacgcctcgatcgccgcatggcccatctcgcggctgatgcccgattgcttgtagccgccaaacggcatcgacgggtcgagcatgttgtgggtgttgacccagaccgtgccggccttgatccgcgggatcaggtccatgaccttcgccaggtcgttggaccagatgctcgcgcccagcccgtactgattgtcgttggccagcgccaccacctcgtcgatctcgtcgaaaggcgtggccaccaccaccgggccgaaaatttcctcgcgcaccacctgcatgcccgcgtgcacgtcggccaataccgtcgggcgcacatagaaaccctgctcgccataggcgaccccgccgcacagtacccgggcgccgtcggccacgccctggccgatcatgtccagcacgcgcttctgctgcttggcggaaatcagcgggttgatctgcgcctgttcgtcgagcccgggaccgatgttcagggagccggcgatggccgacaaacgctccagcacctggtcgaagatcgcccgctggatatacaggcgcgaaccggcggtacagacctggccctggttgaagaagatcgccccggcggcaccggcggccgcggcctgggggtcacagtcctcgagcacgatcaccggcgacttgccgcccagctccagggaaaaccgggtcatgttgtccaccgcggcatggccgatgaccttgccgatctgggtcgagccggtgaaggccagcttgtcgatgcctttgtgtgcggccagcgccgcgccggcctgggcgccgctgccggtgaccacgttgaccacccccggggcgatcccggcgtccaggcacaactggcccaggcgcaaggcggtcagcggggtttcatcggcgggcttgagcaccacggtgcagccgcaggccagggccgggacgattttccagatggccatcagcagcgggaaattccacggcacgatggcaccgaccacgcccaccggctccggcaccgtataggcgcggtaccgcgcgcccggaacggcggcgatggacaggtccaggctcttgccttcgatcttggtcgcccagcccgccatgtagcgggtgaactcggcggcggcgccgacttccagggcccgggccaggtggatcgactggccgttgttgagggtttccagctgtgccagctcttcgccatgagcttccagcagatccgccagcttcagcagcaggcgctcgcgatccgccgggcgctgcgccgcccaggggccctcgaaggctcgccgcgcggcggccaccgccaggtcgatatcggcgtcggcgccggcggcgacgcgggtcagttcttcgccggtggccgggttgaacactggcatctgcgcgccggacaaggccggctggctgcgcccgtcgatcaacaggccgtgctggctgtcgataaaggcggcgacacgtgggtcgatggcaatactcatgggcaatcctcgctagttggcctcatggatcgaactctgagaccaatgccggccaccgtcttgatcctggctgccgcgaaacttgccactggctgccagggaacaccgcggcgccaccggcgcgttttttgtagccgctggcgaagcctgcgctcggcggcgtagccgtcgccaagcctgcgaacgcatttttccgggtagatccgcaatgcgcgggacgccgggtcgatggcagtggcggtcaaatgcctggcacacagaggcaagcaggcatccggcaaagggcgcactactatgtcccacgctgtccgtgcgttttcaggagattcaacgtgagcgaaccaagccgcttctggcatcccatgctgcaccccaacgaaatgcaacaacgcgagccgatccgcattgtccgtggcgatggctgctacgtgtacgacgaccagggccaccaactggtggatggcgtcgccgggttgtggaacgtcaacgtcggccacaaccgcaaggaagtgaaggcggcgatcaccgcccagctggacgaactggaatacttccagctgttcgacggcgtcagccatccgcgcgccgaagagctgtcgcgggtggtgatgaacctgctggagcccgagggcatgcgccgcgtggccttcagttccggcggctcggatgccatcgagaccgcgctgaaactggcccgccagtactggaaactcgaaggccaggccgaccgcaccaagttcatctcgctgcgccagggctaccacggcacccacttcggtggcgcttcggtcaacggcaacacggtattccggcgcaactacgagcccctgctgcccggctgcttccacgtcgacaccccgtggctgtaccgcaacccttacagccaggacccggaagaactcggcaagatctgcgccgacctgctcgagcgggaaatccagttccagagccccgacaccgtcgcggcctttatcgccgagccgatccagggcgccggcggtgtgatagtgccgccggccaactactggccgctgatccgtgaggtctgtgacaagtacggcgtgctgctgatcgccgacgaagtggtgaccggcttcggccgcagcggctcgatgttcggcagccgcctgtggggcgtgaagcccgacatcatgtgcctggccaagggcatcacctccggctacatcccgttgggcgtcacggtggtcaacgagcggatcgagtcggcgttcagcaaaaacggcaacttcaccggcgcgatcatgcacggctacacctactccgggcacccggtggcctgcgcggcggccctggccagcctcgacatcgtggtcaaggaagacctgccagccaacgccgcgaagatgggcgactacatgctgaacaagctgctgccgttcgccgagcgcttcgacagcgtcggtgaagtgcgtggcaagggactgatggtcgccctcgacctggtggccgacaaaaccacccgcgagccgatcgaccccatgggcggctatgccaaccaggtggcgcagatcgcccgcgacaacggggtgatggtgcgtccggtggggaccaagatcatcctgtcgccgccgctggtgatccagccgccgcagatcgacgccatagtcgctgccctggagctgggcttcacccaggcccgttgagcctgacgccgcagccttgaagcctggaccggcgctggagccgatatcagcgcggtctgcgtgatcgcaggaagcccctgcggggcttttcgcagcctgcggcagcggctacaagaagcgcggtgtccgtgtagccgctgccgagcccgcgaggctgcgatcggcaacgcagtggccgcaaaacctgagttcgcgatccgtctgaagtaccgtggcatttggtgcccgctacacggtcgttcgcagcctgcggcagcggctacaaggaacgcggtgtctgtgtagccgctgccgagcccgcgaggctgcgatcggcaacgcagtggccgcaaaacctgggttcgcgatctgtctgaagtaccgtggcatcaggtttggcgcccgctatgcggtcgttcgcagcctgcggcagcggctataaggaacgcggtgtctgtgtagccgctgccgagcccgcgaggctgcgatcggcaacgcagtggccgcaaaacctgggttcgcgatctgtctgaaatacggtggcatcagagggttacggccctctttaccagtcgttcatgaagagggagtcatcccatgcatacgccaaccgccctgccggatgcccaacagcttggccagtgctgcatcagcgcctttacccgggtggtgccggcgaccctgtgcgccttctaccgcatcgacgcgcagctacaggccgagcatttttcgctgtaccacatgagcccgcagatgcatgaggcctacctgcaacgctaccggcactacgacccgctgcggccgcgcaactgcgtggcggcgggccgcccggtgctgtcgctgcacatgggcatggcccagcaggggcggcacgaaaccgaggtctaccaggggttcctgcaacgccatggggtgctggatgtggtggaaatccttgcgcgcaatgccggtggcagcccgatcgccggcctgtccctgctgcgcgatgccagcctgggcccgttccggccagacgaactgagcaccctgcaggcgctgcaaggcctgttggaaatcgccgcccaggcgccctattcgcgccacgacgaacgcctgcaggcccttacgccccgggaacggcagatcgccttactgctgcgcgacggcgcctgcaacaagaccatcgcccaacagctggcgctgggcctgccgacggtcaagacccacctgatcaacctgttccgcaaggtcggggtgaacaaccgcaccgagctggtgagcgcgctgttcctgtaaaaaaccgtgcgcctcaaccattcggttgatgggcaacaacggtttgcgcgatgaacatgaggttctccctcatcgacaaggtccgccctcatgaacctgcaacccgaatggattaccgttggcgccctggccgaaggctttgccgccgataaccatatcctgcccagcctggatgacctcaacggccgcagcctgaccctgcatttcgccaatggctggcgcatcgaacaccttttcggctcacgctcgctgcactggcaggacactgaaaaccaagccagcggcgagacgacttatcgagccacttcaatacgttccggcatttacctggtggactttctcaagtcagagaaccaccaggtccactcggtaagcctgatcctcgacctgggccggaacatcttcaccgcggtgatcgggcagatgccgagccaggccgagacccgggtcgacctgttcagccgcgccctgtccggccgcgagctgaccagcgtccaggcccagttcatccacggcagcatcgacacgcctctgaccgccagtagcccgcaacacgcactgaccgaagagctggtcggcctgcgcaaccagtacatctacagcgccaccgaggcctacgagcacatctacctgaaccgcaacttctacagctggcagtgcctcaagggcgtcgagcagggcctggcggacaccgaccgctgccattactacaagctcgccgaacagctgtacctgttcgtctggcgcgaaaagatcgtgccgaccctgggcctggtactgatcgacctgcaagcgggcaggaccgacggcaagatcttcggctaccagggcagcgacttcgccgcgcccagcaacttcccggtgggcgccctcacccatgtgctgaaccgcaccgcttacatctgatgctacctgtcgcgatccgcacggcgcgctcggcctgacacaccgcgcgctcgggtttcgcggcaactgcgttgccgatcgcagcctcgcgttgctcggcagcggctacccagacactggttcctgtagccgctggcgcagcctgcgatcggctgcgtagcagacgctgcctttacggcccttcgggccgatcgcagccttcgccagcggctacaaaaacctgtcagcgacaaccctttaccccaggacttcgaccatgaccctcggcctcaacctcgatcgcgtcgccagctgttaccaatccgagctgcaactgttcgccgaacgccacccgcgttccgccggcttctaccgggaaaacctcaagcactggttgtacggcgcgccgctgcactggatgcagcaatggccggggctatacccgatcctggtggccgacgcccagggcgcgacgctgaccgactgcgacggcaaccgctacatagacttcgccctgggcgacaccggcgccatgttcggccatggccagcccgccgtggccgaggccatcgcgcatcaggcacggcacggctcgaccctgatgctgccgaccgccgacagcctgtgggtcggccaggaactggtgcggcgcttcggcctgccgttctggcaagtcaccacctccgccaccgacgccaaccgctttgtgctgcgcctgtgccggatgatcaccggccgggagaaagtgctggtgttcaactgcaactactacggcagcgtcgacgagtcccaggtcgagttcgacgccagcggccagatgattccccgcgaaggcgtgcacgccaacggcctgcgccacgacgccaccacccggctggtggagttcaacgacctgccggcgctggaagcggcattggcccacggcgacgtggccgcggtgctgaccgagcccttcatgaccaacgtcggcatggtcccgcccgcccccggcttccacgacggcctgcgcgagctgacccggcgtttcgatgtgccgctgattatcgacgaaacccacaccatctcctgcggcccggccggctacagcggcgaatacggcctgcaaccggacttcttcgtgctcggcaagtgcatcgccggtggcattccgaccgcggtgtggggcgccagccaggccatggccgagcgtatctggcaggtactgccgcatttccagcccggccaggcgatcaaccacttcggcttcggcggcaccctggccggcaacgccctgcagatggccgccatgcgcgccaccttcagcgaggtcatgagcgcggccaactacgcgcacatgatcgccctggccgaacgcctgcggaccggggtccaggcgctgatcgccaagcaccgcctgccctggcacgtgacgcggatcggcgcccgggtcgagtacctgttcatggaccacgcgccgcgcaacggcggcgaagcccaccatgcccgtcatggcctgatcgaggcctacctgcatctctacctgctcaatcgcggggtcttgctgaccccgttccacaacatggcgctgatctgcccggcggctaccagcgacgacgtcgacctgcacaaccgcctgctggacgaatgcctgggcaccgtcactcaaggagaacatccatgatcctcgacctcagcggccgtatcgccctggtcaccggctccggccagggcattggccgcgccatcgcgcaagtctttgccgcccagggcgccaaggtgctgctcgccactcgcagcgaagcctcgggcgccgaaaccctgcgcctgatccgtgaagccggcggcagcgccgaactgctggtcgtggacctgagcacccgggccgcggccaaccaggcggtggccaccacgctcagggcctttggcgggctggacctgctgatccacaacgccgcggtgttcccgatggaaaacctgtgcgacctgagggatgaaatcctcgagtcgaccctggcggtgaacctcaagagctgtttctggctgacccaggcggcgctgccggcgttgtgccgggccgagcatccgcgcatcgtcatcacctcctcggtgaccgggccgcgcacggcgattcccgggctgtcccactacgccgcgtccaaggccggggtcaacggtttcattcgcgcggcggccctggaactggccgaacaccgggtcaccgtcaacggcgtcgaacccggcctgatcgccacccaggccatggccaacctcggcgactccccgaccctggccgccagcatcccgctcaagcgcctgggcagcccgcaggacatcgcccacgccatgctgttcctggcgtccgagcaggccggctatatcaccgggcaaaccctgatcgtcgatggcggcgccctgctgccggaaaacatgcagctcatctgacggcagatgcctgccctcacccacggcgcccgaccgggcgccggcacgccgaccccggcagcaccattcacccggccccttcgcccagcgagatcaacggctcaatggtgctatgggtggaacgctgcatcccgtttttaccgattgacttgaagtcaactttaacttttagagtcggctccgacccattggcgcgcctcaccccggcgatcctcgcccgcctgctttcggagaaacccatgccctcaaccaagcccgacaccctcagctacgccgtcgccgataccagatattggcccgccgtgttcaacgtgctgtttgccggcattgccgcagcgctgcatatcggcaaggccaccatcgccctgccgcagctgcagcaggagtttggccggtccctggaatccctgagctggatcatgtcggccttcccctttatcggggtgttcggcggcatcgccgccggcatcctcgtgcagcgctggggcgatcgctatctgctggccctcggccttttgatcatgtgcgccgccagcgcgctgggttccagcctgcacgacttccatgggctgctggccacgcgctttgtcgaaggcctgggcttcgtcattgtggtagtcgcggcgccggcggtgctcaatcgcctggtcccggcgcacaaacgccacctggtgttcggcatctggagcaccttcatggcgttcggtatcggcacctcgatgcttatcgggccattgctcggtggctggcagcagagctggatcgccggcgcggccttgaccctgctggcggcgctgctgttgccgttgaccacgcccagggacccgctggcgctgcgccgccagacgcaatccgctttgcgccactcgctgagcagcgtgctgcgcgcccgccagccgctgctgatggcactgattttcaccgcctacaacctgcagttcttcgcggtgatggccttcctgccggtgttcctcatgcagcgggtcgggctgtcgatcgccagcgccggggtggtcagcgccgcggtggtggcggtcaatatcgtcggcaacatcagcgccggcctgctgctgtcacggggcgcccgcccacgagcgctgctcgccggcaccagtatcgtcatggggctttccgggatgggcatcttcctctcggccacgccgaccgatctggtgatccctttgtgtttcttcttttgcgcggtggccggcatgctgcccgccacccttctcgccagcacctcgctgacctcgccggaacccgcgctgatcccgctgtgcctgggcctggtgatgcaaggcaactatctgggccaggtgctcgcgcccattgccctgagcgccgccgtcgcctatgccggctggtccgccccggcggcgctggtgctggctgccgcagtgctgggcgtgacgctggcgatgcgcctgaagataaagcaataaaaacgccgctccgcgacggcggtcgccaagtcggggagcggtggcaatgcttcagctgccggtgcggatccggtcgatattcagcggcatggcttccagggcgaacagcttgcccatcatgtccgggctcgggtagaccttggcgtcgttcttgatccaaaagatcacacaaaccgggctattcgcgcttaagtgctctttctgctccattgctccccaaaccccggtactggcctgcatggaagaccagcggttctgcgccgctgtatcggtattgttcgatctcgccaatgaagatcaggtggtcaccgccctcgtactgggtgacgttgcggcacaccagcactgccaccacatcgtccagcaccggggctcccgccttgccataggaatgagctacaccggcgaacttgtcagctgctgcccgtgcgaactgctccgacaagtggtgctggtgcgcgcccagcacgttgatggcgaagtggctcgccgagcaaaaaaacttcaggctcggtgccgtgcgtgccaggctccagagcaccagcgccggcgacagcgacagtgaggagaacgagttggcggtcacaccgacgttgcggccctcagcggtgcgcgtggtgatcacggtcacaccggtagcgaactgccccagcaagttgcgcagttcgcggacaccgcggccctcggcatcgagcaaatcgtgagccttggtttcggtggcggcgttcatggtgatctctcccctcaagctggctcaggcagcctgttggctcattgcgcgcgattgcacgcgcagcgtgaatcgaaccagcggtgcggtcagcgccgtcgtcaccagcgcgaacaccacgaggatcgtgtagacccttggcggaaggatctgcatctgcagaccgattgacaggacgatcagctccatcaagccgcgcgtattcatcaacgagctcaccagcatcgcatcgtgtggcgcaagcccggtggcacgcgcgcccagatagctgccgccgaacttgccgatgaatccgcccgcgaggaatacaccgaaccacatccatgatgccgcgtcgtcgatcgtgccgaccgacgcatgcagccccgcatacgcgaagaacaccggcatcagcacaagcttgacgaaaccttcgacgttgtcgcgccactccttcgcgacgccgggcacgcgccgcacgaacagcgccgccgcaagcgcgccaaatgcgctatgaaatccgatcagcgacgtcgcgagtgccgacgctattacgaagcagaacaacacggccaagcggtcgcgcgccgcatgcgcagtcgatgcgagccgcgcaagcgtcggtcgaaccacgaagcggaccaggagcgcgcacagcaccagatacgcgagcaggctgagaagcatgcgcgcaaatgcccagccaggcccgctcgatagcgaggcaatcgttgcaagcagcatccatccgagcgcatccgtcagcatcgcggcagacattgcgtaccgtgcgcccatcatggcgctgagcgccaggtcgtcgatgatgcgcgccatcaccggcactgccgataccgcaagtgcgacaccgcagaagagtacatagggcagcgccggcgcgtcgctggcgagcgtgtctttcgagacgatggcgacgatcatgccgatcgcggccggtgcgacgagcccgcccgctgcgattgcgacgggcatgcgccagcgcttgccgcgcagcgtctcgcccaactccatatgcagaccgacctgaaacatcagcagtatcaggccgacttcgctgacttgcgccatcgctgacagcgcacgtgggccgaacaacaggtcgtagaaactcggtgcgatcgccccgaacagcgaaggccccaacagcagaccggccgcgatctcgccgacgaccgcgcactggccgagccgttcggcaatgcggccgcagacgttgcagagcgcgatcaccaccacgagttgcaacagccagatagtcatgaatacctcggcaagagcgacaccgacacgcagcgggtggctgcgagcccaagcgggcccgccgcgtcgtacgccgtgatgaccgtgacgccgcttgccagcttcgcgagcgcctggcgcagcgacgcggccgagaccggctcggcttcacgcatcaccgctcactcgcgacgcggtcgacccagcctcgatagaacgcacggtacttgagcacgagcttgtcgtatttgctgtacgcgccgccgccgtccggcttcatcccgttccagattttgacgtcgtaccccgctgcctgcctggtctgcagcccgaacagcacgaagtcggtcgcgcggcgcaggatgccgcccaccttcttgatcgagatgagcatgtgcatgacgttcttgccgtcgctcaccggcgtcacacactggagcagcttgtatttgacgtttccgtccagggcaacggtcatgacgcacccgccggggtagccatcgaagtgcaggttcatctgcgacatgttcaggccgagcgcgcgcgacagcatgccgagggggccgaagtaccggtccacggtgaagtcgatcccggcaccgaaccacgcgcccgccagggccagcgactcaacctccggccaccggcgccaatcgtcaaagagcttgagctcgaaggccgagacgggagcgcgtgcacgggggtcgcgtgctgcgcgtcgtagaagttctcgacgatccgcaagaccgccgtcgtcgtctcgaacgcgaagtgcaggtgcataaagtcgccgttgtcgacgtcggccgcggcgatttcgggcagcgggtgcagcggctgcggggagccgtaccagacccacacgtagccgtatcgctcgacggtgaccaacgtcggctggcgcgccccgcgcggcacaggctccagccggggcaccgcctggctgtggccggggatgtgaacgcactggccctgctcgtcgtaccgccagtggtgaaacgggcactggatgcacccgtccttgacccgcccgtcagccaggttcgcgcctaggtgcgagcagtggcggtccatcaccacggcccgccccgtcgctccgcgccacgccacgcacggacggccgaagagcgtcaactccgtgggcttgtccttgaggtcgtccgagcgcatcgcgacgtaccagctcgcggccaggcgcgtggtcgcgtcgtacgcccccgagggacgcttcttgatgctcgcttgatccaattgaatgtcgttcatcgttttttctgtcgtcgtcggccgactacttcttcagcgccaagccgatgcgggtcgtgacgtacgccttgagcagcgcgaacatcgggttgtagtcgaagtactttttcacctctgccggcgcgcgggtttgcgtccagtacatcagcctcatcgccggcagcaggctgtacttcgagttgttgagctgcggcttgtccccggtgatgcagtacccgaagccgaacatcggcttggcgaagtctcgttcgtcgatgagggcgtgaatccgcgccgcggcttcctcggccggcttgagcccggcgctcacggcctcgacctcggctttggcgtcgttgaacaactggtagtactcctccatgtccgcgcacaggtacccgaggtacggggggtcgttgtcgaggtgatcgaggtcgccctcgtcgcgcgacgcgcggaacctcgcgtgggcttgcacgagccggaactgcccgaggattgtgccgaccgcccacagcctgtggaacgcgtcccataggcggaagtccgagaacgccgtgtagcagcagctgacgaagtcgtcgttgtggtccagaagcttttgctgcaggcgctctatgtactcgaagcgctcgggggagaagtcgtcgtcgcgcagcgccttgatgaggcgcgccgcgagcgcgtggatggtcaccgcggtgttctcgagcccccgggagaagagcgggtcgatgaacccgttcgcgtgcagcatcaggcagtagcggtcgccgacgcaggcgttcgacgagaactgcaggcggtcggtcttgacccagtcgcgcaccggcacggcgtcccggaactgcgccgcgatgctcgggaatcgcgcgaggaactcgtcgaattcctgctgcgcggaaatgtccgttttcgggtagacacgcgggtcgagctgcaggccgacgctcaccaggttgttggtcgaccgcgggtggttgttgaacggaatcacccagagccagccgcccgtgaacatgtggtgcaaggtcccttcgtgccagcgccagcgctgccccttgaccttgaaaatgtcgtcgaacggcttgaccccgagcatgtgcgtgtagaggctgcgcgagtgcgtcttgaagcgacacggctcttcgcggagcccgaacttggtcgcgagcggcgcgcggggtcctccgcagtcgatcatgtaccggccggtgaaccgatcgccctggacggtggtcaccgcgacgccgtccttgtccgcgtgatagtcggtcacgctcgtcttctggcggaccgtgcagccgtatttgatggccgcttgcaacagataggcgtcgaggtcctgccggtaataatggctctccggcccccacggcagctcaggaatcacgcactgcgtgaactccttcgggttgtgctcctggccgggcttgtggaacacgaagccgaagttgcgcttgatgcccgtgctcgacgcgacgtagcgttgcgtcgagtagaacgacgtgatgtggtcgagctccggaatgccgtagcgatcggcgatgatgcggttcatgagagacgtctcggggatcgacgattcgccgatcgtgaaccgcgggtgcgacgactcctcgatgatcagcacgcgaaactgttgtttggccaggatggcccccatctgggtgccggacatgcccgagccgaggatgattacgtcgaagtggttgctatcgtgtccgttcgcggggctcttctgagtcatgggggcaaactctccttgtgagataacacctggtcgcgcgcatcaggattcgtcgagcgcggcgcggatgcgggaccgcgcggcatacgtgagcgtgagtagttcaccgagcatgctgggcgcgtaccccccgctgccgattgtggggccgctttgcccgacttcgtacgcccgctccgccaatttgaggtgaggcgcccggaagcgcagcaggaccttgaagacccgctcgagggctgtcagcccagcccggacgtactcgtcccgcgcaccgaccgctcgcgcctcgtcgagcgcgcggtcgatgagcgccggctctccggagaaccgagcgtagaccgccctgtacgcgggaagcacgtagggcagatacgtctctttgaattctcgataagcttggtcgtccgattgcgagccccacagcacgtgctccagcacgaagaggggcatttctacagcaccggggccgaggtagctctggcccccgactcggatcggttcgtagaagggacggagctcatcgtagaagacctgcggcgagatgaagcggtacgcgtagacgatcgattcgaccattttctgcagataggcttccagctcgtcgcacccttgcgcgaacgctggcgaccgcaggggcacgtcggacagctcgacggtcattgcgatggccgcctcgagggccgccatcgagatgcgcacgctctcgagcaagtgcacttcgtcgggcagcccggtgtagctgcgctgcgcgtcggccgttgcggggttccagaccgtcacatgcaagagtgtctcgcgcggcggcaggccggtcgcgcgcgccagatcgagcagcaccggctcaaggccgggcaccacgtccgcgggctcgtgtccgtgccgcttgagcgaccccaggaagaacccgatgtcccgcatcgcggcggcggcttcgacgaagccccagccggagggcacgccgcgcgccgggaggaactcgcgcagcaggccgatgatgccgggcacgtccttgttacggttcaggcccggcagctgcagaacgagcgagcgcgcctgcagcggatcgcaggccgccacggcagcgtgcgtggccgcgaatgcgcctacccggtccaaggtgcgttccactacagggtttcctgcgtcgcgagcgtcggtccgcgctggctgggagacagccccgcgtcgccgtcacgcagcgaccgcaggtagtcgtagttcgtcggcaggctcgtgcgcagacgctcggtctcgcgccggatgctggcgaacatcgcctcggccttctcgatcgactccggtcggtgctgcaagagcggcagcgaccggtcgggcagcatgcccaagccggcaaagatgcagtagtagttgccgttcaaccagaagttcttgaattcgtagtcgaaggtctcgtagtacgtggaatcgtcgaacgacgtggtggtcagcggcagccccgccttgtagcgctgaaccttctctttgatggcgtccgagagccgcaggtcgtgccggttcgcgagccagaacggcgtgtcttcgcgcgacgcggtgaaatagtgcgcttggacgaaatctcggcagtcgtcgaacatatagacgatctcggcgttgaatgcgtcgctcaaccgcgggtcgaacgaggtgtcggggaagtgcttcacaagctggtaaagcgccgcgtagatgaaatagattcccgtcgattccaggggctccagaaagcacgacgacagcccgatcgagacgcagttgttgacccacgcccgcttgttgcgcccgacccggaacttgatctggttgagcggctgattgtccgagaggccccagaggttgaggaagtcggcggtggcctggtcacgcgaggtgaacttgctcgagaagacgtagccgctgccgaaccggcccagcatcggaatcttccaggtccaccccgagttcatggcgatcgcggaggtgtacggctcgaccccctcgcgcgcgtcgtcgttgggcacggcgctggcgaccgcgctgtcgcacaacaggtagtcggacatgtcgatgaagggctccttcagggcctgattgatcaggagcccccgcatgccggagcagtcgatgaacaggtccgcctccagcgtccgtccctccttggtgaacaggctggagatgtagccgcgctcgttcaggtgaacgtccacgacctcgtcgaccacgcgcttcaccccgcgttcgacggcccagcgcttcaagaagtcggccaccaggtgcgcgtcgaagtgccacgcgtgggacatctggcgggtgccgtcgggcaggcacggtgccagcttgccgtcgagcgccccggcctgcgggtagcacgcgtactccattggctgctggaagccctgttcgcgcttgcgcaaccagtagtgggtaagcggcacgccgtcgcagttcggcacgttgccgaacaaatggtagaaatgatcgtcgcgcgaggagccgggagacttcctccagttcacgaacttgatcgcggccttgaacgcgccgttcacttggggcatccactcccgctccggtatcccgaggaagtcgaagaacaccttctgcaaacttgggatggtcgcctcgcccacgccgatccgggggatcgcttcagactcgatgagcgtaatgttcgcctgctgttggagcgcccggacgaggtacgaggcggccatccagcccgcagtgccgccgcccacgatgacgatattcttgatcggcttgttcataacactccttgtttcaaggtggactgcctgtaacggccgccagcctccgtgcatccgtgcaagaagcacatcaatgtgcttgtgagatttagactctagcctgccggaaaagcgacgcaaattctgtttccgaattaacaaactaaaacgcaaaggcattcggtataacgaaaagtcagtttgtcgacctgagtgatgttcgcaacattggcggcgatcacggccacacgctatgcgccaggcccaccgatgggcatcggtgcgagccaccagctcgcccaggagatctgtagtggggacgtacaacatatttcctgcttagggggttcaatctcctctattgccagacaagaagtgcccgccagcacccgggagtgcactcccagatgccggtttcgacgccgtcgttgcgctcgacgcaggtcaccgaagtcacggcgaccgggctgcccaggggcacggccaccggagtcgattgctccagggtgacgtgggcggtgttcttgaattgagtgatgctcatggcgctatctgtcgatggaaaaaaccgctgtcaaaaacctggttagtgcatcaggccttccatgaagcccgccacccggctggccagccgccggcgccagggcggcgtggccgggttggccagggcctggtcttcatggacgaagctgcgaatgatcgcgttgtagcccagccagcggcacggctccggttcccaggcacgcaaggcgtcgaggccgccctcggggatcacccagggctggcgggtcagctcactgtcgcgttcgaggatcagcgcggccagggtccgcccgccgaggttgctggcgcccacgccttcgccgccgtagccgccggacaaggcgatgccgcgctggcggtcgcagagcatgtgcggccggaagtgccgggacatgcccaggttgccgccccagcagtgggtgatccgcacattgttcaactgcgggaaaagctcgctgaacaggtagcgccgcagctcgacttcactgcgggtcaggtcgaagtcgtgacgcagcttgccggcgaactggtaaccgccacgggcgccgaacaccaagcggttatccgcggtgcgctggccgtaggtcacctggcgactgctttcgctgaacgcctggccctggttcaggccgatctcgtcccaggtcgcggccgacaaaggctcggtggccaccagcaggctttgcaccggcaactggtaacggcccaggggcggcaaggtcaccgaatagccctccaccgccggcactatccagcggcaacgcacgctggccctggcggtttgcaggctgccggcctgccagtggctgaccgggctgttttcgtagatcggcacgcccaggcgctccacggcccgggccaggccgcgcaccagcttggccggctggatggtcgcgcaatggggcgcgtagatgccgccgtaggccttggccacgcggatctgccgggccagttgctcggggctcagccagcggtagtcgcgctcgtcgagcccctggcggtagagcgtgtccaggtagcggcgctgggtgatttcctgctcggggtaacgcgccgcgcagtacagcaccccgcccttgcggtaatcgcagtcgatgccttcacgctcaaggacgatggccacttcatcgggaataccgtgcaacaggtcgaaggaggcgcggcgctgttcggggctcagcccggccagcaaccggtcctcccccaaaaggttgcccatcagccagccgccgttgcgcccggaggcgccgaagccggcggtctgcgcctcgacgatgacgatgttcagggtcggcgccaggcgcttgaggtaataggcggtccacagcccggtataaccggcgccgatgatcgccacgtcgacatccaggtcttgctccagcgatggccgggccagcagcggctcgtcgagttgatccatccacaaactgatattgcgccacgctggcatacacgcactccgcgacccgaacttcgatggcgtcgatcctagtgcctgggctcaggggttgtcttgcgcgcgtgcacgcaaagaaatttgcctggcgtaggccttgggcgacaggccggtatgctggcggaaacagctgtagaacgccgacagcgagttgaagccagcggcgaacgccaactcgtcgatgcgcaccggcggcgtcgcctggtccagggccgccagcagatgctgcaggcgcgcctggttcacatagcgatagaaactctgccccagcacctggttgagcaggtaggagatctggttgcggctgtagccgcactccttcgccacccgctgcaggtccagctccgggtcgaggtacggctgctggcgctcgaagtactgctgcaggtcctcggccatgaagctcaactggcgcggcgacaggcccaggcggctgaccgccggccgcgcgctgccttgggccttgccggcgcggcctcacgcaccagggaagcgtattcgttgacccgccagatcaggccgtcgcgcacggtgatcgcctcgctggcgcgaaacgacaccaggccctgcccgccgcgcagggtcacctggtattgaatgaacgcggtgttgccgtccaggcggatgcggtcgctgtgctccagggcctcgtcaggcgcgcgcggcatgctgttgcgcacgtattcgcgcagctcgtccaggcccagggtgcggttctggaaaaagtcgttgtactggatttgcgggtgatacagcgccatgacgccatcgaggtcgcggtgcttccagcacaggtgatagcgcagcaccgtctcgccggtggcctgggtttgcgccgggccatcatcaagggaagacataggggcagagataacggttcaggggatggaaaggcgcagcttgccgaagttcgtccagcgcttcaatggccaatgcatggcccctggatactggcgttttgcctaaaccgcaggcggaaatgacctgcatcaaaaaagtgcaagacaatcgccaaacggcctgaaaaaaaccgttgaatgtcatatcccggtgctatttttaaaagctccacaggttggtccagtgacggtccttccatacctaccgcgagcacaaggaagcgctcaatgatcaaggtgggcaatccatgaatagagtctccgccagcaaagtcacctttcccaacgcctgccagctgatgcgctggcattttcaccccatgggcttcgaggccagcatggatgcacccggcagcatgatcgcccggctcttcgatcgtgccagcggcgagaccatgatcgccattgccggcatcccctgcgccaccgtgatgaatgccaccgatgtcgagcgaataatcgaggcggtggaagacgagctggaggcctttatgccgccactcgccttgaaagcctagggtcgctctgctcctggccccaggccgctccagactgttttcaagcccgccatcgtgcgggctttttcaggcccgcaggtcggcgaagaacggcttgccctggggaatccggtccgacgccttgggtgcattggccgcctgggtgtccgggcggtccacataccagtagcaatgtttcaccgcccgggtgatgccgacataggccaggcgcaaggtctcgtccttctgcgcattgtcgtaaggctcgctgtcgccatccttgcccagcccggccatgcgatagacctggttcttgtagggcgaactggtcaggtgctggcaatcgcccagcaggaacaccgcatccgcctgcaagcccttggagctgtgataggtcagttgcttgaggcgtcggtcctcggctggcaatctagaatcaacattaactattggaaaaatatgctcttcaatcaatgatttatcgctactttttcgaaacaacatcaagatcgaatcgccattgcgatagtgctccgctagccgagctgcaagcccctggtcatcgcggtccagcacattcaccggcaacacttccttgggttcgccgctggccttggccttcttcccggcaatcgccggcgcggcgcggacgatatgttccgccgcgtcgatgatgtgttggtggctgcgatagttctcgctgagcatcacccgggtgttggccggcgacgggaattccttgttgaactccatgaagaatttcggcgaactgccgcgccagccgtagatcgactgccagtcgtcccccacgcagagcaacgacgagcgctgtgccccgcggccgacatgcatcgccggcccgcggctgcggatctcgcgcaggctggcgcgaatccacgagacgatctgcggcgagacgtcctggaattcatcgatcatcaggtgcgacatcggccgcaagcgctcatcgctgagcagcttgaagttctccggggtgttctcgccgaacagcgcgaacatgcggttgtagctcatgatcggcggtgactggtcgagcagatgatcatccagcgcccgccagaacaggctcaaggcctcgaagaaaaagcggtccgggtcgtcccgggcaaacaccatctgcccaacggccaccgagacgtccagtccgaggttctcgataaacccggccgctgcgacaaaacagtccagcaacggcgccgacgccagctcgcccttgaccttgtagtcgaagcccggcccggcactggcatccccggccagggacgacaggacgcgttttgccgaatcataactatccagccaaatcattggcttacgacagaaagcttgaaacagggtgcgctttaccgcccactccgcgcgcaccgaaagcttcgatccggggcgactcaactgcgggttttcccgaggatcgaaccccagcaccacccaggcatccagctcggcgacgtagccatggcaatggaactgcgagccgttgatctcgaccgtctgccggttcggctcgatgcccttgatcggccaggcgccggcacgaaaccacaagtcttccagggtgtcgcacagctcttcgtcgcgcttggccgccagttcggtcacggccatgcgtttttgcacgtccgggtgatcgcgctccaactccttgagctgcagggcatggcgcagcaacggcttgatcgcctcgcgaaaacgcccgtcacgccgatgcagggcgtggtaacaggcattcaggtgcttgcgctgggcatcgttgatccgcaggtcgaagggattgctgtcgacctccagatcccccgccgccgggcgatcgctgaggttctcgaaggcctgcaggcgctcgaaacccggcaggctgcggaccatcggcaggatgcgcgagtggaaggtgcgcaccagctcccgcgcctccttgaggcccaggggccggccccagagcgcgaacacctccagcagcttgttgatgaagtccttgcgcgactcgcgggtgaaggtcaccacggtcatcgagtcgagctcgaagcccaggtaatggttgagcagcaggatgcgcaggaccagggaggtcgacttgcccgcgccagcgccggcaatcaccgaggtggatggggtttcgctgaagatcatcttccattgcgcgctgctgggttgggcatgggccggcagcaggcggccaacatcggccttgatgcgcttcttcagttcggcgctcagcggcaggcgccagtcgtcgaacagataatcgtctaccccgggcgccggatgctcggtggagcggctgtcgcgaatcagcaggacctgacggccctgctccagtccctcggccttgccctcctggtaaccgtattccaccccggcggtatgcccgctgcgaaagccgtccgcctggccatgcaaccaggacgcgcgatgctgggcgcgcaagcgactgaggccatgaccgaagaacctggccgccaagcgcttgagcagcggcatttcggccaggggcaagagttcgggaggaagatcggggatgtgttgcggcacgctgactccagggtgtgaggctgtgtgggacggtatggtcgcttcattcgtcgatgacttctagtgaaatgcttacaggtcatccacttaagcctcgaactgaatgttggaaagcagaatgaatactacaaaacatatctatttattagatctgattacggtatttttgcgctttttatcgatatttggctaatggatgatgagcgccatcaatcaccggtctcgttctgcggctccaccaaggcgccccatgacgaaccctgacaggagacgatcatgcttgaactcagacccttcaaatccctgggcggcgcccatcatggctggttggatgcccaccatcacttttcgttcgccgagtattacgaccccaaacgcatgaactggggcaacctgcgcgtgtggaacgacgacgtgatcgcccccggcagcggttttccgcagcacccgcaccgggacatggaaatcatcacctacgtccgtgaaggtgctatcacccaccaggacaacctgggcaacaagggccgcaccgaggctggcgacgtgcaggtgatgagcgccggtaccgggattgcccacagcgagtacaacctggaagccggcgaaaccaggatcttccagatctggatcatccccaaccaggccggctccgcgccgtcctggggtgccaagccgttccccaaaggccagcgcgaaggcttcgtgaccctggccagcggcaagcaaggcgatgaccagagcctgcggatccgtgccgacgcgcgcctggtagccgccaacctgaaggccggcgagtccgccgaatacccgctggacaaggggcgccgggcctatctggtgccggcgaccggggtgattgaagtcaatggcttgcgcgccgaagctcgagacggtatcgcggtggaggatgaacgcctgctgcgggtcaccgccctcgaggacagcgaaatcgtcctggtggacctggcttgaggcgttaacggcaaacaaaaaaggggcgaccgtctggtcgcccctttttttgtccggcttacgggccttatcgcggatcagccgctgatcgcgccgtccaccagggtctgcgcttcctgcaccaattgcttcaggtgatcgtcgccgataaagctctcggcgtagatcttgtagatgtcttcggtgcccgatggacgcgcggcgaaccagccgttctcggtcatgaccttgaggccgccgatcgcctggtcgttgcccggcgcatggctgaggatcttctggatgctttcgccggccagttgggtcgaggtcacctgctccggcgacagcttgccgagcagcgctttctgctgcgggttggccttggcatcgacgcgcaccgagaacggctcgcccaactcgtcgcacaaggcacggtaggcctggctcgggtcgcggccggtgcgggcggtcatttccgcggccagcaaggccgggatcaggccgtccttgtcggtgctccagacgccgccgtccttgcgcaggaacgatgcaccggcgctctcttcaccgccaaagccaagggagccgtcgaacaggccgtcggcgaaccacttgaagcccaccggcacttcgtacaggcgacggcccaggcgcgccgccacgcggtcgatcaggccgctgctgaccacggtcttgcccacagccgcgtcggcgcgccagtgcgggcggttctggaacaggtagtcgatggccaccgccaggtaattgttcggcgccagcaggccgcccgtcggggtcacgataccgtggcggtcgtggtccgggtcgcagccgaaggccacgtcgaaacgattcttcaggccgatcaggccttgcatcgcatagctggacgacgggtccatgcggatctggccatcccagtcgacggacatgaaacggaaggtcgcatcgacttccttgttgaccacttccaggtccaggcgatagtgctcggcaatcgccgaccagtagcgcacccctgctccgcccagcggatcgacgcccaggcgcagcttggcgttgcggatggcgtccaggtcgatgacattgatcagatcggcgacatagctgttgacgtagtcatgacgatgagtggtgtcggccttcagcgcctgctcgtagctgatgcgcttcacaccggccagcttgttggccagcagttcgttggccttggcttcgatccacttggtgatgtgggtatcggccgggccgccgttggtagggttgtacttgtagccaccgctttgtggcgggttgtgcgacggagtgatcacgatgccgtcggccaggccgctggtgcgaccacggttgtagcagagaatcgcatgggacaccgccggcgtcggggtgtactcgtcgcctgcggcgatcatcaccgttacgccgttggcggccagcacttccagggcgctggcaccggccggggtggacagggcgtgagtgtcgatgccgacgaacagcgggccatcgatgccctgggcctggcgatacaggcagatcgcctggctgatggcgaggacatgccattcattgaaactcaggtcgaacgagctgccacgatgccccgaggtgccgaaggcgacccgctgggtagagatggcggcatcgggctggccggtgtagtaggccgttaccagtcgcggaagatcgaccagcaattctgtcggtgccggtttgcccgcaaaaggactgagtgtcatgcaaaacctcgggaaatggatggttcggtgagtgctgcgcagtttactggcagtttgaccgcaacgcgacgggatctatccgtggagacctgcacaataagcaggcgcaacataggccattgtcggctgctgcacagaagacactcaggatcgagacgggaataaagaaaggagtgaccgcgagggcagaaacgccagagtgcgcgatggcgaaccctggcgtcgggatcaggccggttcgacctgcagtgcgacccgttcgcggcaaggacactcgtccatgtagcggtgggcttcgacgaactcgttgaacgggaagatccgggtcttcagcggcagcagcacacgatcggccgtcagctggttgatgtcgcgcaaggcgcgctgcaaggccacctggtcctggatgatgcccagctcgggcttgccggtgaagttgccgatgcagtgcacgaagaactggatgttcttctggaacgccgcgcaggccgggaacggcgtctggttgccgccttgcaggccgtacagcaccaggctgccgcgcggcgccaggacgtcgccgagcatcgacatctgcggaccgcccaggccatcgaacaccacgtcgacaccacggttgtcggtgtatttgttgatctgcatgagcaggtcctgctcttcggtgacgatgactttctcggcccccagggacagcaggtactcacgctcttcagcggtcttggtcgcggcaatcacccgcactccgagggccttgcccaactggacaaaggacggaccggcgcagtggctggcatcggtgaccagggcgaactgcccaggcttgacccgcgccaggtcgacataggcaaagtaggccaccagcagcggcgtgtaatgcaccgcggcttccaccgggctgagcacatcgggatagcgggtcaacgccgagcgtggcaggacaatcagctcgccatagaccggataatcgttcgggctttcggccgggaagctggcaaccttgtcgccaatggccaggtcgtcgacaccttcgccgaccgcagtcactacgccggccatctcatggccaaggccggaaggcaggcgggcatgggaagacgccaggttctggcgccaaaggacgtcgtaccaactgatgccgatcgcttcgacacgcacctgcacttcgcctggcgcaggcagagcggccgcatgctcttcgcacttgagcacctcggccggaccaaacttgtgaaaacggatcgtgcgggacatcgcaaacctcgtcaaagtaacctctaatgccccgaactctatctgggctttctggccaagaccatcagtggctattaatagtcgacatgcctgtcattgattccgcagcacctgcaacaacgggaaacagcgtgccagagcgaagggctccttacaggaaaaaacaattagccggtgcagagtagcagcctttccccgtaagattcatgccggccattgttctcatatggccgctctcgtcaagtttgctgactctgccaggactcaagatgaatcgtaatgacctgcgtcgtgtcgacctgaacctgttgatcgtgttcgaaacattaatgcatgaacgcagcgtgacccgggcggcggagaaactcttcctcggccagccggccatcagtgcggcgctgtcgcgcctgcgcagcctgttcgacgacccgctgttcgtgcgcaccgggcgcagcatggagccgtcggcccgggcggtggagattttcgccctgctctcgcccgccctcgactcgatctccaccgcggtcagtcgcgccgccgaattcgacccggcgaccagcaccgcggtgttccgcatcggcctgtccgacgacgtcgagttcgccctgctgccgatgctgctcaagcgcctgcgcgccgaggcaccggggatcgtgctggtggtgcgccgcgccaactacctgctgatgccggccctgctggcctccggcgagatttccatcggcgtcagctacacccaggacctgccggccaacgccaagcgcaaggtgctgcgccgcagcctgcccaagctgctgcgggccgacagcatgcccggcgccctgagcctcgacgacttctgcgcccgcccccacgccctggtgtcgttcgccggcgacctcagcggttttatcgatgaagagctggaaaaactcgggcgcaagcgtcacgtggtgctcgcggtcccgcagttcaacggcctgagcaccctgctcaccggcaccgacatcgtcgccaccgtgccggactacaccgccgaagccctgaccgccgccggcggcgtgcgcgccgaagacccgcccctgccggtgcgcaccttcgaactgcacatggcctggcgcggctcccaggacaacgacccgggcgaacgctggctgcgctcgcggattcagatgttcttcggggatccggatagcctgtaatagacctccaccggacccggcaagcacgccaatggcgaagtccctggtcacaaaccggtcagcgcgatcaagctggagcacatggcccaggcagccatgcagaatctagcgctacgttcattagtgaccctgtgtagcctgtgcgaaaacgcccgggccacactgcatgcaatcctaatttacgcggatgttgagtggccttaacacgtccggtcattgaaacagtaacagtcatggcgcactcaacagcagattacgatctcgacctctcagcatcggaggctagacctctgattacttcagattaaaacctttgtggcatcgcactctgcactccgcaacaaggctcaaaccaattcggctaaagatgccggattgaaacccttcagatccgcgtaattgcctttttcaactttggcggcccaatccttgtcactcagcagaacacgccctacagcgatcagatcaaactcttcgcgctccatgcgctcgacaagccgatccagactcgcaggggttgatcccttgccggcgaaggcattagtaacatcattttctagtccaaccgaaccaacactgatggtcgcggccccggttactttcttcgcccagcccgcgcagttcagaccgttctcaccgtcaatctcggggaactcgggttcccagaagcgacgttgtgagcagtgcaggacgtcgacacccgcttcgactaatggcaacaaccagtcttccatcacagatggcgtttcagcgacgcgtactccgtaatcctgttgcttccactggctgacacgcatgatgatcgggaactcagggccaacagcatgacgaacagcagacactatctcactggcaaaacgcgaacgttccttgatcgtcgggccgccgtagcggtcggtgcgcagattggtaccagaccagaaaaactgatcgatcaaataaccatgggctccgtggatctcaacggtatcgaagcccagtcgtttggcatccgctgcggccttggcgaacgctgctaccgtgtcagcaatgtcctcttcactcatcgccacaccacgcaggtcgcctggcgaatcaaggcccgacggactttccactggcgcatctggctcccagtcgttgatgtaacgtgcggcaccggtgtgccagatctgcggtgccatgcgcccgccagcgttgtggaccgcatcgatcacgtttttccacccagccagcgccgcttcgccgtgaaaaaaaggaatgccggaatcattgcgcgatgctgggcgatcaatcacggtgccttccgacaaaatcagcccaacacgtccctctgcccgccgccggtagtaggcagtgctcgcttcacccgggatgccttcgggtgagaacagacgcgtcattggcgccatgacaatccggtttttcagctcaagcgaccggatggaaaaaggacgaaataaaatgctggtatcagggtttgacattggatggactccatttgattttggaagccacataagtatattttgtaaaccaaatgtcaattaggcacctagagtcgcctaggtatatatgaggaaacttcgatgctggaattaaagccgcaatgtttttcgtcggagtgcccaagccgggcactgttcgaccaaatcgcagacaagtggtcgatgatggttctggcggtacttgatgacgggccgcaccgttttaacgccatcaggcgtcgcctggagggcgtcactcagaaagcactgacacagtgcctacgtcggctggaacgaaatggactcgtctcgcgccaggtcatctcgttttcgcccgtggcagtccagtatgagatcaccccactgggtcgaacactgcagcagccatttcgcgaattgcataaatggacactcgacaaattgtccgaggttgaagcagcccggttgaagtttgacgaggccgcggaggtaaattgacggtgtgattctttttcattgactcgccgccactgctacctgcaacgcattacttgatagatctgctggcggtattcctaaacccatcctggacgttgagtacgcaccagcggtcctgcgacacgtcaccatcgccagcgtttcgatagccctgataccggggcgttctaagatgacagcattccatcccgaccaccacgacatcgaccttgatggctgggcatttcgccagaatcaggtaatccacaggggtagatacaagcctcgagcgggcgagcgacgcgggcgttttctccgtgccgacgggtgccgatgggcagccctgttatcggtacgttagtacaccaaccaacgcttctaatgataagcattagcatatagtatgctgcggtttttcctcccctctcctgctctggatcgtcctgtcgatgcgtcgtacgttcgtttcgctttgcctgctgcacgccgtttcccctgttgtctgggccgatcaatccagcgcttcctcactcgagttacaggccaccagcatcaccgccgatgccgctgccgagcgcgccgacggtccggtgcaggggtatcgcgccacccgttcggccagcgccacgcgcaccgataccgccctgcatgaaaccgcgcagtccgtcagcgtcgtgcccaaggatgtggtggaagacatcagcgcaacgcgcttgcaggatgcgctcgactacgcaggtggcgtgggccgcgccaacaacttcggcggacagggcctgaccaccttcaccgttcgcggctttaccaccggcgagttctaccgcaacggtttcccgatcaaccgcggttatcccaacgcgccggacgccaacaccatcgaacgcctggaagtcctccgcggcccggccagttcgctgtacggccgtggcgacccgggcggaacctttaacgtggtgagtaagcagccgcaggctgaatccaaggtgaccctgggcagccagctcgacgaccaaggcatgcaccgcgccacgctcgacgccaccggcgcgctggatgaaagcggcgccctggcctaccgcctgaacctgctgggcgaaggcggctcaagctttcgcgatgatgtcaaaaccgaacgctacgacgtcgccccggtgctgagctggcaggtcaacgacagcacgcgcatcaccttcgaaggcgactacatgcgcaacaaccatccgctggaccggggcctgactcgctaccccaaccagaaaggaagcgcctcgcgggacaccaacgtctgggaaaagggcctggacaataccctgcacaacgacaacaacatgacccagctgcgtttcgagcatctgctgaacgaagactggaccctggccggtggcgtgcaatggctggatggccagctgcaaggcaatgccgtggaagccaatgccctgcaggccgatggccgcaccctggggcgcaacttcaactaccgcaagctggagtggagcgaccgcgatatgcagttgaacctgaccggctatttcgacctcgctggtttcagccatacgctgctgaccggtgtggaatatgaggactaccactaccaatcgctgatccagcgctccgccgccggtgccgctgcctacccgatcgacctgctcgacccggtgctgggccagccgcgtccggccctcacccgtacgaccacccacgacaaggaaaacctcaagacctgggccctcttcgtgcaagaccaggtggccttgaccgagcgcctcaaagccctggccggcgtgcgtttcgagcgtttcgaacatgattatgacgactacctgagcaccacccgcgacttcaccaagaaccaaaatgcggtcaccccgcgcttcggcctgatctacgacctgaccgacactgtcgcggtgtacgccaacaccgcgcgctccttcaagccgaacaacggcgccagccgtgaagggggcgggttcgacgcggagaaaggcaagtcctatgaactgggcgtcaagtgggaagcgctggagcatcagctgagcgtggatgccgcgatctaccacatcgtcaaacagaatgtactgaccgtcgacccggtcgactccaactacagcgtggcggccggtgaagtccgcagccgtggcatcgacctgaacatcgccggcaacatcacccccgagtggcgcatgctcggcggctacgcgtacgtggacgccgaggtgaccaaggacaacacgctggccgatggcacacgcctggcaaacatcccgcgcaacaccttcagcctgctcaacacctacgaattccaggacggcgtggccaaagggctgggcctgggcatgggcgtgaagtacgtggatgatcgcgccggccagaccgccgcgaccacctacaccatggagcgctacagcgtggtcgacctgttgagcttctaccggttcaacgaacacgtgcgcctgaacctggacgtgaagaacctgttcaacaacggctatgacgaaggcgcgttcaatacctacgtttacccgggcgcgccgcgcacggtgcaggcggggattgcctacaccttctaattgaaagcttgttccagggcgtgcaccgaagaactgcacgcctgcctgtgagggcttttgcagatcccccctgcgaaggcccttgcattggccgctcgcgcagcggcatcgcccctgtcgacctccgcgcccctccctggcggcattgtcccgtcaccccacgacccagccgcccagcgttcgccatccgtcattcggtcgcggctatttcgccacgcttcaccgggggcgagccgttccccaggctgccgggcggcccgggcgccttgcgcggcgtgcaacgcctacccagcgaaaatatgcccactgccgagcaaaatccgctgcagcgccggcccgcggagcgggtatcgtggagcaaaaccatcggccagaggtgcactgtggcgtcctattccttgcgtcaattgaagtatttcgtcaccaccgtcgactgtggcagcgtcgccgaggcgtcgcgcaagctgtatatcgcccagccgtcgatctccacggcggtcaagggcctggaagacagcttcggcgtgcagttgctgatccgccatcacgcccagggcgtgtccctgaccccgggcggcgcgcgtttctaccgcaaggcccaggaactgctgcgcatggcccacgagttcgagcagaacgccctggccgacaacgatgtggtgtgcgggcagatcgatatcggttgcttcgagaccgtcgccccgctctacctgccacggctgatcgccggctttcgccagcgctttccgggggtggagatccgcctgcaggacggcgagcagcaggagctggtgcagggcttgaccggcggacgcttcgacctggcgatcttctacgaacacgacctggacagcaccatcgagaccgaggcgctgatggcgccgcaacggccgtataccctggtgccggccgggcaccgttttgccggacaggcccaggtgtcactgcgcgacctggtgctggagccaatgatcctgctggatgtgcagcccagccgcacctacttcgtgagcatcttcgaggagctgcaactgacgccgaatatcgtcttcggctcgccgtcgatcgagatggtacgcggcatggtcggccaggggttcggctttgccttgctggtgaccaggccccacggcaacagcacctatgacggccaggaagtggtctgtgtggagattgccgaagatgtcaccggctcggcgctggtggccggctggctgaaacgggcgcagctgaccaagcctgcgcagttgttcgtcgattactgcaaggagcagttcaaggcctggctcgcctgagggccggcgagcaggagcggatcgccccccgatgcgttgcccaccactgccccataccgacgtccttgccgccaggccgcgacacgcgaccggatggcgccagccagccggggccggcgctgacaggtggacttaagcttgcggattgaccaggagttgcgcagccccacgcccctggtgccggacgtcgtgggtacaggcgacgaagtcctccttgcgcagcactagcagggccagcagcgacgcgatcccagtcgccacgtaaaagtaccaaggcgcggtgatgtcgccagtaagcttgatcagccaggtggaaatcagcggcgcgctgccgccgaacaccgccaccgggatgttgtaggccacggcgatgccggtggagcggatgcgggtcggcagcagctcgctcatcagcgcataggtcgaggacgcatagagcccgaacaggatcgccacggccatcagcggccagaacaaggtggccggggtcgcgttgggcgcggccttgaagaaccagtacatggccagggtcgccagggtaccgatcaccatcaggaacggcttgcgcccgtagcgatcggtgaaggcgccgccgaacggcatgaccaccgccgccgagagactggcgacgaatacatagagcaaggtggtgccgctgtcgaacttgagggtgttggacatgtaggtcgaggcgaaggtcagcaccaggtagaagatcgagctgtgcagggtgatgatgaagaacaccaaagcgatcgggcgcttccactgccaaacctcgcgcagcggcgccttggaggtctgcccggcctgcagcaaggcgaggaattccgggctgtcctccagtttcaggcggatatacagcgagatgaagcccaggggacctgcgatcaggaacgggatccgccagccccaatcctgcatcagctcggcgcccagggcccaggtcatgccattggccacggcgccacccaggagcaggccgagcacagcggtgaccatcagccagcaggtggcgaatccccggcgccctgggctggcgtattcggaaatgaagctggtgatggtgccgatctcgccaccggcagagaaaccctgcacacagcggaccagcaccaggatcaccggcgcggcgatgccgatgctggcgtaggtcggcaacaggcccagcaggcaggtggagccggccatcatcaccagcaccgtgatcagggtcttgcgtcggccgatcttgtcggccagggggccgaagaacaggccgcccaggggccggatgaagaagctcagggcaaaggccgcgaagcttgccagaaggctactggtgggatcgtcggaaacgaagaaggccttgccgatgtacaaggccaggaaaccgtagacgccatagtcgtaccactcgatcaagtggccggaagtggcgccgatgaaggcccggcgccgctggcgctgggggttggaaggtggcacgcccatcgtggggactcctgtcgtagtgctatccatgaaatgccgcgtttcagaggttgctcaagggcccggtggggtcctgcaaccactggcgcaagcgggtcttgagaatcttgccatagctattcttgggcagctcggcgcaaaacagatacttcttcggtttcttgaacgaggccatgcgcgccaggaaccaatggttgagcgcctgcgcatcgaggtttccgggcgaacgcaggaccacgaaggccaccaccgactcgccccactgcgggtcggcctcccccaccacgcacacttcgaatacctcggggtgctggatcagcacttcctcgacttcccgcgggtagatgttgctgccgccggagatgatcacatccttgcagcgatcggtcagggtcaggtaaccccgctcattcaggaaaccgatgtcaccggtgagcagccagccgtccaccagggcctcccgggtggcttgcggattgtcccagtacccctgcatcaccacagccccgcgcacggcgattatccccctctccccggcagccaggggttggcccgcagtatccaccacgcgcacctcaacgcaggcgtgggcacgccctaccgaggcagcaatggtcggccagtcagcatgtccgcggtcggcaatggtctccctggacagggcgctgatggtcattgggcattcgccctggccgtagatctgcaccagccgcgggccgaaggtgtccaaggcctgggcgagatccgccaggtacatcgggccgccgccgtagacgatggtcttgatcccttcgccgcaatagccctgctgccgggcctgctgcaccatgcgcttgagcatggtcggtgcggcaaacaggctgacctggcccagcgcctgcgccagctcgaacaactccgccgcctggaacccctgggatgtcggcaccacatgccgggcgccacagcgcacatggatgaaattgtagaggccggcgccatgggacatcggcgcggcatagaccacggcgtcatcgccggccaccggatccacgtccagcggataacacaaggacatggcgatcaggttgccatgggacaacatcacccccttggggcggccagtggtcccggaggtgtagaacagccaggccaggtcgctgtcctcccgcaggtgcggctccaccagttcatcgcccggcacccggccttgcacggtcagcccgggcgcggccagttcacggcaaccggcaggcagggccacggtgtcgaagctctggccctcatcggtgtagatcagccgggccccggcattgccggcaatccaggcggcttccagtgcatgcagcttgctgttgatcggaaccgccaccgccccgctccaccagatggcgtacaacagttcgagataaccgcagctgttcttcagcagcagcgccactcggtcgccaggctcgatgccgtactcatgacgcaggtgcagggcgcgggccctggcctgcgcggcaaacgcctggtagtcggcgacctggcggcggccctcgaacagagctccccgccgaggccagcgctgggctgcatcgcgcagccaatgggcgatgttcatcctcagaccttgaccgcttgcaggacgctggcgtagttggccaccgccatgccgcccatgttgaacagcaagccgaactcggcagcgggcacacccaggccgatgggtttgccgatcagttgggcaaagcccagggcatgcatcgataccccggtggcccccaccggatgccccttggccttgagcccgccggacaggttcaccggcaggcgtccgccctggcgcacggtgccgtcgtcgagggcccggtgcccctcgcccctgggcgccaggcccatggcttcgtagatcagcaattcagcgatggtgaagcagtcgtgtacctcggcgaaactcaggtcgccgagggtcacgccggcctggcgcaaggccccgtggatggctcgtcgcggcccctcgaaggccagcatgtcgcggctcgacaagggcaggaagtcgttcacctgggtcatggcacggatcgccacctggcgtcgcatcgaacgggcgcgctggggcgaggccaggatgatcgccgccgcaccgtcactgatcaacgagcagtcggtcaggcgcagtggcggtgcgatcagcgggttgccctgggaaacgttgttgcagtgttcaaaatccatcactcggtgcatctgcgccagggggttggccatggcattggcatggtttttcaccgcgatcatggccatcgaggacatcgggttgtggtagcggtcggcgtactgctgcgccacccggccaaaaagctgggcgaaactcatgccggcctcctggagggtgttctggtagccggcgccggccagggcccgggtgacctcgacggtgctgttgccggtcattttctccgcgccgaccaccagtaccagttcggcggcgccgctgcggatcgcgttgatcccggcctggatcgccgccgaaccggaggcgcaggcgttctcgcagcgagtggcgggcttgaagcgcagttgcggatcggcctggagcatcagcgaggcggggaaaccatccgccaccaagccggagttgaagtgcccgagaaacagcgcgtcgatttgtgcagcctcgatctcagcgtctgccagggcctcgcgggtaacctggacaatcaggtcctcgaggttcaggccgtccaggcgaccgaaagggctatgggcggcagcgacgatggatacggaatcgtgaatcatgtgattttcttcttccttgaagcgggtattccatacaatgattcaacacccgaatcacacgctagttgggggaactacgtacggcagtaagtagtccccggtcccccaaaaaaagagacgcgccgataaacccgaggcaggatgcccgatgaccctacacgcccagcaattccaggacctcgagcgcctggccttccaggtttcccccgcgccgcagatgatcaccgggcatcgccggatgctcgactgcaaccaggccttcgtacgcctgttcggctacgagcgcgaacacttgcaaggccacctgaccctgctgttgtacccctcccaggccgactaccagagcatcggcgaacgcagcgagcactggctgcgcaacggacccggtaccttctactccgacgaacgcttcatgcagcatcgcaacggcgaggtgttctgggcccgcgcccacggtttttccctgactgccgaggatccgttcaagctgatggtctggcatttcgagcgcctggaccgccaaccggcgccgatgatccagttgaccccgcgcgaacgggaaatctcgctgcatatcgtcaatggcctgacctgcaaggaagtggcacgcaagctgggcatttcccaccgcaccgtggaagtccaccgcgcccggctgatgaagaagcttcaggccaagaacagcgcagagctggtgtcgaagatcatcttcatcagttgagcgcctgcccaagcatgtcgctggcactgatgcgcagcagctgcaatggtccgatattcaagccctccacgctgctgccctcagccaggatctggttgacggcatccatctcgacgctgcgtctggagacgattttgcctctgcaggcctcatccacaaaaaatccgatgccttccgacatcggattttcattgcttgccctcagcgatcaagtcaacaggcttgactgtcgagcatccggcacgtctgccggatgtctccttgatcgagtgctagtgggcggtctgcgggtggggctcatcctgggttgaggaggactgcttgccaccgttgatcaacggcccgtagcgccggctgaattcctggttgtagggcacgtggtccttgttgaacccattgtcccagttgaccgaccaggtcatcaggcccttgatcgacagccctttggcgtggaggcgtttgaacgcattggcaacggccgtcgggttgaccacgtatccggtggccgccgcatcgacgttggcgggcaggccaatgacgaatttgtcagcggcaatcctggtgaaaccgcgagtaccactgaccaggctttcggtcaggtaatagaggaagtcctctttcatggcgtcgttgttttgggcgatccaggcccccttgccgttgttggcctcctgaacccagaggccatcgccaccctggttgtagaactgcggcgcgatgaagtcgtagtagccttccagcgccttgaggtagtcgacgtatcgaccggcagcggtcaggtaggggaactccggcgccatgctgatgatgaaatgcttgccctcggcagcatagtgatccttgaccagcttcagcgcggccggcaggacgatcttgttgctggcgaagtcaatcgcgctctgttcaagatcgatgtccagcccgtcaaagccgtaggtttccaccagacggatgatttcattggccaggggctgttcgtggcccgggttcaacgcgatatgagcatcggcgccccccagggacatcagcaccgccctgccctggctgttcagcacgcccacctggcgacgaaactcggcatcggacaggttgtacggcttgaacgtcggaataccgctgcctttcatgaacgccacggccaccacgttgtagtcgcgaggcacatcctccaggttcatattggcaaactgcccgcgctggtagccgtccgaggggccggccggccagttgtgccagtagcccatgagaattttcttgccatccaggctcggcatccgcgacgcggcatcgtcctgcgtcgttttcagttgggtaaagtcaatctgtgacatgttctaatccttcagaacgttttaatgatccgcagacttatttgaagtcgacgtcgaaggcctgatagaaggcgttgccggtattggccacgatccacatcaggacaatcacgtgacggccctttttattggccggcagcttcacttcatgatcgaccttggccttcagttcgccggcatggctgtagtaaggcacctgcggatagaagtcctcggcgaaaggttgagcctccagttgtgcacgggtgatgcgctgtttcgggtcccaaccgtccttggtgatcagccagcgatagccacgggtggtatgcggtgcggtgtactgccaggtcaccttgaagatctggccggggttgacgttgagcgtcggccaggtgaaggcgcgaccgagcttcttgctcatctcctcatcggtgaagttgacgcagtcccgggcatcggtcttgccaccgctgaggatgaagccatcggccggcggcacgtcgctcgggttgtccgtgttgaacggtgcagggaacggacccgccgccagggccgggaagttcttgccgccttccatttcattgacctgccagccgcccagcaggcccaggtcgatggcgactgcgccgcgggaggctggggaggtgacgcgaccgtggcgaagcggtgattgggtttgtggttggttcatgtttattgctccattgatttaagaaactctccctttccaaaggagaggtctgcaaattaaccgagctggaatttctgtccacgggcccatttttcggtctgcatcacgctggcagaggaatctcccgagaatactggatatataaccagtaccactagatttctcctacccaacttgaagcaaaagtcctacctgtccaggcggcgcttgccggcgatgcggccaatacccaatctgcatctgcaggagcgcagcttgctcgcgaagcgtcgcatcaggcacaccgcgttgcctctatcgccagcaagctggctcctacaaagagcgggtgccctcctttaaaaagctggctgccattgacctcagcgcgccgcccaggcgttgaagcgctgctccagctcctcgccatggtccacccagaactccgcgtccaccgcccgcgcgccggccaggttggcctcggcggtgggcagctgccgttgcaccgccgccggcagcagcgccagcgcgtcacggtgcaccggcccgtaggggatctcctcggagaacaccttctgggtctgcggctggctggcgaaggcgatgaagtcttcggccagtgccttgttcggcgtgcccttgaccaccgcccagtactccgggtcgtacaggctttgcggccagacgatgctcagcttcatgccttccttctgcgccgaggcgatccgcccgttgtaggccgcgctcatcaccacatccccggcgatcagccattgcggtggttgcgcgcccgcctcccaccactggatattgcccttgatctggtcgagcttggcgaacgcccgggtcacgccctcgggagtccccagcacctggtacagctggtccggcttgaccccgtcggcgagcaaggcgatttccagggtgtacttggcgcccttgcgcaagccgcgcttgccggggaagtcggcgacgttccagaagtccgcccaggaggtcggcgccttggccagcttgtcctggtcgtaggccatgaccatcgaccagacataggtggccaccccgcattcgctcagggtccccggcacgaattgcgccgggtcgccgaagcgcgccgggtcgaggcgttcgaacaggccttcgtcacagccgcgcagcagctccgggctttcgacttcgaccacgtcccaactggtatggccgacatcgaccatggccttgattttcgacaattccccgttgtattcgccggcgaccacgcgtcctgcgccgctggcggtgaaaggttggaagtaggccttgtcctgggcctgcttggtggcgccgccaaaggagatgacggtgaggctctgcggtgcggccgcaaccgcggtgcacaacagggccagggcaaagggaacacagcaacgcaaggatctggacatgtagcggttcctctcaataggccgacgcgcccgcgcgcgccggccgctttgggctcacaggcgaccgtattcgcgggcggtccgatctacagcggtacgggtcttgtcgaccagttcatcgatgtcggcgtggctggccaccagggccggggccatgatcatccggcccagggtagagcggatgatcaggccctcttcgaagccgatggtgcggcaacgccaggccatgtcgttttcgttggcgaagcgcttgcggctggccttgtcttcggcgaactgcaaggccgccaccagcccggcgccctgcacttcgccaatcaacggatggttgtcgaacacctcgcgcaggcagcgctgcaggtacggcccggtctcgtgcttgacccggctgacgatgccttcgtcgcgcagggccttgaggttggcgatggccaccgccgccgccaccgggtggccggaataggtcaggccgtgggcgaacaccccgccctgctccaccagcacctcggccatgcgcctggagaggatcagcccgcccatggggatgtagccgctggtcaggcccttggcgatcgacagggtgtcgggctcgaagccgaaatgctggtgggcgaaccactcgccggtacggccgaaaccgccgatcacttcatcggcgcacagcagcacgtcgtactggcggcagatgcgttggatttccggccagtaactctctggcgggaagatcatgccgccggcgccctggaacggctcggcgacgaaggccgcgacattctcggcgcccagttcgaggatcttctcttccagctggcgcgcagcgcgcaggccgaactcggccagggtcaggtcgccttcgtgggcgaaccagtacggctcgtcgatgtgcgccacgtccgggatcaccccgcccatgtcgtgcatgaacttcatcccgcccagcgccgtggcgccgagggtcgagccgtggtagccgttccagcggccgatcatgatcttcttctgcggcttgccgaggatctgccagtagcggcgcacggtgcggatcagcacctcgttggcctcggagccggagttggtgtagatcgcgtggctgtagtgcgcaggcaacaggctgaacagcagctccgacagctcgaccaccgccgggtgggtggtgtggaagaacatgttgtagtacggcagctgttcgagctgctggctggcggcggcggccaggtccttgcggccgtagccgaggttggtgcaccacaggcccgacatgccgtccaggtagcgctggccgtcgttgtcccagagcgccaggccctcaccgcgcacgatcacccgcggcccttcggcgttcagcgccttctggtcgaggaacgcatgaatgtggtgcgcggcgtccgcggcctggtagtcgccggtgctgcgcacgggtttcatctgaacggtcattgcgagtctccttgcgggtttttatcgagagtgccgagcacgctggccagcggctccggcttgaacagtggcttgcccatcacgcccttgatccacagcacggcgatgatcgagacgatcagcagcaccaggcccgcgtaggcaaaaatcgagaaggtcatctccgggctgggcgagacgttccagatcgcaaacagcatgccggcgatgccgaacacctgcggcaaggggtagaacggcgtgcggaacggccgcgccacctgcgggtagcgccgacgcagggcgacgacgttgacgtgggtgatgatgtaggccagcaaccaggccagggccgccgagagcagcagctggttgatcgcatcggcatggtcgtgcatcagcagcaacggcaggccggtgaccgcggcgatgaacagcaccgcgacccagggcgcgccggtgcgcttgccctggcgcttgaacacgccgaaggcctggccattacgagccatgccgaacagcatgcgcgggatcgccgccagcgaactgttgagggtgctgcaggtggcggtgatcgcggcggtcaccaggaacaccttgcccgcctcgccgaacaccgtggtggcgaacaggtaatgcggcaggccgttgctggccagttccgcctggggcacggtaagcaaggcgcccaggccatacaggctgatgatcacgaaaatgatggtcaggccgagcatcatcgagcccgggatatcgcgctcggggcgccgggtttcttccaccagcgggcagacgaactcggcgccgacaaagccccagaccgccatcgccgtcagggcgattacccccaggcccagggggttccagtgggcgctgtcgaacagcgtcgggttgggcgcgacgatgtcgctgttcatcgcgctcaggcccatcaccagcaacaccacagtcatcaccaccgccagcaccgtctgcaggcgggcgaagatgtcgatgttgaacaggttgagcactgtgaacagcgccagtactcccagggccacggtcagcggcggcatggcgtgcgggtaaaccttgtcgatgatgaactccatcagcaacagctcggccgacaaggcgaacatcgccaccactatgtagccggaaaaggtcgccaggatcgccgggaactggccgatggcgacctcggtgtaagtgctcaggctgccggcgcgggggatcatcagcgccagttcggagaacgagcaggcgtagctcagggccagcaggtaggccaggcccaggggcacgataaagcccaggccggcgatgccgacgccttgcagcatcagcaccatcacgccttgtgagaccaccaggccgatggccaccgccaacagcgcggtgaggccgagtttcttgtgactcgcgggcggcgccagggcgccggtttgcacgcttgcattgctgttcatcggttgctccgtcttgttgttctattttttgaagatcggtgccgcgctccgaggcctcagccgcgcagttgaatccaggtggttttcagctgggtgtacttgtcgaacgaatgcagcgacaggtcgcggccaaagcccgactgcttgccgccgccaaagggcacggtgacatccagcgcatcgacggtattcaccgacacggtcccggcattcagccgccgcgccactcgatgcgcgcgattgaggtcgtcggtccacagcgaagcggccaggccatagatgtgctggttggccaaggccaccgcctggtcttcgtcgtcgaacagcgtgaccgccagcaccgggccgaacacctcttcgcgggccagggtcatgtcggtggtcacgccgctgaagatggtcggctcgataaagttgctcgaaccgtcgatgctcaattgccgaccgccgcacaccagttgcgcgccctcggcctgggcctgttcgatgtagcgcttgatgcgctgcgtctgccgcgcatcgacgatggcccctgcccggctcgccgggtccagcggattgcccggctgccactggcgcgccttggccaccaggcgctcgatgaagccgtcggcaatcgagcgctgcaccagcaggcgcgagttggccgagcagacttcgccctggttgaagaagatgccgaatgcggctttctcggccgccaggtccaggtcctggcaatcggcgaacaccaggttcgggctcttgccgccgcactccagccagacctgcttgaggttcgattgcgcggcgtactgcatgaagtacttgccgacctcggtggagccggtgaacaccagggcatccacctccatgtgcaggcccagggcgcgaccggcctcctcgcccaggcccggcaccacgttgagtacgcccttgggaaggccggcttcgatggccagctccgccaggcgcagggccgagaacggcgactgctcggccggcttgagcaccacgctgttgccggcggccagggccggggccagtttccaggcggccatgtccagagggaagttccatggcaccaccgcgccgattacccccagtggcacccgggtgatggtcgccaggacattgcccgcgctcggcgccacctggtcgtagagcttgtcgaggctttcgccgtaccaggcaaagacatgggccgcgcccggcacatcgatattccaggcatccatcaccggcttgcccatgctcaaggaatcgagcaaggccagttcgtcgcggtgctccagcatcagccgcgacaggcgcagcaggatcgccttgcgctcgctgggcgccatcctggcccaggggccctgctcgaacgcacggcgggcgctgcgcaccgcccggtcgacctcgaccgcaccacaggcggccacctgggccaagcgtttctcggtggccgggttgaccacatcgaagcgtgcgccgctctcggcctggcacgcctcaccgtcgataaaggcgctgtcgatcaggcgttggcgctgcgccagggctgtccactcgttgaaatctttcaccgcgagttccttgttcttatgaagggtcgtttatcagtgcttgcagaggtattcggccaggcgctccatcagccggtcgcaggccgccatctgctcgatgctgacgaattcgtccggcttgtggccctggtccatgctgccggggccgcagaccaccgccggaatgccggtctggtcgaacaatccgccttcggtgccaaaggccacggtgctgaaggcatcgctcccgcacagttgcgccacaagttgcgcagcggcgctttcggaagcagtcgccaaacctggataagccgagatcgcttcgaagcggatcgccgtatcggccttgattgcctgcatcgccggcaatagctcctgttcggcatagccttgcagttcgtccaccaccgcctggggttcgaaggccggcaaggcgcgcacctcgaagtcgaagcggcagtcggccgggacgatattcagcgccgtgccgccctggatcaccccgacctgcacggtggagaacgccgggtcaaaacgggcatcgtgatgctcgggggccgccaggcgccggccgatctcccccagccggccgatcagccgcgccgcctgctcgatggcgttgaccccataaggcgcataggccgagtggcatggcgcgccgtgcacatggcaacgcatagccagcttgcctttgtgcccgagcaccggtttgagctcggtgggctcgccgatcaggcacagcgccggctgcgggatgcgctgtggcagcacttccagcaggctgcgcacgccgaggcaaccgacctcctcgtcataggagaacgccaggtgcaccggccggcgcagcgggctttcgagaaacagcggcaccgcggccagcaccgaggccaggtagcctttcatgtcggcggtgccgcgcccgtagagcttgccgtcgcgctcggtcaggctgaagggttcgagcgtccagggctggccgtccaccggcaccacgtcggtgtgcccggacagcacgatgccgccttccagcgccggaccgatgctggccagcaggttggccttggtccgttcggcgttgtagatcagctcgcagctcacgcccaggccgtgcaggtagtcgcgcacgaactcgatcaaggccaggttcgaatcgcggctgaccgtggcaaagcccaccagcctggccagcaaggcgcggctgcgcagctcactcatcgcccggtactccgtagctcggcgccagggtcgggttgagggcgcgggtcaggtagtcctgcaactgcggctcgtaggcgccccagagtttctgcaactcgccgatggggttggcctcggcccagtccacccgcaggtcgacgatcggccagaccagctcgccgaccaccgacagcgccgccgaatgcaccgcgcccgcctcgcctccggcgtcctgcccggcctgcagcgcgctgagtaaccgcgccgccaggcagccttcgctactttcgaaggcctcgaccatgcgctcgatcaccgcgctgctggccagcaggttgccggccgccacgcactgctcaccggccacggcattgttaatgcccagtgcgtggttgccgctgaataccgccgtgcgcccccgggcatccaccaccgccacctggcggtactggctgtagccgttgcgggtcagcgcctggtccagggcctgcgctggcgccaggccgtcgcccaggccgtcgagcacctgcgggccgagggccggcaaggtgacgttctggctcgacaccgcgcccaccccgctgcgcagccagggacaacgggcgccgacggcgatgctcgaagagctgatggcaatgcccagctggccggtttcggcgcagcggccgacgatggaaaaagtcatggcgcactccttattcggggatcaccgcgatcacgtcgatttccatcagccactgcggctggcccagggcgctgaccaccagcccggtggagatcgggaacacgcccttgagccacttgccgacctcctggtagaccggctcgcggtaacgagggtcgatcaggtaggtggtggtcttgacgatatggctgaggtcgctgccggcctcttccagcagttgcttgacgttgcgcatggcctgctcggcctgggcccgcgggtcgccgaggccgaccaactggccattgaagtcggtgccgacctggccgcgcacatacacggtgttgccggcgcgcacggcctggcacaggtcgttgtccaggctctggttcgggtaggtgtctttggtgttgaacatgcggatgcgggtatgcgtaggcatcagcgggctcccatgcggctggcgggttgagtggcggattcgcgctcggcttggcgctgcgcggcgtcgcgataatcgaagtagaggcgctgtttgacgatgtgttcggcgatatgccgggcgtcgtgccacacgccccagataaacgccgagccgcggcgcgacagccacggcaggccgacgaaatagaccccgggctcgctggacacgccgcgttggtgccggggcttgccgttgtccttgaaggcgtcgacctgcagccagctgtagtccaccgaatagccggtggcccagatgatggtgccgacgccagccttgaccaggtcgagttcgaggatcggctgggtcaggcacggcgggtccggcagcatcacccgcgcttcgggctcttgcggcaggtccaggccgttgcgggcgatgtaggcgtcggcggcgtcgagcagcgccaggtagttttcgtcgccgcgggcgatgttctcggccaggttggcctcgaagctgaccacaccgttatcgaaggccttggtcaggccgaccagggtcatgccctggtgggccagacggcggaagtccacggtatgcccgccacgggcgccgctgacggcgatggtcacgtgctccttgcccggctgcatggtctcggcatcccactcgccgagcacccccagccaccagcagaagtcacggttgcggtaggcccgcggcgggcggtcatgggccccgaccgagaggtagacctgcttgccggcgcgttgcagctcatcggcgatctgcacccctgacgaaccggcgcctactaccagcaccgcgccttcgggcagctgttgcggattgcggtaggccgccgagtgcatttgcagcacgcgttgatcctgcggggcgatcggcgggatcaccgggcactggaacggaccggtggccaccaccacctgccgggcttcgatcaccccgtcgctggtgtccacggtgaagcccgggcggttggcgttacgcaccaccttcctgacttcgacgccggtgcggatcggcgcattgaacttgcgggcgtaggtttcgaagtagtcggcgacctggtccttgccggcgaaggcatcggggtccaggccttcgaattccaggcccggaaagcggtcgtgccaggccgggccgttggccaccagcgaatcccagcgcccggtgcgccaggcttcggcaacgcggttgcgctccagcaccaggtgcggcacgcccaggcggctcagatgttcgctcatggccacgccggcttggccggcgcccactacaagcgtgtcgattattgttttatgggttgtcatgtctgcgccctgttgagtgatcccacgtaggcagccgtgggaggtgtaggacgcattctgggagaaggcgggaagtgccgaaattatgatttttgtggttgctagagagtaaaaaactgtctggctatcggggggggctcggcataagccctacaaccgaatcagccactgcccagcctcttgcagaatcctcctaaatccctgccccgccattcccggtacggtttccagcgaccctttcgcttgaaccaggaccgccatggccagcaacggacccgggccgatgcccagacttttacggcccgccaatcctaaccagagccccgccgaatgcgccgctgaaaccgaacaacccagctacggcgaacagctctgggcccagtacgagaagtacgccaaagagcccacgccaccgcctgaaaagattcaggtggcgctgcgcattggcgtgttctttgacggtaccggaaacaatgctggcaactcggctatgggccaggtttgcggggcgcagcatgccattgaagccagggatatcgatggcagttgcaagccgtatatgagggatccggagagtagttatgggaatgatgtgagcaatgttaagcggttgagtgatttgtacttttccgaacaggaatctgaaggtgagggcctacaaaaacaggccttccgctccatctatatcgaaggtatcggcacacaagccggcgaaaaggatagcgtgatcacctcggggacggggcgtggcggcacaggcgtcttagggtgtgtgcaaaaggcatttatcgagatcaagcaacatattggtattttcttcgagcagaaccccgacagcgaaatcttatccctgacatttgacactttcggctttagtcggggcgccgcagcagcccgccactttgccaatgaagtcgtgcgctggctcgggccactcgagctaattctccacgaccactccagtgccttcagcccccgcttcaaccgacagtacggtaatgatgtcgatatgggttttattggtctgttcgatacggtgccgtcggttgccgggttgagcaacctgggcaacgtgcgcagcgccattaccccaggaatcaaactgcacctcgaccgccgctactttcgctcggtggttcaactggtcgcccgcgatgagtaccgcgccaactttgccctgagtagggtcaaacccgaccacgtggagatcaccctgcccggtgcgcactcggatatcggtggcggttatctggatgaggtgcaggaatgtgtactggtcagcccgatgcaggcgctggaagtctcaatcaataccgatgtgacccacacctcgatttaccgggatgcgctccaggcaagagcacactggctggccaagggttggcccgcgcaatggctggaaatcgccacaccggagccgctgttgctgccccaggatccacaggaccggctcggaccacgaagaaaacgggtgtatgccggcctgcaactcaataggccaatgagcaataagctggcgggagtcactttgcgcgtcatgtatgagctggccaggcagaacggtgtgcaattcgaggaaatcccggagacacccgagtacgcgattccaacagagcttcaagcactatgtgacaggtttgtcgccggtgactacagtacgacgccagccgaggagactctgctcaagctgcgctatatccatctctcggcccactggaaccacccgctgggtaaacaggacggcggcagccttaaagtcgtctacatcaatgcccccacggtggatgccgtgcgtgtgcaacaccctcacgtacctgactggacactttggtaatgagagcattcatcgccctgctgagcgcactgctactaagtggctgcctgaccaccgatccactatccgcaagaaacgatcccaaaagcccctggtgggagcttggctttaccgagccctactacatgaaagtctgggttgaagacagcgcggtagaagacatcaacggaaaactgtttcgccatactggccgtggaactgcatcaggcggcaagcttggttaccaaaaggaatgggccagaggttggagcgagattggtggtgacggcagatcggtgatcggtgccgacctgcccaaacgcattttcgtgcgctggcaatcggtggttgaaccgcaaacctatcgggtatggatcgacatcccggaagaggcccggcagatcatgcgcaagaccaccgcccgtcggtgcccagaaacgccacagcaaaccgtcagctatatggcctcagtcaatctgggattgacgccagggggcattgttcaggtctgggtaagagatgaatgtcatcacccgatcaaagtcacccgcgtccaagccgaagttgagcctttagggccgagccaaggcaaaaccaatggccgttacgcctaccagatcagtgaagagtccaaacgctacatagagaagtacggcatcccctatggcagttggtaatgaaagcactcgcctccctgccgggcagaccgcaaccaggacgacaatccttgcgataacaccttatgccgtcaccgtcctcgccgcccgacccttgcaatcgcggaaacaatgaaattccgtttagggaattgatagccccctaacgaaaggtgcatgctagagggctttcatcgcgcttatatcattccgaatgatagttaccttcgtctcattcgattcgtgcgatacaaccctgccgagcatcatccgcccatctcaaatacattggcggatgatccatggaacagtcactcaaacacttacgcttccctctcgcactcctggccgtgctggtgatgagcgcttgtggcaaggcgccggaaacggccgccagcatgcccgccgccaaagtcagcgtagccaaggtgctcgaacagccggtcaacgaatgggacgagttcaccgggcgccttgaggcgcctgaaaccgtagagatccgcccacgggtttccggccagatcgaccaggtggccttcaccgaaggcgccctggtgaaaaaaggcgacctgctgttccagatcgacccgcggccgttccaggccgaagtgcgccgcctggaagcccagctgcaacaagcccgcgccaccgccacccgcagtgccaatgaagcccagcgcggccagcgcctgctgaccagcaacgcgatctccgccgagctggccgacacccgcaccagcgccgcccaggaagcccgcgccggagtcgacgcaatccaggcgcaactggacgtggccaagctcaacctgagtttcacccgggtcagcgcgcccatcagcggtcgcgtcagccgtgcgcaaatcaccgccggcaacctggtgaccgccgatgtcaccccgctgaccagcgtggtctccaccgacaaggtctacgcctacttcgacgccgacgagcgcgtgtacctcaagtacgcccagctcgcccgccagggccagcgtggccagaccaccccggtgtacctcggcctgtccaatgaagaaggccacccgcacctgggccagatgaacttcgtcgacaaccaggtcaacccgcagaccggcaccatccgcggtcgcgcggtgttcgacaacgccgacggcagctacaccccgggcctgtatgcacgcctgaaactggtgggcagcggcacctactccgccgtgctgatcaacgacgaagcggtggggaccgacctgggcaagaagttcgtgctggtgatggatgccgacaacaagccggcgtaccgcgccgtcgagctggggccgaagatcgaaggcctgcgcatcgtgcgcaacggcctgaacaaggacgacaccatcatcgtcaagggtctgcagcgcgcccgtccgggcgcgccggtcagccctgaagtggtgccgatggccagcaaggaaaccctcgccgccctggcgcaacaaagaaaggccctggaagccagcaatctgcctcaagtcgcccccgccaagggcgcgtctgaagcggctgcgaaactggccagcgctgcgactccacgcggttaagggaaaagactcaagatgaatttctcccaattcttcatttcacggccgatcttcgcagcggtgctgtcgctgctgatcctgatcgccggctccatctcgctgttccagctgcccatcagcgaatacccggaagtggtaccgccgaccgtggtggtgcgcgccaacttcccgggcgccaacccgaaagtcatcggcgaaaccgtggccgcgcccctggagcaggccatcaccggcgtcgagaacatgctctacatgtcctcgcagtccaccgccgatggcaagatcaccctgaccatcaccttcgccctgggtaccgacctggacaacgcccaggtgcaggtgcagaaccgcgtgacccggaccgagcccaagctgcctgaagaggtaacgcgcatcggcatcaccgtggacaaggcctcgcccgacctgaccatggtcgtgcacttgacctcgccggacaaacgctacgacatgctctacctgtccaactacgccatcctcaatatcaaggatgagctggcgcgcctgggcggcgtcggcgatgtgcagctgttcggcatgggcgactactcgctgcgggtctggctcgatccgaacaagaccgcttcgcgcaacctgaccgccaccgacgtggtcaccgccattcgcgagcagaaccgccaggtcgccgccggtaccctgggcgccccgcccgcgccgagcgccaccagcttccagctgtcggtcaacacccagggccgcctggtgaccgaggaagagttcgagaacatcatcatccgctccggcgacaacggcgagatcacccgcctgaaagacatcgcccgggtcgagctgggttccaaccagtacgccctgcgttcgctgctgaacaaccagccggcggtggcgatcccgatcttccagcgccctggctccaacgccatcgagatttccaacgaagtgcgggccaagatggccgagctgaaacagagcttcccgcaaggcatggacttcagcatcgtctacgacccgaccatcttcgtgcgtggctccatcgaggcagtggtgcataccctgttcgaagcactgatcctggtggtgctggtggtgatcctgttcctgcagacctggcgcgcctcgatcatcccgctggtggcggtgccggtctcgctgatcggtacctttgccgtgatgcacctgttcggcttctcgctcaacgccctgtcgctgttcgggctggtgctggccatcggtatcgtggtggacgacgccatcgtggtggtggaaaacgtcgagcgtaatatcggcctcggcctgaacccggtggaagccaccaagcgcgccatgcgcgaagtgaccgggccgatcatcgccaccgccctggtgctctgcgcggtgttcgtgccggcagccttcatcagcggcctgaccgggcagttctacaagcagttcgccctgaccatcgcgatctccacggtgatctcggccttcaactccctgaccctgtcgccggccctggccgcggtcttgctcaaggatcaccacgcaccaaaggacggcttctccaagttcctcgacaggttgctgggtggctggctgttcaaacccttcaaccgcttcttcgaccgggcaagtggtggttatgtcggcaccgtgcgccgggtaatccggggcagcggcatcgccctgttcctctacgcgggcctgatggtgctgacctggttcggcttcgcccatacgccgatgggcttcgtcccggcccaggacaagcaatacctggtggccttcgcccaactgccggacgccgcgagcctggaccgcaccgaggacgtgatcaagcgcatgtccgacatcgccctgaagcaaccgggcgtggaaagcgcggtggctttccccggcctgtcgatcaacggtttcaccaacagcccgaacaacggcatcgtgttcgtgaccctcaagcccttcgacgagcgcaaggacccgagcatgtccgccggggccatcgccggcgccctgaacggcaagtacgccgatatccaggaagcctacatggcgatcttcccaccgccgccggtacagggcctggggaccatcggcgggttccgcctgcaggtcgaggaccgcagcggcatgggttacgaagagctgtataaagaagtgcagaacgtcatcgccaagagtcgcagcgtgccggaactggccgggctgttcaccagctatcaggtcaacgtgccccaggtcgacgcggctatcgaccgggaaaaggccaagacccacggcgtggccatcagcgatatcttcgacaccctgcaggtctacctgggctcgctgtacgccaacgacttcaaccgttttggccgtacctaccaggtcaacgtccaggccgaacagcagttccgtctcgaggccgagcagatcggccagctgaaagtacgcaacaacaagggcgagatgatcccgctggcgaccttcatcaaggtcagtgacaccgccggtcccgaccgtgtgatgcactacaacggcttcgtcaccgcggaaatcaacggcgcggccgcaccgggctacagctccggccaggcggaagcggcgatcgagaaactgctcaaggaagaactgcccaacggcatgacctacgaatggaccgagctgacctaccagcagatcctggccggtaacaccgcgctgttcgtcttcccgctctgcgtgctgctggccttcctggtactggccgcgcaatacgagagctggagcctgccgctggcggtgatcctgatcgtgcccatgaccctgctgtcggccatcgccggggtgatcctgtccggtggcgacaacaacatctttacccagatcggcctgatcgtactggtgggcctggcgtgcaagaacgcgatcctgatcgtcgagttcgccaaggacaagcaggaagaaggcctcgacccgctggccgcggtcctggaagcctgccgcctgcgtctgcggccgatcctgatgacctcgttcgccttcatcatgggtgtggtgcccctggtgttctccagcggcgccggcgcggaaatgcgtcatgccatgggtgtcgcggtgttctccgggatgctcggggtgaccttcttcggcctgctgctgaccccggtgttctacgtcctgatccgcaactatgtggagcgcagcgaagcccgcaaagcgacccgtgccctgaaactggaggcgcaacaatgagcctgaaagtcttcctgccgagttttctggcactggccctgagcgcctgtgccgtcggcccggactaccagaccccgaccaccgaggcggcccacatcacggccgccgccgatggcgccgcgggccagaagcagttcgaccgcgcgcgcttcgaaggcatctggtggcagcagttcgacgacccggtgctcaaccagctggtgacaaagtccctgcagggcaaccgtgaattgcgcgtggccttcgcccgtctgcgggccgcccgggcgatccgcgacgatgccagcaacgatgcgatgccgaccatcaccagccgcgccagcagcgatctggccaaggggcagatccccggccagaccacccgccgggtcaacagcgaacgctacgacctgggcctggacatggcctgggaactggacctgttcggccgcatccagcgcaacctggaagccagcgaagccgaccagcaggccgccgaggccgacctctaccagttgcaagtcaccatgattgccgagctggtggacgcctacggccagctgcgcggcgcccagctgcgggaaaagatcgccctggccaacctggacaaccagcaggagtcgcgcaagatcaccgaaagcctgcgtgacgccggcgtcggcgaccagctcgacgtggtccgcgccgatgcgcgcctggccgcggtagaagccagcgtgccgcaactgcaggccgaacaggtgcgccagcgcaaccgtatcgccaccctgctgggcgagcgcccggacaagctcagtgtcgatctcaagcccgcgcagttgccggcgattgccaaggccctgccaatcggcgacccgggcgaactgctgcagcgccgtcccgacatcctcagcgccgaacgccagctggccgccgccaccgcgcggatcggcgtggccaaggccgacctgttcccgcgggtcagcctcagcggcttcctcggcttcaccgccggccgtggttcgcagatcggctcctcggccgccaatgcctgggccctgggcccgagcattacctgggcggccttcgacctgggcagcgtgcgcgcccgtctgcggggcgccaatgccgacgccgacggcgccctggcgacctacgagcagcaagtgctgctggctctggaagagtcggaaaacgctttcagcgactacggcaagcgccagcaacgcctgatctcgctgattcgccagagcgagtcgagccgcgccgcggccgacctggcggaaatccgctaccgcgaaggcaccgtcgatttcctggtgctgctcgacgcccagcgcgaacgcctggccgccgaggactcccaggcccaggccgaggtcgacctgtaccgtggcatcgtcgccatctacaaggccctgggtggcggctggcagccggagacggtcgccagcaaataaggcttcaaccgagctcctttggttggccgcaaccaaccaattttttgccccgtgttctcattcggtcacggggctttttttcgcctggcaaaaagcatcgcctattccagcaccgtcaccgtcgccgtggtgccggcgcgcaacctgtccttgcccgggtaatcggggtcgatggcgatccgcaccggcacccgctgcgccagcttgacccaggtgtagctggggttgatgttggccagcaggcggctgccctgggagttctcacggtcggtaatggcgaaggcaatgctctgcaccttgccgttgaaggtctcgccgctcatcagctggatgcgcaccgcgctgccctcctcgatccgcagcagcttggtctcctcgaaataaccactgatatagaaagagtcgctgtccaccagggccagcaaggccgcgccggcactggcgtagtcgccctggcgggtctgcaggttggtcacgtagccgctgaccggggcttcgacccgggtgcgctgcaggtccagttcggcctgcttcagcgcggcctgggccaggtgcacgttggcctgggccaggccgaggttggcctggtcgcgcaacaggtcggcctgggccaccgccacatcggtattggacttctcccactcctcgccggaaatcgcgaagccctgcttcaggctgcggcgccgacgctcttcgctttgccgctgcttgagctgcgccgcgctggcggcaatcgccgcctcggattggccgagggtggcgaccgccacttccaccgagcgcttggcatgttccaccgccagggcatattgcgccgggtcgatctccagcagcagctggcccttgtccacgtgctggttgtcctgcacccgcaggctgacgatgcgcccggcgacgtccgccgacagggtcaccacatcggcccgcacccgcgcatcgcgggtccagggcgcgcgggtgtaatgctcccaggcgaaccagcccagcacgagcgccagcactaccgccaccagggtgatcgaacgggccagggtgtttttcagattcataggcttcccatcaacagaatgaccgtggcgcagacgcaggcatacagcgccccttcgaacaacgcttcgtgccagacgaaacgcaatacaccgaggcgccgcagcccccagtcgagcagcaggaaaatcggcaaggccagcaacagggcctgggcaatgggcggcaggtagacgccgccgaattcgaaatcaatgggcaagggccggttctcctgtttccgtgggttgcagcatggggcggtagcgctccaggaaggcgccgacgatcagcagcgagacgcgcatgcggaacaccgaccacagctgttcgtgggcctggggccggtcgtcggcgtgcaactggtccaggtggtcgcccagttcccgcagccgcgccagcagtgggtccacatccagccccggacgccccgccacatagcgcccgacccgccgcagcaactgctgcaggtcagcgttggccgcgctgctcagccagggattgtccaggctctgctgcttgagctggttcatcgccacgcccagggtcatgcaggccaggctggtctcgaaacgctcggcggaagcccggtcgtcggcggcgggcaacagcccgagcatctgggtcaggcggtcgaccatgcggctctcgaagacaaactgctcctcatcgctggccgtggttttctgcaaggcgtacacctgctcgcgggtgtcgcggaacaagcggcgaatgcgcagcaccgggttgaacggaaaaatgaacgcatagaccagcaacgacagcaccccgccgctgacataggccccggcgaactcgaaccactgagcggcattgttctgccaggcgccgatgttctgcgggccgatcatcagcaggctcgatagccccaggcccatgccgatgccggcggtcatcgggctggccaggcccaccgcgaccgtatacagcagcggcaccagcaacagcgccagccactcgaaatcgccgatcaagggcaccagggcgaagacgtagaccgccgagatcaccagcgccagggcctggccgcgcatatagctttgcgccgccgccaagggccgcgggaaggtcgccatcagcgaacagagaatgcccaccaggaccatgctcgaacgcgcgccgtcccaggcggtttcgatccagatcagcccggcgaccagcagcgcggtgaaggcccgcagcgcattcatcgccgccagcggccagtccaggtgcagtgggtttgagcgaccctggcggtacaggcaactggcctggcgaccgtcctggatggcatcgctgaattcgagaatgtcttcgagctgcttgagcatccgcgcctgctcccagcgcagggcccaggccagggagcgcagggtcgcgggcaaggcatcggcctcgcgctcggcgcgccgtgcctgttcgtcgaagcgctgctgcaagtgcgcgaactgctgccgcgaggcggcgggcaaggcacgcccgtgctgcgccagctcgtcgagaaacgccagctcgtcagcgcgcagttgctggatcgcctccggcagctcgccgacccagcgcgcccgcagcagctcgcgctggtggcgcagtacggtgaggcgcgaggtcagcagcaccagctggttgcccagcagttgcaccaggccgtcggcgctgcgcaggcgtggcgcatcgaaatacaggtggcggcgcaaaccttccagggcgctgatctcgcccagcaactgcatctgccgcttgtggaagtcggcctcgctttcgtcggtacggatcgccgccgcggcgtgggtcgccagcaacttgagcacccggtcgatcttggcgaagtaaccatgggccacggcctccgggcgcgccgtcagcaggctgaccacgcagacgcaagccaccgccagcagggtttcggtgacccgggtaatggccagcatcagggtgttgccttgatcggggatcgccagcatcgccaccaccaccgcggtgtagccactgagcacgaaggcctgggagctggtgtagcgcagcaaggtgccgccggcggtgcacagcgccagccacaggccgagggtgaccaggaacggcagcggcgcctgggggaagatcgccatgatcagcaccgccaccgcggcccccagggtagtgccgaccacctggccgaaactgcgggccagggccatgccggccaggggctggctgacgatgatcaccgccatcagcgaccacttgggctggtcgaggtcgaagatgaacgccaggtacagggtcaacaggccggcgacgatggtacgcagggcgaagcgcagcaccgcgccccccgggtggatcacgaccttgaagtaattgatcagtggctgcatgagtgggttctggacaaaggtgcacctgcggctagcgtagtcagtctgcggccgggaaagcttatcgtcccggccttcccggcaggaaggcaattttttccgaactgtcgatccttcgcgccaaccacgtggtcaagcagagtgattgggccagccgatgtcgctcttgcggcctggccccgccgcgaaaacccgagtcctgcccatcgcctcgcaaccgcggtttgactccgaggggaacctgaccgaagcttgcgccttcgtaaagccgcccccgccatggatgcctgcatgaccaagccccgccgcaccctgttgatcagcctcctcgtcgtattggccctgggcctggcgtggctgttcctgcgtactacgccaccggcggtgccggatgcgatcaggcacggttacggcaaggcgctggaacaggcgcgcaacggccagcccggcgcggcgcgggtgctgtatcagcagctggggcgtccggacctgtcggacagccggcgcatccgcctgctcgccgagctgcacaactaccccagcccacaggcgctgaaactggccgacgccggcctgcaccacgccgagcccgaggtccgcgaggccgccatccaggcggtgctcggcctggtcccggcgcgccagcgcagcctgctgatcggcccgctgctggacgatgaagtgcaaggcgtgcgcttcgccgccgtcaccgccctgctcggcctgtcgccggatgaacagggcctgtatttcgggccgctgcagcaagtgatcgatgagtacacccaggtcctcaaggcccagccggaaaacgtcgaggcgcaataccagttggcgcgcctgtacctgcacaacgccaacctggaccaggcccagcagacgctggagcacgccttgagcctgcaaccggacaacctgcaagcggtgatcctgcaactggaggtgctcgaccgccagggccgcagcgaagccgcccgccagttgctggccaaacagctgcaggcgcaacaggattccgcctacctgcaacacgccctgggcatgtggctactgcaccacgaccagagcgagttcgccctgctcggcctgtcccgcgccgtggagctggagccgaacaacgccgactaccgctatgacctggccaccaccctgcacagcgaagaggagctggaagcggcgcagaaacagctcgaggaaatcgtccagcgccaacccgccaaccgcaaggcgcgggtgctgctgatcaagtactggaaggaaagcggccagctgcagaacgtgcagatcctgctggcccagctggaacaacagaaccccgacgatccggccttgcagcaaggcctgtaaacacctcctccatcctgctccagcgtgccgcccgattgaccgctgcccctttcccgcaggagcgcggcgatctcaagacctcatgaaggccctgcgggccttatcgcagcctcgcgggctcggcagcggctacaggagcgcggcagacttcatgtagccgctgccgcaggctgcgatcgcctgcgcagcaggcgcaagtcctgagttcaggatctttctgatccaccgcagaatcaggctttgcgacaactgcctcggcatgccgcccagtccgatcgcagcctcgcagcctcggcagcggctacagcgcggcggttgtagagagggtcacgccagcaggcgctggatctgttcttgcaggctgtcgaggtcgaagggcttggccaggatcggcgcgcttctcgcgatggggctgccggactcgagaatctcggtgggatagccactgatgaaaatcaccttgaggtcggggcgcagtttcaccgcgggttcggcgatcatcaccccggtaatcccgcccggtagccggtagtcggtgatcatcacatccaggtgcggcttgctggcgaggatctcgaatgcctgctcgccgttttccgcctgcagcacccggtagcccaggcccgacagatagtcggcgagcaacatcagaatcaccggttcatcttcgacgatcagtacgacgtcttgtgcatcttcactcatgagaagcctttgttcggtcaatagctgctgatacgaccatccggtcatccagaaggttgcgtgggagccggtgttttcctacagcggcagacaaacgcgaaacaaggcaccttcgccgatccggctgtcgacttcgatggtgccgccatgggcggtgacgatctgctcggaaatgaacaaccccagcccgagcccggccaccgcatgattgacagagacgcgctcgaactgctggaagatacgcgcctggttttcctcgctgatgccgatcccgtgatcgcgcacttcgacccgcgcctgcccgtccgcgctgtagacccgtacttcgatcgggctcttggcgccatagcgcaaggcattggtcagcaggttggagatcacctgttcgatgcggaactcgtcccactggccgaataccgagtcttcggcgttcagggcaatcgacgactcggcggcctcgacctggggcgcgaaattctccagcaggccgcgcaccagttgcaccaggtcgacccggctcgggcggatcgacagcttgccggtacggatccgcgagatgtccagcatgtcctcgatcaggcggatcaggcttttgatctggcgctcgtcgcgttcgaccatggcgtgcatcttgtccagggtgaacgcggaagcgttgtcgcgggccaggtgcatcttgcgcagctgggtttccaggatcaggccgttcagcggcgtgcgcacctcatgggcgacgatcgacatgaaatcgtcacgcatgcgcaccgcctgctccagttcgttctgggtcgcctgcaactgcttgagcaacgcctcctgctcgcgccggctctgctccagggcttcgacctgctgcttcatggccttgctctgccggtacaggtcgacgaacacattgaccttgctcttcaccgcatgggtatccagcggcttgtgcaaaaagtccaccgcgccgctttcgtagcccttgaaggcatagtcgagctcgcgcccggcggcgctgacgaacacgatggggatgttcttggtcttctcggtgccgcgcatcagttcggccagctcgaagccgttcatgccgggcatctgcacatcgaggatggccatggcgaactcatgctggagcaacagcgacaatgcctcgtccgctgacagcgccttgtacacctggcggtcctcgcgcttgatcagcgcttcgagggccaacaggttctctggcagatcgtcgacgatcagcagcttggcttggatattacttaacatgcgattcgttccagctcgacaagcaaacggctgatgccgtgcaaagggagaatgtaatccggtcggtgcagcgcgatggccgcctcgggcatggtcgccacctgggcctcggccgggtcctggacaatgctcaggccaccgcgccgcttgacctgggccaggccttgcgcgccgtcctggttggccccggtcagcagtactgcggccaggcgcgggccataggcatcggcggcggaatcgaacaggtaatcgatggcgggacgcgaatgatgcacgcgctcctcctggctcagggacaggctgcggtcctgctccaccgacaagtgataaccgggcacggcgaaatacagggtgccgcgctcgatggtctgcttgtcgcgggcctctttcacgggcagcgccaggcgctgggcgaacagctcggccaactggctgcgatgctcttcgggcaggtgcagcaccaccactatcggcaggctgaagccctcgggaaacgcggtgaagattttcagcaacgcctcgacgccgccggccgacgcacctatcactatggcctcgacccgcggcaaggcggattgcccgttggcgtcatcgttcatgatttgcggtagacccgttcttgtttgaccagcggctcgaaatgctcgccgtaggccgagaagtccagggtttccttgctgcccagcaccaggaatccacgatggcaaagcgactcgtggaacaggccgaaggcccggtcctgcaacttcttgttgaaatagatcagcacgttgcgacaggaaatcagctgggtttcggaaaacacgctgtcggtcgccaggctgtgatcggcgaaggtcacgttctcacgcaaggtcttgtcgaagatcgcgtagtcgtaggccgccgtgtagtagtcggcaaaggagcgcaaaccgccggcctgctggtagttctgggtgtaggcgcggatgttctccagggaaaagatgccctgcttggccttctccagggagctgggattgatatcggtggcgtagatgatggtgcgctcgagcaacccttcctcgcgcaacaggatagccatcgagtagacctcctcgccggtgctgcagccagcgatccagaccttgatcgagggataggtcttgagcagcggcaccacttcctggcgaatcgccaggaagtgcgacgggtcgcgaaacatctcgctgaccggaatcgtcaggaactgcagcagctgcatgaacgcgcccggatcgtgcagcacccgctcctgcagggcggaaatggtcttgcattcgaactggcgcagcgcatggttgatccggcgcttgatcgaggcgccggaataatcgcggaagtcgtagctgtacttgaggtagatagcttcgatcaacaggcgcagttcgatctcggtattacgctccactagattctttccatcttgggtaaccagactcgaatgagggaaaacagccggtcgaggtcgatcggcttggccaggtaatcgttggccccggcctgcaggcagcgctcctgatcgtccttcatcgccttggcggtcaccgcgatgatcggcagcttgcgccagcgcggctgcttgcggatttcctgggtggcttcgtagccgtccatctcgggcatcatcacgtccatcagcaccaggtcgatgtcctcgacttcgttgagcttggcgatcgcttcgtggccattgcggccgatgaccacgatcgcgcccttctgctccagggcgctggtgagggcgaagatattgcgcacatcgtcgtccaccagcaggaccttgcgcccctcgaagaccttgtcgcggctgcgggcggccttgagcatcttctgccgctcatgggacagctgggactcgaccttgtgcaggaacagggtcacttcgtccagcaggcgctcgggcgagcgcgcgcccttgatgatgatcgagcgcgaatacttgcgcagctccgcctcttcgtcgcgggtcaggttgcgcccggtgtagacgatcaccggcgggaacgagcagatatcctcggtggacatgcgcttgagcaggtcgttaccgagcatgtccggcaatttcaggtcgatgaccatgcagtcgtagaggttgtcgcgcagcagttccagggcctcctgggccaggccgacggcggtgatctcgatgtcgtcgtcgccgatcagccgggcgatgctgtcgcgctgcaggtcgtcgtcctccaccagcagcacacgcttgaccttctgggtgagcttggcctccaggcgggcgaatacgtccttgagctcttcgcgggtggtgggcttgaccgcatagccgatggcgcccatgtgcatggcggcctcgacccggtcttccacggagatcacatgcaccgggatatgccgggtggtggcatgcgccttgaggcgctgcaacaccgtcagcccggaatgatccggcaggcgcatgtccagcaggatcgcgtccggcacgaactgctcggccaggctgtagccctcgtcggcgccgtgggccaccaggcactggtaacccagctcgtgggccaggtcatacagaatgtgggcaaagttcggctcgtcctccaccaccaggatgcagcgggtggcgaacggcgccttgtcgcgatcgtcggcgaaacgcgcaatctccacctcgggcaccggcggcgtagccggtttgctcggcgccggcgctacccgcacggcggcgggcctggcagcctcttgcggctctggtgcgcgctcgacgtactgttccggcagcaccagggtgaagacactgccctgccccggctcgctggcgaccgtgatcgaaccgccgagcagcgccgccaggtcgcgggaaatcgacaaccccaggcccgtgccgccataacggcgattggtggtgccatcggcctggcggaaggcttcgaaaatgctttcctgctgttccggggcgatgcctatccctgagtcgcgcacagcaaaggcaatgcccgcctcgggctcgcgcgacacggtcaggctgacctggcccttctcggtgaacttcaccgcgttggacagcaggttcttgagaatctgctcgacccgctggcagtcggtgaacagcatcgaaggcgcgccgggctgcaactcgacacaaaattcgaggcccttgtccgcggtcagcggctggaacagcccgcgcaggccttccaccaggcgcgcgacgctggcgttttccgggcgcacttcgagcttgccggcttctaccttggaaatatcgagaatgtcgttgatcaggttgagcagatcgttacccgccgaataaatcgactcggcgaactgcacctgttcggcagtgaggttttcctcggcgttttccgccagcagcttggccaggatcagcgagctgttcagcggcgtgcgcagctcgtgggacatattggcgaggaattcggacttgtacttgctcgaacgctgcagctcctcggcacgctcctgcaactgcacctgggcctggttcagctcgccgttcttgcggtccatggcgtcgcgctgctccgccagttgctcgttggtctgctccagctccacctgctgggcctccaggtgcacctgggactccttgagcacccgcgactgctcctcaagctcctcgttggcggtcttcagttcttcctgttgcacttgcagctcttcgttgagctgctgggtttcggccagcacttcctgcaggcgctggcgataacgcgcgccctcgatggcggtgccgatattgccggcgatcagttccagcagctcgacgtcacgttcgctgagggcccgcaggaagcccagctcgatcaccccgttgacccggtcgtcgtcgctggtcggcaccaccagcacgctgcgcggtacgccttcgcccaggccggagctgaccttgaagtaatcggcgggcacctcgtccaggcggatcagccggtcctgctgggccgcctggccgaccatgccttcaccgaggaaaatcgactgttcgcgctcttcctgctcgcgggagaagccgtaggcggccacgcgcttgaggccgccgtgctcttcacgcacgtacagcgccgccaccacgctgcccaggtattgcgcgcagaactgcaggaggttgcgccccagcaggttcagcgtcagttgccccagcaactgctcggccagttcggtctggccactgcgcagccaggcctgtcgcgccaggctccgggcactttgctgctgggcctcgaggttggcgctgtagctcttcgacaggttgagcaggtcgcggcgcccgatataggccagcaagccgctgatccccaccacgaacagcaggtacaggaccacgctgaggaccgtggtgcgcgtgacattctcattgcgatcgacccgcagttgctgctccatcgccaccgcgtcgtcgtattccttgcgcatctggtcggtcaggcgcttgccccggccggactgcaccgagcggcgataatcgccctcctggcgacgcatttcgatcatgtttttcgcgtgcaggccccactcttcctgcaaggcttccaggcgcttgaagcgatccacctgctgtgggttatccgccaccagcccccgcagctcacgcaattcgctgaagatctgcggcttggccacttcatacgggtcgagaaaatgctcgtcgccggtgatcaggaagccgcgcatgccggtttccaggtcgaccgtcagcttggccgcctggttgatgctgttgattacccgatcgctgtgctggacccactggatcgccgagagcagatagctgatcagggacacgaagaccaccgcgctgagcacgcccacgcccaggggaagcgcgatgttgcggcttagcagcttgcgaaaactctgttcatcgaccgaagacgaagagatcattgaaaggccttggtgaagtgtcaaaaaccatggagtttgccccaaaggagggcaacgtatctatgcttgcgacaagctcggtggcaatttttcatcctgcactgcccgccctcgatcagacaggttattctggcacagcttgtacaggattacttttttgtacaggttcgggaacttgtcattgcgcgttatttactgatgcaagagacaagcacttttttccgctgccgtccttttttccattttttcgagagccttgccatgtcccccaccgattccaccatcctggtcgtcgaagacgatgccatcgtccgcatgctgattgtcgatgtgctggaggagctggaattcaaggtgctggaagccgcgggcagcgaagaggccctggcccggttgcgggacagcacgctgcggatcgacctgatgatgaccgacgtcggcctgcccggcatggacggcaaggaactggcggccagcgcccgcgccttgcgcccggagttgccggtgctgttcgccagcggctacgcggaaaacatcgaggtgcccgccggcatggcggtgatcggcaagcccttctccatcgaccagttgcgcgacaaggtccgcgccatcctcggctgaaccctcggtaacccgcgccgacccgacgagcgcctcggccatgggcgccagggcggccgcgccagcgccctgctgtggtttaatggcgccccccgcagacacccccgcgcttttcaggaatacccactcatgagtccgaccgccgccaccaaagtcctggtcattggttacgtctggcccgaaccccgctcatcggcggccagcgggcacctgatgcagatcctccaggtcttgctcgggcaaggctgggacatcaccttcagcagcccggccaaccccggcgagcacaaggaagacctgagcgccctgggcatccgtgaatgcccgatcgaactgaacaacagcagcttcgaccgctttatcgccgaactggcgccggatatcgtgctgttcgaccagttcatgatggaggaacagttcggctggcgcgtcgagcaacagtgccccggcgcgctgcgcgtgctcgagacctccgacctgcagagcctgcgccacgcccgccatcagcgcctcaaggagcgcctcaaggccagcgacgacaacgatgacttcagcgccctgttcgcccccgccgccgcgcaggagttcgccgccatggccgacaccgaccaggcccggcgcgaaatcgccgcgctgtaccgctgcgacctgagcctgatgatctccgagttcgagatcgagctgctggtcgggcaattcggtttgccgccggccttgctgcactggtgcccgctgatgcccgagcagatgccgcacagctatgtgcccttcgccgaacgggcgcacttcctgagcatcggcaacttccgccacgcgccgaactgggacgcggtgctatggatgaagaacgccgtgtggccgctgatccgccagcagctgccgggcgcgcaactgcatatctatggcgcctacaccccgcccaaggccgcggccctgcacaacccggcccagggtttccaggtgatgaactgggccgaggatgcattagaagtcatgtccgccgcgcgaatctgcctggccccgctgcgcttcggcgcgggcatcaagggcaagctgctggacgccatgctctgtggcacgccgagcgtcaccaccccggtcggcgccgaagccatgcacggcgacgcgccctggccgggagcagtggccgagtcggccagcgccatcgccgcggcggcggtgcgcctgtaccaggaccaggcgctgtggagcgcggcccaggaacagggacgccaactgttgcttgcgcgctatcggcagcaggtccacggcccggccctgatcgagcgcctgcagcactgccgggcgaacctggcgcaactgcgccgcgacaacttcaccggcggcatgctgcgtcaccatcaccacaagagcacccagtacatggcgcagtggatcgaagcgaaaaaccgcctggcctgaggcacgcccgccgatccctggacgtccaggcgacacccgcccctgtagccgctgccgcaggctgcgatcgaccccgaagggggcgccgctcttgaaggcccggaaggtcctgcggaccttatcgcaggctgcgccagcggctacaggtgtaacggccggcactggtgctgagggtttgaaggaggcatgatcgggcgcaacaacgataaaaagcgcagcgccatgagccgatcagctagagtcaccgacccttcctacgaattgatggacgaccataacggcctgtcgatcatctatcgccagcacggcttcccctgccccctggtgcgctggcacttccacaaggagtacgaactgcacctgatcgtcgccagctccggcaaggtgttcatcggcgactacatcggcaacttctaccccgaatcgctgttcctcaccggccccaacctgccccacaactggatcagccaggtcgccgaggacgaagtggtggccaagcgcgacatgctggtgaacttcaccgacgagctgttcgaaagcggctatcaggtgttcgccgaactcaagagcctgacgccgctgctggagcgcgcgcagtacggcatcgagtttcgctgcaagcgcaccatcgcccaggccatggacctgatgcagcgcatcgccgactccagcggcatcacccgcctcgggcactttttcatcctgctggaactgctggccacctgtgacgattaccagctgctgtccggcgccaccacggtgcaactggcggacgagcacaacgtcgaccgcaccaaccgcgcggtggactacatcttcgcccactacgcccgcgaactgccgctggaggaagtcgccgactacctgggcatgaaacccacctacttctcccgggtgttcaagcaggccaccggccgctgcttcgtcgagttcgtcaaccgcctgcgcatcagcaaatcctgcgaactgctggccgacggcgacaagccggtgaccgatgtgtgcttcgagtccggcttcaacaacatctccaacttcaaccggcgcttccagcaactcaagggcatgaccccttcccactaccggcgcctggccgtgcagcgcctgaccgaacagaacctcgcctgacctccccgccccctataagagcgagcttgctcgcgatcaatcctgttagcaccgcgggcatctgatctggcgctatcgcgagcaagctcgctcctgcaaaaagcctcacccccaaagaccagaggccgacctggcaaacgcaccctgttcagctggcgttcagcaaatggcaatcatagccatttgtgaatacgtatcattatgttacaacttagctccctatctatctccccgccggtgctgaatgctcgttccatttctgatcatgctgcgcgaagggatcgaagccgcgctcatcgttggcatcatcgccagttacctgcaacagaccggacgcggccagtggatgccggccgtgtggatcggcgtgtttctcgccgcggccctggccctgctggtgggcggtggcctggagctgatgagcgccgagtttccgcaaaagcagcaggaactcttcgaaggcatcgtcggcctggcggccgtgggcatcctcagctccatggtgttctggatgcgcaaggtcgcgcgttcgctcaagcattccctgcaagcctcgctggaccaagcgctgaccggctcccgacaccaggtcacggcgctgatcgccatggtgttcttcgccgtggcccgcgaaggcctggaaacggtgttcttcctcctcgcggtgttccagcagagccagggcccggccgcgcccatcggcgccctgctcggcctggtcctggcgatcgtcgtcggctggctgatctacagcggcagcatgcgcctgaacctcagcgcgttcttccgctggaccggcctgttcatcctggtggtggccgccggcatcctcgccaactcggtgcaggccctgcatgaagccggggtctggaaccacctgcagggcgtgctgttcgacttcagcgccagcctgccgatggacagcccgctgggctcggtgctggccggcatgttcggttaccaggacgcgccgaccgtcagcaccctgggcgcctatctgatctatctgctggtgaccctggtgctgttcttcatgcccggcgcggcacccgccgccagcccatcgtcttccgtttccagccagtaaggcctttccatgacccagcaagcctccccacagcccccgacaccgagcgccctgcgctgggcgctcgcgggctccgtgatggtgatgatcgccgccggcgggctgttctattacgcctcgcagctggccgccagcaagcgccaggcgcacaaggacgaaatcaccgtgaccatccatccccacagctgcgagccgaacgccctgagcgtaccggccgggccagcgagctttcgtatcgtcaaccgctcggaccgcgccgtggagtgggaaatcctcgacggcgtgctggtggtcgaagagcgggaaaacatcgcgccgggcctgagccaggtgatcaacgccaggctgcagcccggcgactacgccatcacctgcggcctgctgagcaacccgcgcggcaccctgcatgtgaccccgaccgccgagtccgacgcccaggccaaggcccggccgtcgatggtcgcctttatcggcccgctgtcggagttccgggtctacttgagccgccaaagcagcgccctgatcaaggccgtgagcgagctggagcacgccatccaggccggcgacctggcccaggcccaggccttgtacctgccggcgcgcgcggcctaccagcgtcttgccccggccgcccagcgcctgggcgagctggacaaccgcatcaacgcccgcgccgactacttcgaaaaacgcgagcaggaccccgccttcgtcggcttccaccgcctcgaatacgcgctgttccagcaacgcgacctgagcggcctggcgccgatcgcccagcgcctgctcagcgatgtcaccagcctcaagcaacaactgctggcccagtcgctgccaccggagcaactggtcagcctggtcgcgcgcagccagcgcagcatcgccgaggtgcgtgccgccagcggcgaggaagaacgctacagccacagcgacctcaacggctttgccgccaacctggagaccacccgcaaggtcgtcgacctgctgcgacccttgctggccaagcccgccgccccgctgctggcgcagatcgacggtgccctcggcgccctcgacagccagtacagcgctttgcgcagcgccgatggctacgcctcctacgacagtgtcggcgccgatcagcgcaagcggatcgccgaccaggccaaggttctggccgatgcactcgatggaatcgaacccgcccttggcctctccggcctgtaagcagaagacgcccgcccgatgaacgactcaaacgcttccaatccagctttctccgcccaacgccgtcgcgtgctgctgggcatgggcgccgccggtgtggctctggccggcagcagcctgagctgcccggcgctagcagcccagggcgggaaagccgccgcccaggtcacgcaagcaccgagcagcgaccagacccaggaccgccacgatttccatggccagcatcaaagcggcatcgtcaccccgcgcccggcggccggcatgctggtggcgttcgacgtgctggccagcgaccgcgaagacctggagcggctgctgcgcaccctggaccagcgcatacgcttcctgatgaccggcggcccggtacctcaggtcgacccgaaactaccgccgctggactcgggcatcctcggtccggtggtgaccccggacaacctgaccatcaccgtctcggtgggcgcctcgctgttcgacgagcgcttcggcctggccgcggccaagcccaagcgcctgatacgcatggtcggcttccccaacgatgcgctggagcccgactgctgccacggcgacctgagcctgcagttctgcgccaacaccgccgacaccaatatccacgccctgcgcgacatcgtgaaaaatctgccggacctgctgctggtgcgctggaagcaggaaggcagcgtgccgccccaggccccggcgcgtcctggcgagccggcgcagagcgcgcgcaacttcctcggttttcgcgacggctcggccaaccccgactccaacgaccgcaaggccatggagcgaatcgtctgggtccagcccggcagcgacgaaccggcctgggccgcccacggcagctatcaggcggtgcgcatcatccgcaacttcgtcgaacgctgggaccgcacacccttgcaggaacagcaaagcatcatcggccgggtcaaggcctcgggcgcgcccatggacggccagcaggaacaccaggtgccggactaccgcaaggacccgcacggccagctgaccaagctcgacgcccacatccgcctggccaacccgcgcaccgccgaaacccagcgcaacctgatcctgcgccggccgttcaactactccaacggggtgaacaagaacggccagctggacatgggcctgctgttcatctgctaccaggccgacctggagcaaggcttcatcgcggtacagacccgcctcaacggcgagcccctggaggaatacctcaagccggtgggcggcggttatttcttcagcctgcccggcgtcagcggcgagcaggacttcctcggccgcgggctgctcgaggccacccaagcgaaaacccgtgcctgaccaccctccatccccccacggaaacgtcccatgaaaaagtcgcccctcgctgtgttgctgacccttggcctgctgcatgttccgctgtcggcggttgccgccacctcgccgctggagctggtggggccgatttccgactacaagatctacgtcaccgaacagctcgacgagctggccagccacacccaggcctttaccgacgcggtaaagaaaggtgatttggctacggctaaaagactctacgcaccgacccgggtgtactacgagtcgatcgagccgatcgccgaactgttcagcgacctcgacgcggccatcgactcgcgggtcgacgaccacgaaaaaggcgtcgaggccgaagacttcaccggcttccaccgtatcgagtattcgctgttcgcgcagaactccacccagggcctggacgccctggccgaccgcctgaacaaggacgtcaaggacctgcaggcccgcgtcgccggcctgaccttcccaccggaaaaagtcgtcggtggcgccgccgccctgctggaagaagtggccgcgaccaaggtctccggcgaggaagatcgctacagccacaccgacctctacgacttccagggcaacatcgacggggcgaagaaaatcgtcgacctgttccgtgcgcagatcgagcagcaggacccggccttcgtcgccaaggtcgacaagaacttcgccacggtgaacaagatcctggccaagtacaaaaccaccgacggcggcttcgagacctacgacaaggtcaaggacaacgaccgcaaggcgctggtgggcccggtcaataccctggccgaagacctctcgaccctgcgcggcaagctggggctggactgatctccgggtacccggcccgatcttgcgtaggagcgaagcttgctcgcgataagttcgccaggacaacacggtgaaatttgacgaccgccgctgcgcggctatcgcgagcaagcttcgctcctgcagacaagcgtccggccggcgtgccgatgactcgccgcatcacccaggctgctgatctaccctcacctgcgccgatacccctgggcggcggcgcgttttagcgataacgtcccgcgcactcctgactttcatggaagattttgtatgccaactgccacggcccaaccgccgcagaccgccgcgccgttcaaactgctgccgctgatgctcgcctacatggcctgcaccatgtcgatgatggccttcgtctcgttgatcggcccgatcgtgcgcgtgctcggcctggccacttggcaggccggcgcggcggtgaccgtctccggggtgatctggatgctcctggcgctcccctggggccaggccaacgaccgcttcgggcgccgtcgggtgctgctgctcggcacggccggcttcaccctcgcctactgggcgctgtgcctgttcatcgatgtttcgctacacctgttgccgggcatgtggctggcctttatcggcctgatgctcgggcgcggcctgatcggggtgttctacgcggccatcccggtgggcggctttgccctgatcgccgacaacgtcgaacccgagcatcgggcccgcgccatggccaccctgggcgccgccaacgccgtcggcctggtgctggggccggccgtggccgcgctgctggcccgggtcagcctgagcctgccgctgtacgccatggccgtgctgccgctggcggcgttcctggtgctgctgtacaagctgccgcgccaggaactgcacctcaagcaggcaccgcgctcggtacgcctgagcgacccacggctgcgccggccgatggcggtggccttcgtcgccatgctctgtgtgtccatcgcgcagatcaccgtgagcttctacgccctcgaccgcctgggcctggacagcgccgacgccgcccaggccgccggcatcgccctggccatggtcggcgtggcgctgatctgctcgcaactggtggtgcgcaaactcgaatggccgccgctgcggatgatccgcgccggcgcgctgctggccgccagcggttttgccggctgcatgctggtggagagcgcctgggggctgtggctggggttcttcgtctcggcggcgggcatgggtgcgatcttcccgtccttctccgccctggcggccaacgccgtggacgcctccgaacaaggcgccaccgccggctccatcggcgcggcccaggggttcggcgtggtcatcggccccctggccggctcgctgatctacgccctcgaaccgcgcctgccctacctgattgccacgctgttgctgctgttggtggcggtctggccagcggcgaaaagccccaactgatccggccgccgatacccctgtagccgctgccacaggctgcgtacgtcccaaagggacgcagcgatctcaagaccgatgaaggccctgcgggccttatcgcagcctcgcaggctcggcagcggctacaggcgagacccggcttcgtgtagccgctgccgcaggctgcgataagccccgcaggggcttcagggccagcaagaacaactccatcgtggatcgtgcgccgcagacctcagaggatgcggtagagcaaccgctcgatccgcacccggctgacccggcgcaggaacttgccgacggccgccgggtagtccaccagggtttccaggcgctggaagtgctcgatgcgccgggtgtggcggaagatcgtttccagctcctggcgccgcggttccagcaactcgcccttggggtcgtcgagcagcaaggcgttttccaggtcgaggcggaaggctcgcgggttgaggttgttgccggtgagcaaagtgtagcgctggtccacccacatgcccttgaggtgataggtgttgtcgccatcgcgccacaggtgcaggttcaggcgaccgctgtcgatggccttctgatgccgcttggcgaagcgtcgcaggctgatctcgtagaggtacggcagcgcggcgatgaccttgaacggctcgctcggcggaatgtagaagtcgttggcggtcttgtcgccgacgatgatgtcgatcttcaccccgcgcgccagggcgcggttgatttcccgggtcaccgccagcggcaggttgaagtacggcgtgcagatggtcagttgttgctgggcgctggcgatcagttcgcagatgacccggctcagcgggttgttcttgcccaccccgagcagcgggctgaccgacaactggtccttgagcaccccgccggcactggtgtcgtaggccgcgtgcttgaggcggctgcgcaggtcgccgatgtcgttgcgcaggctgcgggtggttggcaggttcggcaggtccaggcgatgcaccgcccgcgacgccaccaggccatgctggaccaggtgctgcatggagtcggccagctcgcggttgtgcagcaggtggtagcggtcgaagcggtatttgtcgaacttgtgcaggtacacgttgttcaggctggcgccgctgtagatcacgcaatcgtcgatcacgaaacccttcaggtgcagcacgccgaacagctcgcgggtctgcaccggcacgccgtacaccggcactacgctttcgtgggtgcgggtcatttcctggtaccaggccgagttgcccggctgcttgccggcgccgatcagcccgcgctgggcgcgcagccagtcgaccacgaccaccacgtccaggctccggacgcgcggccttggcggcgtgcaaggcatcgagaatttcctggccggcctcgtcctgttgcaggtacagcgcgacgatatagatgcgccgggtggcctgggcgatcttctccagcaggcaacggcggaattcggcggcgccattgaggatggacaggtcatcggcagccagcgggaagctgcgcaattttggcagcagggaacgtttgaaaagcgacggcatagggctcgcagaaggtcgaatccaaaagagcgcaagagcttacaccaaggtgccggcccgggtcttgcgaggcgctgtgaagatttgtcgcctgccctctcgcgcctgccgcgcaagcgcgggtgacgggatcggccgcgaccatgaatccatctattgaaaataacttattgaccaaggagaacgatcgttctactgtacgccacatgaacgaaatcactagcaacgacacacgcgacatcattctggatgtcaccgaaaagttgatctataaaagtggcatcgccgccacgggcatggatcttctggtgaagaccgccggcgtctccagaaagagcatctaccgctacttcaccaccaaggacgaactggtggtggccgccctgcaacgccgcgacctgcgctggatgcactggtttcgcagcgaagtggacaaggccccgaccgcggccacgcgcctgctcaacctgttcacggtactgggcggctggtttgcctcggaggactttcgcggctgcgccttcatcaataccagcggcgagaccggcgacccgcaggacccggtacgggtggtggccagggcgcacaaacagaaactgttcgactacgtgttcgagctctgtaaggaacacgcctcggaaaaacccggcaccgaagatccggaggagcaagccagacagctgctgatcctgatcgacggcgccattaccgttgcacttgtgatgggtgatcgcagtgccgccgataatgcgcaatgcatggcgcgaaagttattggacctgtaatcgtttaaaacaagttcgacactgctgaacctcaactttcattggagactttaaatgtcatctaacgctgaagttcgtccgccacttccccctttcacccgcgaatcggccattgaaaaggtccgcctggccgaagacggttggaactcccgcgatccgcagcgggtgtccctggcctacaccctggacacccaatggcgtaaccgcgccgagttcgcccacaaccgcgaagaagccaagggctttttgacccgcaaatgggccaaggagctggactatcgcctgatcaaggaactctgggcctttaccgacaaccgcatcgccgtgcgttatgcctacgaatggcacgacgactcgggcaactggttccgttcctacggcaacgagaactgggaattcgacgagcacggcctgatgtccaaccgctacgcctgcatcaacgacatgccgatcaaggaaagcgagcgcaagttccactggccgctgggccggcgcccggatgaccatccggggctgtccgacctgggcctgtaaccccttgtaggagcgagcttgctggcgatgccggcactgcggtctgtccgacagaccgctatcgcgagcacgctgcgctcctgcaattatccctctcaagccgcggcatcctcgcgcttcagcgccgccttggcttccagctcgcgcaccagtggcaatacacgcttgccgaagtactccacctcctcctggaaatgcaggaaccccgccagcaccaggtccacacccacggccttcaaggcgacgatgcgctcggcgatctgctgcggcgtgccgatcaggttggtcttgaacccgtcgttgtactgcaccaggtcctcgaaagtggacttggcccagttgccctcgccttccggcgacgccttgcccgcctgcttcgccgcgtcgccaaaggcgttcaccgcttccggatcggcctggtcgatgatctcggccagcaccgcgcgtgcttcctcctcggtgtcgcgggcaatcacgaaggcattgaccccgaccttcaccgaatgcttgttcgccgcggccttggcacggatgtcgtcgacctgggccttgatgccttccggcgtgttgccgttggtgaaataccagtcggagacgcgtgccgccatgtcccgcgcagcgcgggaactgccgccctggaacacttccggctgccccagcggcttgggcttgaggctgtagttgtcgaagcgatagaagtcgccacgaaaagtgaagttgtcctggctccagatgcccttgagggaacggatgaactcttcggaacgccgataacgctcgtcgtgctccagccagtgttcgccgatggcctggaattcgcccttgaaccaaccgctgacgatgttcaccgcgatccggccattagtcagctggtcgatggtcgccagttgcttggccgccagcgccggctgccaggggccgggcaggatcgcggcgatcaccttgagcttgtcggtggcggccagcagcgcatggctgaacgccacggactcatgctggaactcggcgccgtaaccggcggtgaaacggatctgggtcagggcgtattcgaaaccggcggcttcggccaactgcgccagcttgcggttgtagtcgatgccccagtgggtgcgctgctcgatcttgctgaccaccagcccgccgctgacgttcggtacccagtaggcaaatttgacggcttgctgactcattggcttgtcctcgcgactgaagtgttcgaataacagtgtccggggaacagagcagcaaccgtgccagccggaaaactccggggccgcgcgccccctatagccgctgccgcaggctgcgcaaaggcccgaagggccttcctgcgccggcaaaggcagcgtctgctgcgcagccgatcgcagcctgcggcagcggctacaaatagaccgtcgaaccctgcgtgaacaggtcgatttgttgatgcgctgttggctgggcaacagttgacgaccagccaccctgcgcccggcccgctgattacggccacccgcctcccggcacggaccgtgcaatcccgtccgcagaaaccacgttttcactgccgactcaaggagctgtgcccatgaccgaacaccaggtaatcaacccattgtccgtaggcgtcgactacgaagccctggccgggcgcttccgcccgatcttcaagcggatcgccgccggcgcggtggagcgcgagcaatcgcgcagcctgccgtacgaggcgatcgggtggctcaaggaagccggttttggcgcggtgcgggtgccggtggaatacggtggcggtggcgcctccctgccgcagttgttccagttgctgattgaactggccgaggccgactccaacgtgccgcaagccttgcgcgggcatttcgcctttgccgaggaccgcctcaacgctgccccagggccggcacgggacctgtggttcaagcgtttcgtcgagggcgacatcgtcggctgcgcctggaccgagatcggtagcgtggccattggcgaggtgatcacccaggtctcgccggccggcgacaagtggcggctcaacggcgagaagttctacagcaccgggagcattttctccgactggatcgatgtctacgcccgacgcagcgacaccggtggcgacgtgatcgccgcggtgcgcacccgccaaccgggcatcgtgcagagcgacgactgggacggcttcggccagcgcaccacgggcagcggcacctcacgctttgtcgatgccgaagtggaggccgagaaccttatcgacttcgccacccgcttcaagtaccagaccgcgctctaccagttggtgctgctggcgacactggcgggcgtcggccgcgccgcggtgcgcgatgtagcccacgaggtgcgcgcgcgcaagcgcatctacagccacggcaacgcgcgccgggtcagcgaggacgcccaggtgcagcaggtggtcggggaaatctcggccctggtgtacgccgccgaggccagcgcggtgcgcgcggcggaaccggcgcagcaggcctacctggcgcgttttgccggtaatgacgaggcggagcgggcagccaatgtcgcggcggaaatccagtcggccacggcccaggtggtggtcagcgagctgatccagcgcgccaccagcgaactgttcaatgccctgggcgcttcggatatccgccagggcaaggccctcgaccgtcactggcgcaacgcccgtaccctgtcgtcacacaacccggtgatctacaaggcacgcatcgtcggcgattggctgatcaatggcagcgagccgccgttcgtgtggcagatcggcaacgggccggagctcaaacaagcctgaggggctgggaagactgagggatctttcgcgagcaagttcgctcctacaggagtcaggccattctgtaggcgcgagcttgctcgcgataaggctctggcacggtcgcaggcatccgagcttacgggtaagatagcgacctttcgcgcagctcttctgcgccccgccgaaataagtcgatcccatgcctttcgaactcagcgtagatttgaccaccctcgccattctggccctcgtcgccttcattgccggctttatcgatgccattgccggcggtggcggcctgctcaccaccccggcgctgcttaccgccggcctgccgccgcacctggtactgggcaccaacaagctcagttcgacctttggctcggccaccgccagcttcaccttctaccggcgcaagctgttccacccgcggcaatggacccacgccatcgtcggcaccctggtgggcgcgttgaccggcgcggtggtggcccattacctgccggccgagtggctgaacaagatgctgccggtgatcgtcttcgcctgcggcgtgtacctgctgttcggcggcacgccgaaagcgccgctggacagcgaagcgccgatcaagaaaaagtggcaatcgacccagggcttcagcctcggtttctacgacggcgtggccggccccggcacgggcgccttctggaccgtcagcagcctgctgctctaccccatagacctggtcaaggccagcggcgtggcgcgcagcatgaacttcgtcagcaacgcggcggcgctgtcgatcttcattttctccggccaggtggattgggccatcggcctgagcatgggcctgtcgctgatggtcggcgccttcttcggcgcccgtaccgcgatcagcggcggcgcgaaattcattcgtccggtgttcatcaccgtggtcctgggcctgaccgtgcgcctggcctggcaacactggttcagcgccgtttgacccactgaaacgacagcgggcgaacccaatggattcgcccgcgctgtttgtttccagcttcttccagcttgcttccagccggggctcaacccggcaatacaggctccgccaagcccaggcgctgcgccacatacagatcgatcaggtaacgggcaatcgagcgtgacgccggcagcggcggcaacgcatgcacgttgaaccactgcgcatcctcgatctcgtcttcctgcggcacgatctcgccgccggcgtactcggcatgaaaacccagcatcatcgaatgcgggaacggccagcactggctgccgatgtactggatattcttgacctcgatctgcacctcttcgcgcacctcgcgcaccaggcaatcctcggccgattcgcccggttcggcgaacccggccagggtgctgtagaccccggggacgaaacgcggcgagcgcgccagcaacacctcgtcgccgcgggtgatcagcacgatcatgctcggcgaaatccgcgggtagctgcgcaggtcgcagggctcgcagtacatcgcccgctcgcgcatcacctgggtcatgggctggccgcagttgccgcagaagcggtgctcgcgggcccaggtgccgatctgcgcggcatagcccaggaccttgtacagggtgtgatcgccgtcgagcatgaacgcccgcaggcctttccagttgcagcccggcacctcggaaacgctcttgagctccagcaggtagaccggctcgccatccaggtggccgatgccgtgctcggcgaggatcggcaggtcctggcgcttgagccattcgcgggggaacagcgcgccgttgtcgtcgaacagaaagccctgcgggccgcgggccacggcccagccgccgggaaggtcgatatccagtactgcggtggtccagcgtgaagtcatgttcaatcagtccagaaattcaggtttctgtttgctcatatgggcggccatggccacgcgcaggtcggtggattgcagcatggcggcgttccaggtagcgatgtattccaggccatcgtcgatgcgatggtcgcgcatgtagccgatcatttccttggtaccgctgacggcgatcggcgacttgctggcgatttcccaggcaatgctcatcacgccgtcgagcaggctttcgctgtcggcgtaggtgcgattgaccaggccgatgctgcgcgcctcctcggcgccgaaggtgcgcccagtgtaagccagttcgcgcagcatgccgtcaccgatgatacgcggcaaacgttgcaacgtgccgacatcggcggccatgccgatatcgatttccttgatcgagaattgcgcgtccgcggcggcgtagcgcatgtcgcaggcggcgatcaggtcgatggcgccgcccaggcagtaaccctggatcgccgccagcaccggcttgcggcagttgtcgacggcattgaaggatgcctgcagctgcaggatcttgcgccgcagcaggcgcgcattgcgcccgacgtccttgcccagttcgttggccacgccggccagcatcatcaggtcgatgcccgaggaaaagtgtttgccggcgccgctcagcaccaccacgcggaccgcgtcggtgtcgtcgatccagcggaagatctcgatgatctcgctccagaacgcggcgttcatcgagttgatcttttccggccggttgatctgcacatgggcgatgttgtcagcaagttcgacgcgaaaggcttgatattcggacatggcagcaatccttagcggagaaaaaatgaggcccgaactatagcaagggcccatgccgtgcagtaaggcagcgcatcggccaaaaccgggactgctctctcctgcaaaagcaatcaggggattttgtgggcccagaacgccgcggtttcgtaaggcacgctgaccacgcatttatcccgcagctccggctcttcggcgatcaaggcggcgatctgccggtcgacctccgccctctgtgcatccggcaaggccgcaataaagctggtggagcgcacccgatcgaaaatcacgttctgcggcgcgccgctgtggctgttgcgaaagtgctgctcctgcaaaggcgtgaaactcggatggggaaaggcctggcgccaggccccagtgtaatagcgcggggtgtcaccttgcagggcgttgacgatccggtccaggcgctgcacccacggcacccgcgcatcgcgcaggttccacaccaggcccaggcggccgcccggcttgagcacccgggcgatttcgctcaacgcctcatggctggcgaaccagtgaaaggcctgggcgcagaccacggcgtccaccgattcgtcggccagcgcaatagaagtggcggtgccgcccagggcttcggcctggggatagcgggcggcgagcctggcgcgcatctgcgccaccggctccacggcgatcacccgtgccccggtggccagcaggcgcccggtgaacttgccggtgccggcgccgagatcgaccgccacctggccggcctgcaagcccagacaggtgcgcagccactgatccagcgccggcgggtagtccgggcggccacgcacgtaggtgtcggccgcgcccttgtagccatcggcggcagcgtgatggatcgcaggttgcgggtctttcatcggtcggctccagatcattgcccagtgctgcccagcatagccccgcccaggcgactgacggcatgaaaaatctgtcagtttgggcggcgcggccagggcgatggacctttaatgggggggaccgctatccccatggagaccgcgcgatgaacatctctgccctcgtcttcggcgccccgctgctgctcgccggcagcctgctgacgaccttgctggcggtcgccgccaactgcccggacggccaggtctgggacagcaagaaccagcgctgcgtcagccagcgcaccacccggctaccggacgccgcccgcaccgaccaggccagtggcctgctcccccatgaccgctacgaagaagccatcgccgctggcggcaagacccgaggtcagtcgcttcccacgccctgaccggtggaacggcgccatggaacgggcacgctatgctctgggagaatggattcattgctcaacccagggagcttgcacatgcctactgccaaaaccgccagccgtcgctcacgcaaggcgctgctggtgatcgacgtacagaacgacttcatccccggtggcgcgctggccgtgcccggaggcgagcagatcgtgcccttgatcaatcgcctgggcggccacttcaagcaggtggtgatcgcccaggactggcacccggccgggcatatctcgttcgcctccagccacgacggccacgcgccgaacgacatcatccaattgccctatggtccgcaggtgctctggccggaccattgcgtgcaagccagccgtggcgccgagctgcaccccaagctcaacctgccccacgcccagttgatcctgcgcaagggctgcaatccggatatcgacagttactcggccttcgtcgaggcggaccgcagcaccacgaccggcctggccggctacctgagccagcgcggcatcgacacggtgtatctggtggggctggccctggactattgcgtggcctggtcggcgctggatgcgcgggcggcggggttcaataccttcgtgatagtcgatgcctgccgggcgatcgacatggacggctcgctggacaaggccacccggcagatgcgcgcggcgggggtgaacctgatcaaggccagcgaactgcagccgaccgccttgtgctgatgcaacaccttccctaaacgccggtttgccaggcattccccgtcgccggaggtgcccggcaaggctcaggccggtgtcggcagccacaggcggaaacgcgcgccgcccagcggtgaggcttcgacggtcagggtcccgccctgggcttccagggcccggcggctgatggccaggccgaggccgaagccgccggtggcgcgatcgcggctgcggtccaggcggtaaaagggttcgaacacccgctcgcgctcgtcgtcgggaatgccgatgccatcgtcgtcgacccagatttcacagccgcgctcgctgacgtgcacccccacctggatacgcttttcgcaatagcgcgtggcgttgcgcagcaggttctggatcgcccgggcggtcagccgcgggtcgagactgaagcattccaggctgccgtgcagcagcacatcgatgacgatgtccggggattccagttcgtcgtcgacgctgccgaggatgctgtcgataaactcgtccagcgacacctcgacctgctccggcaactgcgccgggttctgcaagcggctgtaggacagcagctcgagcaccagttcgtccagctcgcgaatatgcgccaccagcccttgcaggcgctcgcgactggtcgccggcaggtcgtcggagagcgccagcgccaggccgaagtcgagccgggtcaagggcgtgcgcagctcgtgggacaccgcgttgagcaggtcgcgttgctggttcagcaggttctcgatgtcaccggccatggtgtcgaagacattggccaggctgccgatattggagctcgaggggatctgcgtgcgctcgctcaaatggcccttgccgaaacgctcggcggcgtgcttcagacgctccaggtcacgccagtgcggccgcagccagagcaagaggcaggcgagcatggtcgcgccgatcagcacgttgatgctccagtacagcaggctgacatcgatcgggtccggcggcaccaccatctgcaccgccatctgctcgtccagcggcgccaccgcgagggtgcgccagccccagtcgccgacccgcaccacgttctcgccgcgttgcaggcgttcgcgctcgtacagggtgaaatcggcatcgtcgttgcgggtcaggacaatgtgcaacggctggaactcctggtccatttccgcggccagggccggccactgctctgagggcacgccgcgaaactgtttgacgatcagggtctgcagtccccgggaataatccaggttgtaagtgacgaaacgctcgtggaagaccttcaccaccagctccggtaccaggtagatcgccgcgctgaacgagacgatggtcaccaggtacaggcgaatcaggattctcagcatcgattcagcattcccattcggaacggctgaacaggtaacccttgccccacacggtcttgatcttgcgcgcctcgccagcgtgatcgtcgaacttgcgccgcagcttggagatcgccacgtccaccgagcggtcggtgccgttgaactcgatgccccgcaagcgttgcaggatctggtcgcggctcagcacctcgccggcatgccgggccagcaccaccagcaggttgtattcgccgctggacagctccaccagctggtcgcgccagctcacggtacgctccgacaggtcgatgcacaggttgcccatgaggatccggtcgctggcggtctgcggctcgccgaggctgctgcggcgcaacagggtgcgcactcgcgccaacagtacgcgcggctcgcaaggctttgtcacataatcgtcggcgcccatttccagacccagcacctgatcatggctatcatcacgggcggtcagcatcaggatcggcagcgacgccgaatcggcccgcagcaggcggcagacctgcaggccgtccaggccgggcagcatcaggtcgagaatcaccaggtccggcggattgacccgcgcccgttcgcgcacctggtcgccgcggctgatgacattgacctgatagccgttgcgctccaggtaactggcgatcagttcggagagcgcggagtcgtcttcgaccagaaggatgttgggcatggggattgaagtctttgagtgaataaaaacacagcgacaacgttccttagaatgttccctgggaagccgtcgcccgatcagcgaggcacaaaggatatacaacctcgcgcgcacccgagcattcgtttcacactttttcacacagcacctacacagcttcacagcggtcctggcggcatgcccttagcatgccgcagtcatcattggggtatcagcatgtcgaaaaacctgtttgcgccgttctgcctgttgttgctggcagccgcgctgagcgcttgcgaccgggcctccaccgccgaagagcaggcgccgttggccaaggtccgtatcgaaaccgtcgagactcgcccgctgtcgatcagcagcgaactgagcgggcgcatcgccgcgccgcgtatcgccgaggtgcgcgcacgggtggccggggtggtgctgcagcggaccttccgcgaaggcaccgacgtcaagcagggcgacgtgctgtttcgcatcgatccggcgccgttcaaggccgacctcgacagcgccctggccagcctgcgcaaggccgaggccaacgccttccaggcccgtttgcaggagcagcgctacgcccagttgatcgaagaccaggccatcagcgcccaggaatacgacaacgcccgggccaacgcgcgccagaccgccgccgacgtagccgccaaccaggccgccgtgcagcgcgcccggctgaacctcggctacgccaccgtcaccgcgccgatttccgggcgcgtcggccgcgccctggtcaccgaaggcgcgctggtgggccagaacgagaccacgccgctggcgctgatccagcagttggacccgatccacgccgacctcacccaatcgacccgcgagctcaacgacctgcgccgcgccttccgcgccggccagctgcagcaggtcggccaggaccaggccaaggccacgctgatccaggacgacggcagcctctacccgctgccgggcaagctgctgttcgccgacctcagcgtcgacccgagcaccggccagatcatcctgcgcagcgagttccccaacccggacctcgacctgctgcccggcagcttcattcgcgtacgcctggagcaggcggtgaaccgccagggcatcagcgtgccgcagcgggccatccagcgcgacagcgccggcatcgcccaggtgctgctggtggatgccgagcagcgggtggtgcagcgtccggtgcaactgggcgccgtgcaacaggaccgctggatcgtcagcgaaggcctcaaggccggcgaccgtatcgtcgtcgagggcctgcagcacgcccgtccgggcgaaaaggtgcagatcgacgacagccctcttccccttgcccagaccactggacagtaggtaggacccctcatgccgcaattctttatcgaccgtccggtgttcgcctgggtggtcgccctgtttatcctgctggccggcgccctgtccatcccgcagttgccggtggcgcagtaccccaacgtcgccccgccgagcatcgagatctacgccgtgtatccgggcgcctcggcgcagaccgtggacgaaagcgtggtcagcctgatcgaggaggagctcaacggcgccgaccacctgctgtacttctcgtcccagagcagcctgggcagcgccaccattaccgccaccttccagccgggcaccaacccggaaatggcccaggtcgacgtgcagaaccgcctcaaggtggtcgagccgcgcctgccgcaagcggtgacccagcagggcctgcaggtggaaaaggtctcggccggcttcctgctgctgatcaccctcacctccagcgacggcaagctcgacgacaccgcgctcagcgattacctggcgcgcaacgtgatgaacgagatccgccgcctggacggggtcggcaaggcccagctgtacggcgccgagcgcgccatgcgggtgtggatcgacccgcagaagctgatcggcttcaacctgaccccggccgacgtcaacgcggcgatcgtcgcgcagaacgcccaggtctcggccggcagcatcggcgacctgccgagccactcgagccaggaaatcaccgccacggtattggtcaagggccagttgtcgaccccgcaagagttcgccgacattgtcctgcgggccaatccggacggctccaccgtgcgcatcggcgacgtcgcccgggtggaagtcggcagccaggaataccagttctccacccgcctcaacggcaagccttccaccgcggtcggcgtgcagctgtcgccgggggccaacgccctgagcaccgcgaccctgatccgggcgaagatggacgagctgtcgcgctacttcccggccggcgtggaatacaagatcccctacgacacctcgcccttcgtcaaggtctcgatcaccaaggtggtctacaccctgggcgaagccatgttgctggtgttcgcggtgatgttcctgttcctgcagaacatccgctacaccctgatcccgaccctggtggtgcccgtggcgctgatgggcaccttcgccaccatgctggcgctgggtttctcgatcaacgtgctgaccatgttcggcatggtcctggccatcggcatcctggtggacgacgccattgtggtggtggagaacgtcgaacggatcatggccagcgagggtctgtcgcccagggaggcgacgcgcaaggcgatgcaacagatcaccggcgccatcgtcggtatcaccctggtactggtggcggtgttcctgccgatggccttcatgcccggttcggtgggcgtcatctaccagcagttctcgctgtcgatggccacctcgatcctgttctcggccttcctcgccctgaccctgaccccggccctgtgcgccaccctgctcaagccgatcgccaagggcgagcaccatgaaaaaggcggcttcttcggctggttcaaccggcgcttcgaaaacctcagcgacggctaccagcgctgggtcgcctacgcgctgaaacgctgcggccgctacctgctggtgtacggcgtgctgctggtgggcctggggctgctgttcagccgcctgccctcttcgttcctgccggtggaagaccagggctacaccatcaccgacatccagctgccaccgggcgcgagcaagaaccgcacgatccaggtggtggaacagatcgaggcgcacaacgccagcgaaccgggagtcggcgacagcacggtgattctcggcttcagcttctccggcagcgggcagaacgccgcgctgaccttcaccaccctcaaggactggtcgcagcgcggcagcgacgactcggcgcaatccatcgccgaccgggccaacgccgccttcagtgaaatcaaggacgcggtgtcctacgccgtgctgccaccgccggtggatggcctgggcacctccagcggcttcgagttccgcctgcaggaccgcggcagcctcggccatgccgcgctgatgcaggcccgcaccgacttgctggccgccgcggaaaagagcccgatcctcgccaacgtgcgcgaaagcgccctggccgaggcgccgcaggtgcacctggaagtcgaccgcaagcaggccaatgccctgggcgtgtcctttgccgacatcggcaatgtgctgtccaccgcggtcggctccagctacatcaacgacttccccaaccaggggcggatgcagcgagtggtggtccaggccgagggcgatcgacgcagccaggtggaagacctgctgaagatcaacgtgcgcaacaacctcggcaagatggtgccgctgtcggcctttgcccaggcgcgctggacccagggcccgacccagttgacccgctacaacggctacccggccatcagcatttccggcgagccgagcacgggccacagcaccggcgaggccatggcggaaatcgagcgcctggtcagccagctgcccaccggcctgggccaggaatggaccggcctgtcgctgcaggaacgcctgtccggcagccaggcgccgctgctgctcgggctgtcgctgctgatcgtgttcctgtgcctggcggcgctgtacgagagctggtcgattccgacctcggtgctgctggtggtgcccctgggcgtgctcggcgcggtgctggcggtgaccctgcgcggcatgcccaacgacgtgttcttcaaggtcgggctgatcaccatcatcggcctgtcggcgaaaaacgcgatcctgatcatcgagttcgccaagagcctgtacgacgaaggccacgacctggtggacgccacggtgcaggccgcgcgcctgcgcctgcggccgatcgtcatgacctcgctggccttcatcctcggcgtggtgcccctggccatcgccagcggcgccagttcggccagccagcaggccatcggcaccggggtgatcggcggcatgatcaccgcgaccctggcggtggtattcgtgccggtgttcttcgtggtggtgatgaggctggtcaggcgcaacggcaaaaaagcggtgagcgtcacggcgccaggagcggccgaatagtcatgcggcggcgggtcttcagcgtatcgcgtgatcgctgaagacttatcgagcgatcgttgaaggcttatcgagtcatcgttaaagactcatcgcgagcaagcttcgctcctccacaagagccatgtaaccgcaggggccaccgcccctgcggcgacggcatgctaaggtttgcggcaaatccgccactgcgagccgccatgtcccttcttgtacgtacccaccctcgcctgaccatcggcgcccttatcggcctggccgcgggcgtcctggtgccggccgacaccctgatcagcaagattctcatcggctggaacgccggggtctggagctacctggcgctgatgtgctggctcaccgcgcggtccaaggccgacgatgtgaaacgcattgccgaggtcgaggacgaaaacgccgggctggtgttgttcatggtctgcatcgcggccatcgccagcctcgccgccatcaccctctcgctgtccggcagcaaggacctggaaaccggccggcgcctgctgcactacgcctttaccggcctcacggtgatcggctcctggctgctgatcggggtgatcttcagcgtgcactacgcccgcctctactacacctggagcggcaaggacccggcgctgcgttttcccgaaggcctgaccacccccaattactgggacttcctgtacttctccttcaccatcggcgtggcggtgcagacttccgacgtcggcgtcgccacccgcgagttgcgcaagatcgtcctggcccagtcgctgatcggctttctgttcaacaccgcgatcctcgggttttccatcaacatcgccgccgggctgttcggttgaagccgcacaaatcttctagacccgccctggccggcgggcgctaactgtcacgctcgcccttgccacggacacttcatgaacgcgcacaactggatcgatctggcccaggacgccgacaccggcatcgaaaccctgcgcgcccatttcaccggccatgcctacgaccctcactggcatgacagctacctggtgggcgtgaccgaagaaggcgtgcagcaattccactgccggcgcgaacgttttcacagcaccccgggcaaggtgttcctgctcgagcccggggaaatccacgacggcgatgcccccaccgaaagcggcttcacctaccgcatgctgtacctcgacccgcactggctggagcgtgaactgagcgcgctgttcgaagaggcgccggccgacagccagctgagtttcgccaccaccctggccagcgaccagcgcctggccctggccaccagcaatgccttccagagcctgcaccacggcgagctgcgcatcgtccgccagagcgccatggaccagttgctcgaccagctcaccggccacctgcactggcgcaagcgctaccacgcagacccgcgcctgcccctggtggcgcacaaggcccgcgactacctgcatgcccacgcccagcaggacatcagcctggacgagctgggcgcggtctgcggcgtcgatcgcttccgcctgacccgcgccttcaaggccgcctatggcctgccgccccacgcttacctggtgcagttgcgcctggccaaggcgcggcgcctgctggcccgcggcgaacagccggccgaggtggccatggccctggggttcgccgaccagagccatatgggccgctggttcgtccgcgcctatggcctgaccccggcggcctaccgcaagcgctgctcaaaccttccagacgcctgaacccgcaccggcgaagatcgcctccctcgatcttcactggagcctgcccacgatgttctccttcttgccttccctgcctagcctgctgcccttcctgctgttcgccttcgtggcctcgatcaccccggggccgaccaatatcctggtgctgagcaacagcgcccgctacggcttcaaggccgcgctgccgatcgttctcggcgcctgcctggccgccgccggcatagtcgtgctggtgggcagcggcctcggccgcacgctgatggaagtgcccggcctgccgagcgccatgcgctgggccggggtgatctggttgagctacctggcctggcagatcttccgtgccccggccgcgtccctcgacccacaagcggacacccaccaccggcgcctgggcctgctcggcgccgccagcctgcaactggtcaacccgaaaacctggatgatggccctggccgtgatcagcgtgttcgccggcaacggcagcgaacgccaggaccaggtgttgtacctgtcgctggtgtttttcctggtgtccctgccctgcctcggcgcctgggcgctgctcggcgccggctccgcccggctgctgcgttcacccctggccctgcagcgtttcaaccagggcatggcgctgttgttgctggtctcggcctgggcgagcctgtgggcctgaggtcagcgggtcgccccagtgcaagagccggtcgcctcagggcgcgttcataacggtctgcgttacctaaagtggtgggcacggcgcaacaagacgccgcctctgacaataacgacctgccggacgagcccctctgatgaaaaccctgttcaagccttgtctcccgctgctctgcggcgccctgctcctgagtgccaatgcctgggccagcgagcccgcctcctgcaagaccgtgcgcatgggcgtggtcaactggaccgacgtcatcgccaccagcggcatggccgacgtgctgctgaccggcctcggttacgacagcaaacagaccagcgccgtgcagcagatcatcttcgccggcatccgcgacaagcgcctggacatcttcctcggctactggcaaccggcgatggacaagaacatcgcgccgtttctcgaggccgggcaggtcaaggttctggaccagccgagcctggccgacgcccaggccaccctcgccgtgccggattatgtcgccgccgcgggcctgaagaccttcgccgacatcgcccgtttcaaggagccactgggcggcaagatttatggcatcgagcccggcagcggcgccaacaccaccctcaagacgctgatcgacagcgaccgcttcggcctcaagggtttcaagctggtggagtccggcgaggccggcatgctcgcggcggtgcaacgggcgatcaaccgcaaggagttcgtggtcttcgtcggctggaccccgcacccgatgaacatcaacatgcgaatcgcctacctgaccggcagcgaagacgtctacggccccaacgaaggcgcggccagggtgtctaccgtcaccgcgccggactacgccgagcgttgccccaacgtccagcgcctgctgcagaacctgaccttcagcgcggcccaggaaagccagctgatggtgccgatcatggaacgcaggacgccccaggacgtggcgcggcaatggctgcgcgagcaccccgaagacctgcaacgctggctggccggggtcagcagcttcgaaggcaaggacggcgtggcggcggtgcaggccagcctgaaatagtggcgccctgccggtcttatcgcgagccagatcgcgatggccctcttccagacaacggacactcccgcccatgcgccactacccgctctctcgccaactcgccgccttcgtcgagcgcaccctgagcttcaccagccccgacaacagcccccagagcctgcgcgacaactacagccgcatgtgccaggcattcaccccgccccgtcccgagggcctgcgggtcagcgaattgcaactggccggggtgccggcgcgcgcctattaccccgcccgcccgatgcccgcggacggctggccttgcctgttgtacctgcacggtggcggctgggtggtgggcgacctggattcccacgacttcatcaccgcctacctggcggcgcagttgcaggtgctggtgattgccgtggattaccgcctggcgcccgaacatccgtttcccgccgccttcgacgattgcctggcggcctggcgcgccttgcaggccggcgccagctcctttgccctggatgcccggcggcagctggtgatcggcgacagcgccggcggcaacctcgccgcggccttgtgcctggccctgcgcgatgccggcgaacaactgcccgccgcccaggtgctgctgtaccccggcctcggtggcgccgccgacctgccctcgcgcagccagtgcgccgacgcgccgctgctcggcagcaatgacctggacacctaccaggccctgtacctgcccggcccggaacggcattcgccttatgcccggcccttgctggccacggacttgcgcggcctgcccgccgcctttatcgccctggcgcagttcgacccgctgcgcgacgacggcgcgctgtatcaccagcggctgctggccgccgacggcgacagtcagctgtacccgggcctcggcctggtgcacggctgcctgcgcgcccggggcctggcgccggaggtggatgcgctgtatggcgccttgctcgactatctgcggacctgcctcgaatagtctttcttcagcgaaaccgcgtggtccttttcgcgggctagccggatcgccgcccgctcgctcctacagacaactcgcaccccgtaggaacgaggcttgcacgggatcacctgcaacgcaggtgccagacgctttcctctgccaaagaggaccaccagcggtcgggcgcatgacatttttttcatgccgctggcgctgatcgcgcttgacggcgaaagcgctttgctgtttcctgaaaccggtttcagcgatgtggcagaacgtcgcacctggagcgcatacaccccataacaagaacgctaaagacaggtcgccgcccgtgaacagtttttccgccgcccagcgcagccgcgtcaccatgctcgatgtcgccgaacgcgccggggtctccaaggccagcgtgtcgcgctttatcggcgaagaccgcgccctgctctccgatgccatcgccctgcgcatcgaacaggcaatagccgagctgggctaccgcccgaaccagatggcccgtggcctgaaacgcgggcgcacgcgcctgatcggcatgctggtggccgatatccgcaacccctattcgattgccgtgatgcatggcgtggaaaccgcctgccgccagcacggctacagcctggtggtgtgcaacaccgaccgcgacgacgagcaggagcgccagcacctggccaacctgcgctcgtacaacatcgaaggcctgatcgtgaacaccctgggccatcatctggacgaactgcgcgaactgcaccgggaaatgcccatggtcctggtggaccgcaaggtcgagcagctgcacagcgacctggtcggcctggacaacccgcaagccgtgcgcagcgccatcgaacacctgcaagaacgcggctaccgcgacctgctgctggtcagcgaaccccatgacggcaccagctcgcggatcgagcgcagcaacagtttcaaggcgcagatcgagcaacgcccggcgttgcaaggcgcggcggtggaaaccggcgccgcgctgaaccagcagctgcaacagttcctcgccgcccccggccccggtccgaaagcgctgttctgcgccaacggcgtcgccgccctggccgcgacccgggccttgcgcgagctgggctgcccgttgttcgacgagatcggcctgatcgccctcgacgacctcgactggtacccgctggtgggcagcggcatcaccgccctcgcccaacccaccgaacgcatcggcgccagcgccttcgagtgcctgctcaagcgtttgcgcggcgatgtcgagccgctgcgggtgctggatttcccggccgagctgatcgtccgcggttccacccgtcaacgaggcgactcgggaatcgcgctgccggtgtagccgctgccgaggctgcgatcggcgacgccgttgccgcaaaacctgcgtccgcgatctgcctggaaaacgcttcggccgggttaccacggctacgccgccgatcgcagcctgcggcagcggctacagggaacggcgcaggcatgaagatagggaaatgagcttctttttgggggctttttttgagcagaaaatgaaaccggtttcagaggtcatgaccatgaataaatcgcctgtctccatcagcctgtccagctacggcgccgaccgcgtccgtgagcagggccagggcagtttcatcgaggtgctggccgccgccggcgcgtcgcgcatcgaatggcgcgaagagctgctgaccgtcgaagacccgtcccagctggcccgggccacccgcgagcggcaactggaaagcgtgttttcttcgccgctggaactctgggtggtcgggcgttcccgggccaacccgctgctggaacaggcgctgcaacgggccgaggccttcggcgcgaaaagcctcaaggtgtccctggggtatttcaccgagcacaacgacctgccccagttggccctgctgctggcgcagtccccggtgcaattgctggtggaaaacgaccagaccctgcacggcgggcgcatcgaacccttccagcgcttcttcgccgaggtcgagcgccaccgcctgccggtgcagatgaccttcgacatcggcaactggcagtggcaggaccagtccgcctccgtcgccgcgcgcctgctcggccggcatgtcggctacgtgcactgcaaggccgtggcccggcgcgccgacggcaagctggtagcgataccgccgggcacggccgacctgcacctgtgggaacaattgctgcggcacatgactcaaggcgtgacccgggccgtggaatacccgctgcaaggcgaagacctggtgcagctgacccgcgaacacgtcgccaccctcgcccgcctcggccagtcccgcctggagcacgcccatgtctgagttcgatatcctgtcgttcggtgaaaccatggcgatgttcgtcgccgaacagagcggcgacctggcccgggtcggccacttccacaaacgcatcgccggcgccgacagcaacgtggccatcggcctgtcgcgcctgggcttcaaggtcggttggctgagccgggtcggcgccgactccctggggcgcttcgtcgtcgacagcctgcaggccgaaggcgtggactgccgctacgtcgccaccgaccggcaacaccccaccggtttccagctcaagtccctggaagaacacggcgacgatccgcgtgtggagtacttccgccgcggttcggcggccagccacctgagcgtcgccgacatcgccccccagctgctgcgcgcccggcacctgcacgccaccggcattcccccggcgctctcggcctcggcccgggagctgtcccacagcctgatgagcaagatgcgcgcggccggccgcagcgtgtccttcgacccgaacctgcggcccggcctgtggggcagcgaacaactgatgatcgacgaaatcaaccgcctggccgtgctcgcccattgggtgctgccgggcttgagcgaaggccgcctgctgaccggttatgaagacccggccgatatcgccgcgttttacctggaccagggcgtcgaggtcgtggcgatcaagctcggtgcccatggcgcctactaccgcaccccgttgcacgaaggtttcgtcgaagccgtgccggtgacccaggtggtcgacaccgtgggcgccggcgacggtttcgccgtcggcctgatcagcgccctgctggagaaccacagcgtcgccgaagcggtgcagcgcgccaactggatcggcagccgcgcggtgcagagccgcggcgacatggaaggtttgccgagccgcgatgaattaccgacggtcgctgcgcgaccgatcgcgagcaagctcgctcctacaggggctgcgcaagttctgtaggagcgagcttgctcgcgataaaaccgtgaaaacaacaccgcctgattgaaccaacgcgttacctgttgcgacaaaaacaacaagctcaggagcacccttatgcaaacgctgaaactcgccacccgccgctggtggtacatcatgcccatcgtgttcatcacctacagcctggcgtacctggaccgcgccaactacgggttcgccgccgcctccgggatggccgccgacctgatgatcaccccgggcctgtcatccctgctcggcgccttgttcttcctcggttactttttcttccaggtaccgggggcgatctacgcgcaaaaacacagcgtcaaaaagctgatcttcgtcagcctgatcctctggggcggcctggccaccctcaccggcgtggtgtccaacgcctactggctgatcgccatccgtttcatgctcggggtggtcgaagccgcggtgatgccggcgatgctggtctacctgtgccattggttcacccgcgccgaacgctcgcgggccaacaccttcctgatcctcggcaacccggtgaccatgctctggatgtcggtggtctcggggtacctggtggagcatttcagctggcgctggatgttcatcatcgaaggcctgccggcggtgctctgggcctttatctggtggcgcctggccgatgaccgcccgagcgtggcgaagtggctcagcgaccaggaaaaacacgacctggaaagcgccctggccgccgaacaggtgggcatcaaggcggtgaagaactacgccgaagccttccgctcgcccaaggtgatcatcctcgccctgcagttcttctgctggagcatcggtgtctacggcttcgtcctgtggctaccgtcgatcctcaagcacggcgcgcagatggacatggtcgaggccggctggctgtcggcactgccttacctggccgcggtgatcgccatgctcggggtgtcctggggctcggaccggatccagaagcgcaagcgtttcgtctggccgccgctgctgatcgcctccttcgccttctacggctcgtacctgctgggcgccgagcatttctggtggtcctacagcctgctggtgatcgccggcgcctgcatgtacgcgccttacggtccgttcttcgccatcgtcccggagatcctcccggccaacgtcgccggcggcgccatggcgctgatcaacagcatgggcgccctgggctcgttcggcggctcctacctggtgggctacctgaacagcgccaccggctcgcccggcgcctcctacctgctgatgagcggcgcgctgctgctgtcggtgctgctgaccctctttctcaacccgggcgccagcgaccgccagcgcagcgcgctgccggtacgtcgccgcctggcgcattcctgaatcgaacaaggtgaaccccatgaaaaaacaggtcgtgctgtacaagaaactctcgccgccgctgatggcccgcctgcacgagcaggcccaagtgaccctgatcgaagacctcagcgcccagggcctggccaagctgcgcagcgccctgcccgccgcccagggcctgctcggcgccagcctgcgcctggatgcagaactgctggacctggcgccgtacctggaagcggtggccagcgtgtcggtgggcgtcgacaactacgacatcgactacctgacccgccgcgacatcctgctcagcaacaccccggatgtgctcaccgaaaccaccgccgacaccggtttcgccctgatcctggccagcgcccggcgcgtggtggagctggccaacctggtgcgcgccggccaatggaaccgcaatatcggcccgctgcatttcggcagcgacgtgcacggcaagaccctgggcatcatcggcatggggcggatcggcgaagccctggcccagcgcggtcatttcggcttcggcatgccggtgatctaccacagcaacagcccgaagccggcggtggagcagcgtttcggcgcccgctactgcagcctcccggaactgctgcaacaggccgacttcatctgcctgaccctgccgctgacggagcacacccagggtctgatcggccgcgaagagttcgccctgatgcgcccggaaagcatcttcatcaatatttcccggggcaaggtggtggacgaacaggcgctgatcgaagccttgcagcaacggcggattcgcgcggccggactggatgtgttcgagcgtgaacccctgggccacgactcgccgctgttgcagctgaacaatgtggtggccaccccgcacatcggctcagcgaccttcgagacccgcgaggccatggcccgctgcgcggtcgacaacctgctggcggccctggccggccagcgcccggccaacctggtcaacccccaggcctgggagcgccgcaaggctgtggtgtgacgcggtgaccgtgcgatccaccctgtagccgctgccgcaggctgcgacaggtccgcaggacctcggcgtcctgaagatcgccacgaccgttccggtcgatcgcagcctacggcagcggctacagagacagcggcgtttcgacgatcgcagcctgcggcagcggctacagggatcgcgggattatgttcagcggcgtttggaagatcggccttcgagcaggtcctgggtgcaacgcacgatccgctggcaggcgtccgccagacgctgttgatccaccaccaggccgatacggatatgccccgccgcgctggggccgaaggcctcgccggcgagcaccgagacgccgtgcccttccagcagcagctcggcgaattgctgcgcgcccaggccggtttcccgcacatcgaccatgacgaacatgccgccatcgggcttgaccggcttcaaccccgggcattggctcagttgcgcgcacaccaggtcgcggcgctggcgatattcctcgcgcatctgttccagttccggcaggtcggcgtccagcgccaccaccgcggcgttctgcacaaagtccggcaacccgtacaacatgcacagcgccagatggctcaagtgcccggccagggcctggggcgccaccacccagccgacccgccagccggtcatggcatgggacttggacaggctgttgatggtcgccgtgcgttcggccatgcccggcaggctaccggggctgatgtgttcgccgtcgaacagcaggtcgctgtagacctcgtcggagatcagccacaggtcatgctcgacgcacaggcgcgccagggcctgccaggtttcccgggacaggctggcgccggagggattgttcgggctgttgagcatcagcgcgcgggtcttgggcgtgatgcgcgcggcgaccgcggagggctcgacgcgaaaaccgttctccgggcgcaccggaatcggcagcaccttggccccgcaggcaccgaacaccccttcgtaggtgacgtacatcggctcggccaccagcacctcgtcgccggggtcgagcaggcactgggccacggaaaacaccgcgcactgcgcccccggcagcaccaccacgtgctcggcgtccaccgcctggccgctgcgggaggcatgccggtgggcgatgcgggtgcgcagcgaacgattgccgcgcacctccgaatagtgagtgtcgcccgccagcaggctatcgatggcggcctggacgatcggccgcggggtgtcgaaatccgggtcgccgatggtcagcagcagcacatcgacgccctcctcgcgcagctccagggcacggtagtgaatctgccaggccgcggcaccttcgccggcgatccgttgggtcaaggctgaatagcgcatctcgctctccttgggcacgcattccaacaaccctaactcaaatcacaaagcgcgccaccatcgcattcaaatccaccgccaggcgcgacagctcatggctggcggcgctggtctggttggccccggcggccgactgggtggccaggtcgcggatattcaccaggttgcgatcgacctcgcgggacacctgggcctgctcttccgaggcgctggcgatcaccaggttgcgctcgttgatcaggttgatcgattcggcgatctgctccagggccacgccggcggcgcgggccatttccagggtgctctgggtacgctggttgctttgctgcatcgactgcaccgcctcgccggtgccgttctggatgccggcgaccatcttttcgatttcctgggtcgattgcgcggtgcgatgggccagcgcccgcacctcgtcggccaccaccgcgaagccgcgcccggcctcgccggcgcgggccgcctcgatggccgcgttgagggccagcaggttggtctgctcggcgatggcgcggatcacgtcgagcaccttgccgatgtcgcggccctgggtggccaggccttcgatcatcaccgaagtgttctgcacgtcgtgggtcatggtctggatcgcgtcgacggtttccaccacccggtcgcggccttcgcgggcggcctgggtcgactggtgcgaggcttcggaggtcgacacggcattgcgcgccacctcttccacggcggcggtcatttcgttgacggcggtggccgcctgttcgatttcatcgttctgctgctgcaagccacgggaggcttcctcggtgaccgcgctgagttcttccgaggccgaggccagctgggtggccgagccggagatctgctcgatggtcttgcgcaggttgccctgcatctcgttcagcgccaccagcagacgggccggctcgtccttgccgtcgacctcgatggcctgggtcaggttgcccgcggcgatggtctgcgcggccagcagcgcgcggttcaacggggtgacgatgctgcgggtcagcagcagggccagcaccaccgtaagcagggccgcgaccaccgccacggcgatgatgccggtgatggcgccgcggtaatgctcaccggccatatccgaggcctgggtggccccggcgttgttgatcgccaccagcttgttcaactgctcgcccatctggtcggtgccgtccttgatccgcgtattgatcagggtgcgcagctcctcgagcttgttctgtcgcgacagctccagcatgtcgttctgcgcttgcaggtacttgtccagggtggccgcgaaggtcttgtacagggccacttcctcttcccccgccggcaaggcggcgtagctggcctgggcctgcttgagcttatccaccagcacgccgatgcgcgtctgcgcttcctgcaggccggccggctcgcggttgaccagtacccggaacgagagaatccgcaggcgcagcacgttttcggtgacgttgccgaggaaccctacgctgggcagctggttgctttccatttccagggaggcctgtcggatgatcgacatgcggttgacggcgaacacacccagcgcgatgaccagcaacgcgatgaacgcaaaaccgaggaaagctcgaggcgcgatattcatattacgtagggacataggatgactctcgggaattgaggactgcgagcatccatgcactgaaccctgtcaccagcggcggctggcggcctgacaggtgggcgccactgttgtagttggtctgtgggcctaatagcgatatcggcagcgctttaggttttttgcaggccccggcgaaaatatttttcgtcgcccgggagtgtttcactgctgagacagatcgcctggcaagctcgctgccagcctccatgaccaccccatgaaaagtgcaattcattcgccggaaaagccattcagtcgccgccccgtcctgcccatcatgggccccagctcgcaatggcaattcataacaacaacgactggagtggatgatgaaacccgaagacttccgtgccgagaccaaccgcccgctgaccggcgccgaatacctggccagcctgcgcgatgatcgcgaaatctacatttatggcgaccgggtcaaggacgtgacccgccacccggcgtttcgcaactccgccgcctccatggcgcgcctctacgacgccctgcacgaccccgagaccaaggacaagctgtgctgggccaccgacaccggcaacggcggctacacccacaagttcttccgctcggcgaaaagcgccgacgacctgcgccagcagcgcgacgccatcgccgagtggtcgcgcctgacctacggctggatgggccgcagcccggactacaaggccgccttcggcagcgccctgggcgccaacccggagttctatggcaagttcgcggacaacgcccgcacctggtacaagcgcatccaggaagcctgcctgtacctcaaccacgccatcgtcaacccgccgatcgaccgcgacaagccggtggaccaggtcaaggacgtgttcatctcggtggacgaggaagtcgaaggcgggatcatcgtcagcggcgccaaggtggtggccaccaactcggccctgacccactacaacttcgtcggccagggttcggcgcagctgttgggggacaacaccgacttcgccctgatgttcatcgcgccgatgaacacccgcggcatgaagctgatctgccgcccgtcctacgaactgcaggcgggcatgaccggttcgccgttcgactacccgctgtccagccgcttcgacgagaacgacgcgatcctgatcatggacaaggtgttcatcccctgggaaaacgtgctgatctaccgcgacttcgagcgctgccggcagtggttcccgcagggcggtttcggccggctgttcccgatgcagggctgcacccggctggcggtcaagctcgacttcatcaccgggctgctggtcaaggccttgcagtgcaccggttccctggagtttcgcggggtgcaggcgcaggttggcgaagtggtggcctggcgcaacctgttctggtcgctgaccgacgccatgcacggcaacgccagcgaatggctcaatggcgccttcctgcccagcgcccaggccttgcaggcctaccgggtactggcgccccaggcctacaccgacatcaagaagatcatcgagcaggtggtggccagcggcctgatctacctgccgtccggctcccgcgacctcaaggacccgatgctcaaccagtacctgagcacctattgccggggttcggcgggcatgggccacgaggagcggatcaagatcctcaagctgctgtgggatgccatcggcaccgagttcggcggccgccacgagctgtacgaaatcaactacgccggcagccaggacgaaatccgcatgcaatgcctgcgccatgcccaggccaccggctcgatgaaagccatgaccgacctggtggaccaatgcctgggcgactacaatctcgacggctggacggtgccacacctgaccaatccggacgacatcaacatgctcgaccgcatccgccagtaaccactgcctcgcttctgtaggagcgaagcttgctcgcgataagacgtgaacgatgacgcgcggcatctgcgactccacgttggcttgaggtttttcgcgagcaatcgagcgtcgagcgacggctcctgcaaataccgtggttcaatcccgaggaaaggaatctctcatgactcaacttgatcccaagcaacaagcctttcgcaacgccatggcgcacatgaccacggcggtcaacgtcatcaccagcaacggcccggccggacgctgcggcatcaccgccaccgcggtctgctcggtcaccgacagcccgcccagcctgatggtctgcgtcaaccgcaacagcgccctgaacccggtgttcaagcgcaacggccagctctgcatcaacgtgctctgcggcgaacacgaagaggtcgcccggcacttcgccggcatgaccggggtggagatggagcagcgcttcagcctgcacccctggcgcgacggccaggacgccttgccggtgctcgacggcgccctggccagcctgcagggacgcatcaccgaggtgcaggaagttggcacccactcggtgatgctggtgcagctggatgagatctgcgtgggcgaacacggcgattcgctggtgtatttcagccgtggtttccatcggttgcagcgggccgtccaggcggcttgatctgccgctcttctgatcttctgtaggagcggccggtcgacgctcgattgctcgcgatagccgcgcagcggcgatggacctgccaacgcgcgttatcgttgcaaattgatcgcgagcaagcctcgctcctacagaaaccaatatccccgccagcccccttcatcctgcatctgtaggatagcgatcccccaccaacccgacgatactcatgcccaggccctacccacgtccctggacgttccggtccttactgactccgtgacgaaaacaataagaacgtcgcacagaggaacacccccatgagccgtcatgaacatggtcacgccagcctgctgcaagccttcagctcgctgaccctggagttgcagcgcctggcgcagcacaaggacatcgaacatttccatggccatgcgctgaaccgcatcggccagttgctgcccttcgatagcgcctggtggggccgcgccgcgttgatcgacggcctgccggaagaacacagctcctacctccatcacttgccccccagctacctgccggactggcaatcgatcaagcacgtcgacgtcaccgtcggccgggtccatgcacatccgggccgggcggtgatcgtcgacatgcgcgacccggccaacggccccggcctgaactggctgggcacgacctatggcatcggcgagctgctgtgcgtggtgtatatcgacccgcagacccacctcagcgaccacctggcgctgtaccgcgcccccggcgccaaacgcttcgacgccgacgactgcctgctgctgaacaacctgatgctgcacctggtggccgcggtgtcggccaaccagatccgcaccctggtggccatgcgcgaaaccctcaccagcccgcgcaacctggcgctggcggtgtgcgaccagcgcggcaccctgcactgcgccgaacgcggcttcgtcgacctgctgctcggcgagtggccggactggagcggcccctgcctgcccgtgcccatggccgatggcggttacgaaggccggcacctgcaattcgaggcctcgccggtgggcgacctgttcctgctcgccgcccgcggccgcccgctgctgacccagctaagcccacgggaaaacgacgtggccctgggcttcggcgaaggcaagacctacaaggaaatcgcccgcgagctgggcctgtcgccgaacaccgtgcgccatcacatccgcgccatctacaacaagctcggggtcaaggacaagacccgcatcgcccatctgctgcacgccccacccgactgacgtttacctccctcgctgactgactttcgcgctgtcgttttgacggccacgggccgcttttgccctttttccagccactgccgcgtaccggcgagcgcttcgccgcacaacaactcaaagaagagaggttacgcccatgaccagaacgcttgcgcaccacaccgccctggccgtcaccggcgccctgctgaacctggacgccagcgccgccgacctcaacgcccgcgatttcttcggcgcgccctcgggcaccagcctgggcgtgctgtacctgccggcgacccgcgccgacgacttccacggccctgccgacagcaccggcaaggccgagctgaaggtcaacgccctggcctatcgccaggtatttttcaccgacatctgcggcaccctgtgcaccccgcaattcatcgtgcctttcgccgatatcgacgcgcgcctgcccggcgccaatcgccacaccggggaaagcggcttcggcgacccgcaggtcggcggcaccctgtttttcatcaacgacccggccagccgaacctacagcggcctgctgaccctgatcaccctgccggtgggcgaataccacggcgacaacgcggatgtctcgccgggcgccaaccgctggggcgcgaccttcgtttacaactacacccagggcgtcggtgagaagtgggtgctggaagccaacctcgaagcccagctctacgccaagaacgacgactacttcggcagcgacctgaagcaggacccgctgtaccgcctgcaagccttcgcctcctatgacttcaccagcagcacctatggcgccctgcggctgatccacgccgacggtggtgagctgcggatcaacgaccagcgcatcgacgacacacacaagcgctacacccaggtcggcttcgaggtcggccactggctggaccagcagaaccagctgatgttcggcctctcgcaaaacgtcgccacccgtaacggctaccacggcaccgacgccttgctgcgcctggtccacgtgttctgaagcgtttttccggagctacccaccatgaccacccccatgatcgacaagagccaggcgctcaccggcgagcagccgcacaccacgtcatccctggctttgctggcggccatcgtgctgttcgccgccatcaccccgaccatcctcatgaccgccccggcggtggccgcacaactggccagccaatggcaactgagcccgtcacagatcggcgacctgttctccactgaactgggggccatgagcctggccaccctgcccgccttctggtggctcaagcgcgtcgactggcgccgcgcggcgctactggccggggcgctgtttatcgtcgccaacctgctgtcgatctgggcccagggttatggcgcgctgctggccctgcgtttctgcagtgccctggccggcggctcgctgatgatcatctgcctgtccagcgccgcctccaccgccaaccccagccggacctacggcctgtgggtcatgggccaactggtggtcggagcaatcggcctgagcattctgccgcggctgttcgagcattacggcctggcggcctgctacctgctgctggcgctgctgatgaccctgtgcctgcccctggcgcgctactttccccagggcgcgccgcccccggaaaaaaccgcggggcaggcagccaccgcgccgaagtggcaggccctatgcggcattctcggcatcctcagcttctatatcagcctcagcggggtctggacctttatcggttcgatcagcgccaaggccggcatttccgcgcaagccagcggcgagttgctggccgtcgccacggtcatgggcatcgtcggcgccggctgcgcctcgctgatcggcaatcgcctgccgcgcctgctgttgctgctgttcggctacagcctgatggccggctcggtgctgttgctgctgggcgcgccgcccctggcgcgcttcgccctcgccgccctggtcttcaagttcacctggaccttcatcctgccgctgatcctcgcctgcctggccgacctcgaccgctccggcaagctgatgaacgcctccaacctggtgatcggcggcggcctggccatcggccccgcgctggccgggcggctgatcgaaagcaccggcggcttccagcccctgctgatcggcggggccggcctgaccctgctgtcgctggcgctgatcctcggctgccggcgcggcacctgaacgcctgaacccctgcccccctgtagccgctgccgaaggctgcgatcggcccgcagggccgttgcggtttccagatcgctgaaggccttcggccttatcgcagcctccggcagcggctacaaattttcgccccctagatggatatgcccatgacccgtaaaaccgcgtttttcttcgatgaactcagcctctggcacagcgccgggccacatgcgctgacgctgccggtgggcggctgggtgcaaccgcccgccgcggccgggcacgccgaatcgccggaaaccaagcgccgcctgaaaagcctgctggacgtctccggcctgacccgccacctgcaggtgcgcagcgccacggccgccactgatgaggacctgctgcgggtgcacagcgccgagtacctgcaacgcttcagggccctgagcgaggccggtggcggcgaactcggcccgcaagcgccgattggcccgggcagctacgaaatcgcccggctctccgccggcctggccatcgccgcggtggacgtggtgctcggcggcgaagccgacaacgcctactcgctgtcgcgtccgccggggcaccattgcctggccgacggcgccatgggcttctgcttcctggccaatatcgccatcgccatcgaggcggccaaggccaggcgcggcctgggcaaggttgcggtgatcgactgggacgtgcaccacggcaatggcacccagtcgatcttcgaggaacgcggcgacgtgctgaccctttccctgcaccaggacggctgcttcccgcccggctacagcggcgaacaggaccgcggccgcggcgccgggctgggggccaacatcaatatcccgctgctgcccggcagcggccacgacgcctacctgcatgccctgcaacgcatcgtgatcccggccctggagcgcttcgaaccggagctgatcatcgttgcctgcggctacgacgccaacgcggtcgacccgctggcgcggatgctgctgcacagcgactcgttccgcgccatgacccgccaggtgcgcgaagccgccgagcgcctgtgccagggccgcctggtgctggtgcatgaaggcggttattccgaggcctatgtgcccttctgcgggctggcgacggtcgaggagctggccggcatcaggaccgcggtgaccgacccgatgctggagttcgtgcagctgcaacagccgaacccggggttccaggcctttcaacgccagttgatcgatgatctggcgcagaccttcttcaacgactgacccgtacctcaaccaccttgtagccgctgccgcaggctgcgatcgaccggaacgggcgctgcgatctcccgaccgcaggaggtccttcggacctatcgcggcctgcggcagcggctacagggttttgcggacttcgctcggggtctggccgtaatgggccttgaacgcccgggcgaagtgggcctggctggtgaagccatggcggtaggcgatttcgccgatatccaggccggctccccgtgggctgctcagcaggtcatgggcctgttgcaggcgtttttccaggataaatcggctgggctggctgtcttccagggcgaacaggcggctcaggtgccgcggggaaatgccggtctgcgcggccacccgttcgcagctcaagccagggtcggccagctgttcgctgatgcactgcttggccgccagcagataggacgcgctcagggcattgatccgccgctctcccgcctgcccggcgatcaggctggccaacagctccagcgcctggttctgataactctcggcgtcctcgctcagcggctgctggaaaaagcctccggtgcgctcgcccagggtgcgcagcaacaggcgctgcacgccgctttgcccgccgatcttcagcggacggtcgaaacgcttgaggcaacgctcggcgaacagtgcctggggaatgtcgtaaatgaactggcgcatcggcccggagaacccgaacagatagggtttgtcggtgcggtagacgatcagctcgcccggttcgagcaactggcaggcgccatcctgatagaagaacgagccgctgccggtgacgaaggacacgaacaccgactccttgggcaccgcgcggatcatcgagttgtcacgctcgaccacatgctcgttgccctcgatccgcgccaggcgcatgccctccagctgcaggttgtcctggctggcggcaaaaccgctttcacaaaaggaagtgcatttgaggccgaccagggtggaggcgttgtagtcctcccagaaggccagccgctggtccagggcgatgctctgggtgcaggcatgccgggtttcgagcaaggcgcatggagacatttttattcttctcatgggctaggaagcattcccggtcggcaaggcagtgaccggacaccaaggccgcggcagatggcggccgcggcgattcattaacatatgaagcttatgccctgtcaacgtgaaacgcagtgggcacaagtcgattaccagggtaaacggcgtccctgaagcctgtaggaaaagtctcgtccgatccagtcaacaatcccgtccgattggataaaaccccgcccgcgcgccgcgcctaaagtcgcctcgactcccacaacgaatagaggccgaccatgcccgaagccgcccgccgtgaattctggaaagacctgcaaccgatcgccaattgcttcaagccggacgccaagcccgaggtctatatacccgacgccgccagcgacgacctgaagctgtatgtgcctttcaccgaaaccgtgtcctcgcggccgctgtggatctcgccgagcgagaaccgctggtgcgacatcctcatggccagcagcgccggcctggtgaaccggcattaccacccccacgaagtgttcgcctacaccctgtccggcaagtggggctacctggagcacgactggaccgccaccgccggcgacttcgtctacgagaccccgggcgaaggccacaccctggtggcctacgagcacgagcaaccgatgcgcgcgtttttcatcgtcaagggcccgctgatctggctcgacgaacagggcgagccggacggttacttcgacgtgcactcctacatcgccctgtgccgcgcgcactacgaaaagatcggcctcggcgcggcctatatcgacacgctgtttcgctgaagtcgcgacttcacctgtccctcccgcggagaacgaccatggcttacaacaacaataaagccggttacgagaacatcctgctgggcgtgctgttcctgacgttcggcttcgtctttttcgatcgcctggccctgtccttcctgttccccttcatggccgacgagctgcaactgagcaacagccacctgggcatgctgtcgtcggtcctggccctggcctgggcggtgtccggcgcgctggtcggggcctggtcggaccggcgtggcaagcgcaagccgctgctgatcgtcgcggtgatcctgttttccctgtgctcggcgctgtcggggctggtcaccggttttctcagcctgctgctgttccgcggcatcatgggcctggccgaagggccgatcctgccgctctcgcaatcgctgatggtggaggcctcctcgccccatcgccggggcctgaacatgggcctgctgcaaggctcggcggccgggctgctgggcgcggtgatcggcccgccggtgctgatcgccctggccgaagcctacggctggcgccatgcctttatcgtctcgctgatccccgggctgctgatcgccctgctgatctggcgctacgtgcgcaacgatgcgccgccggcaccgatcccggacaacgctcctgctgctccggtcaatcgcctggccctgctgaaaagccgcaacatcgtgctctgcaccctgatcagctgcgtgttcctcacctggttcgtgatcctcatctccttcaccccgaccttcctggtcaaggtccgcggctacagcccggcgagcatgggcacggtgatgagttgcctgggcggcgcctgggtgctgtggggcttcggcgtggcggcgatttccgaccgtttcggccgccgtccgaccctggtgctgttctcgctgatcgccgcctgctgcccgatcgccctgctctacgccaacagcccgctgctgatgggcgtgctgatgctgctgacctacaccggcctgggctgcttcaccctgttcatggcgaccatcccggcggaaaccgtgccccgtgaggtcatggccacggccctgggcatgatcatgggcatcggcgagctggtgggcggcttcgtctcgccgaccatcgccggctttgccgccgaccgtttcggcctgtccatcgtcatgtggatctcctgcggcggcgccctgctggcggcgctgctggcgctgttcctcaaggaaaccgcgccggcggtcctggcgcgcgggcgccgcgccgaaccttccccctctcctgtcctgcaaggaaaccagccatgaaagcattgcgttggcatgccgcccgcgacctgcgcctgagcgatctgcaattgccgcagcccggcccgggcgaggtgctggtccaggtggcctactgcggtatctgcggcagcgacctgcacgaatacgccgacggcccgcactcgattccacaacaggtgccccacccgctgtccggttgccgcgcgccgctgaccctcggccacgagttctgcggccaggtcctggcggtgggcccgggcgtcgaccgggtccaggtcggcagccgggtggcggtggagccggagtaccgctgcggcgattgccagtactgccgcgcaggccagtacaacctctgccagtccatggggtttatcggcctgatgggcgacggcggtttcgccgaacaggtgctggtgccggcctacatgctgcacccgctgccggattcggtgagtttcaagcaggccgcggtgctggagccggcggcggtggcctttcacgcgctgaaccagagcagcctgctgcccggcgacagctgcgtggtgttcggcctcggtcctataggcctgctcttgatcctgctggcgcgcctgcgcggtgtggagcggatcttcgccgtggacatcagcccggaacgccggcggctggcccgcgacttcggcgcccaggaagtgctcgatggccacgccgccgacctgtcgcaacgcctgcacgaactgagcggtggcggcgtcgacaccgccttcgaggccgccggcagccagcagaccctgagcctggccctgcactcactgcgcaagggcggcgaggtagtgctggtgggcctgatgggcgaggtcagcgtcgatgccttccacctggtcaaccacgaactgcgcctgctcggcagcgtgggctatcgcaacgcctacccgccgctgatcgagctgctggccagcggccgcctggacctgacccgcgccgtgacccgctgcgtgaccctggaccaggccgtggagcatggcttcgaggcactgctgcgggacaagagccagatcaaggtgctggtcaatcccaacccatcgctggccaaggcatgacctgtagccgctgccgcaggctgcgatcgaggacgcagtcctcgccagcgcaatcggcagcaccctggtaacccgttggcgaacgctgcgcgtccgatcgcagcctgcggcagcggctacagagctgaacgactcatcacaaaaacaacaagaaacgagtaccgaccatgaaaagcactcccctgctgtgcccgctgctgtcggcggtcctgttcaccccgttgtgccacgccgcggcgccggcacccggccgcgaaggcccgctggccgggctcggcgagcaactggccggctacggcatccgaccccatgtgcagttctggagcctgtcgatgaagaatctcgacaccggtccgcgacaacacagcttcggcaacagcggcgacctgttcgtcggcgccgacttcgacctcgataccctcgccggccttacaggcgcggccgttcatttcgaggaaaccttcttcatcctcgacaccgccaccggccagccgacctcgcgcaactggcaaggcgccgccggcagctatttcgccggcgcgccgatccataacgacatcaccagcaaccagctgagcctgctgacctaccagcagacctggctcgacggccaggtcgacatgagcctggggcgcaccaacgcgcggcgctacttctatatctacaactgcgaaaccgtggtcacctgcaacgacccgatcatcgattcgtccaccggcatcctgccgccgccctacggcagctggggcggctacctgaagtaccaggcgacgccgggcttgtatgtgcatgccggggccttcgaatcgaacccggtggactacctgaaaaaacgcaagggcctggacttcagcaccgacgacgccagcggcaccagcctgctgctgggcatcggcagcaagcacgacggtgcctacagcgctcactacgaactcaacggctactacaacaccgccaagcagcacgacccgctgaccggcgccagcgagcacggcaccggtggcgccttcttcaagttccagcaaggcttctggcgggccgacggcggccagggcaccgcgccccaggcgctgctggcgttcggttcgctgtccctggcggccgacgacaagcagcccttcagccatttcgccgagatcggcctgacttacctggcgcccttcgaccgcgcccgggacaagctcaacctcaaggccagctacctgcgcctcaacgaccaccaactgcgcttccagcaacaggcgcggatcgccaacggcggcgaccccagcctgggcgaacgcaacgtctacgccatcgaggccaacggccacttcgccctgacccggcacctgtcgctcgagcccagcgtgcagtacctgatcaacccggacaacttctacaaccccgaggcccgcgagctcagcggcaacggttttgtcgtcggcctgcaagtcatgtacgacgtcggcgcggcgctggggttgtaaacctgcttttcactgccaacgaggtatctaccatgactgattctgccccgcgttcgttcgactacatcgtggtcggggccggctcggccggttgcgtgctggccaaccggctgtccgccgatccgcagctcagcgtctgcctgatcgaagccggccccagcgaccgcagcctgttgcccggcgcctatgtgcgcaccccggcgggcatcatccgcctgatcgccaacccgaagtggaactggatgcaccagttcagcgcccaggccgccagcggcgagcgcccgatcccctgcccccgcggccgactctggggcggctccagcgcgatcaacggcatgatctacatccgcggccaccgcagcgactacgatcgctgggccgcggccggcaaccagggctggagctacgacgaattgctgccgtacttcctgcgctcggagcacttcgaacccggcgcctcgccctggcacggccagggcggcgaactcaacgtcgccgcgcaacgcagcccgagcccgatcaaccaggtgttctaccaggccgcccaggaactgggctggcgctacaacccggacttcaacggcgaggaacaggaaggctacgggccctttcatgtcacccagatcaacggcgagcgttgcagcgccgcgcgggccttcctctacccggcgctatcgcggccgaacctcagcgtactgagctcgaccctgacccaccgcgtgttgctggagggcaatcgcgcctgtggcgtcgaggtcagccaggatggcgcggtgttccagctccaggcccggcgcgaagtgatcctcagcgccggggcgatcaactcgccgcagctgctgttgctctccggcatcggcccggccgaggaactggcgcgccatggcatcgcccagcgccatgaactgccgggagtcggccacaacctgcaggaccatcaggacgtggtgctgatgtaccgctgcgacagcgagctgacctacgggatctcggccaagggcctgttgcccctggcccgttcgccctggcagtacctgagtcggcgcagcggcccgctgacctccaataccgtggagtccggcggtttcctgcgcctgcaccccgaggacgccgccccggagctgggcctgatcgtcgccccggcgctgaaaaaccagccccagcgcctggtgccgctgggccatggggtcagcctgcacatcgcggtgatgcacccccagagccgtggccaggtccggctcaattccgccgatccccatgacaagccgatcatcgacagccatttcctcagtcacccggaggacctgcgcaagctggtggcgggcgtgcgcctggtcgcgccagctggcggcgagccaggcgttcgcccggcgcctcaagggcgagctggtgcccggcccgcaggtcgagagccaggcgcagatcgaacagtggattcgcgacagcctgggcaccgtgttccacccggtcggcacctgcaagatgggccatgacgagcaggcggtggtcgacgaccagttgcgggtccacggcgtgcagggcctgcgggtggccgacgcatcgatcatgccgagcctgaccaccggcaacaccaacgcggcggcgatcatgatcggcgaaaaggccgcggatctgctgctgggtaaaccggcaccgagccttcaggttcccgctcgcctggaacaacagatacccgcgcctgtcattggctgaaaaacggccaaccgcagccgcgggtgggccaagggctaatgccaatcgatcaaacgccgatgatccattgtaggagcgagcttgctcgcgatggtcgttaacgataacgcgtactaatcggatgaacgcggcgcgctcaggtccatcgcgagcaagctcgctcctacagttttgatcggtatctcccaaaaggagtccgcgtttataggtgtatggattttgccgtaccccaggcatatagttgcaccgcacaactatatcgagagccacaccatgtcatcgccgtcgccgctggtggatcagatccgtaacgaatcgcgcaaactggtgcgcgagctgggttttatgggcgtcaccctggccggttccgatctgccgccctcggcggtgcatgcgctgatcgaactcgacctgcacgccccgctcaccgccgcccagctgggcaagaccctgaacctggagaagtcctcggtcagccgcctgctgggcaagctcatcgagcgcggcgatatccaggaaagccccagccccaacgatgcccgggaaaagcacctgggcctgaccgccagcgggcgcaaacaggtcgccgcgctccatgcctttggcagcgcccaggtgcaacaggcgctgcgcctgctggcgccgcgcgagcaaagccaggtggtcgccggactgcgcagttatggccaggcgctgcaggcctgccgcctgggccatgcacagatcgccgcggccaccccgagcgtgctccgtggctatcggccgggcatgatcggccgcatcaccgagctgcatgcgcattactactcacgcctggtgggtttcgggcagttctttgaacagcgcgtcgcggcgggtctggcggagttcagcgagcgcctggacaaccccgataacggcgtctggctggcagtgctggacgagcggatcgtcggctcgatcgccatcgacctcggcgacgccgcggatcgccctcaggccgacagagtcgcccatctgcgctggtttatcctcgacgaggcggcccgtggcaccggcaccggtcgcctgctgctcaaggcggcgctggagcactgcgaccaggtgcgggcaagctcctgctacctgtggaccttcagcggcctggacgccgcccggcacctgtacgaagccttcggcttccagctggtggaggaacagcccgcggcgcaatggggcaagaccgtgctggagcagaagttcgcgcgccgccatccaggcctgtcctgaaatgcctcagcggttggccggcggcgcgatgttccacagccgcggccagtcttcggaggacaagccattgcaggtcggcatctgccggtaatcgctgagctggaagctttcgccgtcgaacagccagcgcccggtttcaccgcagtcaccgatgccgcgcgccagatagaaggtggtcagcaccccggtcttggggtcgtagtgggcgccgcccgagccgtccgcgttgctcatgggcacggcttgccggcgcaactcctcgagctgcggcgggttgccgcgcgaccagctgctgatcaggtagtcgcagttgtaggccgcgcagtcgctcagcaccaccgtcaacgcccgctgcgcggtcagcggatagacctcgacctgaggctcggccacaaagtcttcatcgtcgttgggcgtgcctggcgcagcgagtttcaccgcggccgccgagatccgcgtgcgttgcgccgccgtcagttccggtgcccccggataagcccgcagctgggccggcagcggccgcaccggcacctcgctggccggacgctggcctggccgccacagcgccgtcacgccatcgacccggccctgcaccgagtccatcagcaacagcgccgccgacagaccggacaacggcacccgagcctcgtcgttcccctccagcttcagttcctcggcattgcgcaggcgttccagccactgacgggcccgggccgggtcggcgatttcataacgggtaacctggatctgcgcgcctttcttctccggcaacagcaccagggcgtccagcagctgtggctccaacggctggccgtcgaggcgcaaggccgtcagctcggcgggttcgccgcgctggtccaggcgtatctccagcgggccgtcggggccggcgcgacgctggatgtgcagggtcaggctgctgtactgcacaccgtgctcgccgttgggcgcgctcagggcgtggcagctgcgcaagttgtcgcagccggtgatccattccttggtctggcgcagcaacggcaccttttccgcggcgtcctgcgccagcgcctgggcggcgctggcggtcagcaaaagaaccatcagggtgcgctgcaacatgggactttccttgtcgggcaaaagcgccgattgtcccacgcagcgcgctggcgctcccagcttttttgccctcagggcgagggtttcgccgcgccctggcgcgcccggtattcccccggcgtcatcttcgcgtagcgctggaagaaccggctgaaatacgccgggtccttgaaccccagctggtagcagatttcgttcaccgaactggcggtgaacagcagcaggcgcttggactcctgcatcaggcgctcgtacaccaggcgtttcgacggcaggtcggcgatgcgccggcagacgtcgttgagacgcgcctcggtgacgccgatctgcccggcgcatagcgcgacagcggccaatgctccaggtagcgggcttcgatcagttcgttgaagcgatggaagatgtgcaggtcttcgtgccgcgccgggcgggccttgagggaattggccgagagcctgagcaggctgatcatgatcaagcgggtcagggcctccagcgccggcgcgtgcccggcgccctgcccggcgacttcctcctgcaactcatcgaacagcagcgccaggcgccgcgcctcgccggcgaaccccgggtccaggcgcgccagggccacgcaggccggcgccacctgggggccgctggcgagacggctgtcggtttcgatcagctcccacaccaactgctggcgcacggtgagcacgtggccttcgctgtcagcctcggtgacgaaggaatgggcaatggtcggtggcgtgaggaaaaacatcggccccgactccaggtattgctggtcgtcgaggtagacccgcaccgcgccgcttttcacgtagtgcacctggaaaaaccggtcgtggcggtgcaccggcatgttgcggccgaagaacccggccaggttgctcagcttgtcgtaatgcacatgcgagtcggcgtaacgctggtcgtagacctggccgatgttgatattggggatcggctggcgatcgctcatggtggcgtgtctctttttttgctcgcggcgctttttatttcgccgcagcgcttttttatttttacccgcagcaagcgcccacatcctgcgtgattcgcggcctgttcaccagcacgcggcggacagttcgtgatcggctcctggccggcgcttgacgatcgttaacatattaaatataacgttaacacattaacgaaatcacctcgtcttccgcgatgctcaggagaaaatcacaatgagccatgcactgcatgaagtcgccaccggcaccctgttcggcgtcgcgctgaactaccagggcctgttgcgcagccacctggaatccttcacccagccgccctaccagaagccaccggtcaagccggtgctgttcatcaagacgcccaacacgcgcaatgtccacggcggcgccgtgatctatccgcaaggcgtcgagcgcctgcaaccgggcccggcgctgggcgtggtgatcggcaagagcaccagccgggtcagcgtggaaaacgccctgcagcacgtggccggctacaccatcgtcaacgagttcagcctgccggaagacagctactaccgccccgccgtcaaggccaagtgccgcgacggtttctgcgccttcggcccggaactggtgccggcggcccaggtgcgcgatccccatgacctggaactgaaactgtgggtcaacggtgaactgctgcaacgcaatagcaccgccaacctggtgcgcggtattccccagctgatcgccgacatcagcgagttcatgaccctgcacgagggcgacgtgctgatcaccggcacccccgaaggccgggtcgacgtcaagcccggcgaccgcatcgaagtggagatcagcggcctgggccgtctcgccaatcacgttgtcgctgaagaaatagccgccgaaattgccgccgaataaggagccgccatgaaacacgcccgcatccgttatcaaggccaggtccacgaggtcgtggtcaacgcgcccaacagcgtgaaactggccgatggccgtgtgctcgccgaggatcaggtcgagtggctgccaccggccaccggcagcatgttcgccctcggcctgaactacgccgaccacgccgccgaactggccttcaagccaccgaccgaaccgctggtgttcatcaagtcccccggcacctacaccggccacaaccaggtcagctggcgcccggacaacgtcgcctacatgcactacgagtgcgaactggtggcggtgatcggcaagaccgcgcgcaacgtcaagcgcgagaacgccctggactacctggccggctacacggtgtgcaacgactacgcgatccgcgactacctggaaaactactaccggcccaacctgcgggtgaaaaaccgcgacgccaccaccccggtcgggccgtggatagtcgacgtcgccgacgtgcccgagccgaaccggctgaagctgcgcacctgggtcaacggtgagttgcgccaggaaggcagcacctgcgacatgatcttcgacatcccctacctgatcgaatacctgtccagcttcatgaccctgcaacccggcgacatgatcgctaccggcaccccggaaggcctgtccgacgtggtgcccggcgacgaagtggtggtggaagtcgaaggcgtcggccggctggtcaaccgcatcgtcagcgaggcggagttcttcaggatcaagacgcaacacgacacgcaacgggcggccaaggagcacgcataaatgatcaaacactggatcaacggccgcgaggtcgaaagccaagacaccttcgtcaactacaacccggccaccggcgaagccatcggtgaagtggccagcggcggcgccggggaaatcgcccaggcggtcgcggcggccaaggaagcctttccgaaatgggccaacaccccggccaaggaacgcgcgcggctgatgcgcaagctgggcgagctgatcgaccggaacgtgccgcacctggcggagctggaaaccctcgacaccggcctgccgatccaccagaccaaaaacgtgctgatcccgcgcgcttcgcacaacttcgacttcttcgccgaggtctgcacccgcatggatggccacagctatccggtggacgaccagatgctcaactacaccctgtaccagccggtcggcgtctgcgcgctggtgtcgccgtggaacgtgccgttcatgaccgccacctggaagaccgcgccgtgcctggcgctgggcaacacggcggtgctgaagatgtccgagctgtcgccgctgaccgccaacgaactggggcgcctggccctcgaagccggcattcccaatggtgtgctgaacatcgtccagggctacggcgccaccgccggcgatgccctggtgcgccacccggacgtgcgggccatttccttcaccggcggcaccgccaccggcaagaagatcatgcagaccgcggggctgaaaaagtactccatggaactgggcggcaagtcgccggtactgatcttcgaagacgccgacctggagcgcgccctggatgcggcgctgttcaccatcttctcgctcaacggcgaacgctgcaccgccggcagccggatcttcgtccaggaaagcgtgtacccgcagttcgtcgccgagttcgccgcccgcgccaagcgcctgattgtcggtgacccgcaggacccgaagacccaggtcggctcgatgatcacccaggcccactacgacaaggtcacgggctatatccgcatcggcatcgaagaaggcgccaccctcctcgccggtggcctggagcgcccggccaacctgccggcgcacctcagccgtggccagttcatccagccgacggtgttcgccgacgtcgataaccagatgcgcatcgcccaggaagagatcttcggcccggtggtctgcctgatcccgttcaaggacgaggccgaggccctgcgactggccaacgacaccgagtacggcctggcttcctatatctggacccaggacatcggcagggcccatcgcctggcccgtggcatcgaggccggcatggtgttcatcaacagccagaacgtgcgcgacctgcgccagccgttcggtggagtcaagggctccggcaccggccgggaaggcggcgagtacagcttcgaggtgtttgccgagatcaagaacatctgtatctccatgggcagccaccccatcccgcgctggggcgtgtaaggttttgcaatcctgtagccgctgccgaaggctgcgctcgtctcggaacgagacggctctttgaagtccctgcgggacttatcgcagcctgcggcagcggctacgggccgaacaataagatgtttcaggagaagcaccatgggcgaagtcgtcatggccgccaaggtctgccacgttccatcgatgtacctgtccgaactgccgggcaagcaccacggctgtcgcgaagcggcgatcgccgggcacaaggaaatcgcccgtcgcgcccgtgagctgggggccgacaccgccgtggtgttcgacgtgcactggctggtcaacagcggttaccacatcaactgcggcgagcacttcaagggcacctacaccagcaacgaactgccgcacttcatcaagaacatggactacgactaccagggctgcccggagctgggcgagctgattgccgcccaagccaatgccgccgatgtgcgcaccctcgcccacaacatccccagcctggagctggaatacggcaccctggtgccgatgcgctacatgcacatggacgtaccgccggagcagcatttccaggtgatttccatcgccgcctggtgtgcctggcacaagctcgaagacagcttcaccttcggcgccgcggtgcgccgggccatcgagaagagcgaccgcaaggtcctggtgctggcctcaggctccttgtcgcaccgcttctccgacgaccgcgaggccgaagccaacatccacaactggacccgcgagttcgacaaacagatggacctgcgagtggtcgagctgtggcaacaggggcgctttcgcgagttctgctcgatgctcccggactacgccgagcactgcttcggcgaaggccggatgcacgacaccgccatgctcctgggcctgctcggcggccccgaatacaaccggccggcggaaatcgtcaccgcgcctttcggcagctccggcaccggccagatcaacgccattttcccgctctagacgccgcgccagcctcgccaacccagccctggatttccagggctggccgccgaaggttcgcccgcaaggaggatcacatgccgcatttcatcgctgaatacaccgacaacatcgagcaagccgccgacctgccagggctgttcgagaaggtccacgactacctcggggccagcggcgtgtttccgctgggtggcatccgcagccgcggcgtgcgcctggacacctggcgcatggccgacggcaagcacgactacgccttcgtccatatgcgcctgcaggtcggcgccgggcgcgacctggccacccggcgcaaggtcgccgagggcctgttcgagatcatcaaggcgcacttcgccgagctccaggcccggcgtctgctggcgctgtcgttcgagatgagcgagctggatgccgagctgaacttcaagcacaacaacgtgcatgagtttctcaagcggcaagcgtgacctgtagccgctgccgcaggctgcgataaggccgaaggccttcagcgatcttgaagtcgctgcggccgtcccgatcgatcgcagcctgcggcagcggctacagagcccgtgccctatcgacaagaacaataaaagagacccgcccatgtccagctcgacccttgccctgcccagcgtcgtggagaccaacgacacctatcgccggatcacctggcggctgatgcccctgctgttcacctgctacatcttcgcccacctggaccgcatcaacatcggcttcgccaagttgcagatgacccaggacctgggcttcagcgatagcgtctacggcttcggcgccggcctgttcttcattgcctatgcgctgttcggcgtgcccagcaacctggcattggaccgggtcgggccgcgccgctggatcgccaccctgatggtggtctggggcctgctgtccagtgccatgctgctggtggacagcgccgccggcttctacctgttgcgctttctgctgggggtggccgaggccgggtttttccccggcatcctggtgctgctcaaccgctggttcccggccagccgccgcggccaggtgaccgcgctgttcgccatcgccgtgcccatggccggggtgatcggcgggccgctgtcgggctggattctcgaaagcttccacgacttgggcgggatgcgcggctggcaatggatgttcctgatcgaaggcctgccggtggtcctgctcggcctggtggtgctcaaggcgctgccggaaagcatcgacagcgtcgcctggctgagcgccccacaaaagcagcaactgcacgccgccctgagccaggaagaacagcacaagccgatcacccgcttcgccggcatcctccaggacaaacatatctggctactggtgtgcatctatttcgcggtgatgctggcggtcaacaccatcgccttctggatgccgaccctgatccaccacgccggcatcgcccgcgacagccgcgtcggcatgctcagcgccctgccatacctggccggctgcctgttcatgatcggtgtcggccgttcctccgaccgcctgcgcgaacggcgctggcacctcggcgtaccgctgctgatgtccagcctcggcctgatcgtcgcaggcgtcgctccggacaacgcctggctggtgatggccgggctgctggtggccggcatgggcgccagcgccgcgctgccgatgttctggcaactgccgccggcctttctcgccagcaacacccaggccgcggggatcgccctgatcagttccttcggcagcatcgccgcctttctcgcgccctacctgatcggcgtggtccgcgacgccacccagagcgccagcctcgccctgtatgccctggccctgctgatcgccttcggtgcctggctggtgctgcgggtgccggcccttatcgtcaatccccaggagaaataaccatgctcagcctttcggacatccagcaggccgccgcccgcctcgacgccgccgaacgcaaccgggaacagatcgcccagctgtcgctggagtttcccggcatcactatcgaggacgcctacgccatccagcgcagttgggtggaacacaagatccgcgccgggcgcaagctggtcgggcacaagatcggcctgacctcgcgggccatgcaggtgtcgtcgaacatcacagaaccggacttcggcgccctgctggacgacatgctgttcgaggaaggcagcgacattgcgttccagcgctttatcgtgccgcgggtcgaggtggaactggcgttcatcctcggcaagccgctcaagggcccggactgcacgctgttcgatgtgctcgacgccaccgaatgggtgatcccggccctggagatcatcgacgcgcgcatccagcaggtcgacccgcagacccaggccacgcgcaaggtgttcgacaccatctccgacaacgccgccaacgctggcgtggtcatgggcggccgcgcggtgcgccccaacgatatcgacctgcgcaaggtgccagcggtgctctatcgcaacggcgtgatcgaggagtccggggtgtccgccgcggtgctcaaccatccggccaagggcgtggcctggctggccaacaagctggcggcctacgacgtcggcctggaggccgggcagatcatcctcggcggctccttcacccgcccggtggcggcccgccccggcgataccttccacgtcgactacgatcagctcggcagcatcgcctgccgttttgtctgaggagaacgctcatgcaactgccgatcaatcatttcaagcaacgcctgcgccaggacgcgccgcaaatcggcctgtggctgggcctggccaatgcctactgcgcggagctggcggccaacgccggtttcgactggctgctgctggacggcgaacacgcgcccaacgacctcaacagcctgctcggccagctgcaggccatcgcgccctacccggtgcaaggcatcattcgcccgccggtgggcgacaccgcgctgatcaagcaactgctggacattggcgcccagactctgctgatccccatggtcgaaagcgtcgagcaggcccggcagctggtgcgcgccatgcgttatccgcccgcgggcattcgtggcgtcggcagcgccctggcccgggcctcgcgctggaacagcatccccggttacctggaccaggccgatgagcagatgtgcctgctgctgcagatcgagaacctcgaaggcctggccaacctggatgccatcgctgcccttgatggagtcgatggcctgtttatcggcccggccgacctctcggcgtccatgggccatcgcggcaacccgggacatcccgaggtggtcgcggcgatcgaggacgccatcgcgcgcatccgcaaggccggcaaggccgccggcatcctcagcgccgaccggacattggcgcagcgctatatcgagctgggggcgaactttgtcgcggtgggggtggacaccacggtgctgatgaagggcttgcaggggttgctggggcagtacaaggagactgcggcgcctacctcgggtggcggagtttactgacccctgtagccgctgccgagcccgcgaggctgcgatcggtcgcgcagcggccgcaacggggccaacgcggttatccagacccaacgcgaatctcaggttttgcgcctgctgcgcagtcgatcgcagcctcgcgggctcggcagcggctacggggctacgggcctcagccctggcgcgccgccaggcgccagacccgggcgatgtccgcggccctgtcgcgcaacaggcgcggcgcctcggcacaggcctgctccagggtcatggggccgcaggccagggcaaaggccgcatccaccccgtgctcatacatctgctcgtagccttcgcccagggtcccggcgatcacgatcaccggcacctggtgctgcttggcgatacgcgccacgccaaagggggtcttgccgcgcagggtctgggcatcgaaacgaccttcgccggtaatcaccaggtccgcgccctgcacggcctcggccagccccaccagctcggccaccacttccacccccggacgaaaccgcgcgccgaggaacgccttggcggcgaaccccaggccgccggcggcgccgctgcccggctcgtcgcgcacgtccttgcccagcacccgcgcggcctggtcggcgaactggccgagggcgcggtccagctgttcgacctgctgtggcgacgcacccttctgcgggccaaaaatcgccgaggcgccgtgaggaccacagagaggattgtcgacgtcggcggcgatctcgaaacgcacctcggccagccgtggatcgaggtggctcaggtcgacccgcgccacccgcgccagggccaggccgcccaggggcaaggcctggccatcgcgatccagcaggcgcacgcccaaggcctgcaaggcaccgctgccggcgtcattggtggcgctgccgccgatggccaggatcacccgttgcgcgccggcatccagggccgcgcggatcagctcgccggtgccgagggtgctgctggtgcaagcatcgcgctggcccggcggcaccagttgcaggccactggcctcggccatttcgatgatcgcggtgtggctttgcggcaaccagccccaacgcgcctccaccggcgcgcccagcggtccctggacccgggtggtgcgcaactggccctcgcaggcatcgaggatcgactccacggtgccctcgccgccgtccgccatcgggcactggatcagctgcgcgtccggccacacccgcgccagcccgtcggcgatggcgctggccacgccagaggcactcaggctgtccttgaaggagtcgggggcgatgatgattttcatgggctatctccggttcttatggcgcccatgctgccagttggccgcgaccttgaccccggtccattgcacaagtgtggggcggctttattgttcatttctacaatagctgcatcgcacgcgtctgtagccgctgtcgagccctggcgaggctgcgcacgaccgcgcagcggtcgcagaaccgagccacaccgatagacagacataccgcgtcgccgggtttacggggcgctgccccgatcgcagcctacggcagcggctacagggcctggcattacaacggggatggctcggtctgcggcaacagctgcacccccaggtacagcgccagcatgccgtcgagcttgagcgggtcgacgccgctgagctcggcgatacgttccatgcggtagcgcaggctgttgcggtggatgcccagggcgtcggcacaggcctggctctggccgtcgtggtcgcaccagctgcgcagggtcgccagcagctggccattggcatccttggcgatgaccttgcgcaaggggttgagcaactcgtccagggcatcgtcattgcggtggcgccagagcatcaccggcaggcggaaacgattgagggtcaacagccgtgactggggcagcacgtcgcggccataggcgagcaagtcgccgacccgccggtagcagcgacgcagccccgccagcccgtcggcctggccgcccacggcgatgcgcaggatgttccagcccaggctgtcgagtttctccagcagtcgtgggttgtcgacactcagggtcgccggccggcaccacagcaacgaggacttggccgagctgacgcaccagctgtccgggtaacgggacatcagccaggcactcagggcctcgacggtctgcgccccgccctcctggggctggcccagttcgaacagatagggcgtgcgcggcagctgcggcttgaggcccatctgctgcgcctcgtccaccagccgcggcgaatccccgctgtcgctgagcagcagcgccagcaagtcgtcgcaacgctggcggcgccattgctgttcggcctgctggtggcgctggcccaccagcatctcggcggtcatgcgcaccagctcggcataggtgcgcagcagttccggctcgccggtgatgcccagcacgccgatcagccgctggtcgtgcagcagcggcaggttgatccccggctgcacgcccttgaggtgcttggcggtctgcgcgtcgatctccaccacccggccgttggccagcaccagttgtgcgccttcatggcgagtgttgatgcgctcgggctcgccgctgccaaggatcaggccctggctgtccatgacattgacgttgtagggcaggatagccatcgtccggtcgacgatgtcctgcgccaggtcgtgatccagttcgaacatagcggcgtgatcctaggctctctacgaaaagtggctgcatgctgggcgccttcggcgctacgcgggccatgctgcgttaaaaacaggctcgtgcgcgagtccgatcggaatgctcatttaggcccctaaagtcgaacgcgaccccggccgttcctcgcctgtttttgccttgcctgaccttcgctcgccgacttttcgtacagacccaacgaaagcgggctcgggtgcgatggcgaaggcttgttcaccggcacaggggatgccggcaaagcctgtgcgccggcacaaagacagcggcccatggggtgaccgagactctcggggcgatcaacgttaacctcgcatcgcaaaaaatcataataaagagagacacgccatgtcacaaagcgccgctgccaccctggccaccgatgacgataaaaacgccgtctacaagcgcatcaccctgcgcctgatccccttcatcttcatctgctacctgttcaactacctggaccgggtaaacgtcggctttgccaagctgcagatgctcgatgccctgaaattcagcgaaaccgtctacggcctgggcgccgggatcttcttcatcggctacgtgctgtgcggcgtgccgagcaacctggcgctgaacaagttcggcccgcggcgctggatcgcgctgatgatgatcgcctggggcacgctgtcgacctgcctgctgttcgtcaccaccccgacccagttctacagcctgcgcctgctcaccggcgccgccgaagccggcttcttccccggcgtggtgctgtacctctcgcagtggttcccgagctttcgccgcggccgcatcatggccctgttcatgtcggcgatcccggtgtccggcctgctcggcagcccgttctccggctggatcctcaaccacttcgccgcgggccagggcggcatggccggctggcagtggatgttcctgctgcagggcatccccacggtgatcctcggcgccctggcgtacttcctgctcaatgacaacttcgcccacgccaagtggctgagcccgcaggagcgcgcgctgctggaagccgaccaggccgaagacgccgcgagcaagccacgcaccagcggcgactccctggcggcggtgttcaagaacccggccatctgggccttcggcctgatctatttctgcatccagagcggcgtgtacgccatcaacttctggctgccgtcgatcatcaagaacctcggtttcagcgacaacctggtgatcggctggctcagcgccattccctatttgctggcggcgctgttcatgctgatggtcggtcgctcggccgacctgcgccaggaacgccgctggcatttggtggtaccgatgctgatgggcgccatcggcctggtgatcgcggtcaacttcgccgccaacccgaccctcgccatcctcggcctgaccattgccaccatgggcgccctcaccggcctgccgatgttctggccggtgccgaccgcgctgctcagcgccggcgccgccgcgggtggcctggcgttgatcaactccatgggccagatggccggcttcctcagcccctatatcgtcggctgggtcaaggacagcaccggctccaccgacgccgcgctgtacctgctggccggggtcatcgtcgctggcagcctgctggcgctgcgcatgacccgcacgctgaaacgctgaccggctttaccgggctcaccttctggtgggcccggcttcccgggacaaaccacgggtttgtcaccgcctcgctacaaaaagcaacagccgacctcagcgcccccgtggtatatcggacagacgtccggccgcggcagttttccattggctggatcgattgatgactccctcgcagaccttaccgaaggaagacccacacgatcatgaccgcgcccttctccctcgcccgcctgagcgatatccaagccctcgaacaacagcagcccctggcccagcgcaatcttcccgccagcacctatgaactgttacaacgctcggccagccgtttcggcgagcgcaccgccctgaccttcctgccccagggcagcatccaggaccagccctggaacatcagctacgccgagttgttcgcccaggtcacccgcaccgccaacgccctgcaccggctgggcatccgcccgggcaaggcggtgtcgttcctgctgcccaacctgccgcagacccattacgtgatctggggcggcgaggccgccgggattgtcaacgccatcaacccgctgctggagcctgcgcacatcgccgagctgatccgcgcctcgcgcaccacggtgctggtgaccctggcgcccttccccggcaccgacctctggcaaaaggtcgcccacctgcgcgaatgcctgccggagctggaagccattgtcaccatcgacctggccaacctgctgcccgagccgcaacgcagtgcgatccagagccagcgcccggcgatgccggaaggcgtgctggacttcgacagcctgctcgcagcctgccccgccgaccacctggaaagcggccgggcgatccagccggacgacattgcctcgtacttccacaccggcggtaccaccggcacgccgaaactggcgccccacagccacctcaatgaagtggcgatggccgagatcatcggcctgcacggcgactacgacagcagcgatgtgctgctctgcgggctgccgctgttccatgtcaacggggtgctggtcaccggcctgtccgccttccaccgcggcgcccgggtgctgctggccggtccccagggctaccgcaatccgaccctgatcaaggatttctggcagttggtggagcgttatcgggtcagctgtttcagtggcgtaccgaccatctatgccgccttgctgcaagtgcccaacgacggcatcgatgtctccagcctgcgttttgccgtatgtggcgccgcgcccatgccggtggaactgatccgccagttcgaggcgcgttcggggctgaagatcatcgagggctacggcctcaccgaaggcacctgcgccaccagttgcaaccctcaggatggcgagcgccgccccggttccatcggcctgcgcctgccgtactgtgaggtcaagatcgccgtgctcgacagcgacggccattacctgcgcgacgccgccaccgacgaacccggcaacgtctgcctgcgcgggccgacggtgttcaagggttatctgcaggccgacaagaaccagggcctgtggctcgacggcggctggttcaacaccggtgacttggggcgcatcgaccgggatggctacatctggctgaccgggcgcagcaaggacctgatcatccgcggcggccacaacatcgacccgcagatgatcgaagaagccctgcatcgccacccggccgtggccatggccgcggcggtgggcaagccggacatcaaggccggcgaactgccggtggtgtacatccagctcaaggccggcgccagcgccgacccggccgaattgctcgagcacgccgcgcgccatatccatgaacgggccgcggtgcccaaggacgtctggctgctcgagcagatccccttgacggccgtgggcaagaccttcaagccggccctgcgcctggatgccattcgccgggtgttcgaagacgaggtgcggcaggttgccgagggcatccgcgtcgaagccgtcagcgacgagcgccacgggcaacgggtggacatccatgtgcccggcctggacgcgacccgccgcgcggccctggagcagcgcctgagcggttatgcggtgcgctaccagttgcattcagcgtgaattgccggcggccccggccatcggggtcaccgcgcttcaaggcattcacctgtagccgctgctgcaggctgcgtacgaccgtgcagcgggcgccgctctcgagatcgcaggaggtcctgcgggccttgcgcagccttcggcagcggctacatcgtcaggtgtcgggcgccagcgtgcagtacaccgcgatccccgtagccgctgccgcaggctgcgtacgaccgtgcagcgggcgccgctctcgagatcgcaggaggtcctgcggaccttgcgcagccttcggcagcggctacatcgtcaggtgttgggcgccagcgtgcagtacaccgcgatccccgtagccgctgccgcaggctgcgcacgaccgcgcagcgggcgccgcccttgaggccgcagctacagtctcaaaccggcgctccgccgtcggccttgtaacggtaatcggcgtccagttgcccgcccgccggcgcatccagttccagcaccaggccacccggtatccgcacgaaaatctgccaggtgccgtcctgcggtacttgcgccacctgatgcggcaggccgctggcctggacccgctgcaatacctgcgcggcatcctcctcggtcctgaaggcgatatggctgagcgcggtctcggcgaaggtcggttgttcgatcacatgcaccagcgcctgcccgtcctggtacagccagcgcccgggaaagggaaacggcggacgccgtccagcctgcagcccgagcagggcctggaatgcctgctgcaaaacgtcgccctcggcggtgttgaaggccagatggtcgaagtgccaggtcatgacacacctccgccaccgatgacggcggtgcgatccggcaagtacgtactgagcgatttcatggggttcaccctggtgcgatggacgtgactgcatattctcagcttgataatcgaggaaaaatcccggtaaaacgcaaggatctttaaaggatttttagcaatgagctcgattctcgaccttgaagtcttcgtccgcaccgccgattccggcagcatttccgccgccgcccgcagcctggaattgacccccgccgccgccagcatcgccctcaagcgcctggaaacccgcctgggcatgcgcttgctggcgcgttcgacccgcagcatgcgccttaccgaagaaggccggcgctacctggacagcgtgcgcgtggcgctggcggccctggcggagggcgaacaggccctgaaacaacagagccagggcctcagcggcgtgctgcaactggcggcgccgtcggacttcgggcgcaacctgctgctgccctggctggacgacttcaagcgcgaacacccgcatatccacctgcaactgttgctcaacgaccggcacagcgacctgttccgcgagaccgtcgacgttgccctgcgcttcggcgtacccagcgattccagcctggtggccctgccgatcctgccgcggcatcaccggctggcctgcgccagccccgactacctggcgcgccacggcaccccgcagacgcccgccgaactgggcgaacacagtgccctgatctatctgcgcaacggtcgcccctacaacagctggcatttcagccgcgacggcgaggtgcaggaggtccaggtgcgcggcgactacctcagcgacgacggcgacgtggcgcggcgctgggccctggccggccatggcatcgcctacaaggcctggctggatgtggccagcgatatccgcgccgggcgcctggtgcccctgctcggcgactggcagggcgaaagcgtaccgctcaacctgctgtgcccgcaccgtttgcaggtctcggaacgggtgaaggtgctgcaaggctttttgcaggcccgctgccagctgctggccggataattcagattgccccctacgcccgttctggtatttgatgggcgtcccataatcggtcgctggccgttgtcgcgccggccttacctcacgcacaaggatttcgtacatgagctatcgcatcctcggccattccgggctgcacgtgtcccccctgaccctcggcaccatgatgttcggcgaacagaccagcaccgaggactccctgcgcatcatcgacaaggcctgggaccagggcatcaatttcatcgacaccgccgacgtctacaccggcggccgttccgaagagatcgtcggcgaagccatcgccagccagcgtgaccaatgggtgctggcgaccaaggtcggcttcggccccgccgatggcgtgcccaaccgcagcggcctgaaccgcaagcacatcttcaacggcatcgacgccagcctgacccgcctgggcaccgactacatcgacatctactacctgcaccgcgaagaccacaacacgccgctggaagtgacggtgtcggccatcggcgacctgctgcgccagggcaagatccgctactggggcctgtccaactaccgtggctggcgcatcgccgaggtgatccgcgtcgccgaccggctcggcgtcgaccggccggtgatcagccagccgctgtacaacatcgtcaaccgccaggccgagaccgaacagatcaccgcggcccaggcctacgggctgggcgtggtgccttacagcccgctagcccgtggcgtgctcagcggcaagtacgcgccggatgtcgcccccgacagcaacagccgcgccgggcgccaggacaaacgcatcctggaaaccgaatggcgcgtcgagtcgctgcgcatcgcccagcagatccagcagtacacccaaggacgcggggtcggcatggtcgagttcgccatcgcctgggtgctgaacaatgccgcggtcagctcggcgatcgtcggcccgcgcaccgaggcacagtgggacgcctacaccaaggcgctggaggtgaagatcagcgccgaggatgaggccttcatcgattcgctggtcactccggggcatgcctcgaccccgggcttcaacgacgtcagccgcttcgtctccggacgcacgccgcgctgatctgccccacagcggtggccccttccgcgggccacctgctgccgcgctgcccgtcagtggcggcaaacgggatattttcccgtaacttgcgataaatccgagtaaacgtctcgcgccaaaccctctatattccccgcagttttcccaccatcccacttgcctggttcaggtcacacgaggacagcttgtctaaaggtattgctctatcggtcttggcgtcggtgctgtttgccgtcatgtatttctacacctccttgctggccccgctgaccggggtggagattttcggctggcgcatgctgctgaccgccccatgcatgaccgtattcatgctggtgagcggcgaatggcggcatgtcggcgccatcctcaagagactgctgggccaaccgcttctgctgctggcgctgccgctgtccgcagcgctgctcggggtgcagctgtggctgttcatgtgggcaccgttgaatggctacagcctggatgtgtcgctggggtattttctgctgccgctgaccatggtcctgaccgggcgtatcgtctatggcgaacagctgtcgcggctgcagaagatcgccgccgggctggcgaccctgggggtgctcaacgagttgtatcaggtgggcagtttttcctgggcgaccttattggtggccatcggttatcccgtctatttcgtgctgcgcaaacgcctggccgccgacaacctgggcggcctgtggctcgatatggccctgctgctgccgatcgcgctgtggttcgtgcaaagcggcgagcagggttttgccgtggtcgatcaacacccctggctgtacctgctgattccgttgctggggttgatcagtgcttcggcgctggtggcctatatcatcgccagccgcctgctgcccttcagcctgttcggcttgttgagctatgtcgaaccggtgttgctgctggccgtggccctgctgctgggggaaagcatccaggccggggaatggctgacctacctgccgatctggctggcggtgctggtgctggtgtacgaggggttcaagcacttgatgcgtcagcgcagaagctgacgctagacctgtagccgctgccgcaggctgcgatcggtctgggcggcactccgtacgaagcggccgcgacagaagacgcggactccccgacagatcgcatcaaggctgagggcgagtcctgcggcctcgttcgcagcctgcggcagcggctaccggtccgcgttgggggtcagggtttgatctgcttcagttcgttgagcagggccagcaaggcctgcatcttctcctcgccgaactgctgctggatgcgctggtagttgatttccatgtcgccgctcatggattcgaaacaggcctcgcccttttccgtcagagtgatgaacaggcgacgctggtcctcgggggatttgcgccggctgacgtattcgtcgcgctccaggcgggtcagcacgccagtcatgctcggcggcaggatgcaggccattttcgccagctgatgactttccagttcgccgttctggcgcaggatgcggatcacccgccactgctgctcggtcaggtcgtgctggttgagggatgggcgaaaaaatgccatggccgcttcgcgggcctgaagcagggtcaatgtcagagaaggtcttgggttggtcatgtgcgggtcgttcacagggctggatggcgacgcggagcgccacaaaggccgaacattaacacattcacaatcgccaaccgacaggcaagaaaaagcccggtcgagaatgccccgaccgggctcgattgtcaggcaggatgcggcttagtcggtggacagcacgccacgacggacctggtcgcgctcgatcgattcgaacagtgccttgaagttgccttcgccgaaaccatcgtcgcctttacgctggatgaattcgaagaacaccgggcccatcagggtttccgagaagatctgcagcagcaggcgcttgtcgccctcttccgaggagccgtccagcaggatgccccgcgactgcagctcgttcaccggctcgccgtggttcggcaggcggccttcgagcatttcgtagtaggtatccggtggcgcggtcatgaagcgcatgccgatcttcttcaactggtcccaggtcttgatcaggtcgtcggtgaggaaggccacgtgctggatgccctcgccgttgaactgcatcaggaactcttcgatctgcccggcgcccttggacgactcttcgttcagcgggatgcggatcatgccatcgggcgcggtcatggccttggaagtcaggccggtgtattcgcccttgatgtcgaagtaacggatctcgcggaagttgaacagcttctcgtagaaaccggcccagtaagccatgcgcccgcggtacacgttgtgggtcaggtggtcgatgatcttcaggccggcgccttttggatgacggtcgacgccttccaggaacacgaagtcgatgtcatagatcgagctgccttcgccgaagcggtcgatcaggtacagcggcgcgccgccgatgcctttgatcgccggcaggttcagttccatcggaccggtttcgatgtggatcggctgggcgccgagttccagggcacgcttgtaggccttttgcgaatccttgacgcggaacgccatgccacacaccgacggaccgtgctcggcggcgaagtacgaagcgacgctgtggggctcgttattgaggatcaggttgatcgcgccctggcgatacaggtgcacgtctttggaacggtgggtcgcgactttgctgaaccccatgatctcgaagatcggctcgagggtattgggggtcggcgatgcgaattcgatgaattcaaagcccatcaggcccatcgggttttcgaagatatctgccatggtttggcgcctcatcattgcttttggaattaacggatcgtcagtggctggcaatgctgaggaaggcaggtggcgcgcaggagataccccgcacgctgcgggcgaggaaatcaccataaatcagttgaaacccgagaatcttcatgtcgacccttgtcttaccggctggggggcgaggcttctgctgccagaagactttattattgtatgcgtaaccagattctacacagcgtaaaactgtttgtccgcactctctataaaatccgctttttttccaggctcgcaaggggtttgttgcactggtaaatgccccacaggatcagcccgccgcccaggcacatggccaggctcatacgctcgtccagcagcagcgcgccaaggatcaccgcggtcagcggattgagcgcgataaacacccccgagcgggtcgcgccgatcttgcgcaggccgtcgtaataccagatatacgccagggccgagcccagcacgccgaggtacaacaagctcaggccctgctccagggtcaggctcaacaacgcttcgagccgtacctcgccgcgcagggccgcggtgctgcagagcatcaaagtgcccagaaggatcgaataggtcacggtctgcaacgggcccagggtctggttcagggtgcgcgaaaacaacgaatagacgccccagcccagcacgcagccgaaaatcagcaggtccccacgccaactgcccggcccgctggacaaggcccccgggtcgcgactgaggatcaccacccccgctccacccaggcacaaggcaatgccgaacagcttggcgccactcaagcgctccttgaacagcgcccaggatgccagggcgatcaccgccggattgagggcgacgatcaacgaggcacgcgaggcattgatcgactgcaggccctcgaagaaacacaggttgtagaaaaagatcccgaaaaaccccagcagcgccagctgggcgaactgcgccaggctcgggcgcaccagggcaatccgggcgatcgccatgaacagcagcaaggccaggctggccaggagaaagcgcaggctggcggccagcaaaggctccagggtgccggccaacaggcgtccggcgacgaaggtgccaccccagatcatggtgaccgccgccagtttgcaatacaccggccaatcggaaggcccggcacaggtttgatcgacagttttcataagaccccgaggcgcggataaaggaaggttcaggtattcttcgactaatgcccgatcatcgtaaaatgagcttttactcatgaccctgagccaactgcagatcttctccctggtggccgagctgcgcggtttcaccagcgccgccagccggttgggcatcagccagtccgcggtgtcccatgcgctcaagtccctggagcaggaattgggggtcgagctgatccgccggcatcagtcgctggtggaactcaccgatatcggccagcaattgttgctgcgggcccgcgccatcctcggcctggccgccaccatggaacaggaggccgccgacgcccgcggcatgaaacgcggcaccttgcgcatcggctcgttcggcccgacctcgtcgatgaaactgctgccggcaatcctccagcgttaccgcgcggctcatcccggtatcgaagtgcacatcgacgaggggcccgaccgccaggtactgcaatggctggaggaacggcgcatcgatgtcggtttcgtggtactgccccaggaacgcttcgactgcttcgccctggtggaagaccagatggtggcgctgatccccagccaacatgcactggccagcaaggactcgctgagtctcgccgagctgtgcgatgacccgttcatcctcaccgaggccggttccgccgaactggtttcccggctgttcctcgcggccaggctcagccccaacattcgctatcgcagctcgcaactgctcagcaccctggagaccgtggcccgcggcgaggccctgaccctggtcgcacaattgtcgctgcccgaggccagcgacccgcgctacctgatcaagccgctgtcacctcccgcccggcgccaggtagggctggcggtgctggaccggcggcaatcgtcaccagcgaccctggcctttatcgagcaggcgcgcagcctgtatcgcggtgactgagcgcaacccggggccaccgtctatcatgcccatggaccggatgccgccggaccgtccaccggcttttgagtgttttctggcttccatttcgccacaggtttttcctccatgccattgaccgccaaaggcccgttgaaacgctccacccgcaacctgcgaaccctgctgatcggcttgctgccggtggtgctgggcgtggcgatcctttatatgcaggccgagcgcgcgctgatccacagcagccagcagaccgccgaggaagcgatccgccagttcgacctgatgctcgacaacgccgacctcgccgcccgggcgctaatggcgcaagtcggccaaccctgcgacgaattccggcaactggccctgcgcgagcaggtgacccgccgcccgttcgtgcgctcgaccaatctggtgtggcgcaatgacaactattgcagttcgctgatcggcccatcctcgttcgtgctggacccggcggactatgtcgacggcaagctgtggttgatgaacggcaacccggtcacacccgataccgcgctgctggtctatcgcctgcaagagggtgaacgcgcggtcctggccaccattgacggctatcacctgagcaatgccttgcgcctgatcagccgctttgccgagctgcaactgcaagtcggcccctactggctggccgacgacggccaggtccatgaatccatcgctccgccgcccccggtcgccccttatcagatggcttcttcgcgctacccctacagcgtcaacgcggggtttcccgagggcgatatctggctctacatgaagtcccagtaccctgccctgttcagcctgctgatcttcttcggggcgctggcggcggcccttggccactggctgcaaaaacgctcgtcgtcgcccagccatgaactgcagcgcgccctggaagcggcggaattcatcccgtacttccagcccgtggtccgcggcgatacgaaacagtgggccggcatcgaagtgctgatgcgctggaaacatccccgggaaggcctggtgcgtccggacctgttcattcccttcgccgagcactccggcctgatcgtgcccatgacccgttcgctgatgcagcagaccgccctgttgctggcgccccacgcccccgccttcatcgacaactttcatatcggcatcaatatcaccgccagccattgccaggacctggaactgctggaggactgccggcagtttctcggcatgttcccgccgggcaaggtgaggctggtcctggaactgaccgaacgcgaactgatagaaccgaccgcgatcacccacagcctgttcgaggaactgcacaagttgggggtgatgatcgccatcgacgacttcggtaccggccattcaagcctgggttacttgcgcaagttcaatgtcgattacctgaagatcgaccagagcttcgtggccatgattggagtcgacgccctgtcccggcacatactcgacagcatcatcgaactctcgggcaagctcgaactggggatagtcgccgagggcgtggaaacagtggaacaacaggactatctggccgcccatggcgtcgacttcctgcagggctacttattcggcaggccaatgcccggggaagagttcctacaagcactggtgcgccactaaatagccattctcatgaagatttattgaactcggtaattgtttcgcgcaccaatttgaatcagaagatgacaaattgtgtgcatcaacaacgacgtgatttacttgcgccagattaactactacaatttttaaagcctgtacaagattcacaggtgggccattataatcgagtcgtactaagactcttggcttatagctttgtttgcggttggtatcagccaaatacactattggagtaaagatattgtccagactcgctgaatttcgtgcagcagaaaaggcccttcaagaacagcttgcccagctggaatccctgaagaacgacgccggactcaagaaagaaatcgagttcgaagaaaagctccagggcctgatgaagacctacggcaaaagcctgcgcgacattatcgccattctcgatcctcatccgggcaaatccgctctgccgctctcgggcgcgccgaaaacccgtcgtgcccgcgtggtcaaggtttaccagaacccgcacaccggcgagttgatcgaaaccaagggcggcaatcaccgtggtcttaaagcctggaaagaacagtacggcgccgccactgtagattcctggctgcgcggttaagcaaccgatgtatataaaagaccctgccaatgcagggtctttagctttaagcgaaggcgctttgtttcgaaatcgaataagttgcaagccctggattgcctgagcggcaataaacacccagccgaaactgcagctacgtacccaatcccccgcttcgatcctacaactttgtacttagttcaaatgcatgagccgtgctggccgacgtagcaccccgctaaagtttcaggctacttcgcaccccacggatttcctcctgactttcggcataaaccgcagcctgtccggcataagacaatacataggccttatcgccatcgacagccgccaccagtgtttgcgacaacacatggcggccgttttcggtaatggtgcaagtggtttccagcgccaccaggcgactcaatgtcgtgtcatgaatgcgcgtgcacacactttgataaccgccgcgcccgaagtccttctgcaccgacttgcgcatctccagcaagaccgcctgcagattgacctgatgtccgctttcaacttgagtcatggtcaactccatgaccatcagcggcgtgccgccggcatcgttcttcaccgcacgctggcggaataccttggccgtttgttcttgcgcctgcggcaactcttcgatctgccagccgctgggccaggtgatcaccgggtccgccgcctcggccagggccggaaccagaagccagggggcaagcagacacaggtttttgaacgataagcgcatggtcatgaacacgtaagggacgagccttgaagtctgaggctggcacgagtatcgggcaacagactcgtagctttgtgtttggtgcgccctgccgctcttgcgtatcattacccgaccgcaaggacgcccgaagccctgcaagccaggggctcattagcatgagtattcttgcccacttcttttccggagggcccatgagcctgcacgaactcaatactttccccggcgtaaccgcccagcctgacaccgccaccgccaacttcgtgttcaaccacaccatgctgcgggtcaaggacatcaccaagtccctggacttctacacccgggtcctgggtttctcgctggtggaaaaacgcgacttccccgaagccgaattcagcctgtacttcctcgccctggtggacaaggcgcagatcccgaccgacgccgcggcccgtaccgagtggatgaagtcaatccccggcatcctcgagctgacccacaaccacggcaccgagaacgatgcggacttcgcctatcacaacggcaacaccgacccacgcggctttggccatatctgcatttcggtgccggatatcgtcgccgcctgcgagcgcttcgaagccctgggctgcgatttccagaagcgcctgaacgacggccgcatgaagagcctggcctttatcaaggatccggacggctactgggttgaaatcatccagccggcaccgctgtaactcgcgcttatcctgcaggagcaagacgtgcctagacaggcagcggcttgattgatccaccgcgtcatcgttgatcgcgagcaggcttctctcctacagaagcgacgggtgcaaataagaaaccccatgagccgaggctcatggggttttgttttttccgcggtcgactcaggccggcgcggaggtgcggatcaggtggtcgaaggcgctcagcgaggccttggcgccctcgcctaccgcgatcacgatctgcttgtacggcacggtggtcacgtcaccggcggcaaacacgccgggcagcgaagtctcgccacgggcatcgacaatgatctcgccacggggcgacagctcgacggtgcccttgagccagtcggtgttcggcagcaggccgatctgcacgaagataccttccaggtcgacggtattgaactcgcccgaatcgcggtccttgtacaccaggccggtgaccttctggccatcacccttgacttcgctggtcagcgcgctggtgatcacgttgacgttcgccaggctgtacagcttgcgttgcagcacggcatcggcgcgcagcttgctgtcgaactccagcagggtcacgtggctgacgatacccgccagatcgatggccgcttcgacgccggagttaccgccgccgatcaccgccacgcgcttgcccttgaacagcgggccgtcgcagtgcgggcagaagcacacacccttggccttgtattcctgctcgccgggcacacccatctcgcgccagcgggcaccggtggccaggatcagcgacttggccttgaggctcgcgccgctttcgaaacgcacttcgtgcaggccgccgacttccttggccggcaccagcgcgctggcgcgttgcaggttcatgatgtcgacgtcgtactggcgaacgtgctcttccagggcgctggccagtttcggcccttcggtttcctggaccgagacaaagttctcgatggccatggtgtccagcacctggccgccgaaacgctcggccgcgacaccggtgcggatgcctttacgggccgcgtagatcgccgccgacgcaccggccgggccaccgccgaccaccaggacgtcgaaggcgtccttggcactgattttttccgcctgtttttcaatggccccggtgtcgagcttgccgaggatttcttccaggcccatgcggccctggccgaagttcacgccattgaggtagacactggggaccgccatgatcttgcgatcgttgacttcgtcctggaacagcgcgccgtcgatggcgacgtggcggatgttcgggttcagcaccgccatcaggttcagcgcctggaccacgtccgggcagttctggcaggacagcgagaagtaagtctcgaagttgaactcgcccttgagggcgcggatctgttcgatcacttcgacactggctttcgaggggtggccgccgacttgcagcaaggccagcaccagggacgtgaattcgtggcccatggggataccggcgaaacgcaggctgatgtcgcttcccgggcgattgatcgagaacgatggtttacgagcatcgttaccgttgtcgagcaaggtaatctggctggaaagactggcaacgtctttcagcaattcgagcatttcctgggatttcgcaccgtcgtcgagagaggcaacgatctcgatcggctgggtgacccgttccaggtatgacttcaactgggctttaagattggcgtccaacatacgggcgatttccttttattcagatcgaaaaaaaacgcccgagcgaatctcgcccgggcgttcttgagggcggtgcagctgacttaggtgcggcggtccgccctgctgtagcgagtcacaggcttagatcttgccgaccaggtccagggaaggagccagggtagcctcgccttctttccacttggctgggcagacttcgcctgggtgggcagcgacgtattgagcggccttgatcttgcgcagcagctcggaagcgtcacggccgaccccgccgtcgttgatttcaacgatcttgatctggccttcagggttgatcacgaaggtgccacggtcagccagaccggcttcttcgatcagcacgtcgaagttgcgggagatggccagggtcgggtcgccgatcatggtgtagcggatcttgccgatggctggcgaagtgttgtgccaggcagcgtgggcgaagtgggtatcggtcgaaacgctgtagatttccacgcccagtttctggaattcggcgtagttgtctgccaggtcttccagctcggttgggcaaacgaaggtgaagtcagccgggtagaagaacacgacggaccatttgcctttcaaggtggcgtccgacacttcgatgaactcgccattcttgaaggcggttgctttgaacggtttgacttggctgttgatgataggcatcggtgattctccatcagtgggtaaaaacttgggttgaaaacttgatggggagaatcctaaccaatgctcccagccaaggctcattggcaaagctgatgctgctgattaggtttggctattagcgcgcagtattaatagaagaaatgcgtatttactcgccgaccggcttttcctggctcagggccatgccgagaaatgggctggcctcaacgtaacgcatggccgacttgatgtccttccagccgacatagctcatcagcgacttgaggtcccagccgctgcgatgggcccaggtggcaaagccgcggcgcagggagtggctggtgtattgctcggcggcgaccccggcgcgctccagcgcctggcgcaataacgggattacgctattggcgtgcaggccctcctcgcccagatggccccagcggtcgatgccacggaacaccggcccacgcaccagggccgcggcgctgatccactcgatataggcctggaccgggcacaaccggcgcagcgccggggtgtgccaggtcttgccaaggttgtcgcggtcgctcttgctgcgaggcagatacaggctgatgccggagcccgccaccgcctgcacatgctcgatccgtagccggcacaactcgtcgctgcgaaagccgcgccagaatcccaggagaatcagcgcgctgtcacgccgcgcgcgcagcagggccggttgattgtcatcgagccgggcctgggtggcttcctgctccagccaggcgattacctgctccagatgctgcaactgcaaaggctcggcctgtttttcctgcgccgggtgcagcgcgcgaatgcccttgaacacctggcgcaccaccggggccttggtcgggtcggcgaaaccctggctgttgtgccactgcgccagggccgagaggcgcagtttcagggtgttgatcgacagctcccccgcatacgccaccagataacgcgccacgctgtcgctggtcgccggcagaaacccgccccaggtcacctcgaaatgttcgatggccgcccggtagctgcgccgggtgttgtcgcgggtcgcggcgtgcagataacgatccagatcactcatggcttgttcgactcgtcttgcgtacggaaatagcggatggcaacagggcattctggttatgacacggggtaataccagtatatcccatgtcaataattctaatatttatctttgattttattgtacaattacacgttatacataccacgtaaaaagtacgtaatcgtaggagatcccatggctcgtggcggcgttaacaaggcggtggtgcaaatcgcccgttcggcaatcctcgctcgcggcgaacaccccagcatcgatgcggtgcgcatcgaaatgggcaataccggctcgaaaaccaccattcaccgctacctgaaggagcttgagcaaagcgaagcccgccgcgccgcgccgcaggaagccctggaagaagaactgacggaactgatccagcgcatggcccagcgcctgcgcgaacaggctcaggagcccgtggcgcaggcccaggcgcaagtggaggaaatgaaccaggaactggcggcgcagcaggccgcggccaaacaggcgcaggcccagctgcagcagcaattgcagacccaggctgcagccctggccagcgaaagcacgctgctgcaggagacccgctccaccctgcagagcgaacagacgcgcaatgccggactgaaccaggccctggccgacttcgaattgcgcctgaaagacaaggacgagcagattcgttcactggaagaaaagcacctgcacgcccgggacgccctcgagcattaccgcagcgcggtcaaggagcagcgcgaacaggatcagcgccgccatgaaggccaactgcagcaggtgcaacaggaactgcgccaggctcagcaaagcgcattggtgcgccaggacgagatcacccaactgcaccgcgacaacgaacgcctgaccagcgagcagcgcgccacccagaaagagttgcgccaggcacaggagcaggcacagaaaaccgacagcaagcttggccagttgctggagcaatccagccgcttgaacagcgaacacaccctcctccaggaacgcctgcgcgtcgccttgctggaaagtcatgagttcaagcagaacctggagcagcagctgcaggacaatcgacaactggaactgcgcgctaccaaggccgaggccagcctggaggccctgcaactggctgccgccgcgaaggccgaggcgcagccagaaacagaagagcagcggccggagccaccagagcaggcttaaccagcgaccggcgtgcgcatggtgacgaactcttcggcggccgtcgggtgcaccccgatggtttcgtcgaagtcacgcttagtggcgccggccttcaaggcaatcgccaggccctggacgatctcgccggcgtccgggccgaccatatggcagcccagcaccttgtcggtttcagcatccaccaccagcttcatcagcgtgcgctcctggcactcggtcagggtcagcttcatcggccggaagcggctttcgaagatctgcaccttgtgcccggcttcccgcgcctgctcttcggtcaggccaacggtgccgatattcggcaggctgaacaccgcggtcgggatcatgttgtagtccaccggacgatactgctccggcttgaacagacgccgcgccacagccatgccttcggccagggccaccggcgtcaactgcacacgcccgatcacatcgccaatcgccaggatcgacggctcggcgctctggtactgctcatcgacctcgatgaagccacgcttgtcgagcttcaccccggtattttccagccccaggttgtcgagcatcggccgccggccggtggcgtagaacacacaatcggtggctagctcgcgaccatccttgagcgtgaccttcaggctaccgtcggcctgcttttcgatgcgctcgatatcggcattgaactgcaggtcgagcccacgcttggtcagttcttcctgcaagtgcttgcgcaccgcaccgtcgaagccacgcaggaacagttcgccgcgatacagcaacttggtgtccgcgcccaggccatggaagatcccggcgaactccaccgcgatataaccgccgcccaccaccaggatgcgcttgggcagctccttgaggaaaaacgcctcgttggagctgatggcgtgctcgcgccctggaatatccgggatctgcggccagccaccagtggcgatcaggatgtgcttggctgtgtagcgctggccattgacctccacctgatgcgggtcgatcagcctggcgtggccttcgtgcaaggtcacgccgctgttgagcagcagattgcgatagatgccgttcaggcgattgatctcgcgatccttgttggcgatcagggtggcccagtcgaaatcggcctcgcccagagtccagccgaagccagcggactgctcgaagtcttcggcgaagtgggcgccgtacaccagcagttttttcggcacgcagccgacgttgacacaggtaccgcccagatagcggctttcggcgaccgcgactttcgcgccaaaacccgcggcgaaccgcgccgaacgcacaccgccggaaccggcgccaattacataaagatcaaaatcgtaggccatttcactctcccaggcaggctgacagcataaccgcagatgcgtatccggtcagcgctagaggatttacataggggcataaaacgaaaaagccacccgaaggtggcttttcagtacaaggaccaagcgggctatcagtaagccttgccagtcttgtagaagttctcgaagcagaagttggtcgcgtcgatgtaaccttcggcaccaccgcagtcgaaacgcttgcccttgaacttgtaggcaatcacgcaaccgtcctgggcctgcttcatcagggcatcggtgatctggatctcgccacccttgcccggctcggtttcttcgatcagcttgaagatgtccggggtcatgatgtagcgaccgatgatcgccaggttcgacggcgcatcttccggcttcggcttctcaaccatgttgcgtacgcggtacaggtcgtcgccgatcaggtcgccggcaatcaccccgtacttgctggtttcttgcgggtcgacttccatgattgcgacgatggtgcagcggtactgcttgtacagcttgaccatctgcttcagcacgccgtcaccttcgaggttgacgcacaggtcgtccgccagcaccacggcgaacggctcgtcaccgatcagcggacggccggtcaggatcgcgtgacccaggcctttcatttcggtctggcgggtgtaggagaacgagcactcgtccagcaggcggcggataccgaccaggtatttttccttgtcggtgcccttgatctggttttccagctcatagctgatgtcgaagtggtcttccagggcgcgcttgccgcgaccggtgacgatggagatttcgttcagaccggcatccagtgcttcttcaacgccgtactggatcagtggcttgttcaccaccggcagcatttctttaggcatggctttagtcgctggcaggaagcgagtaccgtaaccggctgctgggaacaagcatttcttgatcatatgagtccttaaaagggctgtacgtacgaatttcggcgcagtctaatcaggccgcgtgcgccttacaatgggtcgcagtggctaaccgctgccatctaagagaaatattgccgcggatagttccccacatagctccccaccttgttctgcacatagctgcgcacattgttctgcacgctccgcacatcgtttcgaacagacttgcaaacacggcttcgcagcatcgtacagatagcccgcgccgtaaaccgccatctggctgcaaagccttaattttctgcgtcccgcccttgtccgcactcttacaggaactcgtttaccgctatcatggcgcccttgaaccccgccaacgaggcagatagatgtcggcaacaaaaagcgtaaacggttaccagatcaagcagttgaaagacggccagtggtggttggtcagcgcccagggcgagaacgtcgccggacctttcgccagcgaggcgatggcggtcgaagtggcatcggtgttcgaggactcggccggccacgcgtcggcgcgtcgcagccccaagtcctgagactgtcccggcaccgaagagccctgccccgcgcagggctttttcatgccgatctataccgcagtggcggttcgctatagcatctcgtcccagacgctcgccaagggtgtccagccctcccccggggctcaaacttctcgacgatgaccacacccatgcacaaacttctggcactgactgcggtactggccctgagcggatgcgccaccgtttccgatacctacctggagaacggcgagcaaggcctgagcatcgattgctccggcgaagccagctcctgggccagctgctatgaaaaggccgacgcctcctgtgccggcaccggctatcggatcatcggcaccgacggcacgccgtcgctcaaggaaagcgacaagaccctgggggcggacgttggcaactacaaaagccgcagcgtggtggtggtctgcaagtagcaggcgcacggcctacatatgaatctcggcaaacttgatgcccaggttgcgaatggtttcgatcaggtcgtccagtcggtcgaatgactcgacttcatcgttgtcatccaccagaaaatagctgcgccccgcgcttttcttgaagaacacgatccattccccggaattcgccggattctgaatcacatgggtcgcagagatatgcccctccgcatgcctctcccggactgtttcgcgcttcatgttttctcccaaaaaacgatgccgccgaaacctgggtttcgacggcatctttgacgatggccgacagtttatcggatgccctggccaatcagcacgccatctaccgtctggccatacagattgaccccgtcgttggcgtggaacttgagccgggtcttctcgatggagccctccaccagccgcgggtcctgtggtcgttcatggcggttgacgaacgccgccacgtcccaggcccgctggtcgctcaagctgccggccttgcccaggggcatgttgtatttgataaaggacgccgccgtgttgatccggtgcatgcccgcgccccagttgtaggagtccttgccccagagcggcggcatgacatagtccgcgccgaccttctggccctggccgttgtcgccatggcaaaccgcgcattgcgcccggtacacctgctcgccacgcgccaggtcgtagccctgggccggttgcggcacctcgggataaccccgcccgggcaactcgacagcgatcggcgccttgctcgccagccagtaggaatacaccgacaacgcagtgatctcgtagctgtcggcggccggtggcgtgccgttcatgctgaactggaaacagccctgcaagcgttcggcgtaggtgttcaccttgtcgttcttcttgcggtaggccgggtacatcggataggcgccccacagcggcgcggagttggccaatcgcccctgatccaggtggcagttgctgcaattgagcccattgccgacgaacttcggcgccaggcgtttggtatcgacgaacagcgcataaccgtcgcgaaccatcttgccgtaggcattgtccggcaactcgctctccgccggtggctggaaatacccgggatgggcagcgttcaccgccggttcccgcaactgtgattggtcctccatggcgaccgcggcgccataagcctgggccgtcagcaaagcgagggaaaagcccaatagaagatcatgcttcatggcttggactcctggttatcggccttgaccaactgactgccgaccttggcgaaataatcggccaccgccgtaatttcctcggggctcagggctttggcgatgtgtcccatcaggtcgttcggatcgttgcggcgcgtgccgtcgcgccaggcattcaattgcccggcgagatacgccgcgggttgcccggccaacggcggaaaggcgtctcccacgcccacgccacccggcccatgacaggtcacgcactccggaacctgccgctcccaggcgccgcgcaaggccagcctcgcacccacgccttcagccagggaactgcggttgatcggcgctggcgtcgcagccggcatggccgccagggtctggctcaccgcctctatctcgtcatcgctcagggccttggccagtggctgcatgaccgggttgctgcgcgcaccactgcgaaaatcttccagctgcttgcgcagataacccgccgacaatcccgccaggcgcggaaacccggcggccgccaggcccaggccatcgccaccatgacaggccaggcatgccgtggcgccgggctgcgcgccaccctgggcaaagactttctgcccatccatggcctgggcattggcgacaaaaaacagcatcaggctgctcagcagtattcgatccacggggatcatggcgaactccatttttctagttatattcttaggcttattttatataagcctacaaagagtaggccaatagacctttggctacaacgcgaaaccagccgggcctgccttgccaccaggcacaaaaaaacccgccctcgccacggaaatccgggccagggcgggctgttgaaaaatcgcttggctatcagccggaaatgcagtcctccgccgccttgcggatatcgcccggacgcatgggcacattggacatgctttcatgcagcttgatgctgctgccgccggaacgctcctcgatatcgaataccgcggtcgggcccgacgagactttctgcggaacgatgatgcgcatgccgtccttacgcggttcgacctgcaactggccacggctgtcagccagtttgtcgctgacgcacttggcgtactcctgtggctttttccctgaaatcacgttcagggtgggcaatgtctggttaatatccgagaccgtcgcacaaccactgatcgccaaggccagaatcaacacaccccacttcatacatttcctccgataaagaccgtccgaccgcagaaatggcatttttctccggatcagtcagatttatcctaaataatcggcaaataactgttttaaattgtcaaagccgcctgccgcggcctgataaactgcgccatcgttttgattttgtagcaaaagcccttctggaggcgcccatgaaatttatccaccagcgcgagcacctcaacgaagacgatatcgtcgtcatcgaatgctcccaggtctgcaacatccgcctgatgaacgacgccaacttccgaagcttcaagaacggcggacgtcacacctatcatggcggcgcgttcgacaagttcccggccaggatcaccgcgccgagcaccggcttctggaatatcaccatcgacaccgtcaaccgccggcccatcagcgttacccgcaagccgaacctgacccactcgatcaagatcatccgccggtccagctcgaaactgcgctgaaccccgccccagcccgcgaccaacaggtatcaccgtggcccaaacgaccaagtacgtcatcaaatacaaactcaacggcgagcgccgtttcgagttcgcccagctggaaagcggcactcaggaagaagccaaggccgcgctggaagccctgcatggccagaccgacgacgtcatcagcgacgtcagcgtgagcaaggcgctgtaagtccctgctcctagaacctgtgacgaattcgagcgcaagcgacggagtgtgagcggcccgcgcacttcccagaatggcggacctcaacctctactccgggaaccgccagcatgtccgccccctccctcgaacaacgtcttgcctgcctggactgggcctcgatcgagcagcagctcgaccagtacggcagcgcggtgatcgacaacctgctcagcgccgaccaatgtcatgagctcagcggtttgtatccccacagcgagttgtttcgttcacgggtggtcatggccaggcacggtttcggccgcggcgagtatcagtatttcgcctaccccttgccgcaacgggtcgccgagttgcgcggccagttctatccgcgcctggtgccgctggccaatcgctggaaccagctgatgaatatccccgtgcaatatccgccccggcatgaagattttctccagcgctgccacgccgccggtcagcaacggccgacgcccttgttgctgcagtacggcccgcaggattacaactgcctgcaccaggatgtgtatggcgacaacgtatttccgttgcaggtcgcgatcctgctgtcacagcctggcagcgacttcagcggcggcgaattcgtcatcaccgagcaacgtccgcgcatgcagtcgcggccgcaggtcatcggtctgaagcagggtgatgcgctgatcttcgccgtgcatcatcgtccggtacccggtgtgcgcggccattaccgggtgacgttgcgccatggcgtcagccgcttgcacagcggtcgccgccatacgctaggagtgactttccacgatgcccagtaacggtaactttaccggcgaactgttcggcgaacccgagctgcaagaggcgccccgcaccgaacagatcggcccgcagtcctttgtgcttcatggcttcgccctgccctgggtcgagcgcctgctaccggccctgcgtggcgtgctgcgcgccgcgccgttccggcaaatggtcacgccgggcggtttcaccatgtcggtgggcttgagcagttgcggccagctgggctggaccaccgaccgcagcggctaccgttacaccgccatcgatccgcagagcggccagtcctggccggcgatgcccgaggtgttgcacgaactggcccgggccgccgcgacccaggccggttttgccgggttcgaaccggacgcctgcctgatcaatcactatgtgcccggcgcccgcatgtccctgcaccaggacaaggacgagcgcgattacgatgcaccgatcgtctccgtctccctgggcttgccggcggtgtttcagctgggtggcgcgcgccgcagcgaccgcccgttgcgggtgccgctgctgcatggcgatgtggtggtctggggcggtgtcgatcgtctgcgttatcacggtgtgctgccactcaaggaaggcacgcacccgctgctgggcccgcggcgcatcaacctgacctttcgccgggccggttgatcccgcgggaattcaagcgcaagactcggagtgccaggcaccctgcccttggttaatctgagcgacatccgccaccgagtagagcccatgaccatggtccagcccaagcccaccaccgccagcgatccacgctggctcgccgtcctggcccgtgatgcgagcgccgatggccagttcgtctatggggtaaaaaccaccggggtctactgccgccccagcagcctgtcgcgcctgccacggccggagaacgtcgaattcttcgacaccgcggagcaagccgaagccgccggttaccggccgagcaaacgcagcgccagcgaccagacccaggtggccgcgcagcatgccagcctggtagccgccgcgtgccggcagatcgagtcggccgaaacgttgcccagcctgaaacagctggccgagcaagccggcatgagcagcttccactttcaccgggtgttcaaggccgccaccgggctgaccccgaaaggctacgccagcgcccaccgttcgcggcgggtgcggcgccagctggagcacggccattcggtgaccgacgcgctgtacgacgccggcttcaactccaacagccgcttctacgaaaccgccgaccagttgctcggcatgaaacccagcgactaccgcgccggcggcctgaacgccgatatccgctttgccgtcggccaatgctccctgggcgcgatcctggtcgcccagagcaatcgcggggtctgcgcgatcctgctgggcgacgaccccaatgccctggtgcaggatctgcaggacaaattcccccgggccaacctgatcggcgccgaccaggacttcgagcaactggtggccaaggtggtggggtttatcgaagcaccggccattggcctcgacctgccgctggacctgcaaggcacggcgttccaggaacgggtgtggctggccctcaaggagattccgccgggcagcaccgccagctacgccgagatcgcccagcgtatcggcgcgccgaagtcctttcgcgccgtggcccaggcctgtggggccaacagcctggcggtggcgatcccttgccaccgggtggtacgcagcgacggcaacctgtccggctaccgctggggcgtggagcgcaagcgtcagttgctcgaacgcgagaactcgtccgaggcctgaatgccgatgtacaccgataccgattccggcccggtgtacacctcgaagtccgtggcgaagcgtcggcggacctgcgggttgtcctcgaagtaggcccagaccaggccccaggtctggatcaccacgtcgggcatcggccccttggcggagaacgccaggtactcgccgccctgcacctgcaccaacggatagtcggcattgccttcgcccaccgccacgccggcggtgacgtcgaagtaccccgaggcatcggactcgtagttggagtacaggccatagatgaacgagtccgactgccggtgaccgatgctgtcgaacaagccttcgacaaaaaaccgctcccacatcggcccgatccgcgcgctgtccgcttgttgctcgtcggcattgcaggtacgtacctgcaagcccgagacacagaaaggctgaacctctcgcagtttgacatccatgcttcgtactcctgtctggtgtttatctgggtgaccggcgcgcacggtatcagcgattcacatccaccaccacgcgcccgcgcaactcgccggccagcaggcgcgacgcggcggcgatggcttcgctgaggccgatctcatggctgatcaacggcagcagggccggatccagatcgcgggtcaggcgctgccaggcctcgatccgccgggccttgggctgggtcacactgttgatcccggccagggtcacgccccgcaggatgaagggcgccaccgacgccgggaagtccatgccctgggccagcccgcaggcggccaccgtgccgttggcctgggtgctggcgcaggcattggccagggtatggctgcccaccgagtcgatcaccgccgcccaacgctccttggccaacggcttgcccggcgcggacaggctggcgcggtcgatgatctcactggcgcccaggcgcttgaggtagtcatgctcggaagtgcgcccggtggacgccaccacccgataacccagccgggccagcgaggctatggcaaagctgccgaccccgccattggccccggtgaccagcacctcgccctggcccggggtcaggccatggcgctccagcgccaggatactgagcatcgccgtgtaccccgccgtgccgatggccatggcctcggccgcgctgaacgcctggggcaagggaatcagccagtcgccgtccagccgtgccttctgcgccaggccgccccaatgtccttcgcccacgccccaaccgttgagcagcaccgggtcgccgggctggtagtccgggtggctgctggactcgacaatgcctgccagatcgatccccggcaccatgggaaacttgcgcaccaccgggctgctgccggtgatggccaagccgtccttgaagttcagggtgctgtaggccacccgcaccgtcacgttgccctcgggcaactgctcttcgtcaatctcgcgcagcgccgcgcgataaccggcgtcgtctttctcgatcaaaatacccttgaacatcactgcctcccgatagacccatggccgggccgtgaacttgagtttcaggttacaaagctcccaccttcccagcccggacgggaaaaatccacgctcttttcgtcgtaggccgcccacgccccgctcctgcaagtgatcgtgccaccccagccaaagtcgactggccttgattgcctgtctcctgatacaaaccccgggttgccgtccttatctcttgacgtcggagcatcattcacatgagccaatggcctgacacccgtattctcgacctgctgggcatcgagctgccgatcatccaggcgccgatggccggagcgacctctaccgccatggtgatcgccgccgcccaggcgggtggcctcggctccctgccctgcgccatgctgacggccgagcagatccgccaggatgtccagagcatccgccaggcgacccgcgcgccgctgaacctgaatttcttctgccatcagaacccgatacccgacccggaacgggaaacccgctggaaaaactaccctggaaccctactaccgcgagctcggcgtcgatttcgatgcgccgaccccggtcagcagccgcgcgcccttcgacaccgtcagttgcgaactggtggaagaactgcgcccgcaaatcgtcagcttccacttcggcctgccggcgccggccctgctcgcgcgggtcaaggccaccggggcgaagatcctgtcgtcggccagcaccgtcgatgaagccgtctggctggaacaacacggctgcgatgcgatcatcgccatgggctacgaggccggcggccatcgggcgatcttcctcagcgaagacctcaacactcaggtcggcaccatggccctggtgccgcagatcgtcgatgcggtgcgggtgccggtgattgccgctggcgggatcggcgacgcccgcggcatagtcgcggcctttgccctcggcgcctcggcggtacaactgggcaccgcctacctgttcactccggaagccaaggtcagtgccgcccaccacaaggccctgcgtaccgccaaggagagcgaaaccgccctgaccaacctgttcaccgggcgcccggcgcggggcattctcaaccgggtgatgcgcgacatcggcccgatcagccccctggcgccggccttccccctcgccggtggcgcgctgatgccgctgcgcgccaaggacgacgccgacttcgccagcctctggtccggccaggccttgcgcctcggggtcgaactgccgaccgcggagctgacccgcaccctggccgcccaggccctggccaagctgaccgaccgctaaacccggcacgccgcgactgcggtcgcggcgttttgcgcaaaacctccattggccctcaaggccgcgcgaccttcgcagtttcgttcgctggcgattcgctatatatttccctatacagcgtttcacccacccccggtgccgtccatttccaataccgccaaccgcccaacgtcccttcgccaatggagctgttcatgaaccgtcgtctctcaggttttgccccgacctgccttgccgccctgctcgccgcctgcgccttcggcccggcccaggccgctgaagtgcaggtggcggtcgccgccaacttcaccgcgccaatccaggccatcgccgccgacttcgagaaagacagcgggcacaagctggtggccgcctatggcgctaccgggcagttctatacccagatcaagaacggcgcgccgttcgaagtgttcctcgccgccgacgacagcaccccggaaaaactcgacagcgaaggcgccaccgtcaaaggctcgcgcttcacctacgccatcggcaccctggcgctgtggtcggccaaggctggctacgtcgacagccagggccaggtgctcaaggccaaccagtaccagcacctgtccatcgccaacccgaaagccgcgccttacggcctggccgccacccaggtattggccaggctgggcctgaccgagcaggtcaagggcaagctcgtcgaaggccagaacatcacccaggcctatcagttcgtctccaccggcaacgccgaactgggctttgtcgccttgtcgcagatctacaaagacggcaaagtcagcagcggctcggcctggatagtcccggccgagatgcacgacccgatcaaacaagacgcggtgatcctcgacaagggcaaggacaacccggcggccaaggccctggttgactatctcaagggaccgaaagccgctgccatcatccagtcctacggttaccaacgctaaatgccgctatcgagtgccgacttttccgccatctggctgaccctgcaactggcgtcgctgacgaccctgatcctgctgatcgtcggtacgccgattgcgttatggctgtcgcgcacgcgctcgtggctgcgggggccgatcggcgccatcgtcgccctgcccctggtcctgccgccgacggtgatcggcttttacctgctgctcgccctcggccccaacggctctatcggccagctcacccaggccctcggcctgggtaccctgaccttcagtttcagcggcctggtgatcggctcggtgatctattccatgccctttgtcgtgcagccgctgcagaacgcctttaccgcgatcggcacccgtccgctggaagtggcggcgaccttgcgcgccaatccctgggacaccttcttcagcgtgatcctgccgctggccaggccggggttcattaccgcggccattctcggtttcgcccacaccgtcggcgagttcggcgtggtgctgatgatcggcggcaatattcccgagaagacccgggtggtctcggtgcagatctacgaccatgtcgaagccctggaatacgcccaggcccactggctggccggtgccatgctggtgttctcgttcctggtgttgctggcgctgtactccagccgcaaaccccgcgctggctggagttgaatcgtgagtgcatcgatccatgtgcgcctcaagcgcacctataaagatttcagcctcgacctcgacctgcagctgccaggccgtggcgtcaccgcgttgtacgggcattccggctccggcaagaccacctgcctgcgttgcatcgccggcctggaacaggccgaacagggcctggtgcggatcaacgacgaagtctggcaggacagccagcgccaactgttcgtggcgccgcacaaacgctccctgggttatgtgttccaggaagccagcctgttcgcccacctgtcggtgcaggccaacctggagtttggcctcaagcgcatcccgcgcgcgcagcgtcgtgtggacatggccctggccaccgaattgctgggcatcggccatctgctgcagcgtcacccgcacaacctgtccggcggcgaacgccagcgtgtcggcattgcccgcgcgctgctcaccagcccgcggctgctgctgatggacgaacccctggcggccctcgacagcaaacgcaaaagcgagatcctgccgtacctcgaacgcctgcatgacgagctggaaatcccggtgctgtacgtcagccattcccaggatgaagtggcgcgcctggccgaccatatcgtcctgctggaaaacggccgtgccctggccagcgggccgatcggcgaaaccctggcccgtctcgacctgcccctggccctgggcgacgacgccggggtggtgatcgaaggccaggtcagccactacgacgccggttaccagttgctcgccctgcaactgcccggcagccagttgcgggtgcgggttgcccatgcgccgatggccatcggcaagcacttgcgcttcaaggtccaggcgcgggacgtcagcctcagcctgcaagccggcgagcacagcagcatcctcaaccgcctgccggtgacggtcagcggcgaaatccccgccgacaacaccgcgcatgtcctggtgcgcctggatgtcgccggcaacccgctgctggcacggatcacccgctattcccgcgaccagctggagctgcatccgggccagcaactatgggcgcagatcaaggcggtggccgtgctcgcctgagtccccggcaaatgggttggcacccctgcgccgcgccgcggtcaatcgccagacaggcctgatcgattgattgccaaggattccgccatgcccgatagcccgctgcgccaggacctgccacctgacctgcattacgtcgacgacacccagccggggatcagccgcaagaaagtgcgcggcacgttcgtctatttcgacccgcaaggccagcgtatccgggcgcccgacgaaatccagcggatcaacgccctggccgtgccgccggcttatacccaggtgtggatctgcgccgacccgcgcggtcacctgcaagccaccggccgcgacgcccgcgggcgcaagcagtaccgctaccacccgcgctggcgggaagtgcgcgacgccgacaagtactcgcgcctgctggaattcggcagcgccctgccgcgcctgcgccagcgactggaagccctgctggccacgcccggcttcagccgcgacaaggtcatggccacggtcatcagcctgctcgacgccacgctgattcgcgtcggcaacagccagtacgcccgcgacaaccgctcctacggcctgaccaccctgcgcaaccggcacgtggcaatcaaaggcagctcgatcctcttccagttccgcggcaagagcggcatcgaacaccagatcagcgtcaaggacccacgcctggcgcggatcctcaagcgctgcctggagctgcccggacagaacctgttccagtacctcgacgagaacggcgagcgccacagcgtcagctcctccgacgtcaacgcctacctgcaggagctgaccggtgccgacttcaccgccaaggactaccgcacctgggccggcagcaccctggccctggcggtgctgcgcgagctgcactgggaacccgaggccgaggcgaaaaagcacatcgtcgaaatggtcaaggacgtcgcccggcaactgggcaatacccccgccgtgtgccgcaagtgctacatccatccggcgctgctcgagggcttcgtgcaggggcacctggccgccctgccgaggccgcgcaaacgcaaagggctgcgggccgaggaagtcggcctgaggatgtttctcgagcgcctgacgcagcaggcctgaggcttttggcaatagccgcccgggtaccgccgggttgtcatccgggacgctggcgcgttaggctagccgcccttccccgtcaccggacgactgccgacgtgaacaactaagccttccagaaatgtactcgcgacaagccgccttgcagcgcttgttggcctttttcgacattttccggaggtgctgatgactcacgtcacacggctgcctgcgctggtttccctgaaccagctgaccttccagttcgcccatggcgaaaccctgttcgattcactcgacctgacattcgatgccttgcccaccggcatagtcgggcgcaatggcaccggcaagagcgtgctcgcgcgcctgatcgccggcgaactttcaccgtcctcgggtagcatcacgcgcttcgcccgcgtggcctatgtcgcccaggaacatctggcgcaggaaggccagagcgtcgcccaggtcgtcggcatcgccccggccctggccgccctcgggcgcctcgccgcgggccaggcctcgatggccgatctggcgcaggtcgacgagcgctgggaccttggcgaacgcctgcgccgcctgctggacgacgccggtctcgacagggtcggccccgacgatccggccgcccgcctcagcggcgggcaacgggcgcgtatcgcggtgatcggcgccctgctcagcgatgcccagctgctgatactcgacgaaccgagcaaccacctcgacgagcccggtcgccagtggctgctggcgcagcttcggcagtggcgcggtggactgctgctgatcagccatgaccgccagttgctggcgcagatgcagcgcatcgtcgaactcacgccccagggcgcgcgggtctacggcggcaactacgcggcgttccgcgcccagcgcgaagccgagcacggcgcggcgcgggccgccctggaacacgcccgaaccgaacacagtcgcgaacagaagcgcctgcagcgtgagcacgacactatccagcgccacgccgccggcgcccgacgttatgccgacaccgccaacatcgccagctttgaacggatgaagataaaaggcgccgcccgggacatcatgggccatgtgcgcaaccgccagcagggccacaaggacagcctcgatcagcaggtacgcgacgcctatgcgcggctggtgccgcaggcgccaaccctggtgacgctgcccggcaccgcggtgccccggggacaacaggtgttctgcctgacccaggcgcaactgccctggctgccgcccgaggccgcctccagctacctcgacctgaccgtcaccgggcccatgcgcatcgcggtcagcgggcccaacggctgcggaaaatccaccctgctgaagatgctggccggagaattccagcccttgcgcggccaatgcgaagtgcgggtagccagcgcctgccttgaccagcgcctgtcgctgctcgatccgcagcgttcgatcctcgaccacctgggagccctcgaccggccactgcaggaaggcctgttgcgcagccgcctggccttgctgcaactcgacgcccagcgcgtgacccagccctgtggtcggctcagcggcggcgaacggctcaaggccgcgctggcgattgccctgtggcgcgacacaccggccaagctgctgctcctggacgagccgaccaaccacctggacctggaatcggtggaagccttcgaaagcgcgctgcgcgatttcccgggcgcgatgctggtggtgtcccacgaccgcgagttcctcgccgccatggcgcccagccaccggctgcaatggacgccagccggctggagactggacgaggaaaaccaatgaacaggcttttgcacgaatttcaaagttgcttctatagttgctctgagcagctatcaaccagggaagcgccatggaagacatttttgtcgtaaagcgctgcaacaagatcatcatccagggtcgacgcgccggggaagccgcccacggcgcgccgatcgccgcccactggtaccgcatcgccgacacccgcaccgatggtttcatcggcgatggctacgacctgcaagaggacgccgtgcgcgagtgccgccggctcaatgccgccagccgccgcgcctgaaaccgtggacaaccggggctgcggccactcgctggcgatgatgaaatttctttcactgtgagcccgccaaggcttcgctaaagtggctcacgcttattgaagactcccgactggcccaccgccccccggtgggtcttttttatgggcgatcagcaagggccgggcggcggtctggcagaggatgccaagcataaaaaagccccgcacacaggcggggccggatgacgcgggctagacctcggtcacctgagccggacggcggtgccggtgacaaacaccaccaccatgccgccacggccgctgggcatgctgatctcgtagtccaggccgaccaccgcatccgcgcgcagatcgcgagcgcgctccttgatctcgtcggtcgcctgcacccgggcttctttcagcgcccgctccagggtctgggaacgcccaccgaaaaaatcgcgcatcccggcgaagacatcccgcacgacgttgatcccctgcacggactcggcgcttacgatatccaggtactcggcgatctctcgccccgcgatcgcgtgggtggtagtgataatcacggcattctcctttgaccggcgcgacccggccctgaacccgggcggggtcgcaaaaaaacgcgatggtagcagacctccgcgggtggccatggagagcatgtcgggcgcggttgccgcagcgccctgcaaggcgatgccaagggcgagcctgtccgtgattaaatccgccagcggataaccgcagatcctttcccagttggagtattcacatggatgtcattcagtcgcgagcccccgaacaatgcgcaggcatggaggatatccgccgcgagatcgatcgcctcgaccaggctgtcatcaagctgctgggcgaacgtttccagtacgtcttggccgcgtcgaaattcaagacctcggaaaccgccgtgcgcgcgcccgagcgctttcgcgccatgctcctgcaacgccgggaatgggcccaggccgaaggcctgagcgccgacgccatcgaaaagctctacagcgacctggtgcaacacttcatcgcagaggagctcaagggctggaaatccgcccaggcccagtcgccggcctgagggcaaaagaaaacccgacagccagggaacaagccgggctgccgggcagggtcgtggagggggttatcgggtattggcccctcgcgcagccttcttggctttcgccttgtaggccggcaaggctgccgcgtaggccagggcctcctcccgggtgccaaaggagccaagacggtcgcccttggtgcagacccgccaggggccgctgttgacgctgaccacgtcatagccgttcatgtgcatcttgttcagcattggaacgctcataatcgcctccctttcggtagagatcggccgaggttgtcgcgaacaccttacacccggtccgcgcgggtgggggttccatccatcgccacggggcgggaacgcgcggccggtctttcacttgcgcttcaggtttcccagagggtcatacgcccgggacttgggttctttctccggcctgttgtccctgggcgctttcgccggacctatcgggtccacctgcggatcggccagatccggagagtcagggtcgaagcccagttcgtccttgccggaagcgtgctcggatgaacgcgggcccgttggcctgttcgtactcatggatacctcccgaccacgatggaatgtctttcaatgagagggccattctcatgcagggtgcaaaacagctgacgaatggtaatcgatcaaacagcgttttctgccgtgcttatggcgttttggcaggtctgccggagccgaatcatgagctgcgttatcagcccgtacccaggcctgcgtttcgtcgccctgtcgttgctaggggcatagcgcaagcgcacactggctgcagctgacggatcagctccccctctgcaaaaagcccgcccatgcgggctttttgtctatccgccctccccgcgtcccgtcctttgcgaatacgacccgctgccctcgtcgctcggctttacttcaactgatgcacccaggcgtctcttcatgacgcttaccatcgggagccctgccatgaacaaaacacttatcggcatgaccgttctgctgtcagccgtcgccggctgcaccagcgacgctcatgtctaccgcaatcagccgctggtggcgaaggtcgagaccggcatgacccaggaacaagtccgacagatcggcggcgaaccggtgaccgtcacccctcgcaccgtggaactcggcacctgcttcgactatgtgctgacccaggccggccataaacagccgttcaatgtcagcttcgacggcaacggcaaagtcgatcacaaaagcttcctcacctgcgccgaatggagccacgcccagcagaaagccagggctccaggcagcggcacgggaggcatgggcggtatgggtggcggctattgagctgcgctggccagaattggcggcgattgcggatgggcatggccagatgaaatttctttcactgtgagccgagcgccaggcgggtagattccaccctgctcattcaactattggcccgctccccgcgggcttttttttgccttgcaggggggcctcgaggaaggagccaaagtggcatcgaatggcgggaagaaccgccgaaggcaaattccaggcaaaaaaaagcccaagtagctgatggacacttggggctaaaaatgcataaaccgtggtaggtgaacgcggggctatcttaacgtcccgaagaacatgtaacaatatattttgaggttatttttaccctaagtatcttctaagtccttaaataaccacatgttttttcaggctatggcagattcgtcaccttgttgacgccagcaaaaaagcgccgctgcccttcttttcgcatgactacgtctgcgtgaaccgcttgcctgccatcaggcatacaggatcacgcactccgaaaacgaggaaaactcaccggcttccattggcccgttggcgctgaccaaccttgccgcgaaggacagcctgaaacccggtggcaccgggtattcggcacgcccttcatgacccagaagcacgacttttccctcgctgtccagcagttgaacgcccacattgcgtgcggaaccagcctcttcatagtcattcatcaagatcacaccatcactggtgatgccatcaaagtagacctggaccttgttcgcccccttgagcctgtcttcgttcaactcgacactgaaaaactgcggaaaactgccacccgcctgaagcacaccaaggctcgatgtacccagttcgaccacctgctccacgccgctggagcgccgacgtgaagccccgggaacaccactcgtccccaggccattatcaggatcgatcgtccacgcgggagcggtaaccctggcgcgaaaatcaaagaacttaccaacattttgagtaggcattatttattcctttaattgaatgcgaacatgcgatcggttcagtccggagcagccacccaggccactcttcctgcctgtcgccatgcactttttcaatggacgaaacgcagccggctcgatagtcggtgccagccaaaaaagcgcacacggcgaacgctgaaaccttagaacggcaccaaatcgacgtccctaggacacttccgaaacactccactcaattatcagatcgcgctggaatgttgctggaaaagaggctcggcaaaatcaccgccaaggtggctatccgtacttgagccaacgaaaaacaggaaggcgccggaatcgaaccagcatcaggatgtcggggggagtgccggacgctgtatgtcaggcaaaaagcccggtcttgcaccgggcttgctggtgggccggcccggaatcagtccagggcgtcgtgcagaacttcgtagatgatgcctgtggcgatggcgaccaggatcaagtcagtgccggcctgttgccattcatagccgtcatagtgcggcagccggccgagcatccgcccatcgagttttttcgcgatgcccggcggcagtggtttgcctcgggccaggtttttctggatacccggcggcagggccggcccaggtgaccagtagtcacgactgtcgccaatgatcacgcgaataccgccgacatcgacttgagggccgtcataccgcccgccttgcttgtagtcctgggatttgttgcctttattgccatgtccgccctgattgccctgattgccatgggggttgcccttgccattccctgggtccgcatacaaggcagtcgagccgaataaaaacgcggcgcttgctaaaacagctacaaccgaacgagtcgtcatctctgcagtcctctgcatgaatccagccgtggtgccattcgtcatgacacccgaactatagacagccaattgcgtcttagttcatgcaaacctctccttatctatggaagcgatcatgcttttaaagaaaaaaaatctcgtgactgccgtgacctgtgtactgatgctggcagcggctcctctgctccccatgacgtccgcttatgccaaggacggtggtggccatggtggcggaaatggcggtggcaacggcggggggcatggcggaggtaacagtggtggtcatggtggccaggcaggcggtcactcgggaggggtcagcagcaagggccataacggcggcctgaaaagcgacccagccggcaagtcggttcgcaatcttggagaaaatggcaaccattacggcagcattcgtaatgacagcaacggtcatggctcgaccacttccggcgtggctcattccaaagatacccgcgggctgtcaaaagccaccgcgatctcggacaccacgcccggggaccacaactcgaaaggcctgggcaaagccagtgtctcctcgagcaagaatgatcgatagaccctgcctcatgctctccagctgaatcggtttcaacaccctcggttggtcagcatcgccccgcatgaaaagcccggcccagcgtcgggctttttagtacctgcctccgcccggcggcgccctcttctgtcctcatggctcggacaaagatgaaactatctttaagtaaccttcatgaagcgaagcatctgagtgcctacccttctgggaccgacaaagtgaactacaggagtaacccacgatgttttcccatgaaggtctcggtctgatgtccatcttcattgtcctgctgctgtgcgtgctggcgatgttcattcaccctgtgcacgcactctggagctgggttcaaaggcgtagacgcaggttgtcggtagaaaacgcggggcgtgaaggcaagccctattcttcgcgctgaacaggcccccatccaacgaagcccggccatgtccgggcttctgctttcttgctgctacagaaccgctctggctcagagtcgcgcccttggttggcgccggtcgatcgcaaccgcgatcgccgccagcaggatcgccagggtgtaggcaaagagccccaggttgacgcccaggatcaacttctccgaaccatcggtgagcaccatcgacccaccgtaagactgccgaagcccgtaagccagcaagaagccacccgtgatgaacaccgtcagcaggctggacaggcgaagattgcccttcaaccacaccagccacaggctgaatgcaccgatcgccgtattggtgaacagctgccagacctcatgcaaccgtgcgtgcggctcccaggccgggttgaaaacatgggtctgattgatctccagcaccggtaccacaacggcgtagaagattatcccgatcgtcacgagcagctttgctatcacctggaacctccttgtgagcgcggcaaaacgccagtgcttcagcggcctataaggacacgcaaacgaataaagatcacgttcgatatgcgccaaaagtcaggggaaaatgacggcccgggcacagccaatgggtaccgctcgtccagaccgtggtgccctgtcccgttcctcatctacacctttaaccatggacttccggtcgtattcatccgacctcttcagcgccgctcttggatatggatagagaggatcgggcagccggtattcgattcgatggcacacgaagcgccatgcgaaacagcagtacctcaagcttcgggtttcatttctcaaggaacggaaaaatgatcacgaactgcacgaactggcatgcctggctggacaccatgccacccaaaccggacgagctttatgtagtcggagacgttgaagtcgccaacccagggatcaaggcctatctgacggtacgagtcccgcagggtatcaacccggcaatactcctgctggatctgcacctgtaccaaaggccaggggattggattcaggcaatcacctgcacgcaagtcaggttcacccgggtgctgccgcccaacgccacgctctacagcgcggttgaaatcttccacaacggcgagcgaattgcgtacatcgacaaaatcccacacatctcctgactgatccgtactgaatcagtggagccttgatatccgactgcgaccgcctgatcctcgatcagtcggtcgcctcccccgccgcactcctgcatcttttaatatgtcggctcttgaactggctagcgcctgcttctagcctgcaacccattgtcaggaaaagcacaagagaaatgatcagaagatttgaacagcaagatatggatgccgtgctggacatctggctgcaggcttcgctgaaagcccacgattttatcgacgcctcattctggcagtcgcaagtcgacaacatgcgcaacctgtacctcccggcgtcagagacctatgtcatcgagcgacaatccaaagtgcggggcttctattcgctgcacgacgaccagttggccgccctctttgttgcacctgcattccaggccaaggggattggcaagcaactgctcgcccatgccagggcacagcgtcccgtgttgagcttggcggtgtacaaagacaatacggccagctgcggcttttacctggcacaaggctttgtcgtgacccacgagcagacggatgagcaaacggggcagcaggaataccttatgagcagccccccgctctgatccatgtagcccgtcacggtatatccagccctggctttttattgccctccaaaaaacccaaaagcccagcgtacgagctgggctttgcctggccaaaagctgaatcaatgaggctgacgctgcctctgcaactcggccttcaaccaggcgcttgccggttgcgatccagcagcgcagcgcacctcataggccttgccactcatgctgcttttagtggccgcgaggtcgataaagtcctccgcgctgctcaccatgttcttgccctcgaggtaattcagttttttctccaggtgctgtcgtgcctggggggctggatactcggtgccattacgcacgaactggcattggctgtgctcgacaaagtccagcaaaccctttatctcccgggcagcctgaggcgttgtttgcgcctgcgcgttagtcgccattgccaaggcggtgaaacctgccgccatcagccatcgagcccgttcaccggtaaaaattcgcatcattcgtccttgtcttgaaactgagcattgttgtcggatctggtcgagcattacccggcgccaggtcggtcaaacttcgatagggaaaaccggctgaacgccttgctgcacatccgcctgttctatcgcggcttcaagcttggccaggaaggctggattcaatttggcgtcaagcagattgacctgctctaccgccctcttctgctcaatcatcttggcaagttctgcataagacagtttgggtgccgggttttgaataataatcactgaaacgcttccttggttcatccgtccagcccaccagaggcttggcggcaagtgtatccgctgttccacaccgatccaaactcgcccggccagcacttggacacctgtatccactctcccctttgtcgatacctggcgcctccgagcctcaaatgccacttcgagcgcagccttgagccttgccgcctcagcccgtctttgccacgcagcctgtccatgcccaggcccggcagcgcttctgccccgtcatagaccaatggtgccgccagtcgtcgtcgcagcgttgacgccctatcccttaaggcgcgcaatggccccctaaaaatgatcgcccagggcccctttccagatggcaaagatcatagtgctggccggtgacttcccccagggtgacgcggagtatctgcgcggaaccatcacgctcaaaaccgccaataagccgctgatagggaaaagttttctcgtctccgagttcaaggacctgaccgtcgaaaataccgactcgaacaagaacattaagagcgccataggcctgggaatggttggcgccatgtttctggggcctgtgggtgccgtcgccggctatcttctggcgggccacaataccgaggtgacatttctggccaccttaaaggatggtcagacactgcttgcggcaaccgataacgagacctaccaagacatctcggcacgcttcaacagaaaaaactcacctgaaaaacacgataaaaccgagacttgacgcccgacatcgcaggatgttgcaggccgtgacggggtgaacgtagcactcgggtactcattgaccgtcatatcgaagatcaggcatccagaatgccttgcagattgctgcgttttacccgccagcagaaccctctctttcagccttctccgcagtcggcaactatcgacgcagcctggatgggggattgagtgcagcgcgatttgcgcccgaatggaaaagcaacaaggctgaccggattagccattcacagtcagccttgtcgttgggacagcttcaacccggaaaatggcgaatcaccattggcccgagaagatgcaggtcagtgcttcgatgccgctgaacttccacagcgagtcgttacagtctctggcgaatgcgtgggcgttcgaggcggtgagggccaaaaccactgcggaggcgtagacgattttcttgaatgacatggtgaatctcctttttcgtatcggcactttcttgtgagagccaccccgacgaggatggtcgtccgcactatatgcccggcctcggcagcagacgattagggctggtgtgctaatggcgaatacgcatcacccaaggccgcaggcgagttgcgccaaaacagattagtcattgcagctgtactgatactcgaatggaaaaaacactgtatcgaccaccaaggaaaacggcgcgtcgatcagtaaaaagggaatcagctttccatgggaggtgcctaccaaccaccagtccaggcgcacgcccttgtaggggcaagggtggtcgtagtccatgcgcatcgccactgcggcgcagccgctcaggcaattgaccaacaccagcagaatcactttccgaaacacctaatgtccttattacatccatctgcagagctgcgtagacctctctgcaatacgccaataacttttgcccagtggtaatgacaaaaaatacatccgccagcagaaaggcaagaaagcctctccaactgcgtaaatcgcagaccggatttgaatttgcggaccggaaacgaacaagggtttgcatcagctttcgccagcaaacccttgaaatagatggtgcccgaagccggaatcgaaccggcacgcccttacgagcgggggattttaagtcccatgcgtctaccagtttcgccattcgggcggtagcgcggtgttgcagtctgaaaggcgtgagccgtttcagcgccttgcggcaagggggtgaaatatatacatcccctccctttgaagcaagttcgttggcgtcaaattcaagactgaatatcgagcctgcccataaacaaaaagctccgtaaatcatagatctacagagctgtttctatcggtgggggctacggccggaatcgaaccggcgcagaagaaggctgcatgccactgataaaaacaggccggcaggttagcacactgaaaacatcgtaaccaactgattttaaaagacttgtagctgaatggacgaagccgtcggatcgcctaggtgccgctcccaacgccttccaccgcgcgcgcataagcgaccgtcgccacctctatcagagtcttgcgctcttccccgtcgataatccccttggccttgaagttgtcgacaagccgcagcagttcatcgtactgctcctgcgcatccatccggacctcagggttcgtcagcaagtcatggaaggcggaaaacgcctgcactttcgcgtcatcgtacatggccgactctccaggaatgtgtattcggtagagggcgcaatgcctcaatgggttcgtcgtgtacgacgcacggtgtaacccaactgacttggggatcgtgggatggctaaagctacgggccagcagagccgaagagacaggcctgcggctgcttcagcctgaataggcgcccaccctgaccagctgttggccgttcagcaatccatcgtaaacacacctggccgggcaagcggtctgtagtggtctaatgaaaccggacacccatttaggcgagaatgctcgccagatagaggtgtctgatgaccaagcaacgtcgttccttttccgctgagttcaaacgcgaggccgcaggcctcgtgctcgatcaaggctatagccatatcgaagcctgccgttcactcggggttgtcgagtccgcgttgcgtcgctgggttaatcagcttcagcaggagcgcaccggcgttactccgcagagcaaggcgctgacgcctgaacagcaaaaaatccaggaactggaagctcgaattgctcgccttgagcgggagaaatccattttaaaaaaggctacggcgctcttgatgtcggaagaacacgagcgcacgcgctgattgatcagttgagtgcacaagagccggttgattggctttgcacagtctttgaaatcactcgttcgtgctactacgcccaccgcctcagacgtcgaactccgaacgttgaacgacttcgattacgcagtcgagtcaacgaactgttcacgcaaagtcgcagcgctgccggcagccgcagtatcgtgtcgatgatgcaggaagatggcgagcaaatcgggcggttcaaggtacgtggcttgatgcgagaactggaactagtcagcaaacaacctggctcacatgcctataaacaagcgacggtcgagcgtcctgatattccgaacaccctgaaccgggagtttgaggtatcggtacccaatcaggtctggtgtggcgacatcacctacatctgggcgcaggggaaatggcattacctggcggtcgttctagatctctacgcgcgtcgaattgtgggttgggcgctgtcgaacaagccggatgcggatctggttatcaaggcgttggacatggcttacgaacagcgtggcaggcctcaaggcctgctgttccactcggatcaggggtcgcaatatggaagccgtcagtttcgccaacggctctggcgttaccgcatgcgccagagcatgagccgccggggaaactgctgggataatgcgccgatggaacgcgtgtttcgcagcctgaaaactgaatggataccgactgagggctacatgacaacccaagaagcgcaccgggacatcagccattatttgatgcatcggtacaactggattcgaccacaccaattcaacggcggactagcgccagctcgggccgagaaaaaacttaacgtcgtgtccgggattagttgaccactacaggaccactctatccagagcggccgtgcatgtctcgaagacaattctgaagaaaccggaaacctgggcgtagccggcagaagcacgcgtgcgagtacctcggttgagcggtgatcggacgggctagcgtatcgacgcaagcgttcgaggcggggctggcttgctgcttatccaactcggcgaacagggcactcccttacccgccaagccaataacttgaacgggctgcgatagcgaggcggtggatgggacgccatcaatatagcgagcaggttgcgcaatacctgccaaaagtcgcggaacactcccgattgtgcacgtctatccctgggcccctggggtccgcagtgctttaagaatcgactgatacctgggaaagtccagtgccactagtatgcccaggcatttataaaggcatgcgatgaaagtcccacaatcacccgcattgactaatgaacacgccataagaaagaagcgcaccgatgtctctttcaacactttcgagaaattccatgaacaagtcccttgccatgaatgtggcgtttgccggacttctgtcgttgtttgctctaccctcccatgccggtatctcattgaatggaactcgagtggtactgaccggaccgaagaaagaaacttccatgctggtgctgaacgatgaatcgatgcccatcatgatccagtcctggatcgagcccttcagcacaagctccgatcaggacgtcccctttgccatcacccctcccctgaaacgcctgagcgggaacgcccgacagcagttgcgcattctttatcaaggcatgggactacccgcggacagggagtcgatgttctggttgagcgtgcaggaaatcccccagaagtcgaaggatgaaaacatcctgcagattgccgtgcgccagcgcatcaagttgttttaccggcccgccggtttgccaggtgacattgaccaggccccatccaggttgcaatggcgcatggtgctcaaggagggcaagccgggcctggaaatcaggaatgactcagcgtttcacatctctttcggcacggtgaacatcaagagcggttcaaacaactatccgattcccgcagaaatgctggccccctactccagccaatcattcatgatcgagggggcttcttccctggctccaggcggagcaacaaagatcgagttcgaaagcatcaacgacgatggagtgccagtacaacactcaggcgacatatccagctgagcatagttaaagatcagaattttttgtttgtcgcttaacccggcaccttgttattggctgaatatcacttcttagtgaaatacacacttcgccaatagccttcaccccaaacaaagaaaatcatttccgaacgcatggagcatgggtgcgcaagagcgactcacccacaaaccctattcaaggtcgatgaatcgccccgggtttcgtggaggcctcaactcttgagaagatgaggccatgagaaagactacgacctattcccctgaagtccgtgaacgtgccgtgcgcatggttctggagcacctgaacgactacccgtccgagtgggcggccattgaggccattgccccgaagatcggctgtgcagcgcaaacgttgcatggctggattcgccgtcatccaaccgatgccggtcagcgtccggggccgaccaccgaagagcgcgagcgcatcaaggctctggagcgtgagaaccgcgaactgcgcaaagccaacgagatcctgcgtctggccagtgcgtattttgcccaggcggaactcgaccgccgtaccaagtcctgagggcctttgtcgaccagtaccgtgaccgtctcggggtcgagtcgatctgccgtgttttgcagatcgccccgtccggttaccgcaggcatgcggcccaacagcgagagggcattgggatcgccagatgcacggtggagcggctaatgcggcaggcgggattgcagggtataaggcgcggacaggttgtgcggacgacggtggccagcgacaaatcgctgtgtccactggatcgtgttcaacgccagttccatgccgaccgtccgaaccagctctgggtctcggactttacctatgtctcgacctggcaagggtggctgtacgtggcgttcgtgattgacgtctttgcgcggcgcatcgtcggctggcgagtcagtaccagcatgaagaccgacttcgtactggatgccctggagcaagccctgtatgcccgccagccacaccgtgccgatggactgattcatcacagcgaccgtggcagccagtacgtctctattcgctacaccgagcggctggcagaggcggcattgagccctcggttggcagcaagggtgacagctacgacaatgccttggccgaaaccatcaacgggctgtacaaggccgagctgatttaccgtcaatcatggaagagccgcgaagctgttgagatggcgactttgaaatgggtgcactggtacaaccaccaacgcctgctgagctcaatcggatatatcccgcccgcggaggctgaggcaaacttccaccagcaacaagcaggtcaggccatggcggcctgacttaaacgaaacggcctccacaaaagccggggcgattcagctgtggttcgaggtttataacttccaaagaacaagtagatcagtatagagatggcaatagctgcagcgagaccaacccacccccaactatgaaacgagcgggaaagaagtattggaccatgctcctgccgatcatgtctcaagagtacttcttgtcgaaaaatgcttctgctggacttatcactcatactgcacctttatttttgctatggactccaagcacaatccacggcgctattttttgtggtgtttttttaacactgcatgagcttcggaaaaataagatgggtctcaagatgatcacggaaagatcttgttgtttcttgcgaacccaactacttcagccccatgcatgatcaggggctgatctatacacgtagtcgcgctctgctctgtgtttcctgtagggccggccagtccggggcgcccctgaaaccctgaccctgggttatgccagggtcgagtcaacgcccctcttcgtcacgccctccgcttatccccgccgcccagacaattatcgacattccacccatacaaccactgcaccgcatcatagaactgcgcctggctgcgcccctcccacaggctgttgcgcacgccgcgctcgacgccctgggcatggtagaggtggtgcggggatgcgtaccgattcatacaagtagaagtacggcccgtggcatccgttcaggaccgctcctcgtccagcgccttgtccgacgcgatcggcggctcgatgccccagccgccgtgcaggtaccagtcgtcgccgagcatctcggcggggtgcatggtgcggtccgagccattgccgcaggccggggcattggccgcgcagtagcggtcgcagccccagcagatgcgttcggggtgcttggggctgacgggaaaattcttggccatagcgttccccgggtgcgagtgcaggtgagagtgggaatggctcccaggctacgacgcccacagggaaatgcccttgatcggggtcaagaatgacagacccggggcacccgcctcggcaccccggggctgcctgttacgccgtgaccgccggcgcgtagcgcactgccagcttgcgcaaggcgacgtagaacaccggggtcaggaacaggccgaacagggtcaccccaagcatgccggagaacaccgcgacgccagtggcgcggcggatctcactgcccgcgccgctgccgatcagcaacggcaccgagccggcgatgaacgccaccgaggtcatgacgatcggccgcagacgcaagcggcaagcctccagcgccgcctcgatgatgcccttgccctgcagctccagctcccgggcgaactcgacgatcagaatcgcgttcttgcaggccaggcccatcagcaccaccagccccacctggacgaagacgttgttgtcgccgccgctgagccacacccccgacaaggccgcgagcatgcacaccggcacgatcaggatcaccgccaggggcagcgtccagctctcgtacagggcggcgaggaccaggaacaccagcatcaccgccagcgggaacaccaccgccgcggcatggctctgcgtgacctgctggtagctcaggtcggtccattccagggtgatgccgcggggcaatacccgggcggcgatctcttccagcttggcgatcacctggcccgacgacagctgcttgggatcggagtcgccgatcaggtcggccgccgggtagccgttgtagcgcaccaccggatcggggccgtagctgggcgtcacggcgatcatcgcgccgagcggcaccatctcgccccggtcgttgcgcacccgcaggttgccgatgtcctcggcggtctgccggtaggagctgtcggcctgggccatgacccggtagacccggccgaacaggttgaagtcattgacgtagaccgagcccaggtaggtctgcaaggtattgaacacatcgctcaacgacaccccttgcgccttgaccttgacccggtccacctgcacctccagctgcgggatgttggcctggtaggaactgaccgggtaagtcatgcccggggtctgcgccaccgcggcctggaaggcgctcaaggcattctgcagggcgccgtaacccaggcccgcgcggtcctcgaggtacagcgaataccccgaaccgttgcccagcccctggatcggcggcggcaacagcgcataggcaaaaccttcgtggacctgggacagcttggcgttgagttcggcattgatctccaccgcgccgcgctcacgctggtcgaacggcttgaggatcacgtaggcggccatgacattcggcgtgttgaccgattgcaaggcattcaggccgctgaaggccggcacggtctccacgccctccaccgagagtgccgtctcgatcagctcgcgggtcaccgcatcggtgcgggccagggacgcgccttccggcagcttggcgccggcgaacaggtagagtttgtcctgggtcgggataaaaccgcccggcaccagattgaacatccaggccgtgccgatcagcagcaaggcgtagaggaagaacaccgagccgcgccgccccagggagtaggacaccaggccgtgataaccctcggagcggcgtttgaacatccgattgaaggcgcggaaaaagcccccaaacaccttctggatgccccgctccagccaatcctgcggcgcgccgtggggcctgaacagcttggccgccagggccggcgacagggtcagggagttgatcgccgagatcaccgtggaaatcgcgatggtcaccgcgaactgcttgtagaactggccggtgacgccggagagaaaggccatgggaatgaacaccgcgcacagcaccagggcgatggcgatgatcggcccggacacctccttcatcgcccggtgcgccgcctcccgcgggtcgtagcccttttcgatgaagcgctcgacgttttccaccaccacaatcgcgtcgtcgaccacgatgccgatggccagcaccaggccgaacagggtcagggtgttgatcgaataccccagcaaatacagccaggcgaaggtgccgatcaccgacaccggcaccgcgatcagcgggatgatcgaggcgcgccaggtctgcaggaacaggatcaccaccagcaccaccagcaccacggcttccatcagggtgtgctgcaccgcgctgatggattcccggacgaacaccgtcgggtcccacaccgccttgtaggccacgccttcggggaaatgccgggacagttcgtcgagcttgccgtagaccgcctcggcgacctgcaaggcgttggcccccggcgagaggaaaatccccaccgtcgcctggttgcggtcatccaggtgcgcgcgcagggtgtagtcgcccgcgccaagctcgacccgggccacgtccgacagcttcaccagctgcccgtccgccccgctcttgaggacgatatcggcaaactcctgctcgctgcgcaagcgcccacgcacgctgatcgacaccaggaagtcggcgccctggggcgaaggctcggcgcccagctggccggccgagacctgcacgttctgctcgcggatcgcgttcaccacgtcggccgcggtcagtccccgggccgacaggctgttggggtccatccagatgcgcatcgcgtagtcgcccgaaccgtagaccccgacatcgccgatcccggacagccgcgacagctcgtccttgacgtgcagggtcaggtaattgcgcaggtacagcgagtcgtagctgttgtccggggacagcaggctgacgtacatcagcggcgtcggcgattgcttctgggtggtcacgccatactgccgcacctcttccggcagccgcgacagcgcctggctcacgcggttctgcacgcgcaccgcagcggtgtccggatcgacgccggggacgaacgtgatgctcagcgccaggctgccgttggagccggtgaccgacttcatgtacatgatcccttcgacgccgttgatcgcctcttccaggggcacggcgaccgactcggcgatctccttggggttcgcccccgggtaggtggcgcgcaccaccacgctggtcggcaccacctcggggtattcccccgacggcagcaccgggatggcgatcaggccgagagcgaaaatgatgatcgacaggacgatggcgaagatcggtcggtcgatgaaaaacttggaaaaatccatggccgctcttccttatttcgccaagggtgtctggggcacggtggccgcggcctgctgcggcggcgcggtgatgtccttgggctccaccgccatgcccgggtagaagatcttctgcgccccgttcagcaccacccggtcgccggcggccagcccggcgctgatcacccgcaggccatcgagctggcggcccagggtcacgtccttgcgcagggcctggttttgcgggccgatgacgtacacgtatttgcggtcctggtcggtttgcaccgcgcggtcgtcgatcagcacggcgcgggtctcgctgccgccttcaagacgtacccgggcgaacaggcccgcggtcagccgacgctcggggttgggcagcaccgcgcgcacgcggatggtgccggtggccgggtcgacctggttatccaggaagtcacggtgccggtcagggggaaggtcccgacatcgttggccaggccgacccgcacggtattgctcacccccgggcgctggcccttgcccagcagttcggtgtagcgcagcaggctctgctcgtcggcatcgaaatagacgtacatcgggtcctgggaaacgatgctggtcagcacgctctggtcggcctgggccaggttgccgagggtcagcatggcccggccgacacgcccggaaaacggcgcgcggacctgggtgaagtcgaggttgagctgggccgtggccacctcggcgacggccgcgttcacgtccgccacgccctgggccaaggaggcgctgcgaatgtcgccctcctcccgtgacagcgccgactgcttgaccagggcctggccgcggcggtcctgctcggtggccaggcgcaccgtggcgcgggcccgggccagccgggcctgggcgctggccagcgcctcgcggtaaggacgcggatcgatgacgaacagggtctggcccttttccacctcgtcgccttcgcggaacgccacccggtcgacataaccgctgacccgtggccgcaggtcgaccgcgtcgatcgcactgatgcggccattgaacaggtcccactcacgcaccgcctgcacgctcacggtcgtcacctcgaccaccggcgccgcggcggcgaccggctcacccttttcgtcacagccgcccagcgccaagaggaggcacaacgcgcccaatcgatgggttgaagaacagcctcgaccgactactcggcgaattcgattcatgaacgtggactcccgctgcaccagaggtgttgatttataggcagacggaatataaaagttaaagctaactttaagtaaagcccattcggaggccccatgaaaaagcccagcgaaccgctgctgaccatcaccgaagtggcccggcgcagtggcgtcatggcctcggccctgcgtttctacgagacccgcgggttactccactcgatccgcgtgggcagcggccaccgccgctacccacgctcgatcctcaggcgggtcgcctatatcgtgttcgcccagcgcatcggtttctcgctggatgaaatcatccagcaactgaccggcctgcccatcaacaccgccccggcgggcgcggactggcggcgcctgaccgccacctggaaaacccgggtgcagcaacgcatcgccgaactcgaacggctgaacatgagcctggaggaatgcattggttgcggctgcatgtcgatggaacactgccagctcaacaaccccgaggacatctactcgcgcaacggctgcggcgcccggcgctggctgggggaccagaagatcgcgatccccggcgagccgcaggccgattgatagaggaagtcgcctgccctccccagcggcgaccgttccatccgcgccagcgccttagccgcgcagcacaaacaccgggaacatctcgcgcaggtgctgccacaggtccggtaccagcacctgttgcggcgtgctcggcaattgcgggtcgagcatgcgcgcggtgcgcaccatctgcaccgcgaagcgcttgacccccagggcttgcaggcgctggccgaggagcaacaggcgggccggctgcaacaggtgccagtgcacggtggtgcggcattcgtagtcgacgccgctggccagcagcagctccaggctgcgccagttggccttgccgctgcccggcacgccggtaatcatcgggccgtcttcggccagggccttgacgtcgaagccgacccagtcggcgccggccagcgcccgggcaaaggccgccggcttgatgccggcgctgtgcaggccgatgcgcaaccccatggcgcgcacttcctccatcgccgccggcaaaccgtcctgcagggtcggctcgccgccactgaacaccaccgcgtccagcaggtcctggcggcgttgcaggaaactcaggacccggcaccagtccagctcctcgctgccgcgcggcgggatcagttgcgggttgtggcagtagcgacaacgccaggcgcagccctgacagaacagcacgcaggcgagcagccccgggtagtcgagagtggtcaggggcagcatgcccccgacccgcatctttcggctcatgggcgccctgccgcggtcgcctgttcggtgacgtgcaggctgcacacctcgaagaaccgcgtgccgataagaccgaaggccgcccgcaaatgggtgaccggtaacctggggtcgatcattgcccttctccttgcttgctctgcgctcaccccgggtgcccgtcgacccgcgcccgcagcagcatcggcccgtagcgccagacgtacagggcaaaggccagggcccagcacaggcccgccagccacaacgccgccaccggcagccagagcaccagcagcacccggctgaggcaggccagattgagcaggatgaacgccagggtcatccctgctggcggctccagcggccgcccggtgtggcccaggctgacccgggcgatcatcgccaggatcaacccggccatggcgccgatggtcaggccgtgcacggccaggctggggttcaggggcgcgccgaaatgccacagcgccatgcccaggcacgccagcgccagccagccgtaggccaggtgcagcgaccacagcagcggcacgcgccacagcccgcggtcctgccagcgccacaaccgcagcagatgcgcggccgccagcagcaggaacagcgcgccaacccaggtattggcgatgagcgccggcccggcggcatacagcagcgccaccagggccgagcccgccagcagcagataatcgagccatggccagggcgccacggccgcggcccgaccgaggccgcgctgggtgaaaaacggaatcacccgcccgccgatcaggctcatcatcgccgctaccagccacaggccgctcagcacgccctggcgctgccagccttcgtggccttgcagcaggccggccaccgacaggccgtccgccgcggcgagcaacagcagcaccaggacaatcgggtagttgcgctgttggcgcaccttccacagcatgcggcccatcaacccggccaacgccaggggaaaccccagttccagcacggccagcaacggccagggcgcgctgcccagccaggccaggcgcgcggccagccagagcaaggccaggaccgccagcggctggccgctcaggcccggctggccggtccaggtctgcgccgcggtcaacaggaagccggcgatgatcgccaggccgaaaccgaacagcagttcgtggcggtgccagcccagccagcctcccgccggttgccagtcgcccagggcgccctgcagcgccgtcagccacagcggcaccaccagcagcgccaggacacaaccggcgaggaaaaatggccggaaggccaggcgtaacagcggcacgatcgccagcgccgcacgacgctcaagtacttgcatcaagcccactcctttacccagcgtgcgacccggcgacggtcgacacgcggcgaatgaaatccccggccatcatcggccattggcgcgcccttgccgttgtcgcccatcaagcttgcccgggatgcggcgggcggttgtgcccgccgtcctttccagcagtgcaagggccgtgccccggggcccgatcaccaccaggaacggccataggccggcgggccggggtggcggccgacgcggtgccgaggctcgccttacagcgcgagggtcaaaatgaccattcgctagtcatttgcacccgaaatcgccaagtccttttgactacgcctttggcattccccctgcaatcaacgctcgcaatcgggctccacgcactcgcaacctgaggcttgccccggactgtccagatcctcctcgaacagctggcagatgctgtccacttccagccggccggcgggcaggatgctgatgaagcgctccgaaagctccaccaggccgttccaactcagctgttgcaggcgcagccaggcggacgcgaagtactggcggaagatcagcccgtagcggctttcgatggccaggatgtccagctccaggtcgcacgccaggcgctccatgaccaattgccggacctggtcgccggcctcgcagcgccagccgcgacgggtcgccagctggcccaggtccagctgttgcagatagtcgtcgagcagctcgctgttctgcgtatacagctcgtcgaactggctgatggcgcccaggccgaagcccacatggtcgcaataaccgtggcaggtaaacccctggcagttgcggcgcagccggccacgctcctgggccatcatcaggtcgtcgtcggggcgcacgaactggcccaggccgatgtactgataacccgccgccagcaggcgctcgaaacagatgcgccgcatcgtctccttggcctcctggctgcaggctgccgcggggcgctcctggctctggcgccggtagcgcaacggtggctgggcatagtcgaacacctgcaggcggtcgggctccagctcgatcagggtgccgagcttcgaggcgaaactcgaaggggtctgccaggcatggccgtagcccaggtcgacattcaccgagcgataaccgaaggtccgcgccgcatcgatcagcgaatggatgggcgccgggtcctggtagcaggccaccgacagctggctgtcgctgccaatatccggcaccccgatattgacctggttgaacccctgctcgcgcagcaggcccatggtcgcccagtcggtggggtgcaggtcgacgtcgatgccgtagtcgccgcaatcgtgatcgaggaagtgaaagcgctggcgcaggtgctgcatcaagcgttgcagttgcgccgcctccggggtgccgccgcccaggtggaactgttcgatgcgctgctccggcgccaggtggcaacccaccaggtcgatctcccgctccagccgccgcaggtagcttgcgccagcgtccaccggcgtgcccgccaggcgcggcgggaactgcacgttcaaggacagcggccgacgcttctgccggctgttgcgcaatgcccgcagcaggtccagggagccgatgccgccgtgaaagcggcgggtgtcgacatggccgttgggatcgagcacgccttgatcgcgtcgaacgaccggctcgctgcggtgcggcagtagatcaggcatgacagggctccatggctggcggtggagggccagtgtccggcgttaacgcccggggctccttgacttgcatcaagcgtggggcgccgccggcctaccagttcaggtagaacatgcccttggccagcagcacgatcagcagcatatggccgaacaggctgtgatggataaagcgcgaatagcgggcattcatgcgcccgccccggaacagcagcatggccgccaggaagtgcccgagcacgctggcggccagcaggatcttcagcagcagcaaggtaccgaacgacgacgccaagggcgccgccagcaccggcaggtaacgcacccagaccatgcccagcccggcgccgaacagcaccagcagcacccagggcatcaactggcgggcacgccgggcgatgccctgttcgagcagcaccatgagcttggcgggcagttgctggcggatgtgttccaggaacagcacctcgaagaacactgtgccgatgaagaccagcgcggcgagcaggtgcagggtgagcagcagcggatagatcatgggccctccgaatcagagttgcgcggcctgggccagcgcctcaaccgccggtcaccgtgggaaagaacgccacctcgatgggctcggaccaggcggaatcgccccggcctcgcacgttgccgcgagactactgcgccgccccgctcgcgcggttgacgtcaatcaagaaagccacaagtccccgagggggtcgtcatcaccccattcactgtgtaaggcctaaagagcgaccgcccccatgatccgccgcttcaatcgcgataacccgcaagccgcaggtagcgttcgccttccgattgcagctgcgcatcgctcgccgccaactgggcctgagcttcggccaggtttttccggcaaccatcccagcggcaatcaggcagctgtttgctcagtgaattgggcgacacattcgcggcgctcgcctccagtcgctcgccattgctccagtccatccgccactcagtgccgggcagcgggggctcattgttgtaatgcaattgcccgcggtagcgcatcagcttgcctgcgaagaacagccaggtttcgcgcttgaccggcacgtgcccctcgatcgtccgctcggcgcccgcttcggccagcagctccacctgcgcgaggggaccgctttgggtcagatgcaaccacacgcccttgggcgcgttgtagtgcttcaagccgtaccagcgcggtgtgctatccggcatcacgacggtgctgatgcgttccttggcactatacgaatagagtcgtctgggaaactgattgagcttgacggcagccggcacgcggccggtcctggcccagtccggcgacgcctcaagccgttcctgcaggtccaggctcaagtgccccggccatgccatctgtcgcacgctgccgtccggcgccttcaggttggcacgcaaggtcgtcaccgccataggatcgccagggtggctatctccccctggcgttctgacggcgagatccaccatctgataaccgggtacatcctgcttcgggaagaccagcgcaatactcaggggttgcttgcgtcgcttggagaatccccgccgtgcctcccacgacaaatcgcgggcccagtttgtaaacaagggctcgcgccacagcgcctccgccggtgcgcgcaattcggcatggctgaagctgtaatgctcggcaggtgtttcgggcaactcgaagcgcagctttagcggctgccccgcactgccctgcaacacctgtgcgcgaaccgtcacttggcgccgcaccggcaagctttccatctcgaaacgaggcgccgggacacaggcggtaccgaccatgcaggtgaacagttgcaagctgggccgcgtcttctgcgtcttgcccttgctaccgatagaggggaagtaataggcaacgagctcggcccccgtccatacttgcggccacaatcgcgcctgggtcgattcatcgaggtaggcaatggagctgtcggccagttcgacctccaatgacagcgacgccgcctgcaggggcgcaacagacgaggccaccagcaatgcagcggtcgcgatggcgcgccgcagggtctctctgctagccggattggcgaaaaacaggattgtttgaatgagcattctccctccatggaaatgaaacgacacatcgatacagcaccactcagggagcagcaatgaccagcatcatggaccccaccttgcgcggaaccggcaggatcaccggcgcgttcttcaacccggcgggggatatcgccgccgtggtctcggagtttgcattgctggtcaatccgcccgcgcgggcggcctatggcggcaccggcttgcgttatcggctcggcctgtaccgacgtggcgagccgttgccgttcgccatcttcgacgaactgtgcctgccgatcaacgatgtgggtttccaccccaccctgccgcgcctcgtgatcggcgccggccgctatgacggcggctacctgttcgaaggcgagctggcgttgtggaactggcagaccggccagagccgccgcccttttgccgatactcccgaggtggtgcgctgccgctacgacgccagcggcgagcggatcgacgcctggatgcggccatggaacgaagaatgggacgggctggacgacagcgactggtcggtgatcctcgacaccctgttcctggtgcaggccgatgacagcgaggcagcctgggctgggcaaacgcccgcggtgctggaactggacccggccgcgaccgtcgatgcctcggggcatgtcgcggctgaccagcgcccaccgaccgtgcgcctggcccactggctgggtgtgcccgagctggcatgccggggcgcgatccgcgatatcgcctggctcggcccggatcggataggcgtcacccatgacgactgcctgctggatatctacagcacggacggcagccggctcgcccaccatggcggttcgggctacggcgccgagatcctgcgcggggccggcgtgcatgtgcacggggtgctggtgcaggacgggcccgaggcctatcgacgggattcccgtttgtatcggctgacggaaaacggcctggtcctggtgcaggaatacgacgatgaatacaccttttcggccgccagcgatggccgcctgctggggcggcgcaaccgcctgagagggcccggttcgaaggccgtcgacgtcctgctcgacccgactcgcgacagtgcccagcccgtcgatgtcggccactacgactgcttcaaccactacatcggcatcagcggcgcgccccatctgttcgcgctccagggcacgccggccagctcccatgaacacaagtacctgtgcatcgtccagcccgacggggccgtgcaaagactctggccgctgctcaagcaggacggcacccgggccagccacgccatggaatgccgcggcgcttatgtggcggatgccatgggcgcgggcgtggttatcgccggccagcactacaacccttcggtcggcgatgcgtaccagggcttcatctaccgccggcacctggagcgcggccaggaactgtggcggcatcccaccccggcatcgcccagcgcgatcgtccacctgcccgaagccggcctggtggcggcggctttcctggacgggacgctcatgctgatcgacgcccgcagcgggcagctacgcctgaacgccaaggcgcggatcgacggcttgccgaccctcatccacgccatggacgcccgcgacggactgctggcgctgggcactgtggatggccggattgccgtgaagccggtcgaagcgttgctgggtgcggggagcgatcagccctgggtagagattggctgagtcacaccgctcccccaaggcctgcacgcccaggtaaaaaaccgattcgctgggcgcggcaggctgaggttttcagatcaggaagtgcttcttcgcagtaccgaaagagcccgcccaaggtgaattgcgggcactgcgtaatccagaaatcatttattcgcatgcgcttacttttgtgaaaaccacactttgacttttcgtttaaccgggagcgcaaacagatgagtaaatatgcaaaaaaaagcaatccacccgataaatggatgttctgaaactatctcgggccgatgccccaagaacagaaagtcatcattctgaagaatgtccatgtaaggcacgacaaaaagaccattgaacaccaaacaaaaataaaatctggcgtaattcaaatcgccaccagagaggcgcaccttcagaaagtaggcaacactaatgccacaggcggccaaaacaggaaaaacccacaaaatcattttccggattctcggtacacctgctttcctgtctggaagtcggtatatatttcaaaccccatcgcgcctgcccccatgtttttataggatcgtacatagtctgctctgacatatctaaacaagcgccaggcatctggttttaatacatatcgaccaagagcatacgtagacagccctaagtcggctgaaccatagactatatttccttcgcggcccccgtaacccaacgccttggctgctgcttgataccccttcctgactggaccttctgtatcaatgcggtcctctaaaagattacgcccgttttcataaacgttatttgctccatgggccatcatcggcacacccgccacaaggcacagcgtaccggccgagccgtagcagatccctgcgcctgttacaatttgcattgccccagcgatggtaccagcacctttcttggcgatttcccaggactgactgagcaaactgctctgttcgttttttatatccgtcagaccctgttcaggactttttttgccctgtgctacgtcattaacaatgctggttgcgtaataagaaacctcacgattgaactgcaagcgcagagtgccatctttaatgtgtcgcgcacctagcgtgcaggcttgattcgccaggcttcctgcggccttgcttaccatccaataatcacagctgcctggcgtgcaactctcccttaatggtcccactcgttactcccccacgagctgtgcccgctagttcctgctacgtgatgcgtccaagtaatatcgcgatagcgaatcgcaagatgttcttgaggctcagcgtcgttctgcaagacaatgtgaggcatctcaacggtcaggtcggcaataattccaccgctaatttctaccgtgtaaaatttctcctgataaccaaatgaagaaattcggtagaaactaattgaacaggttatttcctctctgtttgagagcgcttgagcaagcaagggagatgacttgtcaatattttttgtgacggtaatcgggctgtgcgttggcttattgatattgccaatattgatcatgttgtggctgtaagacagcaccatgatttcgtcggtatgcgccgcctggcatttgttgccgatggagtcctgggttgagcagcccgcagaaatcagtccttgggccttgccggttatggtcatgtaaccgtgattagccatacgtgaccctccttttagtcagctggccatcctattaaaagaagttacaagcgtgttgtagggaatttccgaaagttgtgcagtccccaagtcgcccatcggcgatgtgctgctgggtggaaatcggctgagccggccgcagacaaaaacgccactcccgggagtggcgttttttattggctgagcgactcagaactgcgccttgagggtcatggtgaagttacgcggatcgccgtagtagttgccgaaggtctcggtgccgatggtggcgtagtagcgcttgtcgaacaggttgttgccgttgagcgccagcgaccaggtgtcgtcgatgcggtagccgatgcggccgttccacaccgcgtagccggcctgggtgattttttcgccggtggccggcgagacccggaagttgtcgctttgcgcgttgaccccggcgccgatgctgaagcgctcgaacgcgccatcgagggcatagtcgccccacaggcgcagcacatggcgcggcacatagctgttgaacgcggcgccattgagcccgctgtcgatgtcgtccagggtcttggtctgggtataggtgtagccggccagcagctgcaggcgctcgatgacctcgccgctgacttcggcttcgaagccctgggcgcggaccttgccggagttcaggtagcagtagccgtccgatgacgcacagctggagttgtagtcggtctgcgcctggtccttctgcacggtctggaacaggttgaaggagctgttcaggcgcccttcgaaccattcgcccttgatccccagctcgtaactttcccccaccagcggcttgagcgccgagccgctttccgagcggtagttgccttggggcgtgaagatctccgcgtagctggcataggcggtcaggttgtcgttgaggtccagcaacaggccggcaaagggcgtgacctgcccggtctcggtgctcctggcgtgctccgaggtgcccgagctgaggaacaccgaatcgcttttcgagcggtaccagctcacccggccgccgacgacgaaggtcaggggttccgccagcttgagccgcagggtcgagtacaggccgcgctgctcggtgacggtcttcaccgggccaccgcgggtcgagttctcgatgaagtagttgtcgtccggttccgggatatgccggtccgggttgaacacgttctgccgctgcggcagcaaggctaccgagaagaaatcgtccttgttcgcgcgactgccgttgacccccaccaccagctcatgctgcaggccgaacgcgctgaatttgccatccaggtaggcatcgaggccgtaatcgacctggtcgtagtcgtacatgctgccgagcatgccagtggtgtcgacgccgggggtcaccgagccggaggcgaaggtgtatttgatgtcctgggtgttcttggtgtagacgccggcgaccttcagcgcccagtcgtcgttgagctggtgcttgaggtcgctgaacaccgtggtgcgcttgctgcgccaggtgttccaggacggatcgaggcaggtcgagcgactgagtttcaggtcgctgccgtccttgtagcgcggcaggccgccccagcacgggttggcgtcgacgtcttcataggcgatgcccaggccgagggtggtgtcggggctcaggtcgaagtcgagcgcaccgtaatacacctggtccttgcgactggcgtcgtcgatgaagtaacgccggctctgctcggccaccaccgcgcggccacgcagggtgccggactcgttgagcgggccgccggtgtcgacctggccgcggtaattgtcccaactgccaccggacaaggtgacttcggtctgcggcgtgctctggccacgcttgcgcacgaagttcaccccgccggcagtgccgcccgcgcctttcatcatcccggcggcgccacggaggatttccacccggtcgtaataggccatgtcgccgctgaagctgtcggcctggacatagaggttgcccatgtccagcggcacaccgtcgtactgatactggcccgacatgcgaaagccgcgggagtagaaatacttgccgcccatggtcgagtcgtagacggtgatgcccggggtcttttccatgacctggtcgatgctgtgcaggttctggtcgtcgagcatcttgcgggtcatcaccgtcaccgactgcggggtctcgcgcagcgagtgctggcccttgccgatggtcaccgccccggtggtgtaggagccgctgccctcggtggtcgcccccagcaattggccgtcgatgttggtggcgcccagttccagcgccgagccgagcaccggcaccgcgcgcagcacatagctgccgttggcctggggctcggcgcgcaggccgctgccgcgcagaatccgcgcgaaaccttcgtcgaccccgaactggcccttgagtccgggcgattgccggccctgggtttgctgcgcatcaaaggaaatcgccgccccggcggcgctggaaaaacgggtcagcacatccaccaggctgccggcgccgatgtcgtaggcacggacctggctctgctgcgccgcggcccctgtggccgggtcggcattcgccgaacaggcgctggccatggtggttgccagcaaagcgactttcactgcgttcgccagacgacctggcgcgttcacccgagacatgctccctcccccaaaacggtcaatgacaactcactgagggatgagccgaacggtgcggtcgaaaagtgcaggcgccgcagaactttttatccaaggcgcctgttcagcgcgaatcggcccgggcgacctggacccagaaacggctgtagcgggtcacgcgcaaggcaaacccactctccagcgccgccagggcgaggtcggtgtcatcgatgggaaagaccccggagactttcaggtcgccgatggccgggtcccaacgcagcacgccggggcgatagcgcgacaggtcgttgagcagcgccgccaagggccggtcgatggcgatgatgctgccctgctgccaggcgcccaccgagacatcgttgccccgtggcgtgcccaggctccgctcgtcgaacgccaaccgcttgccggcctcaacccgcagcgccgaaccgccgcccggcacgctgacctccaccgccttttccagcaccgccacctcgccgcccccgggctggctgcgcacgataaaacgcgtgcccaacgccagcacctcggcgtggcgggtgaccaccttgaagggccgctgcaatggatcaggcgcggtgctcaccaggatctcgccccacagcagctccagcacccgctggcgcccatcgaagcgcaggttgaccgaggtgtcggtgttgagcagcaggctgctgccgtccgccaggcgcaattcgcggcgctcacccacccgggtgcggtagtcgcacatcaggttctgcgcggcctggctacgccagcccagccagcccagggaaccggcgcaggtcagcagcaaggcgctgcgcagcacctggcgtcgggagcgattgccggcctggctcaaggtcggcgccgccagggcgcccggcacgctggccatctgctcggccacggcggccattctctgccaggcctggcgattcagtggatcggccgccagccagctgtcccaggcggcccggtcggcgtcggtcgcggtgccggaatgcaggcgggcataccagcgcgcggcgacaccgatagctttcatttcttcggcgggcaggctcatgggagttgcaactggatctgcatcagacagcaatgctccatggccttggccatgtggttgttcaccgtgcgcacgctgacgcccagttgctcggcgatttgcgggtaggtcaggccactgaactgcgacaggataaaggtctgcttgacccgcggccccaacccttgcagcaggcggtcgatctccatcaacgcctggaacaggatcgcctgttcctccggcgacggctgcagggcttcgggcatggcggccagcacgtcaaggtaggcctgctccagcgagcgccggcgaaacaggtcgatcagcaggcccttggcaatcatcgacaggtacgagcgcggctcgcggatatccagcgcggagcgggccttgatcacccggacgaaggtgtcctgggccaggtccgcggcatcgaaggcgttgcccaggcgcttgcgcagccagccctggagccaaccgtgatggtcacaatacagatcgttgacagcactgcgtaaggacaagtcgttggcgggcatgacgatggaataattcgcgactgataatgactcgcattgtcatgtacaccttcgcggcttgcaacaaatacctgtgggcgcagctcccggcgtgttggagcgacaaccctccccttcgatcttgggctgtttgtccttgatcgcgatgcggaaccgccatgatggctaacccgcgcgatcgctcgcctgggcaaaggcctgccccagggtctgagcgaaacgcttgaggtgagcgaagttgaagttggcgtcgcgataggcacccgggtagcgccaggcgccggtgtggatactgaccggacgatggcggcaagcgttcacggcgggctcagccttcaaaggtaactgaggacaaaggtcagggtgccgtcggccttgccaccggaaaccttattggcaacctgaatataccgggccgccaacttcaacgaattgatcccgccactggccagccccatcatctgcggctgccccagaagcattggcgtgtggtttgccatggaagcattgagtacctggatgccgacccctgtcgccgactgagccgaagacgccaacctgatagtccccgggtagccaccgacctgatgggtgctatccagggtcaggttgaccctggcccccgcatcgcagcgcaggtcgatcgaaaagctcttctcctgcacggcagtgcccgggccacgaaaactgttcgcatcgacccggcccatcttcaccaggatgctgttctccatcacgaagcaggacgacaccgccacattgacctggggaaaagtgaaggtgttgagcttcttgtcatacaggccacccaggacagagtcagggctgctcatcaccgagaagtctggaaatcgaaaactccctcccgccacatcccccagcttgatcaactcgaaggtgtgttggagcgcgtaatatttatcccctcccagatagggaaaggcgacgccagccatgggactggtgctgttgaggtcggtactgctgaacgaatagtttcccgtgggtgccgacagggtccacctcaatccgatcccactgttgctcgtcctgaatgccccacgactgaccccaaccgccgcattggaagacgacttgaagtattgggcatagcccccggttggaaagaagcggttattacatcgaataggggtcttgacctccacggtggccagtacgccgccaaccgggacgtcccgttgcacaaccagcgagctggaaaaaggaacactgataacagcgggccctaaaggaaggcagacatcggaaagggccgcgaccgagtacggggaaaacacgctaccagccgctgcaagccagacagtccagacactgagaccacgaatactgaacaagaaatttccctcgggaattgaacgacttgtgcggcaacgctacatagaagtttcaacagtctaaataagatatttcccaataaattgatctattttccatggccaactgaagattcttacccatgaaaatgatgaaatatccttaagacaacctctgtatatggcagcttgctcaacagatttttccgcatcgaccgatgcgaactttccataactgatcctcaagcgagcttgcccctggtcggccttgaggcagccacacgcccccaaacgccagggccctgtttgcgaagccttgcgccctccccgtcaggccctacccgatataggcaaccttggcagtagaacgcgccgctgtagccgtagggcgagaaggagctgtacgccaggtgccgcagctgaaggcgttgaccttctccggatacgggtcggtgacgttgtcgccaccgggggtgaacagccagtgccgcagtgcgataaaaaaacgccgcctccttgcgggggcagcgttttttatggcctgcggttcaggttcagaagtcgaggctgacgccaacgttgatgccttgctgggtgaagtcatcgtccttgcggatgttgtagctggcgcgcaaggccaggtcctgggtgagcttgtggctgaccccgaggttcaggcggttgaggttggtctgcggggtatagccttcgagggtgtagcggttatccggcaggctgttgagggccatggtcagcttctgggtatcgtcctcgtattccttttcgtgggcgatttcgccgaacacctgggtttgccgggtgatctggtacttgccctgcagaccgatgcccaggcgccgcgacgtgcgtttctggtcatcgaaggtcagcgccgtggagtcgttgccgtcctcggagtaaccgtcgaccttggcccgcgcgtagtcggcgctgatgaacggcgacaggtgccacgggctgctggcctgctgcgcgatgtcgtagcccaggcgagcgctgaaggccaggacgtcgccgctggtatcgcctttttccccgcgctcattgggccccagggcgaatttgcgcttgaggttgtcgtagtccaggtgcccggcggtggctgccgcgtcggcccaccagcggttttgctggtactggacgaaggcggtgcccaggtaggtgttgagtttgtagtccgagtcgttgttgcccgcctcgagcttctgccgataggcgccggccagcacgccgactcgccaggcctcatcgagccggtagctgccgccgatgttcaggttgaaaccgttgccgtcggcgctggcgccgctgcgctggctgtcgaagtcctggtgctggccgcccgcggcgacaatcgcccgccattgccccacgccctgccagttttcccagtcggcctgccattggttgcgcagctcatcctgatgcgcgcgcagggtgccctgggccatttccgggagcagggttatttcccagggcgccgccagcaaggagtaagcgtaatcggcgatcagccgctggccggcttcggtggggtggaccgcgtcgttgtagatcagcttgctcgggtccggcgtggcgctgtgaatgccatagcgggcgttttccgtgcagccattgccactgaagcaggtggcggtgaggttctggtcggtggccaggccgaactgtgccgggttggcgaagctttccttcaacagcacaggaatattgaggggaatgacttcggcatcgaccgtctgcagctgtcggaccagttcggtattgaattgggcactgagctgggaagtgaacccttgcaacgggctgccgttgattaccggggtcaggccgatgtccggcagcagccagaccatgatgtagcgggcgccggcctgttgcagggtttgcacgctgtcgaccaggcggccggccgcggcgttggcctggtcaaggctggtgacgcggccctggaggaagtcgttgccaccgcccgagaggtaatagagggcattcgggtcggcgcggaaatcgttggccagcagatagccggggcggctacggctgccggcggtcgaggtggtggtaatcgaatcgaggatctggtcggtgcgataaccgccgactgcccagttgttgccatcaggcaagccttcgctggcgcgggtcgccgaggtcgacgcggcgagctgggcgtccgagaagcccagtttggcccccagcagttgcgtcgagttggcggagcggacttccccgctaccatccaggtagaccggcccggtacggttggtaaagcgctgggtcgcgcccgcgggaccgccgggatcggcgaattgcccggcatcgctgaggctatcgccgaacacgacaaagttggaatagggagagggagttgcgatcgcttgcgcgcaggccagggacaaaaggctgctggcgagcggtacgaacaacgtctttttaatcatgaacaagtccatttttttgttgtagaaaacgaaacgacagtaccgaaaacttttgcgctttaactatggctatgggccacatcgtctgaatgggacaatccctcgatgcggctgatgattgataggtcgtaagcgttgcctaacggctgatcatgtcggtacccattactgggcccgttgcatttcatctttcttgttcggccggatgaccatgttgacccgtgggcgcgactcggtgatctggctaccggtggcgcgaccgacactggcgatctgcttgacggtgtcgtagacaattttctcacccaaggtggtattgcctgcgctgatcactttggctctgtcgatcaggatgatgcggttctgctgggtcagatattgaatggtcacggcatatgcctggaccggttgagggtctgtcgctttttgcaattgttcgaagtaggccaggttgcccacggaggtaacgacatcgacctcgttatgactgccctttttcatgacgatagtcacagtgtcgccggtgatcttcatcgaaccctgggtaatgatgacgttgccggtataagtagcaaaaccttgcttgttatcaatctgactgcggtcggcctgaactcgaatgagttgctcactgtcgttcggcagcccccaggcgttcatgcttcccagtgcgatgcccaggccaagcaaaatagggaaggtcttaacgaacctcatgctgtccactcaatcaccccttgaaagcgccactgattcgagccgccacaatgcacgatcttggtctcgtaaaaaatgagggaatggagattcagattgttctgaagagcgctggacagcagcaggtagcagccagcgcctgcgtctataccgaatgggccgaaagcgacttgaacaaggcggctggcgctcactgaggcaaaggccctccgagctgggcccgattgtcccgtgccccctccggtcaccacaaaacgtcgggctggagtagctttttttgctgaccagggatggccgaatgaatctcgcgggagaaccttcagcgacacttcgtaaataacgaaccatggctcaggaataatcgatttttcttcacggcgatctccccactagcatgaaccgttggctccagcacacgcccagaccgggagaacggcatgcagtccctgcacatcggcgaaccctggatgtggttcgccttcatcgccttcgttctggccatgctggccctggacctatttgtcctcggcggacgcaaggcccatcgcgtatcggtacgcgaagcgtcgtgctgggtgattgcctggtccacgctggcgctggccttcgcgggcttgctctggtggtatctgcaaggcgagttcgggccagagatcgcccaacgcaagcccctggaattccttaccggctatctgatcgagcagtcgttgtcgatcgacaacatgttcatcttcgtgatgattttcggctactttgccgtgcccccggagttgcagcgccgggtgttgctgtacggtgtgctcggagcgatcgtgatgcgcgcagcgatgattttcgccggcgtgtggctggtgtcgcagttcgcgtggctgctgtatgcgttcggcgtgttcctgatcatcaccgggatcaagatgctgctgttcgcccatcggcagcccgacctcgccaggaaccccctgttgcgctggatacagggccatctgcggatcaccagcggctttcatgacgagcattttttcgtcaagcaggacggtcggcgctgggccacgccgatgttcctggtgctggtgctgatcgaggccagcgacctgatgttcgcggtcgacagcatcccggcgatcttcgccatcaccaccgacccgttcattgtgttcacctcgaacatcttcgcgatcatgggcctgcgcgccctgtacttcctgctggccgacatggccgagcgcttccacctgctcaagtacggcctggcgatagtgctggtgttcatcggcaccaagatgacgctgatgccctggctgcacatgccggtggaatggtcgctggccgtggtcggcggaatcattctggcttcggtgctgctgagcctgatcaacagtcgcgacaaatcgcctgacgaggaccggatgcgaaccccgtaggagcgcctgggcggcgcgctggcgatccggcccctgcccccctggagcgcagcggcgggcgactatcaggacggctggcgcgcgaagagaccttcgccggcttcaagggccagtggcaacccatgccgtggtacttgcgactcagtaactgaaatcgtgccccagctcgcgttgcatccactccaggaatcgcctcacccgagggaagttcgaatgcgcccggggaaacaccaggtgatgggccgcgatgggcgtgctcaggtgtggcgcgacctccaccaggtccccgcgcgccaggtagtcccgcgccagcaaggtgctttccaaggcgaagccgagcccgtggctggccgcctccagggtcatgtaggagcggtcgaaactcagggtgtagggcttctcggggcgcgacacaccgtgctgggcaaacagctgcggccacttgaccagcgtggcttccgaaaggatcaactggctgtcgagcaggtccgccaccacgcggatcgggcgctttgccaggagcttgggcgacgccatgaccgcgatcttttcattgcgcaccgtgcgcacttcgaagctgggccaattgggcaaaccatggcgaatgtccacgtcgatcttgtcccgactgaagtgcagggattcataggagcacgacaggttgagctggatatccgggtggctctggcgaaactgttccagccgcggcatcaaccacaacaggccgaaactcggcgatgaatgcaggcgcaggcagtccaggctgacatcgctggtggcgcgttcggtcgccacggcgaggctgtgcaggatgcccgagacctccgccaggtactgctcgcccaccggggtcagcgtcacgccgcgggcggtacggaaaaacagctggcggccgatcattgcttccagcttggccaactggtggctgacggccgagggggtcaggtcgagaacctccgccgcgcgcgcgaggttaccgaagcgcgccgtctgttcgaaggcctgaatggctttcagcggtggcagtgtggtgggcgcatcgtcgaatgaacgcatgatgatggttattccgctacaggggttgtaagccgggctcggggccattcaaccatgtgcctgtagccctgacgagtgctgaattattttcagcaccggatgagtttcgcgttattgctcagggacctgccgggggacaagctgggccatcgatccgtcgcgggtcgacccctataaaaacaatcagaggtactctccatgctccttcaaggcaaagtcgcgatcatcaccggtgcagcctccgcgcgtggcatcggccgcgccaccgcgaccaccttcgcgcaacacggcgcccgggtggcgatcctcgacctggatgaatcggccgcgcgcgatgccgccgcctccctgggcgaaggccacctgggcctggccgccaacgtcgccgacgaagcgcaagtgcggcaggccgtcgcccggatcatcgagcatttcggccgcatcgacattctcgtcaacaacgccgggatcacccagcccctcaagaccctggacatccgcgccagcgactatgacaaggtgctggacgtcagcctgcgcggcaccttgctgatgtcccaggcggtgatcccgctgatgcgccagcagtcgtgcggcagcatcgtctgcctgtcgtcggtttccgcccaacgcggcggcggcattttcggcggcccgcattacagcgccgcgaaggccggcgtgctcggcctggccaaggccatggcccgcgagttgggcccggaccaggtccgcgtcaactccatcgcccccggcctgatccacaccgacatcaccggcgggctgatgcaggacgagcgccggcacgcgatcatcgacggcatccccttgggccgcctgggcgaagcccaggatgtggcgaatgccgcgctgttcctggccagcgacctgtcgtcctacctgaccgggattaccctggatgtgaacggcggcatgctgattcactgagcacacctggcgggcccggcggcccgtgcggttctggatcgacgacgccgtcaggcccgaaggcctgacgctcaataagaacaagagatcagaccatgacaaccctgtcgcttgaagcggtttcgaccgtgcgcgccaacgcctaccgcaagaccgcgtggcgcctgatgcccttcctgatgctgtgctacctgtgcgcctacctcgatcgcgtcaacgtcggcttcgccaagttgcagatgatgaacgacctggccctcagcgaaacggtgtacgggctgggcgcgggcatgttcttcatcggctacttcctctgcgaagtaccgagcaacatcatcttgcacaaggtcggcgcgcgggtctggatcgcccgcatcatgatcacctggggcatcatctccgccctcttcgccttcgtcgaaagcgcctggcagttctatgccctgcgctttctcctgggcgtcgccgaagccggcctggcgcccgggctgctgctgtacctgacctactggttcccgtcctaccggcgggcccgcatgaccgtgctgtggtttatcgccatcccgctgtcggggatggtcggcggcccgctttccggctggatcatgaaccatttcgccggggtgcacggctgggccggctggcagtggatgttcgtgctcgaggccgtgcccacggtgctggtcgggctgctggtgctgagctatctcaaggacggcgtgcaccaggccacctggctcgacgatgacgagaaagcgctggtcagccgcgagctggccgaagatgaacaacagaaagtcacccatgcttcagtgggcgagttcatccgtgaccagcgcctgtggctgctcgccggcatttatttctgcgtggtgatggggcaatacgcaatcaccttctggctgccgaccctggtacgcaacgcgggggtcgccgacccgctgcatatcggcctgctgaccagcctgccctacctctgcgccattgccgcgatgctgctggtcgggcgcagtggcgacaaacaccgcgaacgacgctggcacctgatcgtaccgatgatcgccggcgccatcggcctgaccctcgccgcgctgctgggcgccagcatcaccctgtccgtcctcagcctgtgcctggcggcggccggcattctctcggcgtcctcgatgttctggatgctgcccaccacgctgctgggcggggtgtccgccgccgctggcatcgcggcggtcaacagcttcgccaacctcgcgggcttctgctcgccctacctgattggctggatcaccacccagaccggctccagcgccatcggcatgtacctgatcaccgccgtgctgctgggcggcgccctgttggtgctgcgcattcccgcggccctggtcaatcgttgagtcaacggagtcaacccatgacaacgcaacctttatccgcttcgaaaaccctggcgcaacgcgcccacaacattcgccgccatgccctgcgcatgggccaggtccagggccagggttatgtcggccaggccctcggcgccgccgacttgctggccgtgtcgtatttccatgcgctgaagcatcggcccgaagacccacagtgggaggggcgtgaccgcttctacctgtccatcggtcactatgcgatcgcgctgtatgccgccctgatcgaagcccggatcatcccgctcgatgagctggaaacctacggttcggacgacagccggctgcccatgtcgggcatggccacctacaccccgggcatggaaatcaccggcggctccctgggccagggcctggggatcgcggtcggcgcctgcctgggcctgaagcgcaaaggctcgccctgcttcgtctacaacctgctgtccgacggcgaactgaacgagggctcgacctgggaagcggtgatgtcggcctcgcactggcagctcgacaacctgatcgccattgtcgacgtcaacaaccagcaggccgatggctactccagcgaaatcctctcgttcgagcccatcgtcgagcgctggcaggcctttggctggttcacccaacgagtcgacggcaatgacctgccggccctggtcgcggccttcgacgccgcgcgcaatcaccgcgccggccaaccccgggtcatcatctgcgacacgcgcatgggcaagggcgtgccgttcctggaaaaccgtgaaaagacccatttcatccgcgtcgaagaagacgaatgggacctggcgctgaaccacctggaagaaggaaaaccatcatgagcaacgccgccaataccccggcctctcccgccgcaccggcgaaaaagcgcctgaccacgtcggcgatgatcgcctcgatcgccgccgagggccaagccaccaggccggcgccgttcggccatgcgttagccgcgctggcggaccggtgcccggagattgtcgggctctcggccgacctgtccaagtacaccgacctgcacatcttcgccaaggcccatcccgaacgcttctatcagatgggcatggccgagcagttgctgatgagcgctgccgccgggatggcgcgcgaaggcttcgtgcctttcgccaccacctacgcggtgtttgcctcacgccgcgcctacgacttcatctgcatggcgattgccgaggaaaacctcaatgtgaagatcgtctgcgggctgcctggcctgaccaccggttacggccccagccaccaggcgacggacgacctggcgatcttccgggcgatgcccaacctgatgatcgtcgacccctgcgacgccctggaaatcgaacaggcggtgccggccatcgccgcgcaccaggggccggtctacatgcgcctgctgcggggcaacgtaccgctggtgctggacgaatacggctacaccttcgagctgggcaaggccaagaccctgcgcaccggcaacgacgtgctgatcatctccaccgggctgatgaccatgcgcgccctggaagcggccaagcagttgcaggccgatggggtcgaagtcgcggtgcagcatgtgccgaccatcaagccgctggatgaacacagcatcctcgccgaagccagaaagcccggcaggctggtggtgaccgcggaaaaccactcgatcatcggcggcctgggcgaagcagtggccggggtcttgctgcgcaacggcgtgaccccgaccttccgacagatcgccctgcccgacgctttcctcgacgccggcgccctgccgaccctgcatgaccgctacggcatctccacccaggcggtctgcgcccggatcaaagcctggctttgactgcgcgagccaaaggatgccggcctgaggacggcgtccctgaggatagaagcccgccagcgctgctggcgggcaacgaccggccccgtggtctcgcaggtcccggcccgctttagccgaacgccggtcaggcgttagcgtcgcccccgcacctcccgcactttgccctatgcttggcatccaccctcccgactgaggacaccaagatgcccacctccgagactgcccttctgcacagctggcaccacaacgcccaggcctggatcgacgccatccgtagcggcgccatcgaaagccgcgtcgaggtcaccgaccaggcgatcctgctggcggtgctgggccgtcagcccgagcgggtgctcgacctgggttgcggcgagggctggctgttgcgcgccctggcgcaacggggcatcgaggcggtcggggtggatggcgatacggccctggtcgaggcggcgcgcggcgcgggctcggcaacggtgcatgtggccagctatgccgctctggtggaagcacaggtggatatcggccgcgactacgacctgatctgcgccaacttcgccctgctgcaccaggacatcatcccgctgctggccgccatgcacgccctgctcgccccgggcggcgcgctggcgatccagaccctgcatccgtggagcgccgcggccggcgactaccaggatggctggcgcgaagagaccttcgccggcttcaagggccagtggcaacccatgccctggtacttgcgcaccctgtccagctggctcaacgccctggacatggccggcttccagctcgccagcctgcaggaaccgcaacacccgcaaagcccggtgccgcagtcgttgctgctggtggccgaacggcgcgggtgaggaggaaaatccagcccgccggccctttcgctaaaagccgaataacgccctgggcgagtccaccagcaacgcacgcgcaagcggcctcgaacaccccagtgcacccagctgctcgatcaccgtgccgaaaccgacgctgtcttcgtgctgcgtatggggccagtcgctgccccacaccaaacgctgaacgccaaagctttgctccagcagcggcagtgcgctgcgggcaaactcgaggttctgtcggtccgtcccgcccagtcgatagatgccggacaccttcatccacagctgcccgctcaaccccagttcgagcgtctcggcaaaccctggttgatcgacgctcaagcgcgcgtccgggcgaccgaaatgatcgatcaccagcttgatgcccaacggcatcagttgaccgagcagccgcggcaaatcctccacaggccggtgtaactcgagatgccagtccagctccgcgaggtggccgaagaagtctttccaggccccctcgcgaaagtcaggcaaggcctggcccatgaggttcaggcgcaccccgaccacgcccagccgggccatctcgttcaaggccgcgcggccgatctgcggctcgaccaccgccaccccgcgcaaacgggccggggcctgttgcaacgccgccagcaggtagctgttgtcgctgcccagaaagctcggctgcaccagcacgccatgactcaagccatgggcctgcaagtgccccaggtattccccaagcgacgcatcgtagccaggggtatagcgccgggcagcgaccaggttcagggcgcggttgaacacatgggcatgggcgtcgatgccgacgatcgactcggaacaggtatcaggcatgggtttcatctatcgaagggaatgatcatcaagctcgggcacgcgcggtgtcggcgctggtcgcgggcgtcgacgcctgggtggtttcgaggctgcggccacgggtttccggcaagcacagcgccgcgacaaccgccacgccataggcgatgccggcatcgatgccaatggcagagcccagcgacatggaatcactcatgtgccccaccaggaacgggaacaccgctgagagcacccggccgaagttgtagcagaaacccacgcccgcgccgcgcacgtcggccgggtacaactcgttgaacaacgcccccaggctcgccgggatgcccgcggcaaagaaacccagggggaagccgaggaacagcatctgcgtattggtcaacggcaggaatacatagcactgcacggtgataacgcagcacaaggcgaacagcacgatatttttgcgccggccaatgcggtcgatcagaaagccactgaccacacagccgcaccagaaggcgaagatgatcaccgccaggtagccacccgagttcagtacggacaggttgcgctcagtcttgagaaaggtcggcaaccaggtcatcacggcgtggtaacccccatgcgcgcccaggcccaggagaccgccgaacagcgtcacgcgcaacagctcgggacggaagataccggccagggacttgaagaagctctgtggaatggctcgttctttttgcaggcgctggaagctgtcgggttcctggacgttacggcgcacccagatgatcaggagcgagggcagcaagccgaccaggaacatcacacgccaggccaggtcctggggcaccagggagtaaatcagcgcgaacacgccaacggccaggccccaacccacggcccaggcgctttgcacagtgcccatcaccttgccgcggtatttagggttgatcgtttcggccatcaacaccgcgccggcggcccactccccgccaatgccaaagccttgcagggccttgacgatcaacaactggtggaagccggtgacgaacgcggacaggaaggtaaagaacgaaaaccacaggatcatccattgcagggtgcgcacccgaccgtagcggtcggacagcgtccccccgacccagccgccgatggccgaggtgaccagggtgacgccactgatcagccccgcatcgcccttggtcaaggcgaacgcggcgatcaacgccggaatcgccaggccgaacatctgtacttccagcgcgtcgagcgaccatccgccgaagcaggcccaaaacgtcttgcgctcccgaggagtgacttggcgataccagctgaacatgatttttatccttataagtggaacgtgaggcagccgaacgcgaaccgcgccgctaccgggccagtcagggcaaatacatcgatgaaatcagcggcgagcgagtcgccgccgagaagtccgctacccgggcatggggtcagcgaatttccacgctgtagcggaaatgctcggcatgtccgcgtgaacgacgccactccagcggcgtaccggcgtagtcgcgcgccaggcgctcgatcaccaccaccgggctgttggccggcacttgcagcaaccgggcatgcacgtcactcaccgattcggcggtcagggtttcttcggcgtaggcgacgacctggccgcacacgtcttcgtagatcgggtaaagcagcggccccttttcagccaggtcgatctccagcagccgttgaaagcggctgcgcggcagccagatttcttcggccagcaccggctggacttccagcagacgcacacgaacgatacgaatcaccggcgcctcgctaggcagccccaaggcctgggccaccgccgagggcgcggccagcggttcgatcgacaagatgcggctctgcggcacctggcgttcgccggcgggggtttgaaaacggaagaaacggaacagcgaagattgaaactgcggccggcgaatgaaggtgcctcgcccctgctgccgctccaggatgccctcgctgaccaaggcatcgaccgccttgcgcacggtaccggtggacagctggtactccgccgaaagcgcggcctcggtaggaatcgcttcgcccggacgccagcgattgttggcgatctgctcggccagatgatcccgcagacgttggtacagcggcaggcgagcatcgctggaaagagaattcatcgactttattcaccttattatctagtcatctatatgaatattaggggcgagtatttctccggacgacctggctgtcaaggaggatcaacgcagtcggctgaccaatggtaagacgcagaaaggtcagccctttatcagcgcccagtgcttcttccgacctgcggcgtctcacagtccccacgctcttgcgtgctgcggcaggcctccgccagcctggccgcaccgccccactgtgctcggagccgtctagatcgacaggacgaagcggcgctcgccccctgccttgtcgtcacttgccggttgctcaagaaggaatccgcatcgctccaggacttttcttgagccgagattttccgggtagacataagccaccagctgcgtcagttgccagcgcgtccgcgcttgttcgatcaactgccgcagcgcctgtgtcgcaagcccctggccgcaggcgctttgggcaatccgatagccgacttcggcggagcgccgcgcggtatcgatgcttttcaggttggcgcgaccgatgatgtttgcgctgcaatcctcgatcaccaaggggtgccaggtgccggccacgaaagcggccaggtagccctcgatatgctcggcgacgccctgcaacgaataaaaggcaggggcgcgcgcctcgatatgggattcgaaccactcacggttccgggtttcgaacgccagcagcgcttgcgtatcggtacggcccagctcgcgcattttgaatggcggcatatacacctctgctttttctcatgagtaattgcacggacctgcccacctgctggccgttcctgcaggaacttcagggtacgggccaggtcgccagttggaccaggccgccgccacgctggagcatgcattgcatatccagccgaacaatcccgcgacgctgcattatcgactcccgtccggagccttcctgatgcagggctgagtttccgagtgtccgtatggctgtggatgcaaccggtcgatagcggcctgtcgcacaaggaccactcgatcaagaccacaaatggcttagcgattaattgcggcagccactgcgtaaatcctcaacgcttcggcggtagtgaacgcttgaaagcgtgccccctggctatcgaaacaatcaacagcgccggcagcaacaaaaccagcactacccagggaatagcgcttgccccgcaggtttccaagagaacgccgccgatcacaccactgcctgcaaacgccaggttgaaaacggtcaccagcattgattgggcaatatcagcgccgtcaccggcaacttcagccaaggcggtttgcaataaggttggtgcaccaccgaaggtcatcccccacaggatgatgccgatatagagcgcactgacgggcagatcagccagcccaagggcaaacgaaaccagggtgaaggctgccaggctgagcaggatcagacgccgaagcctgccatcgatcagcgtgccgatcatccatagaccgaccaaggcagcaatgccgaatgcaaagaggccccgctctacctgatcggccaatccaacagaagccaagaacgcagcaatataggtatagagggtgtagtgggccagaatccagagcatgaccaccgccagcacaggccgcacacctggcgtttgcaagaccgtgcgtagcggcaggcgtcgatcggagtgttgtccaggataatcaggcacgttcaggtatatccaggccatcagcaaaaggctcagccctgagagcgtcccgaacacacaacgccaccccagaagttggccgagccaggcaccgagaggtacaccgagggccagtgccaaagggatgccgagcatggccagtgccatggcgcgaccgtgaagcgctggggcgaccaagcgtctggcgtagcctgccagcaggctccaggccaggccggttgcgatacccaccatgaagcgggcagccagcgtcaaggaaaaccagggcgacagggcagtcaccgcattacaggcgaaaaacaccccgacagctagcaatagcaccaaacgccggcgccagccctgcaacgcgagggtcaatggaatagccgccaaccctgagcccaatgcacatagggtcaccatctgaccggcccacgattgcgacacaccgaacgcctcggcgatttgtggcaaaagtcctgctggcaacgtttcgttggcagtggcgataaagctacccattgtcagcgctaacagggccctcagtgggagacgcccggtggtgcggtactcggcattgcccaatgtcgtgaaagagccattatcaaaatcaaattgcgattcgccggtcatgacctgtgctcaaagagaagggaagcgtgagtgtggtgaatttccacagatttgataattggcctaccatttgatgaactatcaaatttgaattgaatatggctactgaccgattgggtgatatgcgtttgtttgtcgaggcggcggcactcggcagcttgtctgccgcagggcgcaaactggcgctgtcgccagccgcggccagcgcgcggctcatcaagcttgaggcggcgctgcgcaccaagttgtttgatcgcacaacgcgccagttgcgcctcaccgaagaaggtcggttctatttgcagcagtgctgggtcgcattgcgggctatcgatgaggccgaagcggggcttcaagcaagtcaaacagaggtgcgtggcaaggtacggatatccgcatctgccgattttggccgcaatcttttaaatgactggcttgaggcattcagcacgctgcacccggaactgtacatcgcgctgacgttgtcggattccgtatcgaatctggtgcaggacgatgtcgacctggcaatccggtttggacagccgcatgacagttcgatgatcgccaggcagttggctcccaactggcgagtactgtgcgcttcgcctgattatctggagagatacggtgaaccccagacccctgctgacttggttaaccacaagttcatcgtgctggtgacgtctgccggtccattaaacacctttcactttgtggtggacggtcaggaatggaaccacaccgtgcccatgagccaggtatgggaaacaaacgatggtgccctcgcacgcacatgggcgttggccgggcatggcatcgcacgtaagaccatttgggatgcggcagacgatatccgtgctggacggctgaaaatcctgttgcccgacttttgtgtccgtgaggccggcgtctacgcggtattacacggcaatcgtttccggattccccgcgtgcgtgtattgctggatttccttatcgaccatttcgatcgcgcaaccgatgagctgttgttcgaccttaaggtaccgaatgtcaggaagttgtaagccacgccatacctgcgaagagccggctctcgcgccccggggtcgcttcacacctcagccctcgcccccaaggcatcaccttcaacctgctccagggcaagggcttcaagcagcacctgctgcagaatggcaaagaaacagctgatatgagcctgcttcaaggcctgtggccgggtcaccaggtagacctccatatcgggaagctggagctgcgggaacaactcaatcaagtcctgcgccagcacacgcggcagtactgccacccccaggccacgcctcaccgcgtccagctgcagggcgaacgagttcacgctgatctgcgcgcgctccaggccggcggccttggccgcgcgtacttgcggcaacatgtccagtggtggcagcaggccgatattgacggccgtggccggcgtcacctgtggaaaccgccgcagataatccgcagcggcgaagaccccgtaggcgagccggcccatgggtcgataaatcaatgacggctcgcccaggtgcgcggtgcgcaccgcgatgtcggccacgccacgcacgatcttgtgaaagtcggcggctaccagcaattccaccgagcaacgcgggtgaagcgcggtgaagcgactcgcagcttccagcacgcacgacgcaaagccctctcccgcactgaccaggacactgcccgacagctcgctgtccagcgcggacatgccggccacggtttgccgcctcaagcccgcttccgccgcctgggcgacttccaccagggactggccccgcgaggtcaaccggcatccttcgacgccgcgttcgacgagcggctcgcccagggcctcctcaagctgggtcaaccgacgggacacggtagacgccgcgatccctagcaactggcccgcttgcagaaagctgccacgccgcgagacggccaacaacaggcgaagatcgtcccaattcgcttccgacaccatgtttcatctgctccctgatttgcatatatgcaaagccattatgcaggagtcgctgtttttcgagagggggctcgacggtatatctacaggccctggaaacgactggaatggactgtatgccgattggccccaacgactatgcgcaacacgccgccaatgccttcaaccgccgtgatatggaggcgctgctggcgctggtgagcgaagacttcacctacctcgatggcatggggatacaagtgggccgcgaggccatgcgccaacgagaaaccgcgttgttcgaagccttccccgatgcccacgtgatcctcaacccgttcgccgtcggagccgatcgtctggcgctgacggccatgctgagcggcacctttgcagcgcccctggtgctgccggaccgggtgcttgcaccccatggacgctttattgccgtgcactacgccgcacacttcaccttcaaggacgggttggccatccatcaagaggtgttcttcgacagcgcggtgttgatgccgtcagccgaaccgagtgagggttgaaccatgcgtcatgcattcgtgacgggcgccaccggtttgctgggcaacaacctggtgcgtgaattgctcgcgcgtggctgcgcggtcaaggccctggtgcgctcgagggccaagggggaacagcagttcaagaacctgtcgggcgtggaactggtcgttggcgacatgcgcgatgtcgaggccttcgccgcggacctgcgaggctgcgatacggtgtttcacaccgcggcgttctttcgcgacaactacaagggcggcagccactggcaggaactggaaaagatcaatgtcatcggcacccgggagctgctcgagcaggcctaccgtgccggtatccgccggttcatccatacctcctcgattgccgtgctcgacggcgcgcctggcagctccatcgatgaaacttgcctgcgcaccgacgccaacgcggatggctactaccgcagcaagatcctcgccgaccgtgccgtcctggcgttcctagaggcccatcccgagatgcaggcctgcatggtcctgccgggctggatgtggggtcctggcgacctgggcccgacctcctcggggcagttggtcaacgatgtcctgcacggcaagttgcccgggctgatccccggcagcttttccgtcgtcgatgcccgcgatgtggccttggcgcagattgccgcggccaggcacgggcggcgaggcgaacgttatctggcggcgggccggcatatgaccatggccgagctggtgcctgtactcgggcgtatcgcgggggtcaagacccctgctcactacgtgccgctgccccttctctacaccctggcggcggtgcaagaggtctacgcgcgcctgaccggcaggcccatcctgctgagcctggccaccttgcgcctgttggtacgggagaaggaccgcagccgtttcaaccaccgcaagagcgaacaggagctgggcctgaactttcgggcgctggagctgacgattagcgacaccgtggcgtggtaccgcgaccgcgactggtttgaaacccagggtgcgagacacgcccgcgtcatggccgaagactgacttgttgccgatggcgtgaccgtcgagccccaaagccgctggtctcgcctcgccttgctgcggtttcgtactggcaccagaacgatgcctcgaacgctcggccatggcttcatgaatcgactgatcgccaggcaactggaggcacaaggatgggttcgccagacacctaatggcggcagccgctattggagcgcgacagtgtatcggtatggcggtgattaagcagtggccggcggagcattccgggcgttcaatccatggctattttttcccgcaggtttccacatcgtcctggcgggtcaaggcagtgtcgatgcccagccggtagcggcagtagtcgatgatccagcgccgctcctgctcggtgaggcgttcaactttcctgatctcgccatcgttggcgtgcaggttgtagaacttcatttgaagcgtcgggtgctgctttataaacacgatcgtctcgatgtcgccatcctcaagcgcctggtaataaccgacatagaacaccgccaggagcgtcagggcggttgcgatcaacagtgttttcatgagcgcggcatcgctggcagccgttgggtcttcatcctgatgttcctggcctttttcgagacgggcgatataagcacaagattgcgtggtcaggtacatctcctcttggacgattcgcgacatcctcgacagcggccaggagcgcccggtccagcatcccaacagcggctgcgccaatggctaatggaaaacggctaccgcatcctggacgaggaagtggcgcgggaaaaccgcttcaattacgaaatcaacgtcgccgatgcgccgggccgatgatctacagcgccaaggagctgtacagcatggttgatggagtggctggcggatgcgaggcgggatgggggcgtttgctgagcgtcgcgataggctggaatcggccagaagcagacgtttggactaggacgtttagagttggaaaatcaactctcatcggccagtgcgctggtcgcagcgctgctacaaaaaataaaggcagcgcccgctttcgcgagcgctaccttcatcaactgcccgctaatcaggccttcttgtccgcctcaatcaaagccttttcagcgttgaacccgtcgaagttctcgaacacgcccataaagcccggcacggtcacttctcgcgcccagtcgcgctgcagttcgcagtacatctgcacccggctgatgagcttcgcgcccgcctgttccattctgcgcaacgccgcctcgtgtgcggcgagcgatgtgccgccaaccgcatcgaccggcacataaacttcataaccttcctggatcgcgtcgagcaccgggaatgtcaggcaggcttcggtccagagcgcagtcatgatgagcttcttgcgcccgagcgccttgactgcctgcttgaattccgtgtcctcccagctgttgatcgaggtgcggtcataggtcggcagatggccgagcacctcttgcagctcctgaatcggcggcttgttgcggccggtcgcgacattgacggtcgagtggatgatcggaaggttgtagttgagcgccgccctggcgacgctggtgatgttgaagacgagttcatcacgcggcattgagcggatcgaagaaacctgaacaggctgataatcgatgatgatcaacgccgaattttccggggtcagtagctgatcggtattggggttgcggagagtctcgcttgccattggcaaatccttttcatgggtgacgcacgtttgtgaaaaggccggagcctgtgcgactgatggattccagaacacgtgcgaatgatgccgtgcctggaaaatccattgtgctgttcctatcttcgatgcagtagtagcattacgcgacgtgctgtgtcgcgaaaaggggaacgctagaatggatatcgaagaactacagaccttcgtggacgtggctgatgccgggggcatttcgcaggctgcactgcgtcttggcgtgtcgaaatcgatcgtcagtcgccgcctggctcggcttgaaaccgaactgggcgtgcaactgctggcacgctccactcgcggggcggcacttactgaggccggcgcgacgttccgggactacgccgccagagtctgcaccgagatcgatatcgccaaggaaactatcctacccgccggcgcccttcgcggccgcttgcgcgtggccgtcccgctatcgttcggcccgactcacttcgccccgatgctggcggaaatggcacgtcgtcatccggagctgcacatccagacctgctacagcgatcgcttcgttgacctcattgccgaggggtacgattgcgccatccgggcggggtatctgcaggactccaatctgatcgcaaggcggattggcccggtctacggcaagctcgtcgcgagccccgactacatcaaggcccacggcgcacccgagacaccggatgaattgatcgcccatcaggcgctcatgcagggcaccgaagcctggcaatttatggatggcgacaagatcatcacggttcgtccgcaaggacgcttcaaggccgacaacggcaccgccctcgtcgccgccgcgaccgcaggcctcggtgtcgcctacctgcccgactgcctcatccatgaacacgtggcatccggcgcactggtgccgatcatgacaaaccatccaccccctccggcgggtgcctacatcatccgcccgcctggtccgcatccagcccggaaaatacgtgtgctcactgaactgctgatcgagttcttcggcgaaactccgcacctggcggtgcagccgctgtcacatcaggatgatgcgctggcatgtagctgagcaaagcaggagcgacagacatgccttgtggattcaaccgttcgaaggtctgaaggcaacccatagcggacacaggcggggcattacgattagctaacttgatgctcatacagagtgacctgccgaggaaacaactcaccatagagaggatgtggaataccgaaaatgttcacttcgatgcaaggtggcgggagctctttggagtaatccaagatgcccaggcccgcacatggaataaccagacccgcttcggtttgaacagaaagatccaggccggtctgatcgtggtgattcgtggaacactcgttctggatagctgcgtacccatcagcaggctcgaattggcctgaagcaacgcccatggggggatctccgtaatcgagcgccgagtagcccaccaaaaccaacccgctataaattgagaatcgcgtcatgagattgcctattgattgccatgcaaagacccagccagcggtatatcactcagctaatccttaaacgagggcgagcctgttgagttaccgcaattggccgattactacctttcgcaaatgaccgcttttggggggttcgcggtctcttattaggaaccgcggacattcaattgagggcgtaatcaaatgcccgcaagccccagcacctcccactcgcccctcccctacaccccccgcaactgtgcaatatcccgcctgggtgctgcgccaaacagccggctgtactcccgactgaactgcgacgggctttcatagccgaccttgaaggcggcactcgatacatccaggtgttcgttcatcatcaggcgtttggcttcggtcaggcgtagccatttctggtattgcaacgggctcatggcggtgagttggcggaagtggtggtgaaaggtcggcgtgctcatctgcacccgggcggcgagttcgtcgacccgcagttgcgcggtgtaattcaatttcagccagtcgatggccctggcgatgcggtggccctggccgtcgacggaggcgatctgccgcagccgcgccgactggtcgctcagcagcaagcggtagtggatctcgcgctggatcagcggcgccaacaccgggatggcttcgggctcgtccagcaactccagcaggcgcacgaacgaggccagcatggccggcgtcgcggtgccgatgcccacgcccttgcctgtgcctcgatcgcgaggttgcagcagcccgccctgggcggccagctccgccagcatgcgcgggtcgagcttgaagcccagcccgaggcagggttgttccaggctggccgccgtcacctcggaattggccggcaggtccagtgaggtcacgagaaagcgcgaggggtcgtacgggtaggcttcgccgccgacccacagctgtttcgccccctgggcgacgaggacgatgctcggctcgaccatgcatacggcgggtggtgaaggggtctcgcggcgaaaaaaaaccaggccggggatcgctgtcgagcagtctcccgagtgtttgatccaagcgccaatgaggcgcgcgagggtttcctggggcgcctgggcgcgggtgtcgtttgggcgtgtcatgtcggtatggaccctccttgccagacgttaacccggccccggtgccgctcctaccgaaaaaaccaaagcccagagaatcaggcaagaattccagcgaaatgcactactggccgcctgcgcctacccgggaaaatgaccgtccaacgtaacgctggatggagtgtgcaatgttagtcaacgcctatggcgcccatgcgggcgaccaacctctggaaccactgcagatcacccgccgcgcccccggcgcccatgacgtgcagatcgacatcgccttctgcggcatctgccactcggacctgcaccaggtgcgcgccgagtggcatggcacgcagtttccctgcgtgcccggccacgagatcgtcggccgagtcgcggcggtcggcgcccatgtgcacggcttccgcccgggcgacctggtcggcatcggctgcatcgtcgacagctgcaagcactgcgccgactgcgaggacggcctggagaactactgcgacggcatgatcggcacctacaacttcccgacgccggacgccccgggctggaccctgggcggctactcgcaacagatcgtggtccacgaacgctacgtgctgcgcatccgccaccccgaggaacagctggccgccgtcgcgccgctgctgtgcgcgggcatcaccacctattcgccgctgcgccactggaaggtcgggcccggcaagaaagtcggcgtggtcggcatcggtggcctgggccatatgggcatcaagctggcccatgccctgggcgcgcatgtggtggcgttcaccacctccgactccaagcgcgaggccgccctgcaactgggcgccgacgaagtggtggtgtcgcgcaatgccgaggaaatggccgcccatgccaagagcttcgacctgatcctcaacaccgtggccgcgccccacgatctcgacgccttcctggtgctgctcaagcgcgacggcggcatgaccctggtgggcgccccggcgaccccgcatgcctcgcccaatgtgttcaacctgatcatgaagcgccggacgctcgccggctcgatgatcggcggcattgccgagacccaggagatgctcgacttctgcgccgagcacggcatcgtcgccgacatcgagctggtgcgcgcggaccagatcaatgagtcctacgaacgcatgctcaagggcgacgtcaagtaccgcttcgtcatcgacaacgccaccctggcgggctgagcgcggcaagcgcctgatcccgttcctccagggcaacccctggtagtccgctaggtgccctgcttgggtatccagcgcttcgcggcaccggtgtcgcgttttccttctgccgcgaccggagccgctccagcaccgagccggccccgatcgccattcacgcgcctgcccggtcttccaccggcggcgtgcacccatttatgcatcgaagcgtccgcaagacccggccggcaacaccccgcggtcagcacggacgcttccagccacacaggaaacctgtcgccatgaccgctacctctcacgtcgaatcgcccgaaccccgaaacacctggggtgccgtgctggccatggccctcgccgcctttgccctggtggcctccgagttcatgccggtcagcctgctgaccccgatcgcggccgatctgcaggtcagcgaggggcaagccggccagggcatttccgtctccgggctgtttgccctgttcaccagcctggcgatcgcctcggtggcggcccgggtcgagcgcaagcggctgctgctgtccctgaccctgctgatgatcgtctccggaaccgtggtggcgttcgccccggatacttgaccttcatggccggccgcgcgctgatcggcgtggccatcggcggcttctggtcgttgtcggcggccacggccatgcgtctggtgcccgaagaccaagtgccgcgtgccctggccatcgtcaatggcggcaacgccctggcgaccgtgatcgcggcgcccctgggcagcttcctgggttccctgatcggctggcgcggggcgttcttctgcgtggtgccggtggccgccctcgccgccgtctggctgctggccagcctgccgtcgctgaaagcgcagccggccgccggcaccggcaatgtcttcagcctgatgaaaagaatgccggtggccctgggcatgctcgcggtcagcctgtttttcatgggccagttcatgctgttcacctacctgcggcccttcctggagacggtcacccaggtcagtgtcaccaccctgtcgctgatgttgctggtgatcggcctggccggcctggcgggcaccttcctgatcgaaaccttcctgaaaaacgccctgtatcgcacgctgatcatcatcccgctgatgatggcggcgatcgccatggccctggtggcgtttggcgcctcggtgtcggtcaccacggtcttgctgggcctctggggcctggtggcgaccgccgctccggtcgcctggtggacctggctgacccgggcgctgccggacgatgcggaagccggcggcggattgatggtggcgatcatccagctggcgattgccgcgggcgccacggtgggcggcctggccttcgacctgagcggttatcgggcgaccttcgaactgagcgcggcactgctggtggtggccgccgtgctggcggtactggccgcccgcgccgccacgcgcaagcctttcgtggcaacgaacgtggcggcgtgagcggtggtcggcgttaagacaatcgacagaacagggccgggtgtcagcgcgcgctgtcgatctggccgccgtcaggagctgaataaggctttccacctaaagagccgtctttgacaactgcctttgccttggtttaaaagcgcagcctctcgataacgattaaatccatgtcatttacaggcaccaaaaagcaacttgatcgaccatcaagaaatcgaagacattgagtctcttgagtcacaattgcttgacaagggaatttcagttaatgacagggtgcgccactatgcaaatctcttgcttgagcttatccagagtggaaaactaaaagcattcccgataaaaaacttcaagagatggttttctagaggcactacctaatatgcagaaagacatctgtgaaaagtacggactgcccgtactgcctccagaagaaatggtcgccattgcgattgccactctgggcaagtcacctgtttatggcgcacgcatttcgctgccggaggggggtaatgtcagttggtttattcactgcggagaacattcgaacgctgatgatttttatcaagcggttcacactgagcatctcagtgaaatgctgccacaggtgatgaattacctctgcctgcccgctggcgccaagttcatcatcgacaaccaaggctacgaagatgtctggatggaaggctgacaagcctttgccctcgattcaggctgattgacacaacaaggacgtatgaaaaatgaaagtaaaggtattattcattgcttcgctaggcgttctgtcgctcactcaaacatcactgtccttcgcggataacaatgggaaaaatctctattcgcagcgctgtgccgtgtgccacggagccgatatcaaaggaaccggaccactggccaataaaagcaatcctccaacacctgaccttacaacccccgtgttcaagaaacggctcaatgattatccgggcgttattgtgtcatcgataatacttcgccccaatggcgacctgattccaagaaccttgcgggagaatggtgtaaagataccgccgcacgcctggagcattcaggacctgcgcgatttgaatcaatacatgaacagtgtgatttcaaaaaatcgatgaccctgagtcagtcggcctctcacgagcacatcgctaatgaacaatattgatttaaatatctcccctgcagattcaactccactacaaacacattggctcctagaacagccttggcaccagaagcttcattccctatcaacatggatgcgtgcattgagcagaacagctacggagtagtgtatgagcgataaagaagcacctgttctgattcaagtttatgtaacagatgatgacggccctttttttgaagagctgcctgctcgcaagattgaccaggatacttacgagttgctctcctcccctggtatcgcgctgaacctggcacgaggagatattgtttcaatcaaagacaaagaagcacctgccgtcgtcttgaaacgaggcggaaatttctgcatccagatctatgcagactctattcctcaagaagaaatagccttgctggaaaacggtgtagtttgtgagctgggtggaacactggacggtgtatttgagggaaacctgtcattagcggttccggcacgcaatgggctggagaagatcaacgacttctttaacaggtttcgagatagaacagagatccagtggtactacgccaatatctataaaaacctggatgatgacgaggatgagacacttttatattggtggctcgaaagctgatagatactgacgcccgcgatcatttcaccaggcgcttttccttcgacggccgatagccgaaatacgagctgtagcacttgctgaaatggctcggcgagacgaagccgcaggccaccagcacctcgacctgggacagttcggtgtgctgcagcaatcgacgcgcttcggtgatgcgcaattccaggtaatagcgctgcggggtggtgcccaactgctccttgaacaagcgctcgatctgccgccgggaacgcccggcatactccgccagctggtccatttgcagcggttcctcgaggttggcgtccatcagattgaccacctcgcgcaagggcgcgctcaacgacacatgcatggtcggcttgatacgccggtagcgggattcctcgaacgacaggatgtcctcgatgccctcgaccagcgccttgccgtgcagtcccttgatccactccagggccatatggaaagcgccggcgggactggacgccgtgagccggtcgcggtccaccacaaaggcctcgctggtgacatgggtgaccttggaaatctccgccagcgcgggacgatgctccgggtggatcgcacagcggtagccttcgagcagccccgcggcgccaaggaaccaggccccgttccacaacccggccagggtgatgcccagctcggcggcgcttttcagcaggctgctcagctggggatcggccttgagctccgtgcgatagccaccgcagatcaccagcaggtcgaggtccttgagcgccgccgcggtcaggcgcgcatcgggacggatcaccagcccgaggtcgctggtgacctcgccgtcctgcaagccaaaggtcgttgaggagaacaaggcgggacgcagcaggttggcggtgacgatggtatccagggcctgggtgaaggccggcaacgagaagtgctcgagcagcaggaagcccgcccgcgtatgggccgcgggcgccagccgcgcctcttccaggtaacgcaggttcttgcccttcatgccgccactgaaatcccgtcgctcaaccgccatacgccctcgccttttttaccctgccgaacgcagatatcagtgtacgttgaattctggcatccacagaaaaccctgctcgcaccacacgccatcgcccgggcgaagcggagccgtaggctatagaaaaaagtcgctggctagaagcgggttcaactgaacgccaggggcgtggattgggccacgaccctggcgacattgcggccctcaggggccacgacactcaccggccaggctcggcccgcaggatcgaaggctcctcgccgcgatacagcgcctcgaccttggcggcccgccactgcagcaccgcgcgctggttgatcgagcccttgtcggtgatctccccacggtcgatggaggccggttcgtcgagcagcgcgatccactccaggcggctggcgttgccgctggcctcgcggttgaggcgttgcagccaatcaccgaaccattggcgcaccggcgcgctggccaggacctcggcatcgctggcattcgcgggcaagccggccagccgccggcactcgtacagccgcggaaacaccagcgcccccaggcactcgcggtccggcgcggtcaccaccaggtcctgcacatagggcgacccttcgagcaccgcgcgattgcgcaacgggccgacgctgacgaacaccccggagccgagcttgaagtcctcggcgatgcgcccgtcgaacatcaggcccagttgcggatcggcggcgtcgaccagtttcagcgcatcgccggaacagtagaaaccctgctcgtcgaaggcatcgctggtctgctgcggcgcgcgccagtagcccggcatgatgtgcggcccgcgaaagcgcccttccagcttgccgtccaccggcaccaggcgcacctcgcaacccggggccggcaggccgatatagccggccatggacaagggcccggtggtgaaggtgcaggatggcgacgcctcggtcatgccgagcccggccatcatgcggatgcgttcgccgcaatgggcttgcgccacctggtcgaggcggtcccagaccctctgggacaggccggccgcggcgaaaaagaacagcttcatgcgtgagaagaagcgctcgcgcaactcgccgtcctgctccagggcattgaccagttcttcccaacccttgggcaccgtcaggtaggcggtgggggcgatttccttgaggttgcgcagggtttcggcaaagccctgggccgtcggcttgccgtcgtccagataaaaggtgccgccgttgtagagcacgatgccgaggttgtgactgccgccgaaggtgtggttccacggcaaccagtccaccagtaccgggggttcctcgccgaacaccggaaaggtctgcaacagcatctgctggttggcgcagagcatgcgctgggtggtgaccaccgccttgggcagcttggtcgaacccgaggtgaagagaaacttggcgatgctgtccgggccggtggcggcgaacgccgcttcggcttcggcgtcgccggggtgttgcaacaggctggcgaagtcgcgctgcggcctgcccgtcacggcgccacgcaccacgatcagcggcgtgtcgcccggcagcacggcgtcgattgcccgctggaaagccgcgccgtcgctgacgaacaccagcccgggctgcatcaggtcgcagacatgccgcaacttggcgaaatcctgggacaacagcgaataagccggcgacaccgggcaatagggaatgccggcatacatcgcccccagggccagttgcaggtgctcgatatcgttgccggaaagcagcaccagcggcctctcggccgacaggccataccccagcaggctctgggcgatggcgcgcacgctggccagcatctcggcatagctcacccggcgccagtcgccgccgtcctggcgcgcggcgacaaaggtctgctgcgggcgctcccaggcccaatgcaccagacggtccagcaggcgcctcggcagctcggccaggggctccagggaacgcatgtgcaggatgccctgctcttcgctgacctcgaccgcgggatgggcgatggtcacctgtcgataaggcggcgcgtcggccgcgttcggcgctggcgatctgaattcggaattcacgtgtttgtcctccatcaaggcccatcgccggcgaactcggccggggacctggcagccaggggctggggccttgtgattgttgggtccgggggccggagttcagatcgggtagtgccggggaccgttctgcagggtaatccagcgcaactgggtgaactgctcgatggccgccttgccgccaaagctgccgtagccgctggccttgaccccgccaaacggcatctgcgcctcgtcgtgcacggtcgggccattgatatggcagatgcccgattcgagccgctgggccagggccagggcgcgtccggtgtcgcggctgaagatcgccgccgacaggccgaactcggaatcgttggccagccgtagcagggcttcgtcgccctcgccgcgcagcaccaccgccaccggcccgaaggactcttcgcggtacaagcgcatggcctcggtgacgccgtcgagcaaggtcggctgcagaatgctgcccgccagttgaccaccggcaaccagggtcgcgccctgctccagggcgtcgtcgatcagccccttgatgcgcgtgccggcactggcgtccaccagcgaaccgagcaccgagtccgcagcctctgggttgcccgccggcaagctggcgatcttcgccgccagcctggcgacaaagtcctcggccacccgggcatcgacgatcaggcgctcggtggacatgcagatctgcccctggttgaagtaggcgccaaaggccgcggcctgcaccgcggcatccaggtcggcatcctccagcaccagcagcggcgccttgccgcccagctccagcagggccggcttgaggtgccgcgccgaaagctcgccgacaatgcgcccgacccgggtcgagccggtgaagttgacccggcgcaccgccgggttggcgatcagccgctcgacaatggccggggcatcctcgggtgcgttgctgatgacgttgaccacgccgtcaccgagtccggcctcctgcaacacctggccgatcagccgatgcaccgccgggctcagctcggacgccttgagcaccacggtattgccgcaggccagcggcatggcgatggcgcgggtggcgaggatcaccggggcgttccacggcgcgatgcccagcaccacgccgcacggctggcgcagggccatggcgaagctgccggggacatcggaagggatgacctcgccattgatctgggtggtcatggacgcggcttcgcgcaggatattcgccgccagctgcacgttgaaaccgtaccagttggccatggccccggtctcgccggcggcggcgatgaactccgcgttacgcgcctgcaattgcccggccgcgcgcagcaggcggctgcgtcgctcattgggcgccagcgccgcccaggccgggaatgccgcctgggccgcggccacggcggcgtccgcgtcttccagggtggcggcggcgacgcgcgagacgactgcgccggtcaccggattacgccgttcgaaggttcgaccgtcgcgggcggggcacgactggccaccgatcagcaggggcacgtccagcatggtgattcctctttattgtctttatcgggaatacagtggagcggttcacgccagcgcctgggcgctgcgccgaacagcgggcgggcactgctgcccgccgggttgccatcagcgcttgtaagcctgcaggccgggcttgatgctcttgtcgtcgaggaactgcttcatgccctgctcgcggccgccttcggtgtccagcaggcgcgactggtcgagcttggcgtacaggtaatcctcgttctgctcccaggtcagttcgcggcagcgcttgaagccatgcttggcggcccgcagcaccaccgggttcttctccagcaggttgcgcgccagctcgacagtggtttcgcgcagttgcgcaagcggcacgctttcgttgaccaggcccatctcggcggctttctgcccgcagaaggtcttgccggtcatgatgtagtacagcgactggcggtggcccacggtgtcggccatggccttgctcaccaggttgcccggcgggatgccccagttgatttccgacaggccgaaggtcgcttcatcggcgcagatcgccaggtcgcaggccaccaatgggctgaagccgccgccgaagcaccagccgttgaccatggcgatggtcggcttggcgtacatgcgcagcagtttccattgccattgcgaggcttcgcggcggatcttttcctggaggatttccgggccggcgtccacttcgcgaaagtactccttgaggtccatgcccgcggtccaggcttcgcccgccccggtcaacaccagcacgccggcggccggatcctgctccagcgtctccagcacatcgaccatctcgcggttcagggtcgggctcatggcgttgcgtttttccgggcggttgaggatgacccaggcgatcccctcttcgatctcgaccttgacggttgtccagcgaccttcgtagttgctcatggcgattgctctctttgttcttggcttgagatgggcaaaaactaaaccgacaaattagttatgtcaattaactattaataaaattaaccaaactttcacaggcgcccgaagcgcttcaaggccaagacatcggccatcggtcatggctatccccggacaatcccggcaaactagatagccttcttaaccgccagcccgaggatttcccctgcaatggccaagtcttccaacaagatagccaccgccgccgaggcccccgtcgccgacagcgaaacccaggcgcccctggactccgccctggacgacctgatcggttatgccatgcgccgggcgcagctgaaactcttccagaacctgattggccgcctgtcgagccacgacctgcggccggcgcagttctcggccctggcgatcatcgagcagcatcccgggctgatgcaggccgacctggcccgggcactggccatcgagccgccgcaggtggtgccgctgctgaacaagctggaagaacgggcgctggccgtgcgggtacgctgcaagccggacaagcgctcctacgggatcttcctcagcaagaccggcgagaccctgctcaaggaactgaagctgatcgccgccgagagcgaccaggacgccaccgcctccctcgacgaccaggaacgcgaagaactgctcaggctgctgaaaaaggtctatcaacagtagccgccagcctgcgatccctgtagccgctgccgcaggctgcgatcgacggcgcagccgtcgcaacccggccaacgcctttattcaggcggatcgcggatgcaggttttgcggcaactgcgttgccgatcgcagcctcgcgggctcggcagcggctaccccgacaccgcgatccctgtagccgctgccgcagcgctgcgatcggcggcgcagccgtcgcaacccggccaacgcctttattcaggcggatcgcggatgcaggttttgcggcaattgcgttgccgatcgcagcctcgcgggctcggcagcggctaccccgacaccgcgatccctgtagccgctgccgcaggctgcgatcgacggcgcagccgtcgcaacccggccaacgcctttattcaggcggatcgcggatgcaggttttgcggcaactgcgttgccgatcgcagcctcgcgggctcggcagcggctaccccgacaccgcgatccctgtagccgctgccgcaggctgcgatcgacggcgcagccgtcgcaaaccggccaacgcggttttccaggcagatcgcggatgcaggggccggcagatgtgtcaccagatcggcaacgtgtagagcaccaggaagcgggtctggttttcatcgcggaacgccgcaccggcggggaaatcgttgcggtagatcgacttgcgcgccagcagcccgaggttcttcaacggcccgctctggatcacgtaccccagctccatctggaactcccgctccttgcggtcgtcggcattcagcgccgccagttcgatatggtcgccgcgcacgtagcgcaggcggctcttcagccccggcaacccggcagcggcgaaatcgtagtcgtagatggcctgccaggtgcgttcccgggcattgagaaaatcggaactcatggtcagttcgctcatgcccatcaattcggtgcccgacagataaggcgtcgccgtgtcgccgctggcgtgcatgtagcccaggctcagtcgatgcccgccccagcgataggcgaacagcgccgagaggttgcggttgtccaccttgccggccttggcgctgccgtcttcacggctgaagaaactgcgcaggtcgctgctcagcaccccgtccccgagcttgaggttatgcagcagggccagggtgtcctgctgatagaggtccgccacttcggcgtggtaggcgcgcaggctgaggtccggatcgacctggtagtcgccccccaggtaagccatgtgcgacgaggtggccgcgccgttgaagcgccggttcggcgaggcgatgctcagcgcctggtagtcggtggagtcgcgcttgttgatgcgatctatataaccggtgttaaaggtcaggccgtcgatgtccttggagctgagggtggtgccgcgaaaggtctgcggcagcagccgcgacgggctggcaaaggcaaacggcaggaagatcgacacatcgccggtcttcacgctagtctgggccaggcgcagcttggcggtcatcgccaggcgcgagtattcgtccgccgcgcgcttgtcgctggccgacaccggcagcagttcggtgccgctgcggtccggcgccgagtcgagcttgatccccatcagcccgcgggcatccaggccgaagccgacggtccccggggtaaagcccgactccaggttcaggatcgccccctgggcccattcccgggccgcggttttcgcgccgtcgtccttgtagtcacggtcgaggtagtaattgcgcagggtcagggtgccgtggctgtcgtcgataaagcctgcggcctgcgccggagcggccaccacacccagccccgagagggccaggcagcacagacggacaggtagggccagcgtcgccgcacgggcgttgcgtgagaggttcggcatgttcgagtccacttattgttgttgttttgcggaacgggatcgcccggccatggcaggcgtccacggccagagaatggaaacagccgagggccggcgtcaatccagaatgaccgataatcgaacgttaatattattaaccatttaacagatagcactgaacaagactgataactcattgatttacaaaaactaaatcgatatttcaggctgatccgtccacccttcaatttttagttatctttgttaatcttaatttcacctgccaacgcttgaacgagcaggtacttctgctgcgtccgccccaacaaaaacaacaatgaggtttgccatggacactccatcgcgtcgcacgacgctgaccattgccctgtgttttatcgttgccctgatcgaaggcttcgacctgcaagccgccggcaccgccgccgcgggcctgcgccagagcttcgccctggacccgagaatgctgggctgggtgttcagcgccggaatcgccggcctgctgcccggggccttcttcggcggctggatcgccgatcgcatcggccgcaagaaaatcctcatcagcgccgtgctgctgttcggcctgttctccctcgtcaccgcctgtgtcgccagcctctcgggcctgttgctggcgcgtttcatgaccggcctgggcctgggcgccaccctgcccaacctgatcgccctgtgcgccgaagccgcgggcgagcaacgccgtggcaccgccatcagcatcatgtacgccggcgtgcccctgggtggcgccctggcggcgctggtggccatgctgttcaccgatcattggcaggcgacctttatcgtcggcggcctggcgccgctgctggtggtgccactgatgctcctgctgctgcccgagtccagcgcctttcgccagcaacaaggcaaccccggcctgacccgcatctccaccggccaggcgctgttcggcgaaggtcgggcgcgcaccaccctggccttgtggctgagctatttcttcaccctgacggtgatgtacatgctgctcaactggctgccgtcgttgctgctggaacaaggcttcagcaaaccccaggccgggctggtgcagatgctgttcaacatcggcggcgccctcggttcgctgctcggcggcctgctgctggatcgctgcaacggcatcaaggtcgtgctgttcgtctacgccgggttgctcgcggcgctggccggggtcggcctctcggcgggcctgctgcccatggcctgcgccgggttcgccgcggggctgttcgtgatggccgcgcaattggtgctgtacgccctggccccaccctcgtacccgaccctggtgcgcgccaccggcgtcggtgccgcggtggccatcggccgcctgggatcggtggccggtcccctcgccgccggacagatcctcgcggccggcgccggcaccagcggggtcttgctggccacctcgccgggcctggtgatcgccgccttgagcatcatcagcgtgatcgcccgcccggcgtcgcaggtcgaacccgggttggcagcggcgaacccggccgcccccaaaccctgaagccttgacccagctggacatcagcctggttgactgccgtcgtaacgcggttgcccaggctgaaaacagcagcctcccgcgcggaacgctcaggactgcccctaccggggcttttcatttctgcgccgcttttgcatttctgtgcgacagatcccacttcggggactcccgtaccagtcccccgtggtgttaggttgcagagttttttgtcgatcagacacctttcaacaatcagcaaggaatgccctgcacaatggatttttccctcaagcaactggccgcggccaccctggtgctggccagcctgtcagccttcaccaccgccgcccacgccaacatcaccccgcagcagaacgcagcgattctcaagagcttcgctgatgcctcggtcacggatttccgccagttcctcggcaccttgagcaaaaatgaggcggccaagagcgaggtggtcaaagaagccaacctcggcccggccatcaccgccttcctcgacaacaaggcgctttccgccgagcagcagaacgagatccaccgcctgctgggtctctatgcgcgggtgaagtacggcaaggccgccaccgaaaccctgcgtgagctggtggccatccccaccgtgcgcgtcgatggcgtgccgcagcacgagaaccccgagttcctcaagatcgccgacaagatccagggcctggcccaggccttcgacctgaactttcgcaacatcgacaaccgtgtctacgagatctccctgcaaggcagcggcgatgaagtggtgggcatccacgcccatgccgatgtggtgccggtgacaccggagaactgggtgctgcaggacggcaccaagctcgacccgttcaaggtcaccctggtcggcgaccgcatgtacggccgcggcaccgaggacgacaagaacggcatagtcgtggccctgtacgccatgaagatcatcaaggaagagaagctacccctggcgcgcaacttcaagctgctggtggacaccaccgaggaaaccagcggcgacgcgattccctactacttcgaacgcaacccgacgcccaactacaacctggcgctggatggcggctacccggtggtgatcgccgagaaaggctacggcaccgtcatggccagcttcccccggcgtgccgccgagggcaaaggcgcagaaatcgtctcgatgaccggcggcctggccaccaaccagatcccgggcgcctcggtcgccaccctggtgaccgaccagcccgcgaaactcgccgccagcctgcagaaggccggcgccgaatacgccaaggcccatggcggcgacttcagcgtggccgccaaggtcgcaggcaaggacgtcaagctgacgttcaccggcgtgtccgcccactcctccgagcccgagtccggggtcaacccggtggcgcgcatgctcgacttcatcaacggcctcgacggcaaggtcgcgctcaagcacaacccgatcaccgacgcggcgcgttatgccgccgacaactggggcctggactacctgggcaacacgctgggggtcggtttcgccgatgacttcatgggcccgctgaccacctccctgacctatgtcggtcaggacgaaaaagccttcaagctggcggtcaacctgcgcgtgcccaagggcaagacccccgaggtgctgaaaaaggaaattgccgacaagctggccgcctggagcaagcagaaccaggtcgcggtgaacttcgactacaagatcgccgagccgatgtaccgcaaccccgagggtgaatgggtcaaggcgctgctggcggtggccagcgaaaacctcggcatgaagcacgagttcggcacctccgccggcgccacctcggtgcatgaactgcccaacggcgtgcaattcggcctggcccgtcccgaggtcaagtacaccggccacaacgacaacgagttcaagaccgtcgagcagttccagctggacctgcagatcgtcacggaaatgttcggccgcatcggccagctgccgaaactctgagcccttgcggacccgccgccccggcgggtccactgtggtgctcatcccgatccaggtcgggctcgagtcctatccccccgatacacgaccggccaggcgccatgtcgtttctggacatgtcgacaggcgaatggtggcatattgacgccatccaaaaggatagactcagttgcaagcggccaaggttggccaacccacgccggcattgcgtaaggaaaacgctctgcctgcgtctttttgccgtatttcattaaaccgccaccagaaccctgtactaggatacgaggcggcgacgaatccggcgaaaggctctaaacatagtctcgcggcactcgtcgcttactaaggcaagtgtcgcgcaacacgaaactcatggatgaaacgatgaactcacaaatactgttcccacacattggcaaggtcatcgccagcaccggcagtcgcagttttccgcgcatgctgcatgatctgatacgcacccaactggaggtggacgccacgcatatcacccagatgcgtgtgtattcagagggtcaatcgcagcccagaaacacccgcgacgaggtctacagcgactccacgctcgccccatccggcaagaattcgccggcacgccctgccgagatcgccgcgcaactgcacctgaccagccacaaggacgattaccgctacgtgatctcggtctaccgctcctgccagtcacagagcttctcgcaccaagaacgcaccctgctgcaggatttttccccgctgctgctgcccatggtggaggagcacctggcggcgctgcagccgcacaacgccccagggggcccccccgaggccgccgacagcctggaacaccagggcctggaaaccctgcgcctgcgcttcgccgcccgcctgcggcagtcggggctgaagctgtcgaaccgggaaatgcaggtctgcgtcggcctgctcgccgggcgcaccgcccccgagctggccgggcaattgaagctcaaggtgcacaccgtcgagagctacctcaagcgggcggcgatcaagatggggatcagcgggcgccactcgctgctgcgctggatgtactccccggacgaagccacggccacccctggcccgaacaccagcctctgatcctccaggcctgagaacggacgacgcctcgctcgagtcgtccatgggcggggcagccctgaaggcggaatcgcgaaggacgcggacggcgacgcccgccgccacccgcatcaagccgtcacttcccggccctgctccgccccatgcctcgcgccggcccgaagcccatgacgcaacttcaaggccggccgctcgacgcaatagtaggaaacaccgctgaataacagcgacagcgccagcacgctggcaacgatgggcgcatcgtaggccaccggccagaacgctcgcagcaggtacatgaccacaaagtgattgaggaacacgccgtagctgatgttcccgaggaactcgtcgatccggtggaatccgagcttcgtcagcaggtacacggccggcacgcccagcgcgaggccggccgtcacctcggcattgaacggccggcgctctatccagccggccatgatcgccacgaatatcagggccgccgccacggcgctgccgccagcgatcatcaaccccttcgcccgcgcctggtacaggtagctgccgcacaggaacatgaacagcacgccgggcaatagccggtagccgtacaggtcggtgttgatgaaacccaggcacgcggcgaggaagaccgccaccgacagggcaaaggcaacgccgcgcgcccggtagaggatcaggaacgggatcaccaggtagaagcacatctccagccccagcgaccaggccggcggcaagatctccactccggccgccccgaacatatagaaacccaggggcacgatgggcaggctggcggcgatgttccggagcgtcagctcggcggcttgcgacgtgccgggcagcaggaagtagatcaccgcgcaggaggcagcgaagtagaacaaaaattgcgggtaaagccgcaaggccctgtccaggtagaacaggccgacttttgccggcgcccggtagctgcgttcgatcagcgaggtcatcacgaaaccgtgatgatcaggaaggaaatcacagccaccacgccggaattgagccccatgaatgtcttgcccatatgtgaaacagcaaaccagaacagccaacaacaggcgatacgctcccactgactacctcaaaacgtccttgtaattgtggcgcgtaagctacgctgcttcgcgtggggaaaacaggccttttgccatattccgtgagcactgccacagcctttgtcgctcggttgccggcagcccgcccaggcttggcctgggcgggtaatgcacgtcagtcccgcgccagcgcctcgatcgggtccagtcgcgcggcgttgcgcgccggcacgaagccgaagacgatgccgatcagggtcgagcaggcgaacgcggtgacgatcgagcccatggaaaacaccatttcccattccttgacgaacagcgagaacaggtagccgatggcgtaggacagggtgatgccgatcatcccgccgatcaggcagaccatcaccgcctccaccaggaactgctggcggatgtccgactggcgcgcgcccaccgccatgcggatgccgatctcgcgggtgcgttcggtgaccgacaccagcatgatgttcatcacgccgatgccgccgaccaccagggaaatcaccgcgatcagcgacagcagcagcgccagggagcggctggtcttctgcaccgtctgcatgatgctgtccaggttgttggtgaagaagtccttggtgccgtggcgttgcagcatcagcttggtgacgttgtcttccaccaccttgctcggctggccgtccttgatccgcaccgtgatgctgtccaggtagcgctggccgagcaggcgcccggccgcggtttcataaggcacccagacattcagcgtcttgctcgcggcgaacatgttcttgttctcggcggtcaccccgatcaccgtgcacggcaggttgcccaccaggatcacctggcccaggggatcctccccggggccgaacaggcggtggcgggtgttgtggtcgatgaccatcacctgggcctggcgccgagcgtcgctttcactgaaggcgataccggccgccagcttcaacccgcgcacctggaagtactggtcgctgacgccgttgacctgggcgtcgaggtcaatattgcggtagcgcagcaacatgttgcgccccaccaccggggtggcgctgtcgacgtaatacagctggttgagcgcggcgacatcggccggcacgagcgtctcgatggccgtcgcccggctgtcgccgaagctggtgccggaatagatatcgatggtgttgctgccgatggcctggatgtccttgagcacataacgcttggcgccctcgccgatggccgagatcgacaccaccgaggtaatgccaatgacgatcccgagcatggtcagcaaggtgcgcatgcggtgggaaaccagcgccacccaggccatgttgaaggcctcgcggaacagccccaggctggccaccaggcgccgtgcgccattgccctcgagggccaccggcggctcgctgggcggctgggcgccgtcgcggagattggcctggtcgctgaggatctcgccgtcgcgcacttcgatgatccgctcggcatgggccgcgaccttggggtcgtgggtgacgatgatcaccgtgtgcccgagggcatgcagctccagcaggatgttcatcacctccttgccgctggcggtgtccagggcgccggtgggttcgtcggcaagtatcacttcgccgccattcatcaaggcccgggcgatactcacccgctgctgctggccgccggacagctggctcggccggtggcccaggtgcccggtcaggcccaggcgcgccagcagttcccgggcccggccgtggcgcttggcctcggcggtgccggcgtagatcgccggcatctcgacgttgtgcagggcactcaggtgcgccagcaagtgatagcgctggaagatgaagccgaagtagtcgcggcgcagctccgccagggcctggtcgtcgaggtcgcgggtttcctggccgttgatccggtagctgccgccggtggcgtagtcgaggcagccgaggatgttcatcagggtcgacttgccggagcccgaggcgccggtgatcgccaccatctcgccggcctcgatggtcaggtcgatgtgcttgagggccatgaactcgcgctcgccggccatgaaactgcggctgatgcctttgagctccagcaggggttgagactggggctgggtcatggtcaggcccccgccaaggccggcaccggatcgccgatcaccacccggtcgccttcggccagcccgtccttgatctgcaccttgacgttgttgttgatgccggtctgtacgttgcgtgactgagcctggtccttggcgtccaggacccgtaccgggaagctgccgtcgttgttgcgcgggcctagcgcggccaccggcaccgtcaatacatccttggcggtgtcgagcacgatgcgcacctgggcggtcatggagatccgcaggcgatgatcggggttgggcacatcgaacagcgcgttgtagaacaccgcagtggtctgtttcggcgtgcccgcgggctgggtgtcgaggaagttctgcggcgccggctcggttccgcgcagcttggcgtagtagcgccggtcctcgccgagaatggtgaagtacacctcctggccggggctgatatggatcacgtcggcctccgagacctgggccttgacggtcatggtgtcgaggtcggccagcttgagcagcaccggcgccagctggttggcgatcacggtctggccttcctgggtaacgatgcccaccacatcgccgtcgataggcgcgacgatgcgcgtataggccaggttgaccttggcggtgtcgatctggatatgcgcgttcttgatctgcgcatcgagggacaacaggttggcgcgctgcacctcatagttggccgtggcggtctcgaactcctgcctggagatcgccgcgtcttcctgcaggcccaggtagcgttcgtagatcgacttggtttccttgagctgggcaatggtggcgcgccgttgcgcctgcaggttctcctcgtcgacctgggcctggcgcaaggtgttctgcagcaccagcgggtcgatttccgccagccactggcccttcttcaccttgtcgccgagcttgaccttgagcgacttcagctgcccggacacctgggcgccgacatccacctgcttgatgccttcgagcagacccgaggccagcaccgcgttctcgatatcgctgcgctcgaccttggcggtcaggtactgcggcgcctctgccggcgcccgcaccgcgtagaaaaccaaaccggccaccacgaccagcgccaaccccatagcgattttgcgaaacttcgacttttccataggtgatcacaaatccgttgagggtgaacccggcggatgccgggcctcactgtgcgaagcaccctattgccgtcatgaacggtgcttcccgataaacccagcgggctcggccgaccgtggaagcggcggccgaacccattcatcgcccgttgccacaaggcccgggcgggcccttgcccctcatggcagcgcctccccggctgccagcgaccaccccgcctgccaccaggccgccaggtgcgccacatgcggcgccttgagcaggctgaaatggttgcccgggccctgccacacctgcagttcatccacctgctggcgccagccctcaaccattgcctgctgctcgcgctggttgcccgcggcatccaggcgcgggtcatcggccagcaccaggcgcgcccggccctggtagcgccggtgcggtcgatagagggtgcgcaaggcgctggcgaaggtgcgcaccatgccctggatcgcctcgggcgtggaacgcgccgacagcaggccgacgcggaccatgccggcgtgcaactgcgccagctgggcggcatcgtcttgcagggcgaacgcctgcgggtcgatgcccagggactggcccgaggccagttgcagggcgtcgatcaggcgctgcaaggccgctgtggcggtataggccctggccacgccgttgccgccgggagcttcgctgtcgatcagggtcagggacgccacctcgcggccctgggcctgcaacagcgcggccatttcgtacaccacccagccgccgaaggagtgcccgagcaggtgcagcggcccctcgggatatagcgactgcaacgcgtccaggtaatgcgcggccgcgctctcgacccggctgtggggcaccgcgttgccttccaggccgcggggttgcaggccaaggatcgggcagtccgggcccagggcttcggtcaggccgataaagccggtgacgctgtcgccggcccccggcacgcagaccatcggcacttgcccggcgcgcccgctctggatcgtcagcaacggctggtagagcgctgccggcgacgccgccgcgcgctccgccgccgcagcctggatggcttggccgatggcctggcccagcacctggatatgcggcgcctgcatcatgctctggtgatcgcccggcaccgcgatcgcccgcaggcgctccgccgccagcacctggtcccaacccagcagtgggctgcgccgcgacaactcggtcggccgttcctcggcgcagaacaggtgcaccggcaggtccagggcgcacaggctgtaatgcgccagggcatggccatggcccacctcgcgctcgaggaagcccagcaggtcgacgtccgtcgccgcggccatgtccggatacagcagttgctggtcgcggcagcgttgcagcaacccggcaaagtccagcccgtcgagttcctggtgcagtcggtcaaggctcgccagcgccgccgttccagccgcgccctgggctttccagtacaggctgcattgcagcagcaggtgcagcttcagcgcgttgtcgccggaccagcgcgccttgccctgatcggtcagacgcggcacgtagctgtcgatcaggccgaggaattccaccacctggtcctggccgatcagttgctgggcgatctcgtaggccagcaccccgccgaacgaccagcccgccaggcgatacggcccttcggcctgcacctcgcggatgatccccaccaggcgcgtggccaggcactgcagggtgtgcagctgcggttggccgagggccacgcccggcaagccgtagatcgggaaatcgccggcgatatgcttgcccaacgccgggaagtacacgtccaggccactgaactcatggaccaggaacaacggcggctggctgccgccgctgcgcaccgggatcaacgtctgctgctgcggttgcgaggcacccccgcgctggctgagcaaggctgcgatggcggcgacgctggcatgctcgaacagctcggccagggtgatgtgcaggtcggcctgttgcagcagggtgaccagcctgatcgccagcaacgagtgcccgcccagctcgaagaaactgtcatggagcccgacccgctccagcttcagcacctcggcccaggcctgggccagggtctgctccagcgggctggcgggcgcctggtattcgccgtgcagcaaagcctccagttgcggcgccggcagcgccttgcgatccaccttgccattggcggtcaacggcagctgctccagcagcacataggccgagggcaccatgtagtccggcaactggccttgcagataggcccgcagccgctcgatggccagcgccggctcggtggcctgggcggtgcagtaagccaccaggcgcttgtcccccggcacgtcctcgcgagccagcaccaccacctccttgacgcccgggcaggtggccaggcgcgcttcgatttcccccagctcgatgcggtagccgcggatcttcacctggtcgtcgttgcgcccgaggcactccagcaggccctgcccgttccagcgcccgaggtcgccggtgcggtacatcaggcgctgcggccgcgggctgaaaggatcggggagaaacttctcggcgctcagttgcgcgcggttcaggtaccccttggccacgccgtggccgccaatgtagatctcccccaccacgcccaccggcaccggttgctggcgggcgtcgagcacatacacccgggtgttggaaatcggccggcccaccggcacgctgtccgcgtccgccgccagcgccttgacctcatgggtggtggcgtaggtggtggtttcggtggggccgtagcaatgcaccaggcgcaagcccggggccagcgccagtaagcgccggaacgccgccgggtcggcgcgctcgccgccgcacaagagcatccgcaggcccttgagggcatcgggaatcaactgcacatactggttgaacagcgccgtggtgacgaacagcacggtgctgccgctggccttgagcgcggcgccgaagcgctcggggtcgagcagggtgtaatggtcgatcacctgcacctggccgccgttgagcaaggcgccccagacgtccatggtgctggcgtcgaacgccgggttggaggcgaacgccacccggtcctgcgggttgaaatcggcatagccgttgttcagcaccagccggctgatgccgcggtgcggcaccagcacgcccttgggcgtaccggtggagcccgaggtgtacatgatgtacgccactgcttcagcggaccgcgccagctgcgggttgtgctgcggctggccggcaaggtccagccggtccagctcgacccggtgcaccgggccggccggccactcgccgctgcgggtcagcagcaacactgcctggctgtcctcgagcatgaaggcctggcgctcggccggcgcgtggctgtccagcggcacatagaccgctgcgcacttgccgatggccagctggctgaccagcaggtccagggaacgctccagcaggatcgccacgctgtcccccggcttcacccccaggcccatcaggtaatgggccaggcggttggcccgcgcattcagctcgccatagctcagcgactgctggccatgcaccgcggcggtggcctcggggtgggcctgggcccgggcttcgaacagctgcgtcacgctctgctcctcggggaactcgcgcgccgtggcattgaagccttccagcagttgctgccgttcctcgcgggagaggatcgccaaggcttcgaccggcgtctgcggcgcctgctccagggcctgcaccaggttttccaggacgcactgcatatagccgcagatccgccgcgcgccgatgcccggcagggtcagcgcggtcaggctgaaatcctcgcccaggtcatcgacgctcaggctcagcagataattgctgcgctcctcggtcttgagcagttgcatgccctgccaggccgtggaagccgggccggcatccagtgccgtcggcgcgctgtgccggtagttgagcaaggtgttgaacagcggcgtggccggcgccaccgcgctgcaacgctgcaccagcgccagcggcgcatgttcatggccgagcaattgagtcaggcgttgatgagtggccagcgccgcgctgcgcagcgcctgcccgcccagttcgacccgcagcggcagggtgttgatgaacacccccagcgcccgctccgcgccctcgccgccctgcatgcgcccgagcagcacggtgccgaacaccaccgatggctggttggacacccggctcaacagctgcccccaggccaggtgcatcaggctcgcggcactgatgcccagctgccgggcctgggcccgcaggcgccggctcaagccggcatcgagggccaggcgtgcctcttcggtgtcgccgccctgctctcgcgccgacaggccgaacggccgggtcggctcgtcgaagtccgccagcagtgcgcggaagaacgcctcgtgttcctgctcgccgatgcccaggcgggtctgcgccacatagttgcggtacggcaccgccgcccccagctgttcgccctcgcccagcagccaggcctgcatctcctgttgcagcacttccagggcgatgtggtccatcaccaggtgatggaacagcaacagcgccaccacccgcccgttgaccgggtcatgggcatgcaccaggcgcagcagcggcgcctggcccaggtccaggcgataccgccgtgggtcgaagcgtgcccgcagctggtccagcacatcgccgtccgcgccgtccacggccaccgcttcgcagaccagcgaagcctggcgccagaccacctgcaccggctcttccaggccttgccaatgcaccgagctgcgcaggatatcctggcgctcgatcaccgcctgcaaggccaggacaaaggccgccaggcgctccgcgctggcaaaggcaaactgcgcctgcagcacataggggtcgccctggctggcggcgatatggtggtagaggatgccggcctgcaacggcgccagggcatagatgtcctgcacattggccaggccgccgggcacgctggcgacaatccgctcgatcgcctcctggctcaggttggccaggggcagcatggccggggtgatccgcgcgcagcccgggacgatggcattggccggcaccgcgacctcccgcccagcacccaccgctgccgccagcgcggccagggtcggttggccgaacagcacccgcacatccgccgccagcccggcccggcgcatccgcgcgtattggtcctgcatccacaacaggcgattgaccacggcgcggtgttcattgatcacacccttgggtttaccagtggaacccgaggtgtagatcacatagaccagatgccgtggagtcagctcggcgatgactggattgtcgagcggctggtccagccagaccggtcgatccagatcgattaccggcgcatcccccaacagctcccgggtcgcgccttgagccaagaccactaccggcgcgctgtcttccagcatgtaggcgatccgctccaacggatacgccgggtccagcggtacataaccgccgccggccttgaggatcgccagcaaacccaccaccatctccagcccgcgctcgacacagatcgccacccgcgagtccggccccaccccctgctgacgcaggtaatgcgccaactggttggcccgctcattcaggacgcggtacgtcagtgattgctcaccggccttgaccgccagcgcctgcggagtgcgctcgacctgggcctcgaacagcccatgaatgctctgctcaaggtcgtaaggcacctcggtatcgttgaacgccaccagcagccgttggcgctcctcgtcacccagcaggaccgcctgctccagcaccgcctgatcgttgccgaccatggcctgcaacaaccggatgaaataaccgaggtaacgccgcatcgtggtttcgtcgaacagcgccgtggcgtattccagcgaaccgccgatacgcccccgtacctcgcccaggctcagggacaggtcgaacttggccacttcgctgaccggcgccagcccttgcaggcgcaagtcgcccagggccagttcggggccgtcgtggtgttcccagctcagcagggtctggaacagcgggctgtgggacaggctgcgcaccggccgcagcagctccaccacctgttcgaacggcaggtcctggtgggcctgggcttgcagggtgcattccttgacccgggccagcagcgcctcggtgctcggcgcgccggaggtgtcgatgcgcaccgccagggtgttgacgaacaggccgatcagcccctcgacctcgacgcagcggcggttggccaccggcgtgccgatcaccacctcggcctgcccggccaggcgactgagcaactgggcccaggccgccatcagggtcatgtacagcgtggtgccatggcgctggctcagggccttgagcccggcgctcagcgattcgtccagcagcacctcgagccgctggccggcatggtcctgctgcagcgggcgcggccggtcggtgggcagcatcagcaaggccggggcgccgcccagggcctgctgccaccaggcgccctggcgttgcagcagctcgccgccaagccaacgccgctgccagacggcaaaatcgccgtactgcaccgccagcggcggcaacgggtctgcctcgccacggctgaaggcctggtacagcgccatcagctcgcgggtcagcacgcccatggaccagccgtcggtgacgatatgatgcagggtcagcagcaacacatgctcgtcgtcggccatgaccagcagccgtccgcgcaacaacggcccctgctgcaagtcgaaaggctcgctggcttcacgccgcgccagcgcctgcaaggcctgctgcgcctggggatgctggcgcaggtcctcgatgcccaggctgaaggcctgttcgctggcggccagcagcacccggggttcgtcgtcgaagacggcaaagcggctgcgcaggctgtcatggcgctggacgatgcgcgccagcgcccgctgcagcgccgccaagtcgagccgcccgtgcaggcgcaggcccagggcaatgttgtaggtggcgttggcgccctccatctgcgccaggaaccacaggcgctgctgggcgaacgacagcggcagcggctcgtcgcgcggcaccggcaggatctgtggcagcgtgctgcgcccggccccggccagcacccgggccacggccgccagttcggcgttggcgaacagctcgcccagggtcaattccacccccaggcgctggcggacttgcgagaccatgcgcatcgccagcagcgaatggccgcccagctcgaagaagtgatcctggcgcccgatgcgctcgagcttgagcacctcggcccagatctgcgccagggcctgctccagctcgccttgcggggcctcgtaggcgcggcagaagaccgcgtccatgtccggcttgggcaacgccttgcggtccagcttgccgttggcggtcagcggcaggctggcgagcttcacataggccaccggcaccatgtagtcgggcaactgcgccagcaggtaggcgcgcagttcgccgactgccagcggttcgacctgttcctgctcggtgaaataggccaccagccggggatgcccgggctcgtcctcgcgggccagcagcaccgcgtcctggatgcccggcaactggttgaggcgggtctcgatttcccccagctcgatgcgcacgccacggatcttcacctggtcgtcgttgcgccccaggtagtcgagcgtgccgtcggccagccagcgcgccaggtcgccggtgcggtacatacgcgcgccccggccttcgaacgggtcgtcgaggaagcgctcggcgctcagctccggacggttcaagtaaccccgcgccaccccggcgcccgccacatacagctcccccgccacgcccagcggcaccgggcgcagctgcgggtccagcaagtagatgcgcgcattggccaccggcgtgccgatatgcagcggctggccggcctcgatccgcccggaggtggcgaccaccgtggtttcggtcggcccgtagttgttgatcacctcgaagcgctgggtgcgggcgaactggcgcagccggtcgccgccgatcagcagcttgcgcagggtcgggtgttcgaggttctggctgaaggcgtattcggccaccggggtcggcaagaagctcacgtccagcggctgggcgcgccaccagtcgagcaacccgtcgatgtctt

SEQ ID NO: 4 - DNA, 1127585 bp, Pseudomonas fluorescens KENGFT3
cgtctggaatctgtcgtcaagggttaattacacttttgtggcagaaggtgcttttttagcaataagacgggggattcgccgcataactggaggcacccgcagcagaagaagcagcgcaccgatggaagcgtagacagcccactccttcaaatcagcccgaactatccagagcatgtgcagcagaccaagcccgagaatcacatagaccaagcgatgcaacttcttccaacgactacccaaccgtcgctggctgtagcgattagatgtgacagccagcactaataaagcaagaaaccccaacgcccccacaattatgtaaggccgcttgcgcagctccacgccgagctgggaccaatcgagcccaaggacgaacacgcaataagccgccaaatgcaacacaacataggcaaagcaccacaagcccaattgccggcgtaccgcgatccaccccgcccaaccgctcaacttctgcagcggcgtcatcccgagcgtgaccagcagtagaatcaacgtacccaggcccaggcgatcgaccagcacttttcccggatcaggcccaagggcaaaactccatgcttcatatagccagagcaatggccaaaccgccgcagctatgaagaccccaatgcgccagattggaaagcgcatcagtagttcttccgcaggtcgagacctgtatataaagaagcgacctcatcggagtagccattgaacatctgcgtgtcgcgcacattcggactgaacaggccgctggggagtcgtcgctccctcgcctgggtccaccgcggatgatcaaccgtgggattcacgttcgcataaaacccatattcatcagccgcaatgctttgccaggtggttttcggctgttcgctgacaaggctgatccgtacgatggatttcacactcttgaagccatacttccacggcacaaccaggcgcaacggcgcaccattctggttaggcaattcgcgcccatacatgccaacagcgaggatcgccagtggattcatcgcctcatccagacgtaacccttctacataaggccaatcgatcaagccaaaacttgagcgctgccccggcatgctcttcggatcctgaagggtctcgaaccggatgtacttcgctttggaggtcggctcaacctgcttgagcaacgccgagatcggaaagccgatccacgggattaccatcgaccaggcttcaacgcagcgcaggcgatagatgcgctcttccagctcatagggcttcatgaagtcttccaaggcataacgcccaggcttcgccacctcaccgtcgatgacaacactccaaggctcggtcttgagcgaacctgcattcgccgccgggtcgcccttgtcggtaccgaactcataaaaattgttgtagttggttgcgtccttgaacggcgtgatcgcctcatccttgaccgtcaccgcctgccacttcgttccaggaagcttctcggcaaaccaactgggcgccctgcccgcctcgacatcggcatagcgcgctgcatcgtccgcactggcccaacgcggcaagctactggcggcaataccggccagcgcaccaccgagcaagctgcggcgagagaaatagaaggattcaggcgtgacatccgattcgtgacaatcggacgctttaggcaatttgattaacatggcaactccgcagcattggagaactgatgcaccaatagactgcggagtatgggggaaattacattaagacaatgttttgtcccgacgcagatgcagcaagtactgaatcggccccgaagccgcgtagacgaggaacgccaacagcagaatacgcggcggatcgctgaacactaccgcaaacaccagtaccaccacgaggatcgccacaaaaggcacgcgccccttgagatccagctccttgaagctgttgtacttgatattgctgaccatcagcatgccggccgccgctaccatcaaagcgaccaggaacgacattttcgagccctgaataccgtagtcactgaatgcccacacaataccggctacaacacccgccgctgccggactggccagaccgatgaagtagcgcttgtcagcggtcccgacctgggtattgaagcgcgccaggcgcaaagcggcaccggcaacatagataaaggcaaccatccagccgaccttgcccatgtcacccaatgcccaggcaaacgccagcaacgcaggtgcgacaccaaaggcgaccatgtccgacaacgagtcgtattcggcgccgaaggcactctgggtattggtcatccgcgctacgcgcccatccaggccgtcgagcaccatggccacgaagattgcgatggcagcaaaaccaaaatacttgctggcactcgccgcatcacctgccgccagtgcactttgggcactcatggagttgatgatggaataaaagccggcaaacaggttcgccgtcgtaaacagattgggcagaagatagatgccacgatgccggaccttacggccttcggcgtcatgcccttcttcgacatgttcatcgatcggcagcatgctttcggcgtcggaagcctggtttggctcttcgggacgttcgctcatggactttaccttgcaacggtgtgaaaaaaattcgacagatacttgcggcgagtgttcgcccgcaaacgatgcagctttataccagaaccggcccctcaaacgaaaaaacgcggcctaagccgcgttttcccttgatgcgtacgacttagttcttggctttgtcgacgatcttgttggcaccgatccacggcatcatggagcgcagttgctcgccgatgacttcgatgccgtgagcggcgttgttacgacgcttggcggtcatcgaagggtagccggtcgcgccttcgctgatgaacattttggcgtattcgccgtcctgaatacgtttcagggcgttgcgcatggcttggcgggactcggcgttgatcacttccggaccagtcacgtactcaccgtactcggcgttgttggagatcgaatagttcatgttggcgataccgccttcgtacatgaggtcaacgatcagcttcagttcgtgcaggcattcgaagtaggccatttccggcgcgtagccagcttcaaccagggtttcgaaaccggctttgaccagctcaacggtaccgccgcacagaacggcttgttcgccgaacaggtcggtttcagtctcgtccttgaacgtggtttcgataatgccggtgcgaccaccaccaacgccagcagcgtaggacagcgcaacgtttttggcgttgcccgaagcgtcctggtagatcgcgatcaggtcagggataccaccgcctttgacgaactcggaacgcacggtgtggcccggggctttcggcgcgatcatgatcacgtccaggtcagcgcgtggcacaacctggttgtagtgaatcgcgaaaccgtgggagaaggccagggtggcgcctttcttgatgttcggctcgatttcgttcttgtacagcgcggactggaactcgtccggggtcaggatcatgaccaggtcggcagctgcaacggcggaagcgacgtctgtcactttcaggccatgggcctcggccttggcaacggtggccgagcctttgcgcaggccaacagtgacgtctacgccggaatctttcaggttgcacgcttgggcgtggccctgggaaccgtagccgatgatggcgactttcttgccctggatgatcgacaggtcacaatctttatcgtaataaactttcatgaggttcctctatatatccaggccgtaaggccattcgctaatttgggttagatgctgagtactttgtcgccacgggcaatcccggtgacaccactgcgtacggtttccagaatcgaggccgtcccgatcgactggatgaagctgtccagcttgtcgcttgtaccggtcagttgaacggtataaacgctggcgctcacatcgacgatctgcccacgataaatatcggtagtccgtttgatctcggcacgttgggcacccgtggccttgaccttgaccagcatcagttcgcgctcgatgtgggcactttccgacaggtcgaccagcttgaccacttcgatcagcttgttgaggttcttggtgatctgctcgatcacctcatcgtggcccacggtggtcaacgtcaggcgcgacagggtcgggtcttcggtcggggccacggtcaggctttcaatgttgtagttgcgttgcgaaaacaggccgacaacacgggacagagcgccgggttcgttctccagaagcagggagataatatgccgcatgattaagtacgctccgtcttgttcagccacatgtcgcgcatagagccgtctttgatctgcatcggatagacgtgctcgctggtatccacctgaatatcgatgaacaccaggcggtccttcatggcgaacgcctcttccatcttcggcttcagatctttcagatcggtgatgcgaatgccgacgtggccataggcttcaaccaacttgacgaaatccggcaacgattccatgtaggaatgggagtgacggctaccgtagctcatgtcctgccactggcgaaccatgcccagtacaccgttgttcaggcagacgatcttcaccggaagaccatattgcaggcacgtcgacagttcctggatgttcatctggatgctgccttcaccggtgacacaagccacgtcggcatccgggaagctcagcttcacgcccatggctgccgggaaaccaaagcccatcgtgcccaggccaccggagttgatccagcggttaggcttgtcgaacgtgtagtactgggctgcgaacatctggtgctggcccacgtcggaagtcacaaaggcgtcgcccttggtcacttcgcacagggtttcgatcacggtttgtggcttgatgatgctgccgtcgcccttgtcgtaagggaacaggccacgatcaccacgccattcgtcgatctgcttccaccaactggcaacggattccttgttcggtgcctcgccaatgtccttcagtgcagcgaccatttcggtcaacacgctttccaccggccccacgatcggcacatcggccttgatggtcttggagatagacgccgggtcgatgtcgatgtggatgatcttggcattcgggcagaacttgctcgcgccgttgatcacacggtcatcgaaccgcgcgcctacggccaggatcacgtcggcgtggtgcatggtcaggttggcggtgtagctgccgtgcatgccaagcatgccgacgaactgacgatccgaacccgggaatgcaccgaggcccatcagggtgttcgtcaccggcaggttgagcaacttggccagctcggtcagcggagcagaaccaccgcccagaatcacgccaccaccggagtagagcactggacgcttggccgccaggagcatttctgccgccttgcggatttgccccgagtgcccacgcacggccgggctgtaggagcgcagcttggctttcttcgggaagatgtattcgaacttttcggccgggttggtcatgtctttcgggatatcaaccactacagggcccgggcgaccggactgtgcgaggtagaacgccttcttcatgacctccgggatttccgacgcatgcttgatcatgaagctgtgtttcacgatcgggcgggaaataccgatcatgtcggtttcctggaatgcatcggtaccgaccatggtgctggcgacctggccggaaatgatcaccatcgggatggagtccatataggcagtcgcgatgccggtaatagcgttggtagcgcctggaccggacgttaccagtaccacgccggctttaccggtggcacgggcgtaaccgtcagccatatgggtcgcggcctgttcgtggcgaaccaggatgtgggtaacagccggttccttgaacagcgcgtcgtagacatgcagcagagcaccacctgggtacccgtagatatagtcgacgccttcgtcacgcaaaaagcggacgagcatctcaccgccagataaaagctccacgttgttcacctctaaaacgccagaataccgtccgttaaaaaccgacgggtcttaataggtttacttctcaacagagcatgagcgacggtggtcgccgactacgtcagcactgactgagcaagtattgggatcgtcccaagtgttgcgggcttttcccacccagcgcgaggtaacgcgttgcgggtgttacaggtcggcgcggatgtgcgcctcatgatctgctgagcgggcctgcttctggcagtcccgatacagcggactttggattcttctgtttcaggccgttcaagtcaagcaataattgcgcttttttccaactaagcgcatgagaacgtagaagaaatggctttgaggagggataaaactcgcctgaatgtcgtcaagcggtagaaatgtgcgcaagactgccgaaaaagccggcagtcaggcaattaacgagcgtcgacgatcaattggtcgaactttttcagcgcattgcgcaagccaaggctctccaacggccggtcggcgtagaccatctcggccatttccaggattcccgacgcgttcggcaatggcaggtcctgctccaggatttgcttcatgcgcgcgaggaagatccattgcagccactggtggaagtccagggtatcgaccgaaaagggctcgacactgctgagcgcttcagcgctggggggcacttcgtcccaccagccctgcacgcgcagttcgcgctcaatcagcaataactgttcggcaatcgctggaaaacgcgcatccatcagaggctgaccttggctttctgccgtgcctgggcggcacctgcggcgtcaccctgggcagcacgcgcatcaccgatcaaggcccacaagctggcttgcagggccgggcgaccattggacagggacaggccacggcgagcgaattgctccgcttggggtgcatcgccctgggccatgcgcacctgggccagacgatacagcacttgcggctcgcgaggcgccacgcgctgggcacgttcaaggctagacgatgcgccattcaagtcgccccccgcctgctgctgttgagcggtggtgagcagcgccagcaccgggccatccagttgttcatcagccgacagcccgcctgcgctggatgccgacggaatcccgcttggcgtcgatggcatggtgtaagtgccctggttgaccggcgcagtttgaatcggcgcggaatccaccggcccggaggtgctggggcctggagtccatggctcggcactgataggcgccgaggtcgcggcaccactgccaggcaccataacaaccacgcctgaatcctgcggtatcgcttgggttgcagcttgggcagcacgcttgaccacggtctggcgaaagccaccattggccgagatgcggtcgttattggagacggccgtgcttgagtccaccacgggaattgagccgcgctgcacgctggagcaaccgccgagcaaagccagagccgcaatcgctggaatccacaacttgttcacttgaaaccctctttgcttaattcatccagcccttgacccaatccatcaccgattccgcgtcagcaggggcactgccaccgcatgcggcgccgggtggtggttcgctgccgcgaatatacggcatctgtaccgcgcccggacagttggcatcagagccttggccggtgtgcgggtcgatccaggcctgcacgatattgtccggctgcggcatgttgagcggcaacgggtcggccttgcgcatgaaactggtccacacctgcaacgcaccggtggccccggtaaacggcgtcttgccgttatcgtcacgccccagccacaccacggccaatacatcctggccaaagcccgcgaaccagctgtcacgcgaatcgttactggtaccggtcttgccggccagggtcaggttcgacggcagcacgttatagaccgaacgcccagtaccctcacgcatcacgcgctgcatggcgttctggatcaggtagatagagcccgcgtcgaaacgctgctggatctggaacggataacgcttgagcggctcgccatcggcggtcagcacactgcgaataccgcgcatcggcgtattgaagccgccgttggccagggtttggtacatggtggccacttccatgggagtcatggccgcagcgcccagtagcatggacgggaacgccgggaattcacgttcgatccccagtcgcgccaatgtcttcagcacattcggcacaccgacctcaagccccaggcgtgaggtcgagatgttgtaggaatgtgccaacccctgatacaggaacaccgtaccgtgggagcgtcgatcgaagttcttgggcgtccagacctggccgtcggcgcctttgaccgatagcgggtcatccgacagccaactggtcagcgtgtacttgctgggtttttccaatgcgctcaaatagacagccggcttgaccagcgagcctatcggacgcacagcatccagcgcgcggttgaagccggcgaagctggcctggcggctaccgatcatggcctggacttcaccggtctccgggttggtcacgaccatggcggcctcgacttcatccgagcctttgcggccggtcaggcgcttgaaggtgtcgttgaccgacgcttcggccttcatttgcaggatcggatcgaagctggtgaagatccgcaggccctcttcggtcaagtcttcgtcacggtagtcttcacgcagctgacgcttgaccaggtcgataaagccggggaatgagctgtctgccaacttgccacgggtggtcacacccagtggcattttcttcgccgcggccacctgctcggccgtggcaacaccttgctgctccagcacatcaagtaccaggttacggcgctcaagcgcacgctccgggttgcgacgcgggttgtaataggacggccccttgaccatccccaccagcaacgcgacttgatgcaacttcaactcagacaatggctgcccaaagaagaattggctggccaagccgaaaccgtgcaccgcgcgctggccatcctgaccgacgaatacctcgttgaggtaggcctcgaggatttcctgcttgctgtaatgcagctccagcaacattgccatcatggcttcagtgagtttacgggtcaggctgcgttcgttggtcaggtagaagttcttgaccagttgctgcgtgagcgtactgccgccctgggtcatcttgccgccggaggtgttgacccaaatggcgcgggcaatcgacttcggcgagacgccccaatggctgtagaagtcgcggtcttccacagccaccagggtttccagcaggtacggcggaacctgatcgagtttgatcaggatgcgatcttcaagatttttcgggtaaataccgccgatcatcaagggttccaggcgcaccaccggcagcttggagccattgagcgacgacagctcagccacatagtcgccggaaaaacgcacacgcacaggctgagctttttccaggccttcgtagaactggaagccacgggtgttcaggtcgacggtattaccgctgacggccgccgcgcccgggccattgctcacgggctcgcgacggtagcccagtgcgtcgagctcggtcaggaagtcttccttgctcagcttctggccagagaacaactccagcgggcgtgcgtacaccttggccggaatggtccagcgcttgccggagaacttttcctgaaccacggcatcgaggtacaccgcaaagccggcgatcaccacaaggccaaccaggccaagcttgagcgcccagcccagccaggggcgcaggctgcgggaaggaggttttttacgggaacggggagatcggcttcgagtcatggcggcggattatacgcactttattgatgatcaacatgagccggacagcggtttgcacgactggcatcagcagccataatgcccaccatgatttctccccgactttgaaggatcgcccgtgagccagtccctgatcgctgccctgcaaaacccggctttgtaccctcatccggttgaagcgtttcaagtcatcgagacccatatttcctgggtgatactgacaggcgcctacgcatataaactgaagaagccgatgaacttcggcttcctggacttcacccaactggaggaccgcggccacttctgtcgcgaggaactgcgcctcaatcagcgcctgaccgcagatttgtatcttgaagtgttgccgattaccggcactgccgaagcaccgcaactgggcggcgatggcccggtgatcgagtacgcgctgaagatgcgtcagttcccgcaaagccagatgctcagcaccctgcaagccaacggcgaactgacctgcgcgcacatcgacgagatggcccagcagattgcgcacttccacctcaccgcccccaaggttccccaagaacatccggccggcacgccggaggaagtgatggctccggtgcgccagaacttcgaccagatccgcccgtttcttagcgacaaggccgacctgactcaactggaggccctgcaagcctgggctgaaagcagttttgaacgtctcaagcccctgctggagcagcgcaagctcaatggctatacccgcgaatgccacggcgatatccacttaggcaacgcaaccctcattgatggtcacgtggtgatcttcgattgcatcgagttcaacgagccgttccgctttaccgatgtgtacgcagacaccgcgtttttggccatggacctggaagatcgcggcctgaaaagcctggcacggcgttttatcagccagtacctggaactgaccggtgactaccagggcctggagctactgaacttctataaagcctaccgtgcgctggttcgcgccaaagttgcgctgttcagcatgccgagcgaagcaagcccggtgcaacgcgccaacaccctgcgccagtaccgcaattacgccaacctggcagaaagctacagcaccattccgtctcgcttcctggcaatcacccatggcgtttcagccgtgggcaagagccatgtcgccatgcgcctggtcgaagccttgggcgccgtgcgcctgcgctcggatgtggaacgcaagcgtctgtttggcgagcaacagatcgaaaacacgccacaggccggtatctacaatcatgacgccagcgctgccacctacgcacgcctgaacgaaatggccgacaccgtgctgcgcgccggttacccggtggtgctagatgcgacgttcttgaaacgcgctcaacgtgacgcagctgcccaagtcgccgaagctaccggggcgccgttcctgatcctcgattgcaatgcgcctcaagccgttattgccagttggctggcacaacgtcaggcggataaaaacgacccgtccgacgcaacactgagcgttatcgaagagcagcaagccagtcgtgagccgctgacagcacaggagctgttgctgagcaagcgtgtcgagaccaatgaaagcgggaccctcgacgctttagtcgctcatatccgtcagcgcttgccgggcctgtaagaaatatttcttggtcgtgtcgtctacttcgacgcacgacccagaaatagtggcactataatggcgtcataattccaacaggagtcgccattatgagtcagcccaagcttctcgacaccccgctctacgcgctcctgcacaaggacgacatccgcggcttcaatcaggaacgccctgagggtggccccatcgacatgcgtggtggcgacttccggggcttggacctgcgcgacctgaacgccaaggatgttgacttcaccgacgcctatttccgttcggccgacctgcgcggcctggatttacgcgattgctcgctggagggcgccagcctggcccacgcgcagatttcggggacttatttcccacccgagctcacggctgacgaaattctgatgtcagtcaatttcggtactcgcctgcgctaccgtaccaagtagccttcgcccagaaccccggctaagtcccaggcgcgccgggcggttgccgcctgcctgtctctaaagccatcacaccattcttataagcttttcgcccgcttctgaccaaagaaccacgcttttcctactgagcgctacactcattttcaggctgcctggtcacgacacccaccgcaccattcggccgtcgcaaggaggcttgatgaacgatgagctgcaacacctgaaaaacctaggcaagacgtcagcgcagtggctgcatgcggtgggcatccacagcgcgtccgatttgcgtcgcctgggagcggtcgatgcttaccgagccgtgcgaactcgcggctttcgagcatcgaaagtcctgctgtatgcaattgaaggcgcattgatggatgtgcactggaacgacattcccacggagcgcaaggaggcgctcaaccgtcagctggatgctatgtcaacgcgtcagaaaaactagattggcgtgcagacccaatgtttacgggcattacaaacgggcgtttgagaaaactcgatgagcatgcaaaaacaaatgttgactctcaaatgagaatcgttatgattatcacaactggtcgcgagatcagccgataactgaaagaccattggttcggactctcagattatctcctcatcaggctaatcacggttatttgacccggctcttgccgggtctttttttgcccgcacataactgagctcagcgcgcaatgatcagcgggtgcccgcgctccggatgtggctgtaccagaacctccaagccaaagacggccttgagcgattcaggttgcaggactttagagggcgtatccaaggcatgagggcgtccgtctttcagcaacaggatgcggtcgcagtaacgcgcggcaaggttcaagtcatgcaggatcaccagcacggcagcgcctttatcggcgaagctgcgaatggcctgcaacgtggtgtgctggtgcaaaggatcgagcatcgacgtcggctcatccaacaacaacgtctgccccgcctcacccggccataactgcgccaatacccgcgcgagatgcacacgctgccgttcgcctcccgacaaagccaggtaactgcgaccactcaagtggccgacatccgccgcttgcagcgccgcattgataatttcgtcatcgcacactcgcccggtctgatggggcaagcgccccatgcctaccacctcttcgacacgaaaagcaaaatccagggttgagctttgcggtaacaccgccaggcgctgggcacgctgggcgccgcccaggctcttcaactcttgctgatccagccacactctgccctgatcaggctgcaactccccgcaaagcgcccccagcaaggtacttttgccggcgccgttcggtcccagcacgcccagtacttcgcccggcaacaggttcaaggtgacatcggccagcacggttttacgccctcgccgtatctgcaacgcttcagctcgcagcatcaggcgcgcccccgcagtaacaggtagaggaaaaatggcgcaccgataaatgcagtaacaataccaatcggcagctccgcgggcgccagcgccaggcgtgccaccaggtccgcaaacaacaacaaactcgcccctgccagcaccgaggccggtagcaatacccgatgatccggccccgccagcagccgtaccaggtgcggcaccaccaagccaacaaagccaatcatccctgccgccgccacagccgcaccaacgcccaaggccgtgcagaacaccaattcacgcttgagcccctctacatcgatgcccagatgattggcctcagactctcccaacaacagcgcattcaatgccttcgcccgacgcggcaaccacagcgccacgcccgcgctcaccaacagcaagggccacaaccgcgaatagctcgcaccattgaggctgccgaggttccagaacgtcagggtgcgcaaagtggcgtcatcggccaaataggtaaacagcccgaccgccgaactggccagcgccgtaagcgcgataccggcaagcagcatcgtcgcaacgttcgtctggccattgcgacgccccagccgatagaccagcgccgtgacgcccaggccaccgagaaatgcgcacaacgacaacaggtacggcccgaaggcatccggcagcccgccaaaaaacgaaccgccgacaatcgccaccgccgcccccaatgctgcgccgctggacacccccaccaacccaggatcggccagcgggttgcgaaacaatccctgcatcgctacccctgacaacgcaagcaccccgccgaccgcaaggcccagcaaagttcgtggcaggcgaatctgccccaggatcaactcggcttgttccaagcctgctgcttcaatcggcacccccatcagtcttaaagcagccctgagcgtgtccaccaatggcaggctgaccgggcccagggccaatgagagccagatcgccaatagacataacagcgacagcccgatgaacagtgttttcggcttgaccagagtggtcatggagcaggcttggcctgggacggataaaacccggcggacagcttcaccaagctttgtggcaaccgcggccccaggccacccaccagtagggtcggatccagctcaaacactcgcccgctcttggctgcaggtgtagacgcaaggatcggattttccttgaacaaggctgcccgcgccgcatcgccggtgagggcgcgatcagcaaacaccagcacatccgggctcaaccctgccagcgactccactgaaaacggtttgtagcccgtgtgcgtggccagattacgcccgccggcctgctgcaacagccaatcggcggccgtgtccttgccagcaaccagcggcttgccaccggcattgcccagcagcaacagaacacccggcgccttttgtgtggcctgggccttgttcacccaattcttttgctgctcaagcgcctgctcatatccggcaaacaacgtgttggccttggcctcactgccgagcaacttccccaggtgttgaaggttgtctttcaaggtcggcagatccggctgggccgaaaacatatccacctgcacgccagcattgcgaatctgcgccaggaccggtggtggccccatttcctcggtgcccacgaggatttgcggttgcaggctgagaataccttcggccgacaactgccgttgatagccaatgctcggcaacgccttgagcgattcgggatgctgactggtggtatccaccccgaccaatttcgattcaccgcccagtgccgctacccactccgatagcgcccctccggcactgacccagcgctgtggcagctcagaggcttgcgccccgtggttgaccagcagtgaggcaacaagcgcaattgcgctggtactcagacgcataacagggtttccttcctaggcagggccgctcaagcactcatcgatgtgacagataatccctgccaggcatcgtattgagcacccagtcaactgacgggcgaagcgggcatttgataattgtttgcatttgaacgtcaaggcacttaaggattgaaatgaagtttctctgcgcctcaggcggcctcgcccccaacagcagccgcagttttgagatcgacggctgcaagctgctggctgtgcgccgggacggcattgcctacttctatctcaaccgctgcccccatcgcggtatcccgctggaatggcagcccgaccgcttcctcgatgccagcgccagcctgatccaatgcgccacccatggcgcactgttcctgatcgaaagcggcgaatgcatcgccggcccctgtgcaggccagagcctcacggccttgcctggtcgggaagacgcacagggattatgggtagaactctagctaccaagcagcacatgcaatggacgctcgatgtaaatctcttgcggcgtgacccgtacgccatacgccagcacctcgacgcccgcggccttggcctcacgtaaggcgccagcgtaggcagcgtcgatttccacggcggggcgcaccgcatcgattcccgatagattcacgcaatacaattgcaccgctcgcacgcctgttcgtgacaggtaagccagctctctcaggtgcttggccccgcgctgcgtcaccgcatcaggaaaggccgccaccgaggtgtcgtcaaagcccaaggtcacgcttttgacttcgacgaacgcggcaccctgcgggtaatccaggcgaaaatcgatccggctcttctcctgaccataaggtacttcacgcttcaacgccgtgaagccattgagttcagtaatcacaccggcacgcagtgcttcttccaccagctgattggcgcgtgccgtgttgacacacgccagccgtccctgaggcgtttcagcaatttcccaagtgcccggcaacttgcgcttgggatcggaggaacgactgaaccagacctggccaccttcgaccatgcaattgagcatcgagccggtattcgggcagtggatggtgagcaactcgccggtaacggtttcgatatcggtgagaaaacgcttgtagcgacgaatcagccgcgcttcttcgagagggggatcaaatcgcatcagccttgccagctccgcaaaccacgggcgatgcgttccaccgcctcttgtagccgatcgaggttttgcgtgtaggcaaaccgcacatggtgaccggcttgatagcggccaaagtccaaccccggcgtaaaggccacatgctcggtttcgagaaaatgacggcagaacgcgaaggcatcaccgccgaacacgctgatatcggcgtacaggtagaaggcaccctccggctctacagcaatgccgaatcccaactcgcgcaatgcaggcagcaagaagtcgcgacgtcgaccgaattcagcgcggcgctcttcaagaatgcccagtgtttgcggggtgaaacaggccaaggcggcgtattgggccatgctcggcgcgctgatgtagaggttttgcgccaatttctccagttcactgaccgcgtccgggggcgctaccagccaacccaggcgccaacccgtcataccgaaatacttcgaaaaactattcaggacaaaggcgtcatcgtcgacttccagcacgctgaccgcgtcggtgccataggtcaggccgtggtagatctcgtcgaccaccagatgaccgttgcgcgccttgatcgcactggacagcccggccaactcgcctcgcgtaagaatagtcccggtgggattggccggagacgcgaccagcgcacccacactgtcctggtcccaatgcctggcaaccaggtctgcggtcaattggtagcgcacctccggccccaccggcaccaactgggccgcgccttctaccagccgcaggaaatgtcggttgcaaggataccccgggtccgccagcaaccagtgcttgcctgggtctaccagcagactgctcgttaacaacaaggcgccggagccaccgggggtgatcagaatgcgctcgggatcgacactcaaaccgtaacgctgctgataaaacccgctgatggcctcgcgcaattccggcaacccacgggcggcggtatagcgggtcttgccgttcgccagtgcggcctggccggcctggatgatcggttcggccgtggtgaaatccggctcgccgatttccaggtggatcacatcattgccggcggcctgcagctcattggcccgtgccagtaacgccatgacatgaaaaggttcgatagcgcgactgcgcgcactgtagggctgagccattagccttccttaacggtgaggacaaaatcaggattctaccgaaccctcgcggtaaaacatgctctattgcctgctcggccatccaacatgagcccggcaggcgcctgtaaaacgactaaaatcaacattcgagcgggtacatccccagccatggcgggctgttgcagtttgcaacccctttgtcgtggagctcgacaaccgggagtggcgcaccctgaatctatctggtaagttcgcccgcttgcagccgcagggccggcaggtgtcggtgacgttgcaatcctgcgcaatggattagaagagtgagaggcggtctattcatgtccacccaagcaaagcaacagagcatcagcggcttccaaccctacgttgagtcgaagggcgaggaatacatgggcaagcccatgcgcgagcacttctccaaaatcctgaagcagtggaaacaggacttgatgcaggaagtcgaccgcacggttgaccatatgaaggacgaagcagccaatttcccggacccggccgaccgtgccagccaggaagaggaattcgccctcgaactgcgcgcccgtgatcgcgagcgtaaactgatcaagaagatcgacaagaccctgcaactgatcgaagacgaggaatatggctggtgcgaatcctgcggcgtcgagatcggtattcgccgtctggaagcccgcccaaccgcggacctgtgcgtagactgcaagaccttggctgaaatcaaggaaaaacaggtcggcaaataaccctgccgaactgaacgaatggggcgtgctaacgccccatttttgtttctggcgtttaccgcttttgcagtagtatccggcccatgacagcctctacctatatcgggcgtttcgcccccacgcccagcggccatttgcacttcggctcactggtagccgccctcgcctcctacctagacgctcgcgcccaccacggtcgctggttgatgcgcatggaagatctcgacccaccgcgtgaagagcccggcgcccaggcagcaatcctgcatgccctggaaagctacggctttgaatgggatggcgatctggtccgacagagcgagcggcatgatgcctacggcaaagtgctgaacgatttgttcagccacggcctggcgtacgcctgcacatgctcacgtaaacagctggaaccctataacgggatttaccccggcctgtgccgcaatgccggccacgatcagcaagatgccgccatccgtctgcgcgtgcccgaactggaataccactttactgatcgcgtacagggcgagttccgacagcatttgggtcgcgatgcaggcgatttcatcatccgtcgccgcgatggcctctacgcctaccaattggccgtggtcctcgacgacgcatggcaaggggttaccgatatcgtgcgcggcgccgacctgctcgactccaccccgcgccagctgtacctgcaagagctactgggcctgcgccaaccgcgttacctgcatgtgccgctgatcgtacagccggacggccacaagctgggcaagtcctaccgttcaccgccgttgacggcagaccaggccacgcctttgctgctccgggccctgcgcgcccttggccagccagccggcgatgaactgctgcacgccagcctacgggagctgctgaattggggcattgcacactgggacgccacccgcatcccacgcacactcacgttggccgaagcgcaattgagctgaaggcgcttgcaggttgccagccatccgttaccatcgccgcagattttcaatcagaggccaacatgtacatctatcgattggtcctgctgctggtcgtcgggatctacctgttttcccccgccatcatggattggtggatcgacgccacgggcgcctggtaccgcccctatctgctgtggctgatcctgatcgtcgtgaccttcatcctgcagagccaaaaagatgccgatgagctttagtctcacccagatgctgctgatcagcgccgcctacctggctgcgttgttcggtgtggcctggatcagtgagcgcgggatgattccgcgggcgatcattcgccatccgctgacctacaccttgtccctgggcgtgtacgccagtgcctgggcgttctatggcacggtaggcctggcctatcagtacggctatggctttctctccagctacctcggggtatcaggcgccttcctgctggcgccagtgctgctctacccgatcctgaaaatcacccgtacctaccagttgtcgtccttggcggacctattcgcctttcgctttcgcagcacctgggccggcgcgctgaccacgattttcatgctgatcggcgtgctgccattactggccttgcaaatccaggcggtagccgactccatcagcatcctgacccgcgagccagtacaacaccttgttgccctggctttctgcgcgctgatcagcctatttacgattttcttcggctcgcgtcatatcgccacccgtgagaagcacgaaggcctggtgtttgcgattgcctttgagtcggtcatcaagctgatcgccatcggcggcgtcggcctttatgcgctttacggtgtgttcgacggcccgcaacagctggaactctggctgctgcaaaaccagaccgccctcgccgccttgcatactcccttgcaggaaggcccctggcgcacactgctgctggtgttcttcgcctcggcgatcgtaatgccgcacatgtatcacatgaccttcaccgaaaacctcaacccccgttcgctggtcagcgccagctggggattaccgctgttcctgctgctgatgagcctggcggtgccgctgatactgtgggccggcctgaaactgggggccaccactaatcctgagtacttcaccctgggcatcggcattgccgccaacagcccggccctggcgctgctggcgtatgtcggcggtttgtcggcggccagcgggttgatcattgtcactacgctggcgctctcgggcatggcgctcaaccatctggtgctgccgctgtaccagccgccggccgaaggcaatatctaccgctggttgaaatggacccgccgtgcgctgatcatcgcgatcatcatggctggctacgggttttacctgctgcttggcgccgggcaagacctggccaacctcggcatcgtcgcgtttgtcgccaccttgcagtttctgccgggcgtattgtcggtgctgtactggccaaccgccaatcggcgtggctttattgccgggctactggcgggaatcctggtgtgggttgtcaccatgctgctaccgctggtcggcaatttgcagggtttctacatcccgttgctgaacatgatctacgtgctcgacgacaccagttggcacatggcggccattgcctcgctggccgccaatgtactgatgtttaccctgatctcgctgttcaccaacgccagccccgaagaaaccagcgctgccgaagcctgcgcggtggacaacgtacgccgcccgcaacgccgcgagctgcatgctgcctcgccccaggagttcgccacgcagctggccaagcctctgggcgcgaaggcggcgcaaaaggaagtcgagcaggcactgcgtgacctctacctgccgtttgacgagcgccgcccctacgccctgcgtcgtctgcgcgaccgtatcgaggccaacctgtccgggctgatgggccccagcgtgtcccaggacatggtcgaaacattcctgccctacaaggctggcggcgaaaactacgtcaccgaagacatccatttcatcgaaagccggctggaggattaccattcgcgcctcaccggcctggccgccgagctcgacgccctgcgccgctaccaccgccagaccctgcaggaactgccaatgggcgtctgctccctggccaaggaccaggagatcctgatgtggaacaaggctatggaagaactcaccggcatcgccgcgcaacgagtggtgggttcgcggcttaataccctgggcgatccctggaaagaactgctcctgggctttatcaacctgcccgatgagcacctgcataaacaacacctggccctcgacggtcagacccgttggctcaacctgcacaaagctgccatcgatgagccccttgcgcctggtaacagcggcctggtattgctggtggaagacctgaccgacacacaaatgctcgaagacaagttggtgcattccgagcgcctggccagcattggccgcctggcggcgggcgtggcccacgaaatcggcaacccgatcaccgggatcgcctgccttgcgcagaacctgcgggaagagcgtgaagaagacggtgaaatcaccgaaatcagcggacaaatcctcgagcagaccaagcgcgtctcacgcatcgtgcagtcactgatgagcttcgcccactccggcgcgcatcggaatcaggatgaagcggtgtgcctggctgaagtggcgcaggatgccattgggctgctggccttgaaccgacgcaatttcgaagtacagttcttcaatctgtgtgatccggaacattgggtcgatggcgactcacagcgcctggcccaagtgctgatcaacctgctgtccaatgcacgcgacgcgtcgccggccggcagcgcggtacgcgtcaagagcgaggctttcgagcatacggtcgacctgatcgtggaagacgaaggcagcggcattccacagaacatcatggaccgattgttcgaacctttcttcaccaccaaggaccccggtgaaggtaccggtctgggccttgcactggtctattccatcgttgaagagcattatggacaaatcaccatcgacagcccggctgacacagaaagccaacgcggcacccgtatcagggtgaccttgccgcgtcatgtcgaagcgacgtccgctgtgaactgagaccgtcgagagaattgaatcaatgccgcacattttgatcgtcgaagacgaaaccattatccgctctgccttgcgccgcctgcttgaacgtaatcagtatcaggtcagcgaagccggctcggtgcaggaagcccaagagcgattcagcattcccacgttcgacctgattgtcagcgacctgcgcctgcccggagccccgggcaccgagctgatcaagctgggccaaggcaccccggtgctgatcatgaccagctacgccagcctgcgctcggcggtggactcgatgaagatgggcgcggtggactacatcgccaagcctttcgaccacgatgaaatgctccaggccgtggcccgcatcctgcgtgaccgtcagtcggccagcagcgcgcctgccgaacagcgcccagccggtaaaacgaccaacggcgccgacaagccaggcgtcgacaacagcaacggcgagatcggcatcatcggctcctgcccaccgatgcaggatctgtacagcaagatccgcaaagtagcgccgaccgactccaatgtattgatccagggcgagtcggggaccggtaaagaactggtagcccgcgccctgcacaacctgtccaagcgtgccaaggcaccgatgatctctgtgaactgcgcggcgatccccgaatccctgatcgagtccgaattgttcggccacgaaaaaggcgcgttcactggcgccagcgccgggcgcgcggggttggtggaagccgcagacggcggcaccttgttcctcgatgagatcggcgagttgcccctggaagcccaggcccgcttgctgcgggtgctgcaggaaggcgagattcgacgcgtcggttcggtgcaatcgcaaaaggtcgatgtgcgactgattgctgcgacacaccgtgacctcaagagcctggccaagatcggccagttccgtgaagacttgtattaccgtctgcacgtgatcgccctcaagctgccggccctgcgcgagcgcggcgccgacgtcaacgagatcgccagtgcattcctgttgcgccagagtgcgcgcatcaaccgtaccgacctgaaatttgccgcagacgccgagcaggcgatccggcattactcgtggccgggtaacgtgcgggaactggagaacgcggtcgagcgtgcggtgattctgtcggagagcccggagatttccgccgagttactgggtatcgatatcgagctcagtgacctggacgacgatgatttcattggcttggccccgcaacagggcggcgctagcaataccagccatgaaccgacggaagatttgtcactggaagactacttccagcatttcgtcctcgagcatcaggaccatatgaccgagaccgagctggcacgcaagctgggggtaagtcgcaaatgcctgtgggaacggcgtcagcgcctgggcattccacggcgcaagaccggagtcgccagcgaaagctgagggtgcgccccaccaggtaacacctgctgatgtgaaaaaactgttaccgctgacttttcacgtaacagaagccggggcttacggtaacgaagccccggcttttttttggccccgaaaaccacaaaaccacctcaaccccccgattttgctggccggcacaaaagttggcacgcaccctgctatatgcttagtacaaaaacaataacaagctttgtacaagacaataaaaataagacgaatcgactcacgcataacaaaaacaacacggcggaggcgcagctaactgattcttttggagaggcgttgcatttggggcttgccccgcaaccaggccgagaacaacaaaaactgccctaaggcagagcctgaactggttggatcgtagatcagcaacacagcgaccaaagcaatccgtttgctcttgactcccaattgggagtgtcatgaaggtgaagcttcatggcgagggcgatcaacaaaaacaagaagcccgaaatcaataataaaaatagagcacgcaactacttctgggggagcttcggctccccttgtagtttccggcatttgacgttctgaagcttatggcgcaatgcctgtagcttgttcctacaccatcccccgactaaatgctagaatcccggcccatcatgcggtcattcttcgttatggccgaacattccttcaaacagtgcatcccatgctgaagaagttgttccagtcattccgttctcccttgcgtcgaacgcaacacaaacgcagcacgcctgaagtgctcaatagcagccagcattcgctgcaacgggctcaattcagccgttacgcagtgaacatcgtcgaacgtttgcagaacgccggctaccaggcttacctggtgggtggttgcgtacgcgacatgctgctcaatatcacgcccaaggatttcgacgtcgccaccagcgccacgcctgaacaggtacgtgccgagtttcgtaatgcacgcatcatcggccggcgcttcaagttggtgcatatccactttggacgcgaaatcatcgaggtcgccaccttccgcgccggccacccgcaaaacgacgaagaggaagacaccaatcagtcttcccgcaacgaaagcgggcgcatccttcgcgacaatgtctacggcaccctggaggaagacgcgcaacgtcgcgacttcaccatcaatgccctgtattacgacccggtcagcgagcgcatcctcgattacgccaatggcgtacacgacatccgcaataacctgatccgcctgatcggcgacccaacgcagcgctaccaggaagacccggtgcgcatgctgcgggccgtgcgcttcgcggccaagctcaactttggtatcgagaagcacaccgctgcgccgattcgcgagctggcgccaatgctgcgggaaattccctcggcgcgcctgttcgaagaagtgctcaagctgtttctctcgggctatgccgccgacaccttcgaaatgcttgtcgacctgcagttgttcgatccattgttcccggccagcgccgaggccttggaatacaacccaacgtacacgcacacactgatcagcgaagcgttggtcaacactgacctgcgcatcaagcagaacaaaccggtaaccccagcgttcctgtttgccgccctgttgtggccagccctgcccaagcgagtgctgcgcctgcaggaccgtggcatgccgccgatcccggccatgcaagaagcggcacacgagctgatcaccgaacagtgccaacgcatcgccatcccaaaacgcttcaccatgccgatccgcgagatctgggacatgcaggagcgcctgccgcgccgcagcggcaaacgcgccgacctgttgctcgacaacccgcgcttccgtgccggctacgacttcctgctgctgcgcgaaagcgccggcgagcaaaccgacggcctgggcgaatggtggaccgactatcaggacgccaatgatagccagcgccgcgaaatgattcgcgagctgggcagtaaaggcgatggtgtcggtgaaggaccgaagaagcgtcgccgcagcggtagcaagcgtaaacgcaacgccgccgacgcctcgggcgccgcaggggaataagcgtggagcgtatctacatcggcatgggcagcaacctcgctgccccggaccagcaattgcgccgcgcgatcacagccctgtcgcaactgccagacaccaccctcgccggtgtctccgcgttctatcaaagtgactccctgcttccaggccaaccgcgcttcaccaacgcggtggcggccctggacagcaacatggccccgttggacctgctcgatgcactgcaaaccatcgagaaggatcagggccgcgagcgccatgagcgttggggcccacgcacgctggacctggatatcctgctgtttggcgatcgcttgatcgatgagccgcgcctgaaggtgccgcactaccagatgcacgtgcgggcgtttgtgttgtatccgctggctgagctggcgccagccgacctgcagttgcctgacgggcaaagcctcagcggcctgcttgaagcctgcccattcgtcggcctggaacgcttaccttcgtaggagcgagcttgctcgcgaaaatcgccaacgttaacgtgcacagcctgcttaaacgcggtgcccacgcgttcttcgcgagcaagctcgctcctacaatcgcatcagtaacagcggtaacaccgccatcgtaacaatgcggtaacacatccaattgacttcccgtgtcctcctcacgactataggcgtcccgctgccgccaacccggcactacagggcgcaatccaggccttataagcactgctttcaagacagtgcgcctgtataaacgaagactcacgcgcgttactcgctgtttccaagcgcctgaacgaggacccttttcatgccagacattaccctgaccaccttgcagagcctcaagctcaagggtgaaaaaatcaccatgctgacttgctatgacgccaccttcgccaacgcctgttgccaggccggggttgaagtattgttggtaggcgattccctgggcatggttcttcaagggaatgacagcaccctgcccgtgaccaccgatgaacttgcctaccacaccgccagcgtcaagcgtggcaacgacggcgccttgatcatcgccgacctgccgttcatggggtacgccacgctggagcaaaccttccagaacgccggcaagctcatgcaagccggcgctcacatgatcaaagtcgaaggtgcagtgtggttggccgagtcgatccggctgctggctgaacgtggcgtaccggtatgcgcgcacatgggcctgacaccacagtcagtgaacatcctcggcggctacaaggttcagggccgcaatgaagcccaggcgcgccagatgcgcgccgatgccattgccctggaacaagccggtgccgcgatgattgtgctggagtgcgtacccagcgaactggccgcagaaatcacccaggccgtcaaagtgccggtaatcggcatcggcgccggctccgccaccgatggccaggtgctggtactgcacgacatgctcggcctgtcgatgaccggtcacgtaccgaagttcgtgaagaacttcatggccggccagaccagcatccacgctgcgctgagcgcttacgtcagcgaggtcaaagccgtcaccttcccgggcatcgaacacgggttctcggcatgaacaccgttaaaaccctacgtgaactgcgcgccgcggttacccacgcccgcagtgccggcaagcgcatcggctttgtgcctaccatgggcaacctgcacagcggccacgcaaccctggtgaccaaagccgcacagcaagcggatttcgtggtggcgagcatcttcgtcaacccactgcaattcggtgccggcgaagacctggacaaatacccgcgcacgctggccgccgatcaggaaaagctcctgcaagccggctgcaacctgctgttcgcgcctagcgtcgaggaaatgtacccaggtggcatgaccggccagacccgcgtcagcgttccacagttgtccgaaggcttgtgtggtgccagccgcccagggcatttcgaaggcgtggccacggtggtcagcaagctgttcaacatggtccagccggacatcgccgtatttggtcagaaggattaccagcaactggcggtgatacgtgcaatggtccatgacctgaacatgccgatccagatcatcggcgagcccaccgtacgcgcagaggacggtctcgcgctgtcatcgcgcaatggttacctcaccgcagagcaacgcgccgtcgcgccagtgctgtaccgcgccctcaaccagatagccacggccatcaaaagcggagagcgtgatttcgccaagctgcgcgccgaacagatccagcacattgagaacgccgggttgcgcatggattatctggaagtacgccaaggtgtgcatctgcgcccggccacggcgcaagaccgtgatgtggtgatcctggtcgctgcttatttaggcacgacacgcctgattgataacctgcacctgaacctcgcctgacccctctttaaatccacaacctgttgcccccaccgccgtgccggtataaaaaagtaccggccacagcgcagacaaagccaagacatatcgacacgctaggtttaatgtaatcgccctgcgctacggttagcgctgcctggaacccaatccttgatataagactggatgttccgggctttgaagtgtcctaaaggcagtccctgtaataaaaaggaaacccgcagcgatggcgtactaccgcacccctcatgacgttaccgcgctgcccgcctggcaagcgcttacccaacatcgccaagccatgcaggatttcagcatgcgcgacgcgttcaatgccgatccccagcgtttttcccagttcaccctgagcagctgcggacttttcctcgattactcgaaaaacctgatcaccagcgaaacccgcgacctgctggtgggcctggccaaggaagtgaacctcaaaggcgcgatcgatgcgttgtacgccggtgagccggtcaactcctccgaaggccgccctgccctgcacactgccctgcgccgcccggtgggcgacaagctgtcggtcaacggtgtgaacatcatgccggacgtgcacaaggtgctgaaccagatcaccgacctggtcggccgcatccacgacggcctgtggcgtggctacaccgaaaagccgatcaccgacgtggttaacatcggcatcggtggttcgttcctcggcccggagctagtctccgaagccctgctgtcctacgcccataaaggcgtgcgctgccactacctggcgaacatcgatggcagcgagttccacgagctgaccatgaagctgcgcgccgagaccacgctgttcatcgtctcgtcgaaatccttcaacaccctcgaaaccctgaagaacgcccaggctgctcgtgcctggtacctggcccaaggcggctcggaggccgagctgtatcgccacttcatcgccgtttccagcaacaacgccgcggccgtggccttcgggattcgcgaagaaaacatcttcccgatgtgggactgggtcggcgggcgttactcgctgtggtccgccatcggcttgccaattgccctggccatcggcatgtccaacttcaaggaactgctgtccggtgcctacaccatggaccagcatttccagaacgctccgttcgaagacaacatgccggtactactgggcttgctcggcgtgtggtacggcaacttctggggggcgcagagccatgcgatcctgccgtacgaccattacctgcgtaacatcaccaagcatttgcaacagctggacatggaatccaatggcaagagcgtgcgccaggatggcacgccggtgtccaccgataccggtccggtgatctggggcggcgtaggctgcaacgggcaacacgcttaccaccagttgctgcaccaggggacccaactgatcccggccgacttcatcgtgccgatcgtcagcttcaacccggtatccgaccaccatcagtggctgtacgccaattgcctgtcccagagccaggccctgatgctcggcaaaacccgcagcgaagccgaagccgagctgcgtgagaagggcctgccggaagccgaggtgcagaagctggcaccgcacaaggtgatcccgggcaaccgtccgagcaacaccatcgtggtcgaacgcatcagccctcgtcgcctcggcgcgctggtcgcgatgtatgagcacaaggtgttcgtgcagagcgttgtctggggcatcaacgccttcgaccaatggggcgtggaacttggcaaggagctgggcaaaggcgtttacaaccgtctgaccggcgccgaagaaaccttggcagatgatgcctcgacccagggcctgatcaactacttccgcggtcgccaccgcggctgaagctggcctcaaggccaacgtgcgtttggacgttggccttgaaccctcctgccacagggtgcatctttattacttgtcgcaaaaacaagaataaggatcgctcatgttcgatatcagcacgttccccgccgccgatgccgtccgccgggctgcgcaactcagtcaagaggactaccagcgcctctatcgccaatccatcgaacagccggacaccttctgggccgaacaggccaagggctttctcgactggataacgccatggcatagtgtccagcagtcagacatcaagaccggagccgcccaatggtttgccggtggccaactgaatgtcagctacaactgcatcgaccgtcacctggcaaagcgcgccgatcagccggcctttatctgggaaggcgacgatccgacaaagtcctgcaaaatcacctaccgccagcttcatcaaaacgtcagtcgcctggccaacgtactaaaaagccgtggcgttaaaaaaggcgaccgcgtgtgcatctacatgccaatgatcccggaagcggcctatgccatgctggcttgtactcgaattggcgcggtgcactcggtggtgtttggcggcttttcacctgacgccctgcgtgaccgtattctcgacgccgattgccgtacggtgattaccgccgacgaaggcgtacgtgggggcaagcccgtggcgttgaagcagaacgtcgataaagccctggccagttgcccgaatgtcagcaccgtactggtagtggaacgcaccggggcgagcgtgaactggagcgagggccgcgacctcaagtatcaggcggccctggacgccgccagcgacaactgcccgcccgagccgatggatgccgaagatccactgttcatcctctatacctccggcagcaccggcaaacccaagggtgtgctgcacaccaccggcggctacctgctgcaagcggcgatgaccttcaagtacgtgctcgattaccgagaaggcgaagtgttctggtgcaccgccgatgtcggctgggtcaccggccacagctacattgtctatggcccgctggccaatggcgcgacctcgctgatgttcgaaggcgtgccaagttacccggacagctcgcggttctggcaggtgatcgacaagcaccaagtgaatattttctataccgcgcccaccgcgttgcgcgccctgatgcgtgaaggccacagtccgttggagagtagctcccgcgccagcctgcgcttactcggcagcgtcggtgagccgatcaacccggaggcctgggactggtatttcaacgcggtcggcgaacagcgctgcccgattgtggatacgtggtggcagaccgaaaccggcggcatcatgctcagcccgctggtcagcgcccagcgcatcaagccgggctgcgccacccagccaatgttcggcgtacagccggtgctgctggatgagcagggcaaggaaatcagcggcgccggcagcggcgtgctggcgatcaaggccagctggccggggcagattcgcagcgtctatggcgacccgcaacgcatgatcgacacctacttcaaaccctatcccggctactacttcaccggcgacggcgcgcggcgcgatgaggacggtgactactggatcaccgggcggatcgacgatgtgatcaacgtatcgggccatcgcatcggcactgccgaggtggagagcgccttggtgctgcatgaccaaatcgccgaagccgctgtggtcggctacccccacgacgtcaaaggccagggcatctatgcctttgtgaccccaatgaacggtgtcgagcccagcgatgcgttgagaaaacacctgctggacctggtcagcaaggaaatcggcagctttgccaagccagaactgatccaatgggcgcctgccctgccgaaaacccgctccggcaagatcatgcggcgcatcttgcgcaagatcgcctgcaacgaactggacagcttgggagatacctcgaccctggccgacccgagcgtcgtagacggtttgatcgacaagcgcctgaaccgataggaacccccgagtcgccatggaatttatccgcagccgtatcgaaacccagttgatgagcctgacgggtttgtcactgggccaactggacctggagaaccccaagggcgatcccggactgttcgggcccgactcggtcagttggcaagtgcatggcgacttcagcagcatgctgatcggcggcatcagtgccttgatgctgcaagccttgcacccactggccctggccggcgtatgggaccattcgaacttccgccaggacatgctcgggcgcttgcgacgaacctcgcagttcatttccggcaccaccttcggctcacgcaaggatgcagagtggctgatcgaaaaagtgcgcaccattcacctgcaggtggtcggccacgcgccggatgggcgaccttatgcggccagcgatcccgagctgctgacctgggtgcatgtggccgaggtgagcaactttctggccgctcacctgcgttatcgcaacccacggctttcgggtcgcgaccaggatcgctactacagcgaaattgccctggtcgctgaacgcctgggcgcgcggcatgtgccacgttcacgccaggaaatttcggattatctggtgcgtatccgcccgcaactgctgtgcgacgagcgcagccgtgaggtgctgcgcctgctgctcgaggcccctgccccgagcactttggccaaacccttcggcagcctgatgatgcaggccgggatcgacctgctgcccgactgggcaagcgcgatgctcgaccaacagcagagcccgctgcaacgccagatgatccgcgccggggtcaagcgcagtgcgccactgctgcgctgggcgatgcgcaacggttcggtgcagcgcgcccatcggcggatggggctgatgtaggtagcggcccatagctgttaaactccgcgcccacaatgccctcatttaccgcaagcaaggcgcgctccatgactcccttgaatcaggcgctgcgcgccgccctcgattatcgccaagacctgatcaaccaactgcacgcccagggtacggactgctatcggttgttccacggcagtcaggaaggtgccggtggcctgaccatcgaccgctacggtccgcaattgctggtgcagagcttccaccagtccctggaaagcgcagacctgctggacctgcaccagatgatcaaccagcacatgggcctggaattgctgctggtatacaacgaccgcgcccgcggtaactcacggatcgaccgcgaagacacggtgtaccgcgcagagcctgcggcattggaagacctggtcggccacgaatggggcctcaactatcgtgtgcgcgggcgccatgccggacaagaccccctgctgttcctcgacctgcgtaacacccgtggctgggtcaaggaccacagtgccggtaaaagcgtgctgaatctgttcgcctacacctgcggtgtgggcttgagcgcggcggccggcggcgcacgcgaggtgtgcaacctggattttgccgaggggaacctggcggttgggcgtgaaaacggtgagctcaacccgcaattgccaaccatggaatttgtgcagtccgattacttcccggcgattcgccaactggcgggcctgccgatcacccagcgtcgcggccagaaattgccgagttatccacgcctggaacagcgccaatatgacctggtactcctcgaccctcccgcctgggccaagagcgccttcggcaccgtcgacttgctgcgcgactatcagagcctgctcaagcccgcgctgctggccaccgccgacaatggcgtgctgatttgctgcaacaacctggcgaaggtcagcatggatgactggcgtgagcaggtgctgcgttgcgcagaaaaagccggccgccctgtgcgtgactggcaaatcatgacacccggagccgactttccatccagagaccagcaaccgccattgaagaccttgatcctgcacttgtaggaagtttcccagcgcccacggttcttcggaaccgaattcccgtgccatactccaaggcactctcgtttgacatagatggcgtcacccatgcccaaaggattgattcgcgccgcaggcgccttgttgaccgcccttgctttgtacagcttgctgggctttctgatcttaccgggcattgctcttcgcattgccaaccaacagttggccaactacgccacggtgcctgcgcgaatcgagcgcatcgagctcaacccgttcagccttgaactgacattgtggggcctgaagatcggtgagccgggtaaagaacaagtgggtttcgagcgcttctacgccaacctgcaagtggacagtctctggacccgcgccctgcacctggccgatgtgcaactggaccagcccaagaccgaactgctgttcgacaaatccggccaacttaacctggcgcagttgttcaagctgccaccgagcgagccgaccccggccgatcctgatgccaagccgttcccactgcgtatcgacagcatcaagctggcgggcggcaatctgcacttccaggacctgcgccccagcgaacccatcgaatttctctacgacaaactcgacttcgagctgaaaaacctcagcaccttgcccgaagacaacgccgatatgaccttggtcgccgcgggccctgacggtgggcagattgactggaaaggtaatttcagcctggtgccgatcacatccgaaggcaccttgaaagtcaccgacggcaagatgaaagcctggtggccctatgtacgtgacgccttgcctttggtactggaagacggtgtgcttaacttcagcactgactataaattcagcctggccaaagaaaccgaactgaacctgaccaacaccgccgccagcatcgcgccctttgcaatcaaggcgccggatggccggccattggcccgcctggagcgcctggacgtcagcgaaaccacggtagacctggccaagcagcaggtggttatcggcaagattcgcagcaacaagctggaaacctgggcggcccgtgaagccgatgggcagttggattggcagaaactgttcgccagccagccgagcaaaccagccacggcaccggaaccggccactgcgccgaccactgccgacgcccctcaagcacaacctgcagccccgaacaaaccctggcaagtgttgctcaaggacgtgcaactgcgtaactatcaggtgcacctggccgaccgccaggccaaacctgcggtcgcgctggagctgggcccattgaatgtcgatgtgcagaacttcgacagcctcaaccagagcccctttaccttgaaggtcgacaccggcctgggcaagcaaggcaagatccaggcgactggtgaggttaacctcaaccccgtcagtgccaagctgaaagtgaacacccaggacatcgatctgcgggttgcccagtcctatatcagcccgtttattcgcctggaactgcgcagcggcatgctgggcagcaacctggatgtgaaccttaaaagcaccgagccgctggccctccaagtcactggccgcgcccaggttgatcagttgcataccctggacaccctcaagacccgcgacttcctcaaatggcagcgcctggtgctggaaggcgtgaactaccagcacggtcaaagcctgtcgatcgacaaggtcaacctgctgcaaccgtatgcgcgcttcatgatcaacgacgatcgcaccaccaatatcgatgacttgctggttccacagccggcagacagtggcaataagtcggccgccaaacccgcagccagcaacgagaagccactgggcattcatatcgggcagatcgcgatcaacgatggttcggccaactttgccgacttcagcctcactcccaacttcgccacggcgattcaacagctcaacggccagattggcaccatcgacagccgccaggccaagccggccagcgtcgacataaagggcaaggtggaccgctacgcgccagtgaccatcaaaggcagcgtgaacccgtttgatccgatggcatccctggatatcgctaccagcttcaaacgtgtcgaattgaccaacttgacgccttactcaggcaagttcgcaggttttcgtatccgcaagggccgtttgaatctcgacttgcactacgtgatcatcaagggccagttgaaggctgaaaacaaagtggtggtcgagcaactgcaactgggtgaaaaagttgacagctccgacgcggtggacttgccgattcgcctggcggttgccctgctcaaggactccgatggcaagatctccatcgaattgccggtgagcggcgacctgaataaccctcaattcagcgtgatgccgattgtgtggcagaccctacgtaacctcgtagtacgggcagcaacagcgccgttcaagtttatcggtgggctggtgaccggtggcggctcggaagacctgggtaatgtgtcgttcgccgccggctccagtgagctgaacaaagatgccgaaggcgctttgaacaccctggccaaggcgttgaaagagcgccctaccctgcgcctggaaatcgaaggtacggctgccgcaagcagcgacgggccgttcctggccgcagaacggctggaacgtgaataccaatacaactactacaagatcctccagcgccgtggcgacaaagtcccggcccaggcctcattgctggtggtgccagagaaggaaaaggcccccttgctggaaggcatttatcgcacccgcttgaaacagcagccaccggccgaatggaaagacctgggcagcgatgagcgttcggcgaagctcaaggacggcgtgatcaagttctggagcgccagcgatgtgttgttacgcaaactgggccaggaccgcgccagtacgatcaaggattatctggtggacaagggacagctggaagacgaccgggtgtacttcattgatgcgcaactggggcaggccgagaaagatggtcgtgtcatcaccccaatgcatctggatgccgagtaacctcaagctcgcgcaattctaaatgtgggaggggcacgccctaatgctttttgtaggagctagcttgctcgctcctacagagagcgatattaaggtaagccccctgccatattcttatgcctcgcttggccagcaattacgccccagaatagaacaggccccgacacaagtgccggggcctgtaatgaccacatccgtgtggtcggtcgcatgaactccagaggtgcctcgggtggatatctaactcaccctaagccgccgccatccagttcagacgaaaagggcgcgttactctgctttcaggccatcggccgatacagctttaacgcctttgattttcttggcaattgcgactgcggtttctttctgcgatgcagttacagcagtcgcggacgacagggaaaccacacctttgttggtctctaccttgatatcggtaccaggaatacctttttcggtaaccaggtcagccttcactttagtagtgatccaagtgtcgctggtcgcgcctttggcatcagcagccgcacctttggttttatcaataccgtcagctttggcagcgccgccagccagcaggccgtcagcagaaacagcagttacacctttgattttcttggtaatggctacagcggtcgctttctgcgagtcggagatagctacatcggaagaaagggaaaccacgcctttgttggtttctaccttgatgtccgaaccaggaatgcctttttcagtcagcaggtcagcttttactttagtggtgatccaggtatccgaggtggactctttggccttggtcatttcaccagccgccagagtcataggggcttgggaagtctgagcaaaggccacgctagcacccatggccagtgtcagagcggtagcagtagcgagagcgaacttcttcatacgagtaactcctgttttattaaaagtctgcggcgtgtggaccttgatgctgcagcgttaactggaatattgcagacggcgtgccaagtccaaaaacccgcataaacccttataaatcagttagttaaaaaaacatccgattttcgaaatcgtgcaacttgcatgaaaccacctgtacctgcatgcaagttgcggtttttggcagtgggctaaatggctgattttgcttaattttccatcacccataaaaaaaggactccgaagagtcccttttttcagcctgagctacgagcgattaaacgcccgaagccttggctgctgctacgtctttgatggacagcttgatacggccgcggttatccacgtccagtaccagcacttcaacttcctggccttctttcagaatgtcggtcactttctcaacgcgagcgtcgctcagcatggagatgtgaaccagaccgtctttgcctggaaggatgttgacgaatgcgccgaagtcgacgatgcgctcaaccttgccgacgtagatcttgccgatctcagcctcagcggtgatacccaggacgcgctggcgtgcagcttcagccgcttccttggtttcgccgaagatcttgatcgaaccgtcgtcttcgatgtcgatcgaggccttggtctcttcacagatcgcacggatggtcgcgccgcctttaccgataacatcacggattttgtcggtgtcgattttcatcgcgatcatggtcggagcattttccgacagttcggtacgggactgaccaatgatctggttcatctggccgaggatgttcaggcgcgcttccagggcttggcccagggcgatttccatgatctcttcggtgatgcccttgatcttgatgtccatctgcagcgcggtaacacctttagcggtaccggctactttgaagtccatgtcgcccaagtggtcttcgtcacccaggatgtcggtcaggatggcgaacttctcgccctctttgaccaggcccatggcgataccggcaaccggtgccttcatcggcacacccgcgtccatcagcgccagggaagcaccacaaacggaggccatcgagctggaaccgttggattcagtgatttccgacacaacacggatggtgtacgggaacacgtcagcagccggcaacattgctgcaatcgaacgacgggccaggcggccgtgaccgatttcacgacgaccagcaccccccatacgaccacactcgcccaccgagaacggagggaagttgtagtgcagcatgaacgggtcttttttctcgccttccagggtgtccagcagctgtgcgtcacgggcagtacccagggtcgcgacgaccagggcctgggtttcaccacgggtgaacagcgccgaaccgtgagtcttcggcagaacgccgacttcgatgttcagcggacgcacggtgcgggtgtcacgaccgtcgatacgcggcttgccgttaacgatgttttcgcgaacggtgcggtattcgatttcaccgaatgcagctttgacgtcgctggcagaaggctggccttcttcgccggacagcttggcaacgacctgatccttcaactcgcccaggcgagcgtaacggtcggccttgacggtgatggtgtaggcatcggagatagccgcgccgaactcggagcggatagcccccagcaggtcggtggcttccggggcagcagcccaggtccaggttggcttggcagcttcggcagccaattccttgaccgcgttgatcacaacctggaactcgtcgtgagcaaacagtacggcgcccagcatctggtcttcggtcagctctttggcttccgactcaaccatcagtacggcttcggaagtaccggcaacgaccatgtccaggctcgaagctttctgctgctcgtaggatgggttcagcaggtagcccgtgctttcgtggaaagcaacgcgagcggcgccgatagggccatcaaacggaataccggagatagccagcgcagccgaagtaccgatcatcgctgcgatgtccggatcggtcttcttgctggtggaaaccacggtgcagacgacctgcacttcgttcatgaagccttctgggaacagcggacggatcgggcgatcgatcagtcgggaagtcagggtttctttctcggaaggacggccttcgcgcttgaagaaaccgccagggatcttaccggcagcgtaagtcttttcctggtagtgaacggacagagggaagaagcctttgctcgggtcagcggtcttggcgccaacaacggtcaccagtacggtaacgtcgtcgtcaacggtaaccagcactgcgccggaggcttgacgggcgatacggcctgtctcgagggtaacggtcgactgaccgaactggaattttttgataaccgggttcacggtgtcctaccttctttgtggctcttgggggaacttgtcttcttgcgaaattcttgggcaatgtcgggaatcggcccaacccttgtccaggggtaaaacgtgtatccagataaaacttgaggctgggagcctaccatgggccagcgggaatcccactgacacacggcagacaaccaacctctagcgcaatcgctgattagcgacgcagacccaggcgaccgatcagagcctgataacgacccagatccttgcctttcaggtagtccagcagcttacggcgctggtttaccatgcggatcagaccacgacgggagtggtgatctttaccgttggccttgaagtgaccttgcagcttgttgatgttgtgggtcagcagtgcaacctgcacttctggcgaaccagtgtcaccaacagcctgctgatagtcagctacgatttgtgctttttcttgaacgtcgagagccatgaggcaatccttttttcaggaaactacccaagggtagtttcaacaggccagggacaaatccctgtatctaaaaatgagaagtgaccatgcctgttaacagccaccctcgttcggtcattctgaccgaatcagtcgacgcggcgcgatacgcccgtcttcgctcacttcaccgataccgatgaagcgaccgttatgatcctgtacccgcaccatgccgaacttcggggcatccggggcgcgtaccggctggccgttgagccagtagaacgcgctgtgctccgagaagtgcagcaatggccaatcgagcaaaccgctgtccgatggcatcaggaagcgatcaaccgcttcgttgccgccttcggcatgcacagcttccaactcttccagcgtcaccgtctgggccaggctgaaagggccggcttgggtacgtcgcagttctgcaacgtacgcgccgcaaccgagcttttcaccgatatcttccaccagggtacggatataggtgcctttgctgcagtcaacggccaaacgggcagtgtcgccttcacaggcgagcaattccaagcgcgcaatagtaacagaacgcggttcacgctccactacttcgcccgcacgtgccagcttgtaaagtggctgtccatcccgcttgagggccgagtacatcggtggtatctgactgatttccccacgaaaagccggtaaagcagcttcgatatcagcacgaccaacggtcacgtcgcgaacctgcagaacatcaccttcggcgtcggccgtagtggtggtcttgcccagttgcatcagggtttcatagcccttgtcggaatcgagcaggtattgcgagaacttggtggcctcgccaaagcacaacggcagcacgccggtggccagcggatcaaggctaccggtgtgccctgccttctcggcattgagcaaccaacggaccttctgcagcgcggcattggaggtaaagccaatgggcttgtcgagcagaatgatgccgctgacgttgcgacggatacgtttgacctgagccaccgcttactccttggcgtcttcaggtgtggacgggtgctggctgtcttcagcaacggcgcgctcgatcaatgccgacaggtgcgccccacgcacgacgctttcgtcgtagtggaagtgcaactgggggacgctacgcagcttcatttcacgggccaactgcatgcgcaggaaacctgcggccgagttgagcaccttgatgctttgtgcgatttcttcgctgttgtcctgccccatcacggtgatgaagatcttggcgtgacctacgtcacggctcacttcaacggcggtgatggtgaccaggccaacgcgagggtctttgacttcgcgacggatcagttgggccagctcacgctgcatctgatcgccgatacgctgggtacggctgtattcttttgccatgtcttgttacctgttactgccacacggtgaaacccgtggggtctgaaagcggcaaacgcccggcctgacaaaagccagaccgggcgttgcgtttagagtcctgacgctgcgcggggcatttgcatgcccacacgctgcgtggctcctgaagtgcgcgagttagaggctgcgagcaacctgaaccttctcgaagacttcgatcttgtcgccaaccttgacgtcgttgtagctcttgacgccgataccgcattccatgccggcacgcacttcggcagcgtcatccttgaagcggcgcagggattccagctcgccttcgaagataacgatgtcttcacgcagtacacggatcggacggttacggtacacagtgccttcgacaaccatgcagccggcgatcgcgccgaacttcggcgagcggaacacgtcacgcacctcggcgatacccaggatattctcccgaacgtcgctgccaagcatgccggtaagggctttcttgacgtcttcgatgatgtcgtagatgacgttgtagtaacgcatgtccaggccttcctgctcgacgatcttgcgagcgccagcatcggcacgcacgttgaagccgaacagtacagcgttggaagccagtgccaggttggcgtcggattcggtgataccaccgacaccgccaccgacaacgcgcacttgcacttcgtcgttacccaggccgttcaaggcgccgttcaacgcttcgagggagccacgtacgtcagacttgaggacgatgttaagcgtcttcttctcttcctggcccatgttctcgaagatgttttccagcttgccggcgtgagcacgggccagcttgacttcgcggaacttgccttgacggaacagagccacttcacgggctttcttctcgtcggcaactacactcatctcgtcgccagcgtccggggtaccgtccaggccgaggatctcgaccgggatagctggacctgcttccttgattggcttgccgttctcgtcgagcatggcacgcacacggccgtagttcgaaccgaccagcaccatatcgccttggcgcagggtaccgtcttgaaccagcacggttgcaaccgggccacggcccttgtcgagacgggattcaaccacgacaccacggccaggagccgatggagtagcagtcaactccaggacttcggcttgcaacagaaccgcttcgagcagttcgtcaacgccggtacccatcttcgccgagactgatacgaatggagtctcgccaccccactcctcggaagtcacgccgtgaaccgacagttcgctacggatgcgatcgagatcagcgcccggcttgtcgattttgttcacagcaacgaccagaggaacaccggcagccttcgcgtgctggaccgcttcaatggtctgcggcattacgccgtcgtccgctgcaacgaccaggatcacgatgtcggtcgccttggcaccacgggcacgcattgcggtaaacgcggcgtgacccggggtgtcgaggaaggtgaccatgccgcgttcggtttcaacgtggtacgcaccgatgtgctgggtgataccaccggcttcgccagcggctaccttggcacgacggatgtagtcgagcagggaagtcttaccgtggtcaacgtggcccattacggtcacgactggcgcacgggagactgcctcaccttcaaacttcagggactcggccagggagtcttccaaggcagtgtcgctgaccagggtcactttgtggcccaattcctcagccacaagctgggcagtttcctggtccagtacctggttgatggtggccggagtgcccagcttgaacatgaacttgatgatttcagcagccttgaccgacatctgctgggccagatcgcccacagtgatggtctcgccgatcttcacttcacgcacgacagggccggttgggctctggaaaccgtgggcgttgcgttttttcagcttggccttgccgcgtccaccacgacggaagccatcgctttcttcgtcggtagtacgtggggcaacgcgtggagcaggcgccttctctttgaccgaagcacgatgcggagcgtttttgcgctcgccatcgccaccaccaccgcgacgactgttatcgtcggcacggggtttgtctggacgacgaggttcgtcgcgcttgcgggcatctgctgcaggagcaggtgcagcggcaaccggggcggcctcacgcacagcttcaacaggggcggcgaccgcttcagtggcagctggttgcgcagcagcaggctggcgacgcgcttcttcttcggcgcgacgcttggcttcttcttcagccttctgacgagcagcattttctactgcgcgacgttcttccagttcgcgtttgcgctcggcttcgatttcttccgggctgcgctgtacgaagactttcttcttgcgcacttcaacgctgatgctcttgctacccgcaacacgcagggtgctggtggttttgcgctgcaatgtaatcttgcgcggttcttccactttcgccttgtggctgctcttcaagtgagtcagcaaagactgcttctcactatcgctcacaccttcatcggcggcggtgtgcggcagacctgcctcacgcatctgctgcaacaggcgctctaccggtgttttgacctcatcggccagttgtttcaccgtgacttgcgtcatgcacttctctcctcaggccgcgcctaattactcgaaccaatgggctcgggcggccatgatcaacttgccggcacgatcatcgtcaatgccgtcgatgtcgagcagatcgtcaatagactgctcggccaggtcttcgcgggtaattacgccgcgcaccgccagttccatcgccaaatccttgtccataccctcaagcgagagcaggtcttcggccggatgggcgtctgccagcttttcctcagtagcgatggctttagtcaacaaacgatctttggcccgagcgcgaagctcgttgacggtgtcttcgtcaaagccgtcgatgttgagcatttcttccaacggtacgtaggcaatctcttccaggctggtgaagccttcatctaccagcacctgcgccaggtcttcatcgacttccagctcttcgatgaagttgcgcaggatgtcaccggtttcagcttgctgcttagcctggatgtccgattcggtcatcacgttcagggtccaaccggtcagttggctggccagacgcacgttctgaccaccacgaccaatggcctgagccagattgtctgcgccaacggcgatgtccattgcatgggcatcctcgtcaacgataattgccgccacttcagccggcgacatcgcattgatcacaaactgcgccgggttatcgtcccacaggacgatgtccacacgctcgccgcccaactcgcccgacactgcctggacgcgcgaaccgcgcataccgatgcaggcgccttgcgggtcgatgcgcttgtccttggagcggaccgcgatcttggcacgcgaacccgggtcccgggatgcagccatgacttcgatcagcccttcggcgatttccggcacttcgatgcggaacagctcgatcagcatttccggcgcggtacgcgacaggatcaactgagggccgcggttctcggtgcggatttccttgagcagcgcacgcagacgcacgccaacacggaaggtttcgcgagagatgatgtcttcacgggccagcaacgcttccgcattgttacccaggtcgacgatcacgttgtcgcgggtgacttttttcacggtgccggagatgatttcccccaggcgctcgcgataagcgtcaacgacttgagcgcgctcggcttcgcgaaccttctgcacgatgacctgcttggcagtctgtgcagcaatgcggccgaactcgatcgattcgatcttttcttcgacgacatcaccgacctgggcaccagggtgcgtctgcgcaaccttgctcggccaggtttcgatggccggatcatcaagatcggcttcttcgacgaccgtccagcgacggaaggtctcataggcaccggtgtggcggttgatttccacacgcagatcaacttcatcttcaaaacgctttttggtagcagtggccagggccagctccagcgcttcaaaaatcacgtttgccggtacgcccttttcattggataccgactcaacaaccagcagtacttctttgctcatcgtacgcctcgcctttcgcaagccattggatccgcgggatccgcgtctcagtcaaaactgggaataatgttggccttgtcgatcatatcgatcggcaacaggaactcatggtcttctacctgcaccacgacatcctgttcttctacaccgcgcagaaggccctgaaagttgcgtcgcccttcgaacggggagcgcagcttgatcttcacttgttcaccggcatatttagcaaactgctcgatagtgaacagcgggcgttccatgcctggcgaggaaacttcgagggtgtattcaacggcgatgggatcttcaacatccagcacaccgctgatttgacggctgacaattgcacaatcgtcgaccagcacgccgccctctttatcgatataaacgcgcaacattgagtggcgaccttgagccgaaaactcaataccccagcattcatagcctagggccacgaccaccggggccagcaaggcctgcaactcttctagcttgctcgacacctgaaccccctcgtgcatgtatgtgcatgctgtgcaaaataaaaaaatgggcgaaacgcccatccttgaaacgccgtcgaacagcggcgttgaaagtgtccagctaacaaaaagccccttaaaaggggctccgctaaaactggttgcgggggccggatttgaaccgacgaccttcgggttatgagcccgacgagctaccagactgctccaccccgcgacaaagctggggcggaagtatacgaccgatcccttacagggtcaatgtaaccttccacctacaagaaagcccgcaacagcgggctctcctgataattggtaccgagaaggggactcgaacccctacaccctatgggcacaaccacctcaaggttgcgtgtctaccaattccaccacctcggcaatacagcgtttacaaccttcttacttctgctcttgagctggaggcacgtcagtcgctggagtagccgacttttgctcttgaagcaccgggacatcatcagaagccggttttgcttttggtacttccaacactgctgggtttgggagacctacttgagtcagcacatgagccttctctttagcaaagtaacctaaccccaagctggttatgaagaaaccggcggcaagtatagcagtaaacttactaagaaaggtagaggaaccttggcttccgaacacagtatttgaagcacctgcaccgaaagacgcaccagcatccgcacctttaccctgttgcaacaaaaccagagcaactacgctcagggcagccaacagatgaaaaacgactacgactgtttccagcattttttcagtttcccgcggcgcgacagatcgcaccgaactcatctgcattcagggaggctccaccaatgagccccccatcgatatccggcatgccgaacagttcgaccgcattggccgccttcacgctgccgccgtatagaagccgcacaccttgtgcgacctcagaattctctgccgccaactgcgcgcgaatggctgcatgcacatcctgcgcttgttgcggtgtagcagtcagcccggtaccaatggcccagaccggctcgtaagcaatgactgcctttgcaaacgcaccaacacccagctcctcaatgatgctgcccagctgacgcgagacaacttcaagagtcttgcccgattcgcgctgctccagggtctcccctatgcacaacactggaatcaagccacaagcctgtgctgctgcgaacttgcggttgagtgtcccatcacgctcgcccatcatctgacgacgctcggagtgcccgaccagcacataggaacaacccgcatccaccaactgacttggcgaaatctcgccagtcaacgcaccttgcatgggctccaccgcagagttctgcgcgccgacctgaatcgacttacctttcaagccgtcaaccacttggttgatatgcaagcaaggcgggaacaccgcgacatcaacaccgccaggcaaggccaagtgacgaaggccgttgatcagctcagcgacactggcgcgggtaccgtgcatcttccagttaccagctaccatagtgcgacgcatgctgtacctcgtcggtcaaagtgggcgcagatgttacccaaccacatcatcactggcaagccgaattcaggcgcaaacttcagttaccagttttgccaggtcttcggcatggccgcgaacctgggtttcgtcttcgccttcgaccatgacgcgcaccagaggctctgtgccggacttgcgcaataacacacgcccacgcccagccattgcctgggtcacacgctcgcaagcctctttgactgccgggtgctcgattgggttttcgccaccggcaaaacgcacattcagaagcacttgcgggcatttgcgcagggcttggcgtgcctgggccaggctctcttcacgacgacgcaaggccagcaaaacctgcaacgcggcgatgatcgcgtcgccagtggtggtgtgctggaagcaaacaacatgccccgaattctccccaccgaccagccaattacgttccagcaactcggcgatcacataacggtcaccaacattggcacggataaaggggatacccagttctgccagcgccagttcgagcccgaggttactcatcaaggtaccaacgacaccaccgtgcagcttgttacgctcatgcaggtcacgagcaatgatgaacagcaggtcatcaccatccacgatcataccggtgtgatccaccatcaggacccggtccccatcgccgtcgaaagcgatgcccaggtctgcgtgctcggccagcacagccgcctgcagctgctccatgtgggtggagccacaattatcgttgatgttcaagccattaggctgtgcggacagtaccgtgacctgcgcgcccaactccttgaagacactcggcgccaccttataggtagcaccatgggcgcaatcgacgacgatcttcaacccggcaaaattggtactgcttggaacgctgcttttgcagaattcgatataacggccagatgcgtcattaatacgcgacaccttgcctagcttgctggattcaaccaccgtcatcggcgcatccagcaactcttcgatcatcaactcgatctcgtcaggcaacttggtgccctgcccggaaaagaacttgatgccattgtcatcatgagggttatgagaggcactgattacaatcccagcctcagcgtggaacgtgcgcgtcagatatgcgatcgccggtgtgggcataggccccagcagcatcacatcggctccggcggctgacaagccggcctccagcgctgactcaaacatgtaacccgagatacgggtatctttgcctaccaggatgcgacaagcgcccatgctgcggaacgccatgcctgccgcccagcccagcttgagcatgaaatcaggagtaatcggaaattcgccgacccgaccacgaataccgtcggtgccaaaatattttttagtcataagtgctccatcattcttattcggctgattctacagcagcgagcatgcgcaccacatcgaccgtttcggcgacatcatgcacacgcaaaatacgtgcgcccttggtcacggcaagcgccgcaagcgccaggccgccatacaagcgctcgcccaccgggcgattcaaggcgagcccgatcatgctcttgcgcgagacacccaccaacagcgggcgaccaagggcatgcagagcatccatgtgcttgaacaggctcaaattgtgctccagggtcttggcaaagccaaatcccggatcaaggatgatcttctcaggtgcaattcccacagccacgcactgggccatcctgtcagcaagaaacccacttacttcgccaatcaggtcgttgtagtgcggattatcctgcatattgccgggctcacccagcatatgcatcagacagacaggcaggccggtcgctgcggcggcatcaagggcaccatcacgtcgcaacgaacgtacgtcgttgataagtcccgcccccagacgagcagtttcgcgcatcaccgccggagtggaagtgtccaccgagataatcacatccagctcgcgggcgatgcgctcgacaaccggcgccactcgctccaactcttccaatggcgaaacaacacgagcaccaggccgggtcgattcaccaccgacatcaatcaaagtcgcgccagcggccaccatcgcctcggcgtggcgcaacgcagcgtctacctggctgaaacggccgccatcggaaaaggaatcaggggttacattgagaatgcccatgacatgtgtatgggccaaatcaagaacccggttgccgcaaggcaaccgggtagaggacaacgcagaagtcatttcaaaccttaatggtcagccgccgggccaccgatcggggcttcagggagttcattctgaactacgggcggggtgcccgaggtacccgaaccaccttcccaatcacgaggctcacgcggcgtacggccagccatgatgtcgtcgatctggtcggcatcgatggtctcatacttcatcagcgcatcagccatggcgtcaagcttgtcgcggttatcagtcaggatctgcttggccgtgccgtagcactggtcaatgatgctgcgaacctcggagtcgatcagcttggctgtctcacccgagaagctggcgctctgaccgccaccaccacgacccaggaacacttcaccctcttcctcggcatacatcaagggacccagtttttccgacaagccccacttggtcaccatgttccgggcaatctggctggcacgcatgatgtcgttggacgcgccggtggtcacaccgtcgaaaccaagggtcatttcttccgcaatccggccgccgtacagcgaacagatctggctgatcagtgcccgcttggagagactgtagcggtcctcctccggcaggaacatggtcacacccagggcccgaccgcgcgggatgatcgacactttgtagaccgggtcatgctcaggcacaacgcgaccgacaatagcgtgacccgcctcatgataagcggtgttctgcttctctttctcggacatgaccatggatttgcgctcggcgcccatcatgatcttgtctttggccagctcgaactctttcatttcaacaatgcgcttgccggtacgggcagcgaacaaagaagcctcgttgaccaggttggccaggtcagcaccggagaaaccaggcgtaccacgggcaatcacagccggtgccacgtcgtcacccattggcactttgcgcatgtgtactttcaggatctgttcacggccacggatatccggcaggccaaccacgacctgacggtcgaaacggcccggacgcagcagtgcagggtccagcacgtccggacggttggttgcggcaatgacgataatgccgtcattcatctcgaaaccatccatctcgaccagcaactggttgagggtctgctcacgctcatcgtgaccaccacccatgccggcgccacgatggcgaccaacggcgtcgatttcgtcgataaagatgatgcacggcgcgtgcttcttggcctgttcgaacatatcgcgaacacggcttgcacccacgccgacgaacatttcgacgaagtcagaaccggaaatcgtaaagaaaggcaccttggcttcaccggcaatcgccttggccagcaaggttttaccggtacccggaggacccaccatcaacacaccgcgaggaatacgaccacccaggcgttggaacttgcccggatcgcgcaggaactcaaccagctcgccgacttcttccttggcctcgtcgcaaccggcaacgtcagccagggtggtcttcacctgatcctcggagagcaggcgcgccttgctcttgccgaagctcatcggcccgcccttgcctcccgcgccgccttgcatctggcgcatgaagaacatgaacacagcaataatcaccaggatcgggaagctggctaccaggagctgggtccagatactctgctgctccggctgcttgccttccacgacgaccttgttatccaccaggtcgccgatgagcccattgtcctgaattgccggacgaatggtcttgaagctgtcgccatcgatgcgcttaccggtaatcacgtagccatcaaccgctacgcgctcgaccttgccatccttaacttgctggatgaagtcggaatagttgagggtctgcggctcgttagggctggagaagttgttcatcaccgtcaccaggacagccgcgatgatcaaccacaggatcagattctttgccatatcgttcaattaactaccctctgaagcaagctccgctactggcgcgcgcttcgcatgatattcaccggcctaacttactacattacctacatctctggcaggcgccgtctgtaaccctttgtgaaactttgaccacacaatattcgtaaagcctcatgacgaaagcgatataaaaaaacctatcgccctcctcgaaattctcaaaaacgctcttcgctcgccgcgccttcgacgccgcggaagccgcggcacaacaggtattgctccctggacctgtcccgggaggagtccggcttacgcgtctgaaccttgtcgaacaacttgcggatgttcttgtggtactcgtcgaaaccttcaccctgaaacactttcaccagaaaatcaccacctggacgcaatacgcgccccgccagatccaatgccaattcacacaggaacatggctctcggcatatcaacagccggtaatccactcatattgggggccatgtcggaaatcacaaggtctacctgcgaatttcctacagcctccagaatctcggccagcaccgcgtcctgggtaaaatcaccgtggacgaaggtgacatccgggatgctgtccatctcaaggatgtcggaagcgatcagtcgaccttgcccaccaatcagacgactggtcacttgggaccagccaccgggggccgcaccaaggtcgataacgctcatgcccggacgaatcaacttgtccttgtcctggatctccagcagcttgtagctggcccgggagcgatacccatccttctgcgcttttttgacgtaaggatcgttgaaatgttcttgcagccacttaaggctagttttggaacgggccacgggccacctcgaaaaataaaacgggtcgtgattaactgggcggtcccggactcgctcgggtaaactggccgccgctttttacaagatcagacgcaggggtcagattatgccgctcactcaagagcagaagaaacagtacaaatccattggccaccatctgaaaccagttctgattgtggcagacaacgggttgactgaaggtgtgttagccgaatttgaacgcgcactgaacgatcacgaactgatcaagatcaaggtcaatatccttgatcgcgaagcgcgcctggctgccgttgcagaactgtgcaaggcgggcaaggcggacctggtccaggtcatcggcaagatggcgctgctgtatcgcaagaacttcagcgtcaacaagcaactgtcgaacgtacaccgcttcaagtaacaaaaagggtcacgggcgtgcttcgcgcgccctgccactccatcccgggaccggctgcatcaccagcaccaggccggagaaccctagcacaagatagctgaacagccgccagcgcaacgcttccggcagccatacatgcaccacgcaaaacatcgcgcacgcatacagcgccatcaacagcagttgcccacgaatatctcgccacagactccccaagccttcagccttgatcagcactaacgcctgaagcattacgcacgccgccgcaaaacctaccagcagcgcactcaataatccgtcgacctcgtcgatcagcagcggtgccaggccaatcaggcccagcgccggtaacacgccaatatgtaacagccacagaccgccgacccaaagcatctgggagagctgccaaagcatggcgcccgcacgaagcgggcgctttttttcagatgtgacgaacttcgacaatctcgtactcgatcacgccactcggcgtcttcacagcaaccacgtcgccctcttccttggcaatcaaggcacgagcaatcggcgaaccgacggagatcttgccttttttgaagtcagcctcatcttctcccacgatctggtaggtcacgctctcatcggtctcgacgttggcgatttccaccgtggtgccaaagatcaccttgccagtatgcgggatggtcgtgacatcgataatcaccgcattctgcatgcgcccctcgatgtcacgaatccgcgcctcgaccataccctgctgctcgcgggcagcgtggtattcggcgttttccttcaagtcacccagctcgcgggccgtaccgatgtcctggctcagctttggacgtacgaccttggtgagatgggcgtgctcctcttccagggccttggcaccctgaacggtcattgggtatttggttatgctcatgccttcaatcccgcatgtaaatcctgcaagcgacgcacggtcttttccggaccgaacttgagcgcttcgcagatggcttcgccagcagcaatggtggtggtgcagtagatcttgtgctgcaaggcattacgacgaatggaataggagtccgcgatcgactggcgaccttcggtggtgttgatgatcagcgtgacttcgtcattcttgatcatgtcgaccacgtgcggacggccttccgtcaccttgttcacgcgacgtactttcaggccggcagcttcgatcagcttggcggtcccggcggtagccacgacttcaaagcccaagttgatcagatcacgggcaacccctgcaaccagtggcttgtcgtcatcacgcacgctgataaacgcagtaccgccggtcggaagcacttcactggcccccatctgagccttggcgaacgcttcaccgaaggtatcgcccacgcccatcacttcaccggtggacttcatctccgggcccaggatcgggtccacaccagggaatttggcgaatgggaataccgcctctttcacgctgtagaagtttggaatgatttccttggtgaaaccgatttccttcaaggtcttaccggccatcacacgggccgcgatcatggccagggacacaccgatgcacttggaaacaaacggcacggtacgcgaagcccgcgggttgacttcgatgacgtagatgtcttcgccttgcagcgccaactgtacgttcatcaggccgaccacacccaactccagagccattttcttgacctgctcgcgcatctcgtcctggatgtgcgccggcagcgagtacggcggcagcgagcatgcggagtcaccggagtgaacgcccgcctgttcgatatgctgcatgattgcgccgatcaccacgtcggtaccatcgcaaaccgcatccacgtccatttcgatagcgcagttgaggaagtggtccagcagcaccgggctgtcgttggacactttcaccgcatcacgcaggtaacgcttgagctcgtcttcttcatagacgatttccatcgcccgcccgcccagtacgtaggacggacgcaccaccagcgggtagccgatcttgctggcagcacggatggcttcgtcttcgctgcgcacggtagcgtttggcggttgacgcaggttaaggcgctcaaccatctgctggaaacgctcacggtcttcggcacggtcgatagcgtccgggctggtgccgatgatcggcacaccggcggcttcgagggcacgcgccaacttcagaggagtttggccgccgtactggacgattacacctttgggcttttcgacgcgacagatttccaggacgtcttccagggttaccggttcgaaatacagacggtcggaagtgtcgtagtcagtggaaacagtttccgggttgcagttgaccatgatggtctcgtacccgtcttcacgcagcgcaagggcggcgtgtacacagcaatagtcgaactcgatgccctggccgatacggttcgggccaccacccaggatgatgattttgtcgcgatccgacggcgcggcttcgcactcttcctcgtaggtggagtacatgtaggcagtgtcggtggcgaactcggctgcgcaggtatcaacgcgcttgtagaccgggaagatctccaacttgtggcgatgggtgcgcaggttcttctcggttacacccagcagcttggccaggcgctgatcggagaagcctttgcgctttagacggaacatcaagtcgcggtcgatagacgacagaccgagggtcttgaccttctcttcttccttgatcagatcttcgatctgcacaaggaaccacgggtcgatcatgttcatgccgaagatatcttcgacgctcaggccggcacggaaggcgtcagccacataccagatacgctcggcgcccggcacggtcagctcgcgcttgaggatgctcatgctttccggattgctcaggtcgagcttctcgtccagcccgcaaacaccgacttccaggccacgcagggctttctgcagggactcctggaaagtgcgaccgatcgccatgacttcaccgacagacttcatctgggtggtcaggcgcgcatcagccttggcgaacttctcgaaggcaaagcgcggcagcttggtcacgacgtagtcgatagacggctcgaaagacgccggcatagcgccgcccgtgatttcgttttgcagctcgtccagggtgtaaccgatcgccagcttggcagcgatacgcgcaatcgggaaaccggtagctttcgaagccagtgccgaagaacgcgatacacgcgggttcatctcgatcacgaccatgcggcctgtgtccgggcagataccgaactgaacgttggaaccaccggtttcaacgccgatctcacgcaataccgccaacgaggcgttgcgcatgatctggtattccttatccgtcagggtctgcgccggagcaacagtgatcgagtcaccggtgtgcacacccatcgggtcgaagttttcgatggagcaaacgatgatgcagttgtccttcttatcgcggacaacctccatctcatactctttccagccgatcagggattcgtcgatcaacagctctttggtcggagacaggtccaggccacgggcacagatttcttcgaactcttcacggttgtaagcaatgccaccaccggtgccacccatggtgaaggacgggcggatgatgcatgggaagcccagcttttcgagaaccgcgttggcctcttccatgctgtgggcaataccggagcgcgggcagtcaaggccgatggacttcatggccttgtcgaagcgcgaacggtcttcagccttgtcgatggtgtcggcattggcaccgatcatctctacgccgaacttctccaggacaccttcgcgctccaggtccagggcgcagttcaacgccgtctggccacccatggtcggcagcagcgcgtccggacgctctttctcgatgatcttggccacggtctgccacttgatcggttcgatgtaggtggcgtcggccatggccgggtcggtcatgatcgtggccgggttggagttcaccaggatgacgcggtagccctcctcgcgcagggctttacaggcctgggcgccggagtagtcgaattcgcaggcctggccgatcacgatcgggccagcgccgagaatcaggatgctttttatgtctgtacgttttggcatgggtttgtcactcaaatccgcaggtcagtcggcaagccgtcatgaacaatctttgaaaagcctgcgggggccaccgaagctcggggccgcccgcaggccagtcagtcagcgtcgcttggccatctcattgatgaaacggtcgaacagcggcgctacgtcgttcgggcccgggctggcttcagggtggccctggaagctgaacgcgctcttgtcggtgcgctcgatgccctgcagggaaccgtcgaacagcgacttgtgaatggcgcgcacgttgcttggcaaggtggcttcatctaccgcaaaaccgtggttctggctggtgatcatcacgatgccggtatccaggtcttgtaccgggtggtttgcaccatggtggccgtgacccattttcagggtcttggcgccggaggccagggccagcaactggtggcccaggcagatgccgaataccgggatctcggtttccagcacgtccttgatggcctggatggcgtagtcgcatggctcggggtcacccgggccgttggacaggaacacaccatcgggttgcagggcgagcacgtcgctggccggggtctgtgccggcaccacggtcacgcggcaaccgcgctcgaccagcatgcgcaggatgttgtacttgacgccatagtcgtaggcgaccacgtggtaaggcaagtcggcagcatcgatggtcgcatggctgtcagtcttcaaatcccagacagtggagcgccactcgtacttttctttgacgctgacgactttcgccaggtccatgcccttcaggccagggaaaccttgtgctgcggcaatcgccgcctcttcggaaatattgtcaccgaccatgatgcagccgttctgcgagcctttctcacgcaggatgcgcgtcaggcggcgcgtgtcgataccggcgatcgccacaacattgttggctttcaggtaatcggacagcgacatcgtgttacgccagttgctcgcaaccagtggcaggtcacgaattaccagacccgccgaccagacacgatcagactcgacgtcttccggtgtagtaccggtgttgccgatgtgcggataggtcagggtaacgatctgttgggcgtaggaaggatcggtaaggatttcctgatagccggtcatggcagtgttaaacactacctctccaacggtttgaccgtcggctccaatggcttcgccgcgaaaaatgctgccatcagcaagggcgagtatggctggcttagtcaagaagacctcccgtaaataaagcctgaaagggcgatcgcaggttgtaaaaaagcggagtgacgtatggacacgtcaccccgcttcttcactgaattattctgcgcgcttttagtggacacactaaagctgtagcttacagaaaaaggcttttttggtccaccgctaatgagccttaaaggcaggggaatgcgacaggacgtcgcttagcgggtaaaaacggggcctcaggataatcgtgggccccagttttagctactgattagtgcagatccagcacatcgcgcatgtcgtacaagccaggctcgcgcccctccaaccagagcgcagcacgtaccgcccccttggcaaacgtcatgcgactggaggccttatgcgtgatctccaggcgttcgccttcggtggcgaacagcactgtgtgatcgcccactacatcaccaccgcgcacggtcgcaaagccaatggtgtcgcgcgcacgctcacctgtatgaccttcgcgcccgtacacagccactttcgacagatcgcgacccaacgcatcggctatggcttcacccatgcgcagtgcagtaccggagggcgcgtcgatcttgtgacggtgatgggtctcgatgatttcgatatccgcctcatcacccagcacacgcgccgccagatccagcagtttcagcgacaggttcacacccacgctgaagttggcggcaaagacgatagggatgtccttgcccgcctccaccagcaactgcttctgctcagcactcaagcctgtcgtgccaatcaccatggctttgcccgccttgcggcagaacgccaggtttttcagcatcacatccggcaaggtgaagtcgatcaatacatcgaactcgtcagccacctgcccaagactgcccgacaacgaaacaccgatgcgccccaaagaagccaattcaccggcatcagcaccgatcaacgtgctgcctgggcgaacaatcgccgcggtcagcccagaggccggcgaacgctgttgcaccgcttcgaccagtgtcttgcccatgcgcccggcagcgcccattacggctatacgtcgcatatcacttccttacaggtcgccgaagaagcgcttcacgccatcgaaaaagccagtggttttcggcgagtgggaatcgtcaccctccagcgaactacggaactcttcgagcaattcgcgctgacgacgccccaggttaacgggggtttccaccgctacgcggcacatcaggtcgccagcagcaccaccgcgtaccggcgcaacgcctttaccacgaatgcggaactgctttccggtttgagtaccttcaggaatcttgagcttgaccctaccatcaagggtcggaatttccagctcgccacccaaggctgcatcgacaaagctgatcggcacttcacagaacaaatgcttgccatcgcgctggaagatcgaatgctcgcgcacattgatcaccacgtacagatcgcccgtcggaccgccttgggtacccgcctcgccttcgcccgacaggcgaatacgatcaccggtatccacacctgccggcactttcaccgagagggtcttgtactcttcgacgcggccttcgccgtggcaggagtcgcacggatcagaaatgatcttgccctgaccatggcaacgcgggcaggtttgctgcaccgagaagaagccctgctgcatgcgcacctgaccgataccaccacaggtcgggcaagtaatcggcgaggagcctttcttcgcccccgaaccgtcgcacggcttgcaattgaccagcgtcggtacacggatattgacgctggtaccgcgtacggcctcttccaggttcagttccagggtgtagcgcaggtcactgccacgctgggcaccgccacgctgaccaccgcgaccaccaccaaagaagtcgctgaacacgtcgccaaaaatatcggagaagttctggccaccaaaaccggcaccgccgccgcccatgctcgggtcgacgccggcatgcccatactggtcgtaagccgcacgcttattgggatcacacaggcattcgtaggcctcgttggcctccttgaacatctcttcggattctttgttatccggattacggtccgggtggtgcttcatcgccaggcggcggtaggcctttttcaggtccgcctcgctggccccgcgctccacacccaatacttcgtaatagtcacgctttgccataagtctttgcactcttaaggacgtccggcctggccctcctgaaccctgccaaactcgttgagccccaatacaggcccggacccaactcacgtcaattcaacgatcctggtcattactgctttcagccagggacccggccaaaaacgcggtgattgtcattcggaaagcaggagcattcccggtcacaccgccagcatccgagcgttgtcgcatgctgtaaaaattcgcataccccagacacgccaacgcgggagctagctcccgcgcggcgacatcctaccagtcaccgcttgtcagcggtcaaccggacaaccaacttacttgttgtctttaacttcttcgaactcggcatcgacaacatcatcgtgcttggcttcaggctctgcttgttgcgcagcaccgtcagccggctgagcttgttcggcgtacattttctgagcgaccggcgcggagactttcgacagttcctcaaccttcgcctcgatggcggccttgtcgtcgcccttgatggcggcttccagggcaaccactgctgcttcgattgcagttttctcttcggcagtcactttgtcgccagcatcagcgatcatcttgcgggtcgagtgaaccagcgcatcaccctggttgcgagcaccggccaactcttcgaacttcttgtccgcttcagcattggtttcggcatcacggatcatctgttgaatttcttcatcagacaggccggagttggccttgatggtgattttctgctctttgccggtagccttgtccttcgcgccaacgtgcaggatgccgttggcgtcgatgtcgaaggtcacttcgatctgtggcacgccacgtggtgctggtggaatctcagccaggtcgaacttgcccagggacttgttctgggcggcttgcttacgctcaccttgcagcacgtgaatagtcacggcgccctggttgtcatcagcagtcgagaacacttgggatttcttggtaggaatcgtggtgtttttctcgatcagcgcagtcatcacgccacccatggtttcgatacccagggtcagcgggcttacgtccagcagcagtacgtctttcacgtcaccagccagtaccgcaccctggatcgcagcacccatggcaacggcttcgtcagggttgacgtctttacgtgcttctttgccgaagaactcggttaccagcttttgcaccaaaggcatacgggtctggccgccaaccaggatcacgtcgttgatcgagccaacatcgatgccggagtctttcagcgcaatacggcaaggttcgatagtgcgctgaaccaggtcttcaaccagcgcttcgagcttggagcgcgagatcttcacgttcaagtgcttaggaccggttgcgtctgcagtgatgtacggcaggttgacgtcggtcgactgagcggaagacagctcgatcttggctttctcagcggcttctttcaggcgctgcatggccagcgggtcacccttgaggttcatgccgctttctttcttgaattcatcaacgaggtagtcgatcagacgaatgtcaaagtcttcaccacccaggaaggtatcgccgttggtggccaacacttcgaactggtgctcgccgtcaacttcagcgatctcgatcacggaaacgtcgaaggtaccgccacccaggtcataaacgatcacagtgtgatcgcccttggccttgtccatgccgtaagccagtgcggctgcggtaggttcgttgatgatgcgttttacgtcgaggcccgcgatgcggccggcgtctttggttgcctggcgctggctgtcgttgaagtaggccggaacggtgatcaccgcttcagtcacggcttcaccgaggtagtcttcggcagtcttcttcatcttcttcaagatttcagccgagatttgcggcggcgacattttctggccgtttacttcaacccaggcgtcaccgttgtcggccttggcgattttgtaaggcaccatcttgatgtctttctgtacaacttcttcgtcgaacttacgaccgatcagacgctttaccgcgtacagggtgttatgcgggttagttacagcctgacgcttggccgactggccgacgaggatttcaccgtcgttcgcgtaagcaatgatcgacggagtggtacgtgcgccttcggcgttttcgataacctttgcaacgccgttttccagcacggagacgcaggagttggtggtccccaggtcaataccgataattttgcccatgatttactctcccgaaactttaatttttttgccgcagcagtggtggctaaccgcggtagtacttaaacgcttgacttatagatgggggccttgcggcggatttcaagcctgctcatcaatagaaggtgcaggaggtgcatcggcggcaggagccttgctcaccaccaccattgccgggcgcatcaagcgaccgttgagttggtagcccttctggaacaccttcatcacgctattaggctccaggtcgtgactttcctgcatggccatggcctggtggtgctcagcgttgaaaggctcaccgccttgcggatcgatagcttccagctgataacgcttcagggtgtcctggaacattttcagggtcagctcgatgccttcgcgcattgggcggatgttttcgtcgtccgggttggacaactcaagaccacgctccaggctgtcgatgatcggcaacagatcaccggcgaatttttccagcgcgaatttatgagccttctctacgtcctgctcggcacggcggcggacgttctgcagatcggcggcaacacgcaaagattgatcctgcgcagcggacaattgctcttcgagcacttgcacgcgtgtcgccagctcatcaccggcagccgcgttggcgtctggagtttgcgtatcctgcgtctgttcgtcagccatagatctctcctttcaaaatcatgcgcgaactcaactcgcgcttctgttccggtatatggggccacaatttccaggttcaagggcgcaggcgttaccaaaagtctttcgcatgctctggatcatttcctgcgccttcattccgcattgcgctaaaaaaacgcattgatcaagcaaatcgagctaagcatcaggattgtcagcccagaacaaaacactgtataaataaccagacctaaagcctgggagcggccgtcatgctggtgcacctgtctgtacacaactacgccattgttgaacacctggaccttgaactggaccgcgggatgagcgtaatcacaggcgagaccggcgccggcaagtcgatcatgctcgacgctctgggcctgaccctcggcgaccgcgccgacagtggcgtggtacgccctggctctgacaaagccgatatcctggccaccttcgaccttgcggatattcctgaagccgaggcatggctggccgagcgtgacctcaataatgaagggccctgcattctgcgtcgggtgatcactgccgaagggcgctcccgcggctatatcaacggcaccccttgccccctgggcgacttgaaagcgctgggggagctgcttattgatatccacagccagcatgagcaccaatccctgctgaaaaccgatacccaccgccgcctgctcgatgaatacgccggcgccaccgatcttgcccgtcaagttcaactcgcggcccaacgctggcgccagacgcgccaggagctggaacgcctctccaactccggcgatgaacaacgtgcccgccaccagttgctcagctatcagctggaagagctcgaaagcctgggcctgggtgagaacgagctagagcagcttgagcaggaacacaagaacctgaccaatgccgagaccctgctaggtatatgccgccaggtggtcgagcaatgcagtgagagcgattccggcaatgtactcaacgcactgaccgccagcctcaatcgcctgtccagtgtgaacaacgcttccggttcgctgagtgaagccaccaccctgctgaccagcgcacagatccaggttgaggaggcggtcggcgaactgaatcgttttctggaccatttcgatgccgatccagcgcgcctgcaggaaatagaagagcgcctggatactatctataccctggcacgcaagcatcgaatccagcccactgaagtcgccgccatgcagcagaaactgctggatgaaatcgagacgctgaacgcgaacgacgaatccatcgagcgactgggcgaggaactcgcttcgtttgcccgccattatcaagaaaaggcccgggaattgagcgacctgcgccagcaagcagccaccagcctggccagcgccgttgagcaagaaatccagcgcctgggcatgccaggcgggcgcttcaccatcgaactacgcgcaaacgccagtcacgaactgcaaccccatgggctggagcaagtagaactgctggtcagcgccaaccccgggcaaccactcaaggccctggccaaagtcgcgtccggcggcgagctgtcgcgaatcagcctggcgatccaagtgattaccgcccaaacctcacgagtgccgacgctggtattcgacgaggtagacgttggcattggcgggccgaccgcagagattgtcggccagttgttgcgccgcctaggggatcgcggccaagtgcttacggtaactcacttgccgcaagtggccgcccagggtcatcagcatttatttgtgcacaaggtgcgaggcaatgacgcgacgcacacggccgtctccaagctgaacaaatcggagcgggtagaagaggtcgcgcggatgctcggcggtatcgacttgaccaaggagtccttggctcacgcgaaaaaaatggtcgtggcggcgaaggcctgaactgatatctcccttcttatagaaagcacgaaggcgaccggggtcgccttcaatcgtttcacagagcaaatctgcgtcgatttttactttttcttacggatgtacaacaccagattatgatcgaccaaatcgaatccatgctcctcagcaatcttatgctgcagcgcctcgatttcaggactggtgaactcgataacctcattggtatccaggtcaaccatgtggtcatggtgaccaccgtcggccaattcgaacaccgcatgaccgccgtcgaaattatgacgaaccaccagccctgcggcttcaaactgggtcagcacacggtaaaccgtggccaagccgacgtcctcgttagactccatcagcgccttgtagacatcctcggcactcatgtggcgctgctcagcagaatcgagcatttgtagaatcttgactcgtggcagagtcactttgagaccggctttgcgtagttcgctattttcaaccatggttagctttctcgcggatgctgcttcgcagcttctcttaatacgggtatgatcggcgtttacgttgtcccagccaagatagtggaagtcgcccaccgatgcaaaacaccaagctcttgctaaccagtttcacctttgtgggactgctcgcactcgccggttgttcattccccggggtttacaaaatcgacatccagcagggcaatgtcgtcacgcaggacatgatagaccagttacgcccgggaatgacccgacggcaagtacggtttatcatgggcaaccccctgctgaccgacactttccatgccgatcgctgggattatctctatagcctccagccaggtggcggtgaacgccaacaggagcgcgtcagtgtcgtcttcaacggcaatgaccagcttgtcagcctgtccggtgacttcatgcctggcgtgagccgcgatgaagcgctgctgggcaaagacagcggcaccaacgtgaccgcacctgtgcaggaagctgaaaagccgaaatccgaggtgccggccaagccaggctcgctgctggaccagatccagaaagacgtcgacggcgtggaaactgttcccgtcccgacgccacaacctctggacaccgacccgcagtaattttgcggcgctcgataaaaagcccggcatgccgggctttttgttgtctgccatttggccggcttataaattttgctgtctgctcatcgcagctttagccgcacgcagcctgcgtacttccttggggtccgccagcaatggtcggtagatttcaattcgatcaccgggctgcacagcacgcacatcagcgtccgccaccaccttaccgaagattcccagcgggcagtcagccaacatcaattgaggaaagtgctcggctattcccgacgccaggaccgccgccctcaagctggtgcccacgggcattgtcaccgccaacagaacctggcgatccaccgccgcatacaccacttcaatctcaaccatgcagttgcttggcccgctggcagaacgcgtccaccagcgtattagcggcctgattgaacaaaggccccagcgtggcacgcacaatgggcccggcataatcaaaagacaaatccaggctgatcttgcaggccttatccgtcagcgccttgaatacccacaccccatgcaactgagtgaaaggcccctcctgcagattcatttcgatggatttgccaggcaccagcacattgcgcgtcacaaaatgctggctaagaccgcccttggcgaccccgacactggcaaccatgtgctcgtcactgctctccaagacctcggcagtcgagcaccaaggcaggaattccgggtaacgcgccacgtcgttgaccaggtcatagagcgcctgcgctggatagggcaacagggccgaacgttgaatatgcgtcgtcatgtgagcgttacttccactgctgagcggcaaacatcgcgaaagtacagcccgatccgcgagagaaaaaaacctaagaactgcccgtattgtccgggattcgtccaacacgctcaagcacgcaggttgaccgtagccgacacgctcgcaactccctataatgccgcccctatggctaaacaaaagaaacaccccacagggaccatcgcgcaaaataaaaaggcgcgacacgattacttcatcgaacatcggttcgaggctggtctggtcctggccggctgggaagtaaagagtctgcgtgccagcaaactgcagctggtcgacagttatgtgctgctcaaggatggcgaggcatggctgctcggcagtcatatcaccccgctgaccaccgcgagcacccacgtgattgccgacccggtgcgcacgcgcaagctattgcttaacgcccgcgaactggaaaagctcgccgcggctgtgcagcaaaaaggttacgcctgcgtttgcttgtcgtggtactggagcaagcacctggtcaagtgcgaaatcgcactgggcaagggcaagaaggaatacgacaagcgcgataccgaacgcgagcgcgattccaatcgtgaactgcatcgcgccgtgcgcaacaagggtaaggaagaataacccttgcgacgatgtagcctcgggcaccttgcccagggctacatgcccttgcgtcgttccgcccgcgctacacgctgaacctcctgacgtacttcttccagcacttcctgcacatacaacaggtgacgtgtcgaaacttcgcgcgcctgctcggctcgcccctcaatgattgccaggtacaaatcccgatgctgactgatcagcatgtcgcgggtctctgtacgctgttggtacatgccgccgatgttggtcaccacgttccgcttgagcaggtcgaacaagccgcgaatggtgtgcagcaatacggcgttatgactggcctcggcaatcgccaagtgaaaccttgcatccgcggcgccctcctccactcggctcacctcatcggctcgcgcataacaatcctgcagcgcctcaaaagccgccgtcagtcgttcacggtcgacctccgtggcacgcaacgccgcgtaataggcacaggaagcctccagggtctggcgaaactccaaaaggtcccgctgtgcctcgggattgttttccaacaaatgcagcagcggatcgctgaaggtcgaacccagggagtccaccacatagttgccaccgccctggcgactgaccagcaaccccttggccgccagtttctggatcgcctcacgcaatgacgggcgcgacacaccaaactgttcagccaaagcgcgctcggccggcaagcgctcgcctgacttcaacgtgccctcaaggatcatgccctcaagctgctcgacaatgtcatcagacaaacggcgctgacgcacctgatcaaaccccataactcactctccacgatcccgaccactcgccgggccttctattctggcctatcgctgcgcttgcagcacctatcagaacgcctttgattcatccgatcagagcacctcccatcacgccctaagaccaaagtttcgcgagcggcaaattgacacacccctgcaatgcctcttaatctagcccacagcgagtgtaaattggtattaccaattacccaagcatacaaacaacaacaaaatcaggggccaccccatatgcaaacctggcaacagctctacagccctctcggcagcctcggcttgtccgcaatggccgccgtcattcccatcgtgttcttcttcctggccctggctgtgtttcgccttaaaggtcatgtggctggcagcatcaccctggcgctgtcgatcctggtcgccatcttcgccttccagatgccagtagacatggccctggctgcagccggttatggctttgcctacggcttgtggcccatcgcctggatcatcgtggcggcggtattcctctacaaattgacggtcaagagcggtcagttcgagatcatccgcagctcggtcttgtcgatcaccgacgaccagcgcctgcaggtactgctgatcggcttttgctttggtgctttcctggaaggcgccgccggtttcggtgcgcccgtggcgatcaccgccgcgctgctggtcggcctgggtttcaacccgctgtacgccgccggcctgtgcctgattgccaacaccgcgccagtggccttcggtgcattgggcattccgatcatcgtcgcaggccaggtcaccggcattgatgcgttcaagatcggcgccatgaccggccggcaactgccgttgctgtcgctgttcgtgcccttctggctggtgttcatgatggacggcctgcgtggcgttcgcgaaacctggccagcggcattggtggctggcttgagctttgccatcacccagtacttcacctccaacttcattggcccggaactgccagacatcacctcggcgctcgccagcctgattgccctgacgctgttcctgaaggtctggcagcccaagcgcaccgcaggcgcacagattgccggcgccacctccagcgtagcggtcacttccagcatcggcggcttcggtttgccacgcagcaccgtggtttcgccctacagcctggggcagattttcaaggcctggtcaccgttcctgatcctgaccgtgctggtcaccatctggaccctcaagcccttcaaggccatgttcgccgcgggcggttcgatgtacagctgggtcttcaactttgcgatccctcacctggatcaactggtgatcaaagtcgcccccatcgtgaccaacccgaccgccatcccggccgtattcaagctcgacccgatttcggccaccggcaccgcgattttcttctccgcactagtctccatgctggtgttgaaaattgacgtcaaaactggtcttaccactttaaaagaaactttctttgagctgcgttggccgatcctgtccattggcatggtgctggcgtttgctttcgtcaccaactattcgggcatgtcctcgaccatggccctggtgctggccggcaccggcgcagccttcccgttcttttcgccattccttggctggctgggggttttcctgacaggctccgatacctcatccaacgccctgttcagctcattgcaagccaccaccgcccaccagatcggtgtcaatgacaccctgctggtagcggcgaacaccagcggcggcgtgaccggcaaaatgatctcgccgcaatcgatcgccgtggcctgcgccgccaccggcctggtaggcaaggaatccgacctgttccgctttaccctcaagcacagcctgttttttgccaccatcgtcgggctgatcaccttggcgcaggcctactggttcaccggtatgctggtgcactgagacctgcacgtaatagggtaagaatcgacgccggataacgattccggcgtctgctatttctggaggaccgatgagcctgcctgctgcttttatcagcgacgtcgcacaactgatcccgaaagatcgtcgtttcgacgacgcactttccaccctggccttcggcaccgacgccagcttttaccgcctgatcccacagctggtgatccgcgtggagtcagaagacgaagtcgtcgcactgctgcaaatggcccagcgtgatcacgtgccggtcacctttcgcgccgccggcaccagcctgtccgggcaggccatcagcgactcggtgctgatcgtgctgggagacaactggaaccatcgcgaaatccgcgggcaaggcactcagatacgcctgcagccgggcgtcatcggtgcccaggccaacgcctggctcgcgccattcgggcgcaagatcgggccggacccagcgtcgatcaatgcctgcaagattggcggtatcgtcgccaacaatgccagtggcatgtgctgcggcacggcgcagaatacctaccacaccctggcgggcatccgcctggtactggccgatggcagccgcctggacacggaagacgccgccagcgtgcaagccttccgccaaacccacagcgcgttgcttgagcgcctggccacattaggccgtgagacgcgggaaaatactgagcttgcggcaaagatccgccacaaataccgtctgaaaaataccaccggcctttcactcaatgccctggtggactttgacgacccgctggatattctcagccacctgctggtgggctccgagggcaccctggggtttatcagtgccgtcacctacgacacggtggtcgatcacccgaacaaagcctcggcgctgatcgtattcccggatgtcgagacctgctgcaacgcggtaacggtactgaaaacccagccggtctcagcggttgaactgctggatcgacgcagcatgcgctcggtgcagaacaagccgggcatgcccgcattcgtacaacacttatcggaaaacgcctgcgcactgctgatcgaatcccgggccgcctcgcccgcattactgcacgaacaactgacactgatcatggcttccctggcggcgtttcccgtagagaaacaggtcgatttcaccgaagaccccgtggaaaacgctcgcttgtgggcaatccgcaaagacaccttccccgcggtaggcgccgtgcgcaagaccggcaccaccgtgatcatcgaagacgtcaccttccccgtagagcaactggcgattggcgtgaaccgcttgatcgaactgttcgacaaacatcactacgacgaagccatccttttcggacacgccctggaaggcaatctgcactttgtgttcacccagggcttcaacagccgcgaagaagtcacacgctatcaagcgttcatggatgatgtcgcgcagttggtggcggttgaatttggtggctcgctgaaagccgaacacggcaccggccgcaacatggcaccgttcgtcgagctggaatggggcagcgacgcctaccagctgatgtggcaactcaagcgcctgctcgaccccaacggcattctcaacccggatgtagtactcagcgacgatccgcagattcacctcaaacacctcaagcccttgcctgccgccgatgagcttgtggataagtgcatcgagtgtgggttctgcgagccggtgtgcccgtcaaagggccttacgttgagcccacgccaacgcatcgtgatctggcgcgatattcaggccaagcaacgcgcgggggtcgacaccaccgagctggaagcggcctaccactaccaaggcatcgagacctgtgccgcgaccgggctctgcgcccaacgctgccctgtcggtatcaacaccggtgacctggtgaaaaagctgcgcagccgcgaggccgaccgtacgaaaaccgccgaatggcttgccagccatttctccatggcgctgcaaggcgcacgctttaccctgcacgtcgccaatggcgcactcatgctgctgggagcaccgcgcctggcgaagtggtcggccacggtgaccaaattgtccaaaggccaggttccgcagtggaccaacgccatgcctcaaccggaaaaagccattcgcttcagcccagcggtgccggacgagcgctcgcgggtggtgtatctggccgcctgcgtctcacgcgccatgggtccggcagccggggataaagagcagatgtcgctgtacgataaaacccgcaatttattggaaaaagccggttaccaagtcgtctttcccgacaaccaagacagcctgtgctgcggccaacccttcgcctccaaaggttacgccgagcaggctgaacacaagcgccaggaactgatcggcgccctgctccacgccagccgtggcggccttgacccgatctactgtgacaccagcccatgcacactgcgactggtgcaagacctgggcgaaactcgcctggacctctacgacccggtgcgcttcatccgcacccacctcatggaccgcctcgactttaccccccaggaagcgcccatcgccgtacacgtcacctgcagtacccaacacctgggcgaaagccaggcgctgatcgaactggcccggcgctgcgcaaaaaccgtggtaatccccgaaggcattcattgctgcggctttgccggcgacaaaggctttaccacgccggaactcaacgcccactccctgcgttcgctcaaggacgccgtgcaacattgcagcgaaggcatctccaccagccgcacctgcgagatcggcctgagccagcatggcggcattgattaccacggtttggtgtacctggtggaccgggtcacccgcgcacgcgctcactaaccctgcaaaaaaacagaaccctggcgcgccagcgcagtcatctgcataggcctcgacaaacgaggctcatcagtgatgtcgctggcagcggttgaacgccagcagcgtcgagcccttttgcgcaaggagataccctatgaagcgttccgctcttgctggcttgtttattaccgctgcgatgctcgcctcccctgctttcgctgccggtgacaaagacctgtgccagatcaacctggacaaaatcaacaacggcaaggccctgctggccaccgacaccagcggcaaaagcggcgaaatcgacaccgccgtttcccaggccaaggccgccctcgcggccggtgatgagaagaagtgcatcgaaatcacctccaaggccctgcaggacctgcaaaacagcgacaaaggcggccagtaagcgatagggccaaccttcgggttggccttcgctgaccttttggcgtacactgcacaggcttgtcactcactaagaaacaacgagttacaagcacggggccgtttaggattcgacgccggttgcgaaactttaggtgcatgccgagttggtaacagaactcgtaaatccactgttgcaacttcttatagttgccaatgacgaaaactacggccaggaactctctttcgctgcgtaagcagccttagatcctgagcttctggtaccttcgggtccagcaatcaccaggggatgtctgtaaacccaaagtgattgtcatatagaacagaatcgccgtgcagtacgttgtggacgaagcggctaaaacttacacaactcgcccaaagcaccctgcccttcgggtcgctgagggttaacttaatagaaacggctacgcatgtagtaccgacagcggagtactggcggacgggggttcaaatccccccggctccaccaatctaaacaccagagaagcccgcccagtgcgggtttttctgcatctggacgcatgacaagtggttatcgattatgcggactatcgcaagattgagccgcttttcagcaacaccctctacggcgtcctgccaaacgaaagcaatgcccactcccccagcccatcgtaagccaggcagcaaccgcagccctgaaacgaatgagcttcaaccccggctattgagcgtgacaacccatcaaaccacgggtaactatcatggacctaagccccggtaaacgaggaaacactcaatggacccttccacactgcaatcactcaagcttggcatcatctcagccaccggtctctcgagggacgccctgcatatctatgtaggtctgggtttgctgatcgctaccagctgcatcactcgaaaatccttgggctcactcagcagttggttggtggtgttggcgggggcgagcctcatcgagttgttcgatcttatggatgataaggcgagcttgggatactggcggtggggcgcgagcctccatgacattgtcaatacactgttctggccaacggtgctggtcgtggcctatcgtttcaggttgattaaattctgatcaacgctgttgttcagctatcgccataccccgccgcacccgccagctcgatcactcaagtctgcaccttcaccccttcgcgattaccttgagccatcacccttaccgcaatcgaagcacctgccagcagcccaacgatgcccagaacctcaaggccggtaggcaagcgctgctcggcgatcagcccaaaggcgactgcgaatatggtttccactgaaataagctgcccggacagggccatcggtagccgctggctggcaaagttccaggcccatgcgccgccaacggaggcaacacaggccagcgccgctgcggcagccagcaccggcagggtgttgcccaagtgcaggtccaggtgcggataggtgtacatgtccaataccagcccgaacggcacgaacacaaccacgctcagaccggcgccgaccatcatcaggccggtccataggcctgcgtgtaccctggggattttcgccagcatcttctggttgagtatgctgaacatcagccaagtcagcaccgcccccacggcgtagctgactgcggccaggtaggaggtcaggtcattgtctaaaaccccgaccaaggtgccatagttcgccgcgaccaacccgcaaaccgccagcatgatgggaacagcgaggctgctccaggtggtggtgcgctcgatcatattgcccgccaccgcgatgatgaccggtgtagcgctcaggaatgccggggcgatgatagcgccgccattgagcacgctgcccatgatgcaaccgatgtacaccgcatagccaagcacgcccagcagcccggcgctgaggattgagcgcctgcttaatacggggtcgccaggccaatagatgcgcagcattaccaggccgatgccgccggatacgatgaaccgcagagtgatgaagtcaatcggaccgagcgcgcccatcatgtagggcgacagaaaattaagcgcccagctgaaagtagcaaataccgcagctgccacccccagcacgtaggatctggacattagcgctcctcagcaggcgatttttccgagaacatcagatgacagggccgcaatatgtggaagtgcgaatttcctcgccgtcattgatgtcggtaaattgcgaaccataggcggtctgggtcggcctgccccagttgacccccatccctacgccgccaccgctttcagactcgccttcgaacatcgttttgtccaatcgtgaacgccaatcgagaaaacgcatggtcaccgccaggcgagtcgcgagcggtcctggcaagagcggttcagagcggtgccacatcgatttggtgaacagcagtacgtcgcccaatgcaaaatcgtcctgggttttatacgtttcaaacaggtcggtgagcaggctgggggtttggaacaccgctctcaaatgcgcggaaaaatcctccacggcaacgccggcatccatccttttggaaatcaggctggccatctggaaattcgcttttgcgctatagatgtcttcggctaaataagccatgcccccgcgctggcctgaattgtcgatagggtccaacgggatccacacgctgaaggcggcgtcctgagggcggatgtacctgaaactcagggaatcgtagtgccaggcaaaaccttctttatgcggggtaagctcgaaactctgggactcggtcatgatcagcggatgcccgattaacgtcaccaaggccgtcctgaaagcgattgaggagtagatgtttttcaccgcgtcggttgtccccagatcgtaggtcaaccggctgaaagaatccccataggcggactgcgactcccgagctgagatcacttttgaacgcgccgcctgcttcaaggattgaatggcgtgctcagataagaagtctttgagtttgataaacccctggcgacgaaatgcttcgatttcatcgctgctgaacgagaggttgttaacaagagacaggtccttttcttgtgattgcatcagcgtggcctcctttatgccagcgtttgaactcaagcatgcaataggtgggcgctggtgacttgaacccagacgactgttttgcgcactgaggcgacattggatgctgggttgccagtcgtcggcgatattgctagtgtcaggtcatgactacctatggcctcacctcgacaaccaccaccacgaccgccgaaagcggagcgtgcgaggtgtcgtgagccattagccaacgaacttcaaaggcccgccagcgatggacagggcctttttttatgcccttgtgtcgctggttcacacgcaaggagatgcacctatgtacgccctgttgatactcgatatccaagttggactcatccacggcccggaaaaaccctggcgctgcgacgagctcttggaaacgctcaacactttgatggacaaggcccgcagcgcaggcgcgccaatttttctcgcccgtcacatcggccccgctggctcgccaatcgaatcgggtagcccgcttacgctggttgcagaggaactgaagttgctaggtggagaagtggtgttcgaaaagcggcggcccaacgcttttgcgatgacagaccttgctgataatttgcgctccagcggcgccaccggcgtggtagtcactgggatgaaaacgcaatactgcgtcgacagcacctgccgcgccgcgcgtgatcttggcttcgatgcggtacttatcgccgacggtcatacctgttctgatacgcccttgatgaaagccgaggccatcgtggctcatcacaatgccacgctcaatgggccgttctgccagttggttcaggctgaggattggagcttttaacagaggtcttcggctggaaagaatgctggcgctggcgacctgaattccggaggacagaaagtcgccagggcagcgcttcggacttttcccgcaacatggcgcgctgttggtgaactggtcaaactcacctgtcgcggatagcctgcaactgtcgcagcaatagcaacgccacccgctcagtacggcgcgcaggcaattgttagtacctgcccagcagtcctgagctttttttgcccggagaaaaatttggaggcgatatggcggctatgcgtggggcactttagggtgcgccgggttccttgattcctggtctgctaacccgcgcacggttgccaccctttaatacgggcgagaggcctcaacgcccacctcgcccgctggcatcccctcacacttcccattaccctgacggcctttatcagacaaccggaagtcagatacccgtgttcaagcccttcgccgtcatcaccctcgccttcatcccttcattcgcaaccgctgccgagctggacggggtttggcaaggtactttgggcaagtccgctatcaccgtctgtttcaacggcgccgacggagagcatggcagttattactaccagcgtatccgtacccccatccagctgacccaggccaacgacaacgccccttgggtggaggaaggaaacaccggtttctgggccctgcaaaagccccagggtgataccctctccggtgcatggagcaaaaccgccgacggcaagccgctacccttggccttgcgccgcattggcgcggatggctgcggcagcgatgcctacaacgcgcctatggaagccgcgccgctgccgatcaagaccgagaagaagactttcaaaaaccactcctacgcgctcaagacccaaggcccccgcgtcacgctcaagctggaaggtgacagcccggcagtgcagaagatcaaccagcaactcgccgccctggccgtcaatgacgaagatctaaccgactatttttatgaacggcgtgaatacctgggtcgaaacgggtcggtctataccagtgaaatcgaggttgaacccgcctattggtcatcgcaatttctcaccgtgcggttctaccgctgggccgcaggccaaggcgccatgggcatcagttggggcctgcactcctggaacctgcaaaccggtgacagtgtggacccatggacctggctcggcggccatcagcaatggcatgacgcctattccggccatttgaagctacccgccgccttcagcacttggctggccaagcaaaccactaccgacgagggctgccccgcgatcaccgattactccaactttcacctcagcttcaacacccagggcctgcaactctcgactcctgccaatggtgacggttgcgacaacgacttgagcttcacctgggagcagttggaaccggtgctgaccgaacaaggcaaagcggcattgcccagcttgaaactaccctgaaccaggctgataaaaccctattgtcgttcaccaaaggttaagaatcgcgctcgtatactccctgactacccatgaccggtcgcccgatcggtctcatgccccggtagccagattccatgacgcgtcccgctcccctgctgctcctgcttgctggtctgctgttcttcttcgcccttggcaaccatgagctgcaaggctccaccgaggcccgggtgtccgggatcgccatggcgatgcacctggacgatgactgggtggtgccgcgcctgtttcgcgagcctttcctggaaaaaccgcccctgagcctgtggctggatgccggcgcgattcgcctatttggcgccagcaccggggccgtgcgcctggcgtcggcgtttgccggtttgttcagcgtgatgctgctgtacggcatgctgcgccgcttcgggcggccgcagacgctggcattcagtgctgcgctgatcctggcaaccatggccagttactggggcaatgtgcggggggtgggtgaggattcgttgctcagcctcggcgtgaccatggcattgctggggttttaccaggctgtgcggcccgagcgcgaaggctccagtgcgtgggcctgggcgttgtttaccgccggcatggtcatcgccaccctgagtaaaggcgtgttaggcctggcaatgccgggtatcgtgatcttcgtctacctgctcagcaccagcctgatggataaacgcctgcgcatcggcgactggctcaagccggcattgttcacactgttggccttggtgcccttgctgatctggctggggtttctgtttcaacgcggcgggatgcaggccgtgggggaagtgttatggaccaacagcgtcggacgcttcagcggctcgtttgtcgaagccgggcactacgagccgttctactattacatcgccaagctgccagaggccttcctgccttggaatatcctggtgtacctgggcctgtggcacttccgtaagagcctggtgcgcaaccgttaccgtctgtttttcagcgtgtggctgatggcgcagttcaccttgctgaccctggcttcgagcaaacgcacggtttacctgatggcactcaccccggcggctgccgtgctggccgccgaatatgcacgggtgttgttggagtgggccaaggcacacaagccggcgctgtaccgttaccaccggcgcatcatcgccggggttttcagcctggccatcgcctgttacctgagcgcggcattctggttcgcacctaaagccgacgtgcgccactcattcgtaccggtgataagtcagatccagacgctgcaggacgaagggaaagcggtggcgatgttccagcccaacgagcggatcgccggcgccagcgtgttctacctgcaagcctacctgccgatccttaagaccgaagccgagctgcgcgccttcctcactgccaagcccggcaatgttgcgctgatggatcacaccgaccggctgaacgagaaggtcacagtcatcaagcagatggcgatcaaccgccagccttactacttcgtcgagcagtaaggccggcgcggggcatcagtgcttggtgagcttgtccaggtagcccatggcaaacgccgagaccacgaaggtcatgtggatgatcacgtaccacatcaggtgttgcggatcgacgttcttggcgtccatgaagatgcgcagcaggtggatggaggaaatcgccacgatggaggccgccactttcatcttcagcgacgaagagtccatggtgcccagccaattgagtttttccttgttttcatcgatgtccagctgcgagacgaagttctcgtagccggaaatcatcaccatcaccagcaggccgcccaccagggccatgtcgatcagcgacagcagcaacaggatcacttccgcttccaacatggtgaagatgttgggaatcacgtgaatgatttcctggaagaatttcagcgccaggatcagcaagcccagggacagccccagatagatcggcgccagcagccaacgcgaggcgtacatcgtattttcgataaagcgttccattgaatctcacacagcttggctaaaaatggcgccgagtataccagccgccacccggcccctgtcaccgctagaaaactgacccaagtggcatctgtaagagagtttttctgctagtgtcgagaccattaactcggctcgatgatgtcggacaggaaaactcagatgatggatgtgcgatcccctttggccactctcggcctgtgcgcggcgttgctgatggccagcggctgctcccccaaagaagagcagaagcaagccaccctcgaagagaaaaccgcccaattcgaacagtctctggacgacatccaggatcccaagctgcgcgacgccatcgccgacctcggcggctcgctgctgttgctggagcgtgcgcgcctcaagcttgccagcaagcccatcgaagccgagtacggcgaagacagcctggccctgctcaagcattaccctaccccgcaggccctggtggacacctatatcaacggcctgttcgtgctgcgcaagacctcccattcggactacctgacggatttgcagccggtcttccctttcaacttcaacgcccccgaccagttccccttcccccatggcctggaatggcaatcggtcaccctgagcaacaataaagtcattcctttccagccggagtggtcggaaaccgaccctggcatccaactgagcccgagcagctccaacctgaccaatcccgacgacctgacggtcacgtatccgtttatcgagggcatcgagacggaaaacaaaagccaaccacagccagtcagcctcaaaggcgcagtcgaagtggtcaccccgggcaaggtgctgactttcgatctgacgaaaaaagacgtcggccataaacgcaccgagggcaatatcaccctcaacctgctggtgctggaaaagaactacgccgagatcgaactgaccaacagcgcccgcctcgccgccgaactgggcgacgagtcgccgaacccgctgctggtgcaggcacgggacagcaccgggcaatttctcacgcgctcaggctcgatcaacgagagcgccgcgcaggtggcgttctatgagaaacaattggctgaaatgcagaaacaaaagacctggtccgaggccctcgagaaacagcttaccgacgagcaaaaagccttcgaacacaagcagagtagccattacgccaaagtgtatttcaatgggctgatcgacaatctgcaggtcaatgtgctggatttttctacagctacggtcacccacaaagacctgaacctgccggtgctgcgcttcgacagaaacagcctgcagcaaaccgttcaggctctgccgatgccggtcacggtgtatgacgacagcgccgccagttggctaaaagatgcctcgatgagcgaagaccaactcaaacgcagcgtcaccatcagccaatcgaccgaagacgccagtgcggcgaaaatcgtgtttgatcacccctatacgttcaatgatgacctggtcggcgccgagcgtaacaacagcgatgcgcctatcaccttcttcaccgccgacgacaagggcgaacgcggcgagcctatcgagttgccgaccgaggcgtttgagctgaacgccgccagcggcacgctcacctacgacctcaacctgttccctgagactccggcgtttgtagtgggctccgtaccgctcttcctggcgagcattgaaaaaaccacgattgacgtggccaagctgcccaagggcctgtcgctcaaggacaacgcactgatcgtcgaccagaaggatttcccatccgatagctggcgcttctatgccaaggacgccagcggcaagtacctcaaggaggtcctcagcgtcagccaccgtgccgaggaatacggcacggcgttgtttgacgtgcattatttctacggccagccgactacgctggaaagttaccagcgcaccgacctcagcaccgtgcaatacggctttgaggtcaagctggacaagcctgagagcaaatagccggcgctacagggccagccgctcttgactgccattgaggtggcgcagatgggcttgcaggtgcagacaccagatctgcggttcgtccatctgctcatagccatgcaaggtcaggttatcgacgatggagcccagcattgtttcagccacccagggcccgttaaacgggccctcggacttgacggtggaaggctgttcgcccgacattccagcggcaaacaataacgtccacagtccgttgtccccggcgagtgggcgaatggagcattcaatacgggtgaccaggcccaggcactggcgggtaaggcaaaggttgcgcgacatggcggcgaccctcggtagatcggtgttcagccccagcgcgaggcggggctgtctctatcctgcgactcctgtggatatccctgaattgagaatagaagaaaaacgcgccaaaccaaggtcgtagggaccaacggacgtttttccgggacaactgtcaatttaatgacatacgcaggagcaaatgtgggagggggcttgctcccgattgcggcgtgccagtctaagtaattttgactgacccactgctatcgggagcaagccccctcccacattttgatctccatcgagcttgagggatcaggttggtttggcttctgccaacgcctgctgcgccagctctttctccgcctccttaagatcttcctcgctgatcatctcggcaatcgcccgcaaacgctcaaccacccgcgcattcacggtgccttccgggaattgcccctcggcatccggctcaccggcatcctcacccaccaacaggctcaaggcttcatccgcctggcgtactgcatagatatggaactgcccgttgcgcacggcctgcaacaccttctcgtcgagcatcagcgtggccacgttggcctgggggatgatcgcgccttgctcaccggtcaagccgcgtgcttcacacagacggaagaaaccttcgattttctcgttgaccccacccaccgcctgcacttcaccaaactggttgatcgagccggtgatggcgaagcactgcttgagcggcgtcttcgacaaggccgagatcaaggtgcaggcctcgcccaaggaagcactgtcgccgtccacataaccgtaggattgctccagggcgatgctagcggagatggccaacgggaattcctgagcatagcggctgcccaggtaaccggtgaggatcatcacgcccttggagtggatcggctggccgaggttaacttcgcgctcgatgtcgacaatcccgctgccgcccgggtataccgtggcggaaatccgcgccgggacaccgaatgccgagtcgccgacctccagcaccgtcagcccattgcacttgcccacggcggcgccagccgtgtcgatcaaaatgacgccggcgagcatgtcgtcaagaatccgcgccgacacgcggccggtacgcgtggccttggccttgagggcgcgctcgatatgcccggcatcggtcatctcgtcgccggccaggtgacgaatgaaatccgcctcgctgaccaactggaacaaatcgccaatccgcgccgacaaccggccctggtgttccgccaggcgggcgctgtaggtcgccaggcgcgccaccgcgtccgaggtcagtggcgccatgccttcttccgaggtgcgggttttcagcaactgggcgaactgctccaggctttcgtcgaccatcgggatgtcttcgtcgaagtccaccagtacacggaacatttcctggaagtccggatcggcgtcttgcaatgcgtagtacagctggcgcgagccgatgatgatcaccttgacctgcaacgggatcatttgcgggttgagggtcacggtagccaggcggcccagctcgcccaggggcgattccatcttcagcttgcgcgattgcagggaacgcttgagcgcatcccacacgaacggctcgctgagcattttctcggcttcaagaatcaggaagccgccattggcgcggtgcaaggcgcccgggcgcagttggcgataagtggtgtagagcgcgccctggtcggtgctgtattcgatgcggccaaacaggttgtcgtaggtagggtgcggttcaaacaccactggcgcgccaccgttgagcggatggcccaccactaggctcgggcagtactgctcttcgagcagcttgcgcgcctgggcatcggtcttggcgtcatccaccaattgctcgaccacggttttgagcaggtacacctgcatggcttgcaggtagccgcagacgccggcgttttctgcgtatttttccgacagcggcgccagcaaaggctgcagggccagtgtgatggtttcttcgttgaactggcgcagttggttgttggactcacgcttccactgcggcaggctggcgagttcttcgttgagacgttcttccaactcggagatatcggtgtggaaacgctcccgatcggcctcaggcagttgcgagaactcggcttcgtccagcgccttgccatcgagcatcggcgtgaaggcgatgttggagctgtcgcgatacagcgccacgtccttttccagggcaaggcgctcgatcacatcaagcgccttgtcgtagcgctggttgaacgcccggtcgatggcgcttttgcgctgttgataagtcgggtgttcaaacactgccgggaaggtcgcgaccaggttgtcgaccaagccgttgatatcggcgataaacgccgcagcgccgccgcccggtaattccagggcgcggggttcgcgcggctcatcgaaattattcacatagacccaatctgccggggtctgcaggcgcttgccttcggctttcaggtagcgtttgacgaacgaaaagcgaccggtgcccggctcgcccatgacaaacacgttgtaaccggggcgtggcatggccacgccgaactgcaaggcttcaaccgcacgttcctggccaagcacaccgcgaaagggctccaaatcattggtggtcgagaagctgaactgttcagcggagaaagggcgagtcagcgcttcgggcgctagacgcaagctggcagcaacaggatcaggcatcgggcttccttacatcaggcggggcagatgggcgcattctggctcccggttgagcgctctggcaaggcgcgctttcgggaaagcatagccaccgcacgcgtcctacaaaaaaatcgccagagattgaatgtttataaaaaaacacggaaccccgggaacgtgcctaaactccaaattgcgcgggttggactaataactggcccctagggcgttgcgaagcgcctgaacccttgtccattggtttgcacacaaagagaacaaagctatgaaacggatccttcttggtactctcttcaccgtcgtctccctcaatgcaatggcagaagcaccaggtggcccgaactgcggttggggcaacatgttgttcgaaggccagcgcggcactccggcccacttcctggcctccaccaccaacggcacctcgggtaacgccacattcggcatgacctcgggcaccaacggttgcagcaccaacagcgccctgacctacggcggcaagtcctggattgccatgaatggcatgatgaacgagctgtccgaagacatggccaaaggcaacggcgaagcactgaccacctacgcggtggtactgggtgttgccccggaagatcgcgatcacttcgcggccgtgacccacgagcacttccagcagatcttcagcaaggctgacgtgaccgctgacgacgtgcacaacaacaccatcgcagtactgaaaagtgatgcccgtctggcgaaatacgcaacccaggcttaagctcgacccgcccgcgtctttcgaggcgcgggttttattttttcgacctgccccccttgggtcttttattcagtccgacttaagtagcccccatgctcaaacgcctcgcttgcctggctctcttcgcctgcgccccgctgcatgcggccccgcacctcgacgatcaacgtttgcagcaactggccaatgacccgttctggctttcgcttgggcattacgaagccggcaagatcagcggctggcgcagctatgtcagcgacaagaagttcttcctcgccgccgatggcgcccaccatccggatgccgaactaaaggccaccgtcgatgcgctgtacgaaccggccagcctgggtgaaaaacacgcccaatgcgtctaccctgcacgcacccgctggctcaaggatcagttgcacctgaccgacctgcccgctctggactgcaaagaattcacccaatggttcaaggacgtcgccccccatagcgcggtgatgattttcccggcggcctatctcaacagcccgtcgtcgatgttcggccacaccctgctgcgcatcgaccaggccgatgtgcaaagcaacaacaccgcgttgctcagctatgcgatcaacttcggcgcctacatcgaaggctccgacaacagcatcctctacgcctggaagggcctgatggggggctaccctggtctgttcgccttggtgccctaccaggagaaactctccgaataccgtagcctggaaaaccgcgacctgtgggaataccgcctgaacctcaccgaagtcgagaccaagcgcatggtcgagcacgtgtgggaactcaagcagatccagttcgactatttcttcttcgatgaaaactgctcctatcgcctgctggagctgctgcaggtggcccgccccggcctgcgcctgaccgaacaattcccgctgacagcgatccctaccgacacggtcaaggccgtgaaggacgcgggcctggtggagaagatcgactatcggccctcccgtgagcgcgaactgctggaacgcgccaagccgttggatggcgatgagcaacagtgggtattgaaaatcagcgatgaccagaaacaactgcaggaaccagccttcaaggtcctgccccgtgagcgccaggccctgatcatcgacgccgcctaccgtctgggccgctatcgcgccaacggtctggagcgcgacagtgcacgctcccagcgcagcttcgagctgctgcgagcgatcaaccagaaccctgcgcccgacctcaagatcacgcccccaggcttgcccgagaacggccaccaatcacgcacctggcaagccggcatcggcacccgaggcgacaaagccttcggcgaatacggcctgcgcatggcctatcacgacctcaacgacaacgccgaaggcttccccctgggcgcccagatcgaaatcctgcaaatgaaactgcgccagtacgaaggtaaccactggcaactgcagcaactggacctggccaccatccgctccctgaccccgcgcaatgcactgctgcaaccctggtcatggcaagtcaccggcggcctggagcgcgtgccgggcaagcacgacgacgaaaccctggtcgcccatgtcaacggcggcgcgggcggcacctggcagttgagcgacgacatgctcggcttcgccctcggcaccgtgcgcgtagagcacaacaacgacttcagcgaagccatctcccccgccgccggtttcaacaccggcgtgctatggaagaacccgctgggcaacctgagcctggaagccaagggcgatttcttcaccaacggcgaagtgcggcgcagcatcagcctcaaccagcagtgggaactgtcgcgcaacctgggcctgcgcctgagtgcgcagcgcgaatacagccacttgtccacgccggtaaatgaagtgatgctcgaagtgaagtggtaccactactgactcaagcctggtgaaactcaaaatgtgggaggggcttgccctctgtaggagcgagcaagctcgctcctacaaaagtcctgcacatccctctgacaccactttcacatacagctgacaaaaccccttctagactctccttaacagccgtgaaccggccagggagtaagccatgtggcggtatgcgctaatgctgtgtgcagtggtgtggctggcgggttgccaaacaacccatcaggatttattggccaagggttatccacctgcctttgccgatggttttgacgacggttgcagcagtggtcgccaggctgctggggtgatcaccggggagtttcgcaagaacgtgccgcgttacctgaaagaaaagcactacgccgaaggctgggaggatggtttccgtcagtgcaaggctatgcgcgagagcgaagagctgcgcgactaccaggacaaccgcaacaacgaccgcgagcacgagtggcagcaagaaaaagaccgcgatgctgccaaggcctatcgctcgcaataggtcgtttgcagacatccatcgaaactaaagcacggcgaatatggcccaaacgccatagagggagaacgccatgagccgagcttttgtaaatgaagacaatgctgccgcccaggccgatcagccggtggagcgtcaggtcagcgaacagcccaaccgcctgaccgcgcaaggattggcgcagttgcaagccaaggttgcgcaattgaagcttgagtacagcgccgagtccgccaagggtgagcaggccgataagcagcgccaggcggatcttgagcgggacctgcgttatttcaaccagcgagtgcaaagcgcccaggttgtgccgcctgccacgtccaccgacaaggtgcagatcggcagctgggtcacgttcgccaacgagcaggacgagcagcagcgcatccagttggtcggtgaagaccaggccgacgccaacgccggactgatcaactggggctcgccccttggccgcgccctgctgagtgcccaggtgggtgacgaggtgctgtggaagcgccccgtcggcgatcagttgatcgaagtgttaagcatcgaacctgaggtttaaacgatgccctgagccagcatcgcgtcagccacttttacgaaacctgcaatgttggcgcccttgacgtagttgacccggccgttttcctcaccgtagtgcacgcaggcatggtggatcgattgcatgatgttgtgcagcttgctgtccacttcccctgcggtccacagcaggcgcatagcgttctgcgacatttccaggccactaacggccacgccgccggcattggatgccttgcccggcgcgaacagaatgcccgcgtcgataaagatatccacagcctcaagggtggtcggcatgttggcgccttcggccacgcaaatacagccgttgtgcagcagggtgcgggcggcgtcggcgtcgagttcgttctgggtcgcgcatggcagggcgatatcgcaggccagctcccaaggcgtcttgcctttacggaactccaggccgaagcgttcggccaactcactgatgcgcccgcgttgcacgtttttcagctccagcacggctgaccattgcgcctcggtcaaaccactctcggcgtacaaggtgccttcggagtccgacagggaaatcaccttgccgcccaggtccatcaccttgcgcgccgcgtattgcgccacgttgccggaaccggacaccgccacgcgcttgccttcaacgcgctggccttggcgcttgagcatttcctcggcgaaatagacgcagccgaaaccggtagcctccgggcggatcaggctgccgccataggtcatgcctttgccggtgagcactgaggtgaattggttgctgaggcgtttgtactggccaaacaggaagccgatttcccgtgcgcccacgccgatatcaccggccggtacgtccacgtccgcaccaatgtggcggtacaactcgctcatgaacgcctggcagaagcgcatcacttcggcgtcgctcttgcccttggggtcgaagtccgagccgcctttgccgccgcccatgggcaacgaggtcagggagttcttgaaggtctgctcgaaggcgaggaatttcagcacacccaggttcactgacgggtggaagcgcagaccgcctttgtagggcccgatggcgctgttcatctggatacgaaagccgcgattgacctggaccttgccatgatcatccacccacgacacccggaaggtaatcgcgcgttccggttcgcaaatgcgctccaggatgcccgaggtcaggtaatgggggttggcttcaagaaaaggccacaggctgcgcaggacttcttctacggcctggtggaattccggttggtccgggtcgcgtttcttgaggcgggccaggaaggattcgacggattcgatcatgaaaagtctcggcaaattgattgttgttaaacagagattgagccggactttatcaattcgtttcgcaccgtgacagggcaaaatgtcgcctttgtgaaattaaatggtgcattggatataactgtatccagttttaccgggctttatgcacttaaaagaggatttcaaatcaagggagtgcaccagcaggtaaaccgctatcggaggcaagccccctcccacattcgaccgcattaaaaacacaaaaaacggagcccgaaggctccgtattttttcaaaccaacctgaatcaggccagtttcttgtgacgcacacggtgcggctgggcagccgcttcgcccaggcgctttttacggtctgcttcgtactcggtgtagttaccttcgaagaacaccgcttgagagtcgtcttcgtacgccaggatgtgggtcgcgacgcggtcaaggaaccaccgatcgtgagagatcacaatggcggcgcccgggaagtccagcagggcttcttccagggaacgcagggtttccacgtcgaggtcgttggacggttcgtcgagcagcaacacgttgccgccctctttcagggtcagggccaggtgcaagcgaccacgctcaccaccggacaagtccttgacgaacttctgctggtcgccgcccttgaagttgaaacggccgacataggtgcgcgacgggatttcatagttgccgatacggatctggtcggaaccgtcagaaatctgctggaacaccgtcttgctgccgtcgaggtcttcgcggctctggtccacgcatgccagctgcacggtgtcgccgatctcgatgctgccggagtccggggtttccttgcccatcagcatacggaacagcgtggatttacccgcgccgttaccaccaatgacgccgacgatcgcgccttttggcatggagaacgaaaggttgtcgatcagcacgcggtcgccatagcctttgcagacgttcttgaactcgatgaccttgtcacccaggcgcgggccggccgggatgtagatttcgttggtttcgctgcgcttctggaattcctgcgactgcatttcttcaaagcgttgcaggcgtgccttggatttggactggcgtgccttggcgcctttgcgcacccactccagttcttccttcatggctttttcgtgggccgattgctgcttggattcggcagccagacggtcggacttggcttccagccaaccggagtagttgccctcgtaagggataccggcgccgcggtcgagctcgaggatccagccggcaacgttgtccaggaagtagcggtcgtgcgtgatcgcaaccacggtgcccgggaaatcgtgcaggaagtgctccagccaggcgacggaatcggcatccaggtggttggtcggttcgtcaagcagcagcatgtcgggcgccgacagcagcaggcggcacagggccacgcgacgcttctcaccaccggacaggtgctcgaccttggcgtcccacgccggcaggcgcagcgcatcggcggcgacttccagctggcgctccaggttgtgaccgtcgccggcctgcaggatcgcttcgagcttggcctgttcggcggccagcttgtcgaagtcggcatccggttcggcgtaggcggcgtagacctcgtccaggcgtgcctgggcgtccttgatcacgctgacggcctcttcgaccacttcgcgcacggtcttggtcgggtccaggatcggctcttgcggcaggtagccgatgttgaggtccggcatcggacgggcttcgccctcgaactcggtatcgacgccagccatgattttcagcagcgtggacttacccgaaccgttgaggccgagcacgccgatcttggcgccggggaagaaggacaatgaaatgtttttcaggatttcccgcttcggcggaacaacttttcccagccgatgcatggtgaagacgtattgagccatggtgaacctagcgtcagtgactgatgaattaagcgggcgaagcccgtgccaggccatgcgccgcgcgggccgttgacggtgatcaatgcctgcgtggggaagagcctgagtgtctggggctggaacgcccccgcgtaaccggcaaagctacctgaatgcgctggggcagtccagccaggcaggactggcactttgccacaactcaaggcatgctagccgccctccgggcgtccggcttatagtgcacgtcgcgcgccagtccagccaaccgcaggatcacagcttgtccaaagtcacgccgccaactcccttgcgcgccgctcatattgcgccgggagcgcccctgcacggcaccttgaagggcgcattggcgacgcttgtcctgctgctgctcgcgttattgttctggcaactgctcgaccagttgcagcaaaaccagaaaaaccagcagcaatacaccatcgactacagtgccgacctggccgagcaaatcagccagagcatggccctgagcgcgcagatcgccctgaacctgctgcccatcgtcgaaccgccgcgcaatgccgaacagcagcaggccttgatgcgcaccctgcagcgttcgttaccagaactgcgcagcttcgccctgctggcgcccagcggcgcgctgatcagcgacaccgaccacgacagccgcgacagcgcctggcttgaagagctggtcaagcgcagccactcccagtccttttacctgagcaacgacaacgacggcaccgtcatctatttgttgctgcaccagcccagcggtggctccaaggtgtactgggcattacgcctggcacccagctacctggccggcctcacacgccaggatgtccagggccagcgcccgatgtgggcgatcgagaaccgcctgaaccaccgcgtggtcagccgggacagcggcatgccggcgcagtgggccggcgccctgaccccggaggagttgaacaaaagcgtgctggtcacgcccttgagcaaaagcgactggcaactgcgcgggctgttcgaccgcagcgcagtgcttgaacaactgctgccggcgtttatcggcaaatgcctgctggggctggcgttctcgctgataccggtgatcgtgctgctgaatatgcgtcgccgccagcgccaggtgaacgagggccggcggcgctaccaggacattttcgaaggcacgggcgtggccttgtgcgtgcttgacctgtcggggctcaagacattcttcgacaaaaccaaagtgcacagccgcgagcaactgcatgcctggttgcaggccaaccccagcgaacgccagcaactgcttaaggaactgcgggtcaccgaggtcaaccaggtggcggtacgcctgttgaacgtaaactcatgtgagcaagcctgggaacgcctgatcgatgattgcccacgcaacgccaccgccatcggctacccggtgctggaagcggtactggcccagcagaaacagctggagctggaaatccagctcaacgatgtagccggcaacgagcaatacctgtggctggtgatgcgcctgccggagcaacaggacgacttcaaggcggtgatcctcagcatcagcgacatcaccagccgcaagctgatcgagctgtcactggtggaacgcgagagcttctggtcggacgtggtgcgcaccgtgcctgaccacctgtatgtgcaggacgtgatcagccagcgcatgattttcagcaaccatcacctgggccacaccctcggctacaacaaggccgaactgcagcaaatgggcgagtacttctgggaaatcctgctgcatcccgaagacgccgagcattaccacgacttgcgccaacagcagcgccgggtcggctatacaacgcaactgcactgccagctgcgttttcgccaccgcaataaccaatggcgccgcttcgatatccgcgaacaagccctggcccgggacacgtccgcggtggtcacgcggatcatcggcgtggccaaggacattaccgaccagatcgaggccagcgaatccctgcgcgacagtgaacagcgctaccgcatgctggccgaaagcatcagcgacgtaatctgctccaccgacagccaactggccctcaactacgtcagcccatcggtcaacgccgtgctcggctatgacgtggactgggtgttcaagaatggctggcagtcgatcatcgccaacccacaacagctgaccggcatctatagcctgatggaacaggtcagccgcgccctgggcaacccagaggccttgaacacgctgcgcgatgatgttcagacccagttgttcctgtttgactgcctgcgcgccgatgggcgcaaagtgccgatcgaactgcgcctggtactggtatgggatgaacacggggcgtttgaaggcatcctcggcgtgggccgcgatatcagccagcaacgccgcgccgagaaagacctgcgcatggcggccacggttttcgagcattccacctcggccattctgatcaccgatccggcgggctacattgtgcaggccaacgaggcgttcagccgggtcagcggctatgccgtaagcgatgtgctcgaccaactgccgaacatgctcacggtcgacgagcagcaggaagcccacttgcgctatgtgctcaagcaactgcaccagcacagcacctgggaaggcgaggtgtggctcaagcgccgcaatggcgagcattacccggcctgggtcggtattacagcggtgttcgacgatgaaggcgacctggccagctacgtctgcttcttcagcgacatcagcgagcgcaaggccagcgaacaacgcatccaccgcctggcctactacgacgccctgacccacctacccaaccgcacactgttccaggaccgcctgcacactgcgttgcagtcggccgagcggcagaagtcgtgggtggtactgatgttcctcgacctagaccgtttcaagccgatcaacgactccctcggccatgccgccggcgaccgcatgctcaaggaaatggccacgcgcctgctcggctgcgtggccgaggacgacaccgtggcgcgcatgggcggcgacgagttcaccttgctcctgcaaccgcgggtcagccgcgacatggcgttgaaccgcgcgattcatgtggccgagcagattctcgccagcctggtgaagccgtttgtactggaaggccgcgagttcttcgtcaccgccagtatcggcatcgccctcagcccgcaagacggcaacgagctgagccaactgatgaaaaacgccgataccgcgatgtatcacgccaaggaacgcggcaagaacaacttccagttctaccaggccgacatgaacgccagcgccctggagcgcctggagctggaaagcgacctgcgccacgccctggaccagaacgaattcgtgctctattaccagccgcagttcagcggcgacggcaaacgcctgaccggcgccgaagccctgctgcgctggcgccatccgcgtcgcggcttggtgccgccgggtgatttcattcctgtgctggaggagttgggcctggtggtggacgtgggcgactgggtgatcagcgaagcctgtcgccagctcaagacctggcaccagaacaaggtgcgggtgccgaaagtctcggtgaacatctcggcgcggcagttctccgatggccaattgggcacgcgcatcgccaccatcctcagggataccggcttgccgccggcgtgcctggagctggaactgaccgaaagcatcctgatgcgcgaagtcaacgaagccatgcagatcctcgccagcctgaagaacctgggcctgagcatcgcggtggatgacttcggcaccggctactcatcactcaactacctcaagcagtttcccatcgacgtgctgaagatcgaccgtacattcgtcgatggcctgccctcgggtgagcaggacgcgcagattgcccgggcgatcattgccatggcccacagcctgaacctggcggtgattgccgaaggcgtggaaacccatgagcagctggatttcctgcgcgagcatggctgtgatgaggtacagggttacctgttcgggcgaccgatgccggcgaatcggttcgaggcgcagttcagcaatgatgcgctgttcatgttcgactgagctgctgttgtgaggctaatggccccatcgggagcaagccccctcccacattttgaactgtgaataccttcaaatgtgggaaggggcttgctcccgatgaggccagcacagtcaccactcatctccagatgagccccacttgtccgcgacatgatgtcctttcatatgccatccaaaacccattgggttagaatgccctccttttctgcccccgatccttgaggaccgccatgttcagccgtgatttgactattgccaagtacgacgccgatctcttcgccgccatggagcaagaagccgtgcgccaggaagagcacattgagctgatcgcttcggaaaactacaccagccctgcggtgatggaggctcaaggttcggttctgaccaacaagtacgccgaaggctacccaggcaagcgctactacggtggttgcgagtacgtcgacgtggttgagcagctggctatcgaccgtgccaagcaactgttcggcgccgattacgccaacgtccagccgcatgccggctcccaagccaacagcgcggtgtacctggccctgctgcaaggcggcgacaccatcctgggcatgagcctggcccacggcggccacctgacccacggtgccagcgtctcgtcctccggcaagctgtacaacgccgtccagtacgggatcaatgccgacggcctgatcgactacgacgaagtcgagcgcctggcggtcgagcacaagccgaaaatgatcgtggccggtttctctgcctactcgcaggtcctggatttcccacgtttccgcgccatcgccgacaaagtcggcgcctacctgttcgtcgacatggctcacgtagccggtctggtcgccgctggcgtctacccgaacccggtgccttacgctgacgtggtgaccaccaccacccacaagaccctgcgcggcccacgtggcggcctgatcctggcgcgcgccaacgccgagatcgagaagaagctcaactccgcagtgttcccgggcgcccagggtggcccactggagcacgtgatcgccgccaaggccatctgcttcaaggaagccctgcagcctgaattcaagacctatcaggaacaggtagtaaagaacgcccaagccatggccaaggtctttatcgagcgcggttttgacgtggtgtccggcggtactgaaaaccacctgttcctgctgtcactgatcaagcaggacatttccggtaaagatgctgacgctgccttgggcaaagccttcatcaccgtaaacaagaactccgtaccgaacgacccacgctcgccgttcgtcacctccggcctgcgcttcggcaccccggcagtgaccactcgcggtttcaaggaagccgagtgcaaggaactggccggctggatctgcgacatcctggcagacctgaacaacgaagccgtgatcgacgcggtacgtgagaaggtcaaggccatctgcaagaagctgccggtatacggcgcgtaatacaaagaagcccactgtaggagcgagcttgctcgcgaaaaacgtcaacgataacgcgtgcatcttgggtgcacgcgttgcctgtgagttcttcgcgagcaagctcgctcctacaggtgggcttttttatgcctgatagacccgctcaaaaccctcgcggattttgtcttcgggtaattcatcggcaataaacacaatcacactctcccgcgtctcaccctcggcccattcggtgtcccaatcgaacccgtagagtttcagcacgccctggaacaccatgcgccgatcttccccggcaatattcagcacgcccttgtagcgcagcagttgcttgccgtggtcttccagcaactcgttcatgaactcgctgagacggtcgatatccagcggctgctcggtgcgcagcaccaggctggaaatacggtcgaccgacggcgcagcgctgactgggcgcagactcatgccggcattgaggttgaagccgcgcacatccagcaactcggccaagtcaatctggccgtgatcgaccacacgaattggcgcacggcgattgatacgggtcaggcgctggctcagggcgtcgaatgtggcgtcgtccaccaggtcgcgcttgctcaccagcaggcggtcggcaaagccgatctgggcctgggcgatggtctgggtcaggtgatgctcggcgtgggccgcgtccaccagggtgatgatgccgtcgaggatgtagcgctcacgcagttcttcgtcgatgaaaaacgtctgggcgacaggggctggatccgccaggcccgtacactcgatcaccaaccggtcgaaagcgatttcgccactgtccaggcgctcgagcagcaggtacagggccttggtcaggtcggtgtggatggtgcagcacacgcagccgttggacagggtcatgacttgtaccggctctgcgcccaagagctgggtgtcgatgccggcgtcgctgaattcgttttcgatcacggcgattttcaagccgtgctcggccttgagcagatggcgcagcaaggtggtcttgccggcaccgaggaagccgctgaggatggtgacagggatgggagaggacaaaaaaatctccttataactgaaggaacacaaaacaaatgtgggagggggcttgcccccgatatcggtgtgtcaggcacttataggtcactgacacaaagctatcgggagcaagccccctcccacagtagatccactgccagcccgaattaacgggtcagcagcacttgggcccacccttgccgccgtaacgggcctcctggcgttcccggaagaacgccttgtagtccatcaccggcttgtccgggtgcttgttttgcatatgctcgacgtaggtgtcgtagtcgggcatgccgaccatcaggcgtgcggcctgaccgaggtatttaccgaggcgactgatgtcattgaacatgtttgcaatcctcgtttacgcgtccggtacagcctggaacggggcttctttatccgtacgctctttgttgccccaggcggcgacgccaaccttgagcgcatagaacaggatgctgaacaccacgaacaggaacagcgccgtcagcgttgcgttggtataggcgttccagatcacgtgctgcatctggtcgatgttcttggccggggccaggatctggccattagccaaggcatcgctgtatttcttggcaagcgacaggaagccaatggccgggttggcgtcgaacagcttgatgaagcctgcggtggtggtgcagatcagcagccagaccgccggcagcatggttacccagatgtagcgctggcgcttcatcttgatcagcacaacggtggccagcatcagcgcgatacccgccagcatctggttggagataccgaacagcggccacaaggtgttgatgccacccagcgggtcgatcacgccttggtacagcaggtatccccacatcgccacgcagcctgcggtagcaatcaggttggcagtccacgactcggtgcgtttcagcgccggcacgaaggagcccagcaggtcctgcagcatgaagcgaccggcacgggtaccggcatcgacggccgtgaggatgaagagcgcttcgaacaggatcgcaaagtggtaccagaacgccatggtgttttcacccggcagtacactgtgcaggatctgcgcgatccccaccgccaatgtcggcgcaccaccggcacgggccaggatggtggtttcaccgatatcgtgggcgacggctgacagcgcctcaggggtaattgcaaagccccagctgctgacggtttgcgccacggtgaccacgtcggtgccgacgattgcagccgggctgttcatggcgaagtacacgcctggctcaatcaccgaagcggcaaccatcgccatgatggctacgaacgattccatcagcatgccgccgtagccgatgtaacgggcgtggctttcactggccagcaacttgggcgttgtacccgaggagatcagcgcatggaaacccgagaccgcgccacaggcaatggtgatgaacaggaacgggaacaggccgcccttccacaccggaccggtgccgtcgatgaactgggtcagtgccggcattttcaggtcaggcatggtgaccaggatgccaatcgccagggcgatgatggtgccgattttcaggaaggtcgacaggtagtcacggggcgccaggatcagccagaccggtagcacggcagccacgaagccgtagccaatcagcatccaggtgatctggatcccggtgaaggtaaaggccttggcccagtacgggtcggcggcaatctgcccgcccagccagatcgaaccgagcagcaacagcacgccgatgatcgaaatttcaccgatgcggcccgggcggatgtagcgcatgtagatgcccatgaacatcgcaatcgggatggtcgccatcaccgtgaagatgccccacgggctctcggccagggccttgaccacgatcagcgccagcaccgcgaggatgatgatcatgatcaggaagcagccgaacagcgcgatagtcccgggaatgcggcccatctcttcgcggaccatgtcgcccagggagcgaccgttgcggcgggtggacaggaacaggatcatgaagtcctgcaccgcaccggccagtaccaccccggcaatcagccacagggtgccgggcaggtagcccatttgcgccgccagtaccgggcctaccaagggccccgcgccggcaatcgccgcaaagtggtgaccgaacaggatatgtttgttggtcggcacatagtccagaccatcgttattgaccactgcgggggtggcccgccgcggatcgagttgcatcacgttattggcgatgaacagactgtagtaacggtacgcaaccagatagatggccacggcagcgaccacgatccacaaggcgttgatcgcctcgccgcggcgcaaggccactacgcccagggcgcacgctcctacgattgccagcaccagccagggtaagtggcgtagcaggctattattatttttcatttttatattccagccagggtggacagaaaggacagccatccggagtttagcgctactggcatcaaagaccagccccctacgttggtctagagccttgccatggccaaaaaaagtggaaataaacgctggagggtggcgcagggctacactgctcctatccaaagagggcctcaccatgatcgagcaagcgcctgaccgccgcaattttcgccggatagcttttgacgccaagaccgaacttcggcaaaacggatgggaattgccggttaagttggtagatctctcgttaaagggcctgctgatagagcgccccgagggttggaagggaaataaagcgctgccgttcgacgtcgacatacgtctggatccgaaggcacatatcaagatgcaggtacggttgacccatgaagatcccgggcaactgggcttcgtgtgccaatacatcgatctggattcgatcagccatttacggcggctggttgagttgaatctgggggatgaggatgagctacacagagagctggcggcattgctggaaatctagaagccaacagagctctgaatgtgggagggggcaagccccctcccacattggttttgcggtgtcgctggctactcgaacagtgcatccaacgcctgctccaggcgtgtcaccccaatcacctgcaacccctggggcatttccttcggcgcattacccttgggcacgatcgcacgcttgaagccatgcttggctgcctccttcaatcgctcctgcccgctgggcaccgggcgcacttcacccgacaagcccacttcaccgaacaccagcaggtcatgaggcaacggccgattgcgcaggctggacatcaccgccgccatcagcgccaggtcggaggcggtctccaacaccttgaccccgccgaccacgttgaggaacacatcctggtcgtgggtcgggataccgccgtggcggtgcaataccgccagcaacatcgccaggcggttctggtccaggccgagcgtgacccttcgcgggttggccagatggctgtcatccaccagcgcctggacttccaccagcattggccgggtgccctcccacgtggccatcaccacactgcccgggacttcttcttgggcgcgggtcagaaaaatcgccgatggattggagacttctttcagtcctcggtcggtcatggcgaacacacccagctcgttcaccgcgccaaaacggttcttcaccgcccgcagcaagcgcaggcgaccgtcggattcaccttcgaaatacagcacggtgtcgaccatgtgctccaacacccgtggcccggccagcgcgccttccttggtcacgtggccgaccaggaagatcgccgtgccactctgcttggcataacgcaccaacagcgccgcactttcccgtacctgggacacgccacccggtgccgattgtaattgctcggtaaaaatcgtctggatcgagtcgatcaccatgaccttgggcttttcgatccgcgccgtggcaatgatgctttcgatgcaggtttcggtcatgacccgcagctggtcctggggcaagcccaggcgccgggcgcgcatggccacttgttgctgggactcttcgcccgtgacatacagcgccggcatgcggctggcgatgctgcacagggtctgcaagaggatggtcgacttgccgatgcccgggtcaccgccgatcagcaccaccgaaccgtccaccaggccaccgccgagtacgcgatccagctcaccggaggcggtggagaaacgcgggatctcttcgacactgacctcggccagggtcttgatctgggcctgttgcccggtccagccagcgcggccagtaggcgctgccgccccgccgctctcgatcatggtttcagtcagggtgttccacgcaccacactcggagcactggcctgcccatttgggaaaggtcgcgccgcactctgtgcagccgtacatgcgcttggcctttgccatatgagaacctccaaccgaaaaaccgcgatgatagctcagcgcgacgccggggtccggatttcaccgttagccaaacgtgaagcgctgttgccgatggggtcttcggcgttcaagtcggcgcctttggcttgcagttcgctcagcagctcgacacgcttgaagagcccggcgtacatagcggcagtctgccccgcgccgttgcgttgatcggggttgcagtcggctgccagcagacgctgggcaattttcagctcgcctttgaagatggcgcccatcaacgccgtgttgccgcgcttgtcttgcacacaggcgtcggcacccgcgccgagcaaacgctctacatacgggccttggccgtgataagcggcgagggtcagcgcggtgtagcctttatcgtcctgggtgttgaggccgtagccagactcgatgaaggtgttgagcatgtcgaggtcaccacggcgggcagcatcgaaatagtaatcctgtaactgcgccttgagcgccatcgggtcgggggattcggcatgggcgacgaaggccagcatggccatcagcaaaccgatagaaatacgcataggggtttctcctgcaaaaggtcagcgcccccatcagggcgccgaccacaaccaacggatcagtcggtcagtttttcagccagcgccttcacgcgagccaggtcacccttggcgaccttggtcacgccggtgccgtattccggatcagccttgtagagaaacgacaggatgatgtgcttgctctcgtcatcggtggtggccaacgagccgccgaagttatcgatcaagtcctgacgctctttcttggagtaggagcggtacaggtcaccggcctgcttgaagttttgctcacgctggatcttcgcctgctgggtgttgcccgacagcgccgactggctgtagcgcgcggtctgcggctcttcccgtggcaataggcggcttggctggtagttcacgccggtggtggtcttgccgaagttcatcgcgccgtcctggttgccgttgttgacggtcactcgtggggcgttgatcggcaattgcagggcattggcgcccaggcggtacatctgcgtatcggcgtaggaaaatacccggccttgcagcaggcgatcttccgacggttcgatgcccggtaccaggttggccggggccatggcgacttgctcggtttcctggaagacgttggccgggttgcggttcagcaccatttgcccgactttacgctgcggcacatccggccagatcttggtagcgtccagtgggtcgaaatcgaacttggccaagtcttcgggcttaagcacttgcacatacaagtcccacttagggaagtcgcctttgttaatgtgcgttaccaagtcattggtcatatggctgtagtcacgaccctgaacctcggtgacttgcttgggatcaaggttcttgatgccttgcaggctcttccagtggaacttgacgtagtgcacttcgcctttggcgttaatcaacttgtaggcatgcacgccattgccgtccatttcgcggtagctggctggcgtgccggagtccgaatacaactcggtcagtgtacgagtggactctggaacatgggagaagaagtcgaaacggcgtgaatcatcatccaggttagtgcgggggtccggcttgaaagcgtgaaccatgtccggaaacttaatggcgtcacggataaagaaagtcgggaagttattgccgaccaagtcccagttaccttcggcggtatagaacttggtggcgaagccccgtgggtcgcgtagggtttccggggaatggttaccgtggaccaccgccgaaaaacgcacgaacacgggggtggtttcaccagcagcgaacaccttggccttggtcaagtcactgaggttgtcggtaacggtaaacgagccatgggcgccagtgccgcgggcgtgtactacgcgctctgggatgcgttcgcggtcgaagcgttgcagcttctggatcagttgcacgtcctgcagcaacaccgggccgttggcaccggcggtttgcgagttctggttatcacccacggcggcgccgttatcgcgggtcaggttggcggcttgcaccgagagggaaagcaggctggcggttaccagtgccagcgcatggcgcgctgacaccggcctgcggctgagtgaagtgttcattgaggtttcctctggttttttagtgcacattcgattgtgcttgtcagaggctagtgacctgggagtcagaagataaatagaaaaacaccacaggcccgattaagaaaataatctggtaactcgctgaaatgacgggtaattcgcgcgcgactggtggcactttgcaaactatttgcgatttaatgtgtcgattaaaatcgacagtgttaacagttgtgtcgagcaagccttgaccgactgaattacactgacctccacccttttcaactgtaacaaggaataacctatgggcgtgatcagtgaattcaaggccttcgcggtcaaaggtaatgtggtcgacatggccgtcggtatcatcatcggcgccgctttcggcaaaattgtttcctcgtttgtaggcgacgtgatcatgccgcctatcggccttctgatcgggggagtggactttggcgacctggcagtaacgctcaaggccgctcaaggcgatgtacccgcagtggtcctggcctatggcaagttcatccagagcatcatcgactttgtgatcgtcgcgtttgcgatcttcatgggtgtaaaggccatcaaccgcctgaagcgagaagaggccgtggctccgagcttgccgccgacgccgagcaaggaagaagtgctgttgggtgagatccgcgatctgctcaaggcacagaatgacaagccgctgtaaccagcggctgcagaaagaaggcgcctcttagggcgccttttttctaccagtagttttctactgcaacctggcccggacgtcgactcaggctcaattgcatgtcccgttgcttgagcaactgacgggtgtcatcgaccatctgcgggttgccgcaaatcaatacgcgcgagtgctccgccgtcagctcgacgccggctgtacgctccaactcaccgttctctatcaaggccgtaatgcgcccgttcaacgcacccggatgctgctcacgggtaacgatggggatataggtgagcttgtgggcgtactccgtaagatactcacgtgtccccagctccttaatcagcgattggtaggccagctccttggcctcccgtgcgctgtatacgaggatgatgcgctcgaatttctcccaggcctcgaagtcctgcaggatcgacaggaacggtgccacgccagtaccggtacccagcagccacagatcacgcccatccacgaagcggctcagggtcaggaaacccgtggcttggcgttccaccagcaaggtatcgcccacctgcaggcggctcagttcactggtgaactcgccgcctgggacgacaatggaaaagaaatcgaggtaatcgtcgaacggcgacgacaccacggaataggcgcgccataccgtgctgccgtctgccttggttacgcccaggcgcacgaactggcccgcggtaaaacgaaaaccggggtcgcgagtggtgcgcagggtgaagaggctgggtgtcagcgattgcacgtcgagcaaggtctggcgggtaaatttctcagcactggccgtcatggggggctccgttttgcacaggcgcctagtgtccctcaaagcaggccgcgcaaacaccgttgatttgtactggcattgccaagggcgccaacccctggatcacctgccgaacaaaaggacctgttggcggcacaagctcggggccactgaacgcaaactaaatatttcgctatcaatcgaatgccaagctactaccgccgagcacatcgcattaaaggtgccatcactctggcagcacttataaccccttaaatcaaataaaaaaacctgtctgcgccagggtttttatacaaaataaccccccctgtacaaaatcaaacaaccgttagatccaactggatatagcatcttttcacgcgcatccgtaggcagtgtcctacactcatttccgtcaagcaccgggatcaggacgtactcaggtaaaactgcaaaccatggagattcactgatggaaaactggcgcactactcgcctccccaaactggaaggggaaaacgagatcactagtgtctttgagatggtgctcaaccatacctatgaactaggcttccagtactgttcattcacgatgggctgtcaatcgcatagccctcatgcaaaacccgttcagatgaataactacccaaatgaatggagcaagctttatcaacgagcgcactacttcgacgtagacccgattgtggcccactgcaagcgctgcgtactgcctatcgtctgggaggaaaaagcgtttgaaaccgcacccgagttgtgggcgatggcccaatcctacggcgtgcatctggcttggacacaaccggtgcatgacttccagggcgtctatagcatgctgaccttgggccgcagtactggcgaaatcaccccgcaggaattatatgaaaaggcagggcaggccttgtggctatgtcatgcgctacacgcggtggtagcgcaaaaatatgccgataactccgacgtgcattctccgagcaaactgactccacgggaaacggaaatcctcaaatggtcagccatgggcaagactgcctcggatatcgccaccatcctctgcctgtcggagcgcacggtaggttttcatatcagcagtacgttcaagaaactgggggtcaacaataagattgcggccgtactcagtgcctccaaagcggggctgttttaaccggcgcaagaaacactgcatgtcatcgggttcaaaaaaaagtaacatttgtggtcaattctgagtgttgacgcagcccttgcaggtattgcttcgcggttcactcagacggcccgccgattacccagagcctcccctgccatgcccctgctcgacagccccttcgcccagctcgatctgattcgccagccagagcagcataatgatccgctgcaagccttcgatgccgccgacgagtacctgctgagctaccttgccgaacaacagccccctgctgccacccgcgtgttgatcctcaatgacagcttcggcgccctggcagccagccttgagggccaggtgcaggtgacctccagcggtgactcattcctcgccgcacaggggctggagaaaaacctcgtgcgcaacggcaaggcctttgatgcagtgaggtatatgccggccagccaggtcgcgaccgggccgtttgatcgcgtcttgctgcgtgtcccgaaaaccctggcgctgctggaggaacaacttatccgcctgcaggggcaactggcgcctggcgccgaagtgatcgccgctgcgatggtcaagcatctgccacgggcggcaggcgagttgctggagcgttacatcgggccgatgcacgcctcattggcggtaaaaaaggcacggttactgatcgccactgctgccgaacgccccgtggcggtctctccctacccgacccgctacaccctggaagcaccggccattgagttgctcaaccacgccaacgtgttctgccgcgaaggcctggacatcggcactcgcgccttcctgccacacctgcccaaagacctcggcagtgcccgcgtggcggacctgggctgcggcaatggcgtgctggcgattgccagcgccctgcaaaaccccgacgctcactacaccctggtagatgagtcctacatggccgtgcagtccgccgctgaaaactggcaagccgccctaggcgcgcgtgacgtgcaggtgcgcgccgacgatggactggccggccaggagccacaatcgctggacgtggtgctgtgcaacccaccgttccaccagcaacaggttgtcggtgacttcctcgcctggcgcatgttccagcaggcacgagaagccctggtcgtcggcggcgccttgtatatcgtcggtaaccgtcacctgggctaccacagcaagctggcgcgtttgttccgcggtgtcgagcaagtggcggccacgccgaagttcgtgattctcaaggcacgcaaataaaaaagccctgcccttccaaaaagaaaagcagggcttgcccctcaagtcagcaggcagcgggctgcaaagcccggatggggatgtcagtgggtggtcaggccggcggcattcatgaacatgcgcatcaggctggccacaatgaacagggccaccacgctggcggtccagatcatcgccagccaacccaggcgccgccacaacggctgcttctcggcctgttcaatctcgtgcaacgtaggtttgccggacatgtttcgaccctcctagtgatagccgtcttcgtgggtgaccttgccacggaacacgtagtagctccagaaggtgtagcccaggatgaacgggatgatgaataacgttcccaccagcatgaagccctggctttgcggcggcgcggcggcatcccagatcgacacggacggcgggatgatattcggccacaggctgatacccaggccgctgtagccgaggaaaatcaacaccagcgtcagcaggaacggcgtgtagtgcgcatggcgggccacggcgcgaaacaacccgtacatggtcaccagcaccaggatcggcactggcaggaaccagaacaggttcggcagggtaaaccagcgcgaggcgatttccgggtgggtcaacggcgtccagaggctgacgataccgatcaccgccaacaccacgaaagccaacggccgcgccaggttatgcatctgcccctgcaacttgccttcggtcttcatgatcagccaggtgcagccgagcaaggcataggccacgatcaacgccacaccgcagaacatcgtgaagggtgtgagccagtccagtgagccaccggcaaactgacggttgaccaccggaatgccgtcgatgaaggcgcccagcgccacgccctgaaagaaggtcgccgccagcgagccgccgataaacgccttatcccacagatggcgcttgtggtccttggccttgaagcggaactcgaaggccacgccacggaagatcaacccgatcagcatcaggatcaacggcaggtacaacgccgacaacaccaccgaatacgccagcgggaacgcgccaaacaacgccgcgccgccgagtaccaaccatgtttcgttaccgtcccaaactggggcaacggtgttcatcatgacgtcgcgatcgaccttgcccgggataaacgggaaaaggatgccgatacccaggtcgaagccgtccatgaccacgtacatcatgatgccgaagatgatgatcacggcccagatcagcggaagatcaatacccatctcaattccccttgtgctggatgtggtcgtggtcgttatcgctgccatcgtcggcggcagacaacggccgcgccggggtgcgtttctgcccaggtccaccgtgggtaggctcggaaccttcgtgagtctgaggccctttgcgcaccaggcgcatcatgtagcccaaaccggccccgaacaacgcgaagtacaccaccacgaacaacaccagggtaatggtcatttgcgccaggctatgcccggacgaagcatctgccgtacgcatcagcccgtagaccacccaaggctggcgaccgatttcggtggtgaaccagccggcgagaatcgcaatcaggccggatgggcccatccacaacgccaggtacaggaacggcctggacgtgtacatcttgtcgccacggcgcagccacaggctgaacagaccggtgaagatcatcaggaagcccaggccgaccatgacccggaacgaccagaacacaatggtcgagttggggcggtcctcaggcgggaactccttgagggccggcacctgcttgtccagggaatgagtcaggatcaagctgcccaggtacgggatctcgacagcgtatttggttttctcggccttcatgtccggccagccgaacaggatcagtggcgtcggctcgttgccgatgttttcccagtggccttcaatcgcggcgatttttgccggttgatgcttgagagtattgaggccatggaagtcaccgatcaccgcctggatgggcgcgacgatcagggccatccacatcgccatcgacagcatttttcgaatagctgggttgtctttgccacgcagcaaatgccaggccgccgaggagccgacaaagaatgcggtcgccacgaaggccgccgtggccatgtgcgccaggcgataggggaacgaagggttgaagacgaccgcgaaccaatcggtaggaatcacgcgaccgtcaatgatttcaaagccctggggcgtctgcatccagctgttggacgagagaatccagaaggtggaaatcaatgtaccgacggccaccattaccgtggagaaaaagtgcagcttgcgccccaccttgttccagccgaacagcatcacgccgaggaagccggcctcgaggaagaaggccgtgagcacttcatacgtcagtaacggcccggtgacggcgccggcgaagtcggagaagcgactccagttggtgccgaactgataagccatgaccaggcccgagaccacacccatgccgaagttgaccgcaaagatcttcgaccagaaatggtagagatcacggtaggtgtcgttgtgggtcttgagccacaagccttccagcaccgcaaggtaactggccaggccgatggtgatcgccgggaacaggatgtgaaacgagatggtgaacgcgaattgaattcgggcgagatctagcgcctccaaaccgaacataagtcttcctctgtcaggtaataccggccgctggctgggagcctgcaaccactgcccccacggatatggagtgtggcgaatttcaattcgtttctttttttacccatctcgcggggaatctggtcttgcgaccgccagaacaatcccggggcaggttttgatctggatcaagcattgctcaaaagagtagtctcattttcgcgttaggactgtgtggtcttttgccgcgtgacagcttgcctcagtcctgttctcgcaactatttgttacagcttggtgctaatctcgccattcccacaacctgacctgagttcccgatgcccagtgaacccgcgttattgttacgtcaccaccgccctttcatcgcgttctggctggcgcgcatctttactgccagcggcttccagatgctcaccgtggctatcggctggaacctctaccaactgaccggcaatgtgctggacctgggcttggtgggtctggtggagttcgtaccgcgtgtgctgttcatgctgcacaccgggcatgtggctgatcgctatgagcgacgcaaagtcgccgccatctgccagaccctgcaggcgctgattgccttgtccctggccatcggcggcctgaccggcaacgtgacccgcgagatgatctttattctcgcgttcctgctgggcgcggcgcgttcatttgaaatgcctactacccaggcgctgttgccgagcatcgtacccagcgccctgttcccgcgggccgtggcctcctcgcaatcggcgcagcaattggcgaccatcgtcgcccctgcccttggcggtttgctctatgcgtttggcagtgtgtgggtgtacggcccgaccgtggcgctgtacctgatcgcttgtgtgctgaccctgaacctgcccgcccgccagaccccgctgaacaaaggcaaggccaccctggattcgttgctggccggcattcgttttatccgcagccgtccggacatcctcggcgccatttccctggatttgttcgccgtactgctgggcggcgccaccgcgctgttgccggtgttcgccaaggacatcctgttgaccggcgcctggggcctgggcctgctgcgttcggcaccggcggtgggggcgttgttgatgtcattgtggttggcgcggttctcggtcgaccgccaggtcggccgcgtgatgtttaccgccgtcggcgtatttggcgtggcaaccatcgccttcggtctgtcgacctcgttctggttctccctggcagtgttggtggtactcggcgcggcggacatgatcagcatggtgatccgcgcgtcgttcgtgcagctggaaacgccggatgaaatgcgcgggcgggtcagtgcggtcaatggcctgtttatcggcgcatcgaaccagttgggcgagttcgaatccgggattactgctcattggttcggcactgtgccggcggtggtcatgggtggtatcggcacgctggtggtgactggagtgtggatcaagctgttcccgaccctggctaatcgcgaccgtatgcatgtgccggtggaagagcccattcaaaaaactaccgcatagctaatgtgggagggggcttgcccccgatagcggagtgtcaggcgacgatgccgtgactgacctgacgccatcgggggcaagccccctcctacatgggtgatgaggtgtttttttaaagcaccttgtccagggtgatcggaaactcccgcacccgcttgccggtggcgtggtaaatcgcattcgctaccgccgccgccaccccgacgatcccgatctctcccacccccttggaccccagggcattgacgatctcgtcgtgctcttcgacaaacaccacgtcaatctcgccgatatcggcattcaccgggatgtggtactcggccaggctgtggttcatgtagcgccccagttggtgatcgacctgggtctcttcatgcagggccatgccgatgccccataccacgccgccgagtatctggctgcgggccatcttcgggttgaccacgcgcccggcggcaatcgcgctgacgacacggctgaccttgatagtgcccaggtcctcatccacctgcacctcgacaaataccgcagagtgggtggcggtggcataaccctcgcgcttcttgtcgggctcactgtcgacctgcacctccaggacgtcctcaccactgtccttgacgagctgggccaacgccacactcacgtcaccggcatgcagcttgccgtcctcgaaccttacggattcgacatccttgaacaccggataagtctgccgggcgattttcagcaatttggcgttcagcgcttcgcacgcttgctgcacggcggtgccgacggaggacacggtaaacgaaccaccctgcagcggcgccgtgggtagggaggaatcacccaacaggaaattgatatcggccagcgccacgccactggcctgtgccgcgatctgggtcatcaccgtgtaggtgccggtgccgatatccgtggtagcgctgctgaccgtgagcttgccatcggcgtcgatgcgcgccttggcgctggccttcatctgcatggcttcccacacgccgccggccatgccccagccgatcaactggcggccgtcgcgcatgctacgcggttccgggttgcgctggctccatccgaagcgttcggcgccctcgctgtaacactcacgcagagccttgctcgaccagggcttgtcttcgttctggttgcgctcggcgtagttgatcaggcgcagttgcaccggatcgatagccagggcgcaggccagttcatccatggcgcattccaggccgatcacgcctaacgcggcgccgggggcacgcatatccaaaggcgtgaacacatccagcggcgccaacttgtaggtcagttgcacgttgtcgcagtggtagagcatgccgctccattccaccacgtgctcgctgaaatcctcgaagcgcgaagtctggccaatcgcggtatgccccagggccagcaagcgcccgttggcggcggcgcccatctgcaaacgctgcaaagtgcgcgggcgatagccgaaggtgaacatctgctggcgagtcagggtgacgcgcactgaacgcttgagtgccagggatgccatgacggccagtggcaattgatactgcgggcgcaggcccgaaccaaaggcgccacctacgaacgcagcgaaaatgcgcacctgggttttatccaggccgaagactttttgcacataggcctggcagttctgcgggccctgggtcttgtcgtggatatgcaaagtgccgtccggctgatacagcacggtgctggcatggggttccatcgggttgtggtgctcgatgggggtgctgtagtgcaagtcgaggctgaccgcggcgcccgcccattcggcctggaagttgccgcgtggcttgggcggcgtctgtggcgaggggtgggcctgctcctgttgggtgagcaaatccgtctcgaagctttcgcgttcgtattcgatctgcaccagtgagccggcatgccgcgccagttccaggttatcggcgatcaccagggccaggggctggccgctgtagagcacacgatcgttgtagagcgggcgaaacggcgagccatcggcggcatcgtcatcggcaaaggcatcgtcgtaactggcgatcttcggtcgattgaggtgatggatcaccgccaccacgcccggcaacgccagggccttggcagtatcaatgctgacgacccggcccttggcgatcgtgctggagaccacgctgccatgcagcaggccatgttcgggaaactcaccggcataacgcgcttgtccagtgactttaagcaggccgtcgacacggtccacgggtttaccgatggcactcatggctgttctcctgcgaccgctgcatcgctcagggcacgaatgattgcgcgacgcgccaacttgaccttgaagccgttgtgttcaagcggctcggcatcttgcagcagggcgtcggcggcgttgctgaaggtttcgcggctgacggcctggccgatcaatgaagtttctaccgcacggtcacgccagggtttgtgcgccacaccacccagggccaggcgcgcatcgatgatggtctcgccatcaagctcaagggctgcggcgaccgacaccaaggcaaaggcgtaggacgcccggtcgcggattttcaggtaatggctgtgccgggccagatggtcggcgggcaactcgatggcggtgatcaactcgtcgtcggccaactggttatcgcgctgcggcgcatcaccgggcaggcggtggaagtcggcaaactcgatgactcgcgcaccgccgcgcccctcgacatgtacccgcgcctccagcgccgccagggccacgcacatgtccgaaggatgggtggccacgcagtgctcgctggcgcccaggatcgcatggatgcgattcaaaccgctgcgcgccgggcaaccgctgccgggctcgcgcttgttgcacggcaccgtcgcgtcatagaaatagtagcaacgggtgcgctgcaacaggttgccgccggtactggccatgttgcgcagttgcggcgaagccccggccaggatcgcctgggacagcaacgggtagcgctgttcaatcagcgggtgccaggccaggtcggcattgctcaccagcgcgccgatacgcacaccgccctcggcagtttcttcaatcccatgcagtggcaggccagtgatatcgatcaggtgctcggggcggctgatgttttctttcatcaaatccaacaggttggtgccgccagcaatgaagcgcgataccgcactgctcgactgcaccgcttcgtgcacatcggcaggtttgctgtactggaaagggttcattgctcacctcccgtggtgcggcacgctggcagcgcctcttcgatggcatcacggatattggtgtaggcgccgcaacggcagaggttgccgctcatcaattcctggatctgggcactgtcatgggcgcggccttcattggccaggcccacggcggaacagatctgcccgggggtgcagtagccgcactggaatgcatcgtgtttgataaaggcttgctgcatggggtgcagttggtcgccttcggccaagccttcgatggtggtcagctcggcgccatcgcacatcacggcgagggtcaggcaggcattcacgcgcttgccatcgcgtaataccgtgcaggcgccacattggccgtggtcgcagccttttttgctgccaaccaggtccagttgttcgcgcaacaggtccagcaaggtggtccagggcagcacgtccaattggcgatcctggccattgagggtcaatcgaatcgagtgggcgacgaacggttgggccgccgcgccattaggggtcgcgctcataaaacacctcacgggttggtgtacatccgcggcgttcaggaaaatcgccgtctcaggggtacgacttcccggggttttgagcgttcaagatgattgatcagcggatattgagctgggctttcaaggtgttttgcggcgggttgatcgaggtgttggtgaattcgaaccagccctgggcctgcacattcaggtcgaacacatagatgtagcccatcaatgtgcccacgccgttgcaggcctcactgatgttgccgacctggcacaccgccgtgcgttgcccgttcaactctgcgccgttgaagcgacccatcgggctgttgcccaggccgacttccatgaccgaaaccttggtgggcccgcggtgctcgcacatctgggtggtgtcgacccgttccgggatcgcttcgctgcacttggccgattccaccttgaacacccgcacctcgctcaaggccggtgcagccgcgccccacgccggtgctgcacccagccacaggctgatactggcgatcagagctagactccacgcgttggcttttttcatgctggcaatgacccggtattgaacgtcggcgcagtatgcctcaaggccatgcgccacacagcctcggctgctggtatgatgcgccgctttttccgatcctctctgaaaccacaggcgcttggcgcagtttgtgctttgacttagaggtcaacaaataacgacgcaagatagcgtcacagggagccggcatgctggaaaagctgtttcaactcaaagcacacaacaccaatgtgcgcaccgagattctcgcgggtatcactaccttcctggccatggcctacatcctgttcgtgaacccgagcatcctcggcgagaccggcatggacaagggcgcggtgtttgtcgccacctgcctggccgccgccatcggctctaccgtgatgggcctgatcgctaactacccgattgcgctggcaccgggcatgggcctcaacgccttctttacctacaccgtggttctgcacatgggccatacctggcaggtggcgttgggtgcggtgttcatttcggcggtgctgttcttcctgctgtcgatcttccgtatccgcgagtggatcatcaacagcatccccctgcccctacgttcggcaattgccgccggtatcggcctgttcctggcgctgatcgccctgcacaacgccggtatcgtagtcgccaacccggcgaccctggtgggcctgggcgacctgaagcaacccgcgccgatcctcgccaccctcggtttcgtgctgatcgtcgcgctggaagcccttgcggtacgtggcgccgtgttgatcggcatcctggcggtgacgattgtctcgatcctgttgggcgtcactccgttcggcggcgtgacttcgatgccaccgtccctcgccccgaccttcctgcagctggatatcaaaggcgccctggatatcggcctggtcagcgtgatcttcgccttcctgttcgtcgacctgttcgataactccggcaccctgatcggcgtcgccaagcgggccggcctgatgggcaaggacggccatatgccgaaaatgggccgtgcgctgatcgccgacagcaccgccgccatggccggctccttgctgggcacctcgaccaccaccagctacatcgaatccgctgcgggcgtgagtgctggtggtcgcaccggcttgaccgccatcgtggttgcgatcctgttcctgctggcgctgttcttctcacctctggcggccagtgtgccggccttcgccaccgcgccagcgctgctgttcgttgcggtgttgatgacttctggcctggccgaaatcgactgggatgacattactgttgcagcgccggtggtgatcaccgccctggcgatgcccttcacttactccatcgccaacggcatcgccttcggtttcatcgcctggaccgccatcaagctgctttcgggccgctaccgtgagctgaacccggcactggtgatcctgtcgattctgtttgtgatcaagctgggctggttcaacgcatgatttttgacgccgcaacctacaccgttcaactgcaagacaaggtcacgcgcctgcgtgacctgctggcccccttcgacgcgcccgagccgcaggtcttcgactcgcccttgcagaacttccgcctgcgcgcggagttccgcctgtggcgggagggtggcgagcgccactacgcgatgttttcccaggacgacaagcgcacgccgatcctgatcgaagcattccctatcgccagccagcgtatcaaccaactgatgccgcaactcaaggccgcctggcaagccagcgccgccctgagccacaagctgttccaggtggagttcctcaccaccctggccggcgacgcgatgatcaccctgtgttaccaccgccccctggacgaacattggcacaccgccgcaaacaagctggcggcggagttgaacgtgagcatcatcggccgctccaagggcaagcgcgatgtgatcggccaggactacgtggtggagaaacttgacgttggtggccgcaccttcagctaccgccaacccgaaggtgccttcacccagcccaacggcacggtgaaccagaagatgctcaactgggcctatgaagccctgggcgatcgcccggacgatctgctggagctgtattgcggcaacggcaacttcaccctgccactggccacgcgcgtgcgtaacgtgctggctaccgagatcagcaagacctcggtgaacgcggccttgagcaacctcgatgaaaacaaggtggataacgtcaccctggtgcgcctctccgccgaagagttgaccgaagccctgaatgaagtacgtccgttccgccgcctgcacggcatcgacctgaaaagctacgagtttggcagcgtgttcgtcgacccgccccgcgccggcatggacccggacacctgcgaactgacccggcgtttcgacaatatcctgtacatctcctgcaacccggagacgttggccgccaacatcgcgcaactgcatgacacgcaccggattacccaatgtgcgatgttcgaccagttcccgtggacgcaccatatggaatcgggtgtgttgctgacccgccgataaatccgcggggcatcgacccaataatgtgagagagggcttgctgtggcgagccccctcccacactggctcttcatgtgtctggtgtttctggtacgtccttgcgtggccgcccgccctttttgccattagcgcgggcggcggcagttttggccgcgctgcttttgcgaccattgcgcgatgccaccaggctggttgccagttccatcagcggttggcttgtggcgatcaggccggtgatcgaaacatccaggccctgagcctcacagctaatcgctttgccaccgaaagtcacctccaactgctggaaatctttctctgaaaagccttcgaactccggcaggccagccaccggcaacatgatgcggctgccgtcgctgaagccaatggagagacagtcgttttcataacgtacgttgctggcgttggcgtacaggcgtttcaacctgcgccctcggacgattgccttgtcaacgtcagcttcagtgagaggtacataaggtttgaccttagcttttacgatcttcataaattaatccccacacaatctggcgctcttatcagattcaaaatagtccgttgctcgacaacgtcgtgccgtgcgcttgcaatgacgtagacacccggtcgaatgaccaaccttggaaccaattcacctgcgtcccaattccaggaatgattctccaggcaaaccgtctgcagtttttcccaccaaatcctgcgtgcccgcgccaggtagtgccgctgcatgatcgccccgcgtatctcattcaaaaccgccatgggtggccgcctccgttcaggctccacgtcccacaactcgacatccccatccaaaaaactgaaacgaaaacgtacatcccatcccttgcccctgacatgcacatggggcgggcaatgctcatccctgacaaacaccgaaatcacgtagcctttgtaagcacctactctcatcgtaacccatccgttaggttattttccgccaagtaacaatttccctctgtcacccgacaaccggctccttattcccgaagctgtttcacagattagtaaccacaaaaaacccggcgaacgccgggttgtaaccactcatgccgacggctggaaatacccggccagtgcccgcaagtcctgctcgctcagcaaccccgcgtaatacttcagttgaatgcgcgccagcaggtaggcatgccgcgcattcgccaggtcgcggcgggcggtgaagagttgctgctcggcgtcgagcacgtcgaggttgacccgttcgccgccactgacgcttttcttcgtggcggtcaccagcgctgttgcagaactcaccgccatttcataggcgcgcaccttcgccgcgccgctggtgttgaggttgaattgcttgcgcaactccaccagcgtggcggcggtttgcgcgtccaactcgtattgggcctgggacagttggttggccgcctggcgcgtggaggccgacaccgagccaccggcaaacagcggtaggctgacttggatgccgacgctgttggtgtcgtacttctggttgtagctgctttctgagtcggagctggtctggcggctgctggcgtacaggctgaccttaggcaagtgcccggcgcgcttgcgttccacttcataagaggccacatccagtgcgtggtgctgggacttgagttcagggttgttggccatggccagttcacgccaggtttcgaagcgattcggttccagcggtgcaatatcgaattggcgggccaggggcgccagcgcttcgatctgcagcggctggccgacaatggcctccagctcgcgcaaagcgctgtcctgggcatccagggactcgatttcctcggcctgggccaggctcaggcgcgcctgggtttcgagcacatcggtgcgcgtgccttcaccgcctttgagcaggcgatcattgagttgcagacgttcggcataggcacgcttctgcgcacggctcaattcgatgcgctcctgggccagcaacgcctggctgtaggcgcccagcacccgcaccgccagttcctggctcttgccgcgaaagcgctcatcagccatcagcgcctgggccgtgccttggcgaaagcgcgcataggcttcgtaatccaacagtggttgttgcaaggtcagggtcgaggcgtagctgcgatagttacggtcgctggtgacattgccgagcgcggtgctctgggtcacttccgattcattgcgcgaattgttgtaactccaagacaggttcggcagcagggccgcccgcccgatcacgcggttttcttcaccggcttcacgctcctggatcgcggcctgaaaagttggatcattgcgcagggccaagtcataaacgtccaacaaacccaaggcctgcgcggccgatgtacagctgaaacagagggtgaacagcaacgccttcattcttccaccagggccatatgggtgcggtccagcaagggcttgaacagatagttgagcatcgagcgctcgcccgtcttgacgaaggcttccaccggcatgcccggacggatctgcacgccgtccagttgctgcatgcctgccgcactgacttgggcacgcaacgtgtagtatggctcgtcggtgcgctcatcgacctgacggtcggcggacaccagcgtgacttcacccgtcacccgtggcgtggtggactggttgaacgccgaaaacatcaattccaccggcaaccctgggtgcaccttgtcgatcatctgcaccggcacccgtgcttccaccagcagcggctcgccctggggcacgatgtccatcagggcctggccgggcttgatcacgccgccctcggtgtacacctccagccccaccaccacgccggatgccggtgcgcgtaccaggctgttggccagttcaaactcagccgaggccaggcgattgcgcaggtcgtcgctgcgagtgcgggtctcggccaactggccgcgcaagtctttctggaagtcttcaccgagctggcggatgcgcaaacgcaattccagcacctggcgctgcaactggccgatgcgtccagcatcctcggcgatggcaccatcgatttgcgcgtacagccgctcgctgtcaagcaggcgattgcgtgggatgtagccgtcgcgcgccaactcacgcaggccctgcagttgttcattcaacgccgcccgctgttgcactttgcttgcctgggaatcccgcgtaccgcgcatttgcgcctcaaagccggcgatggtttcgcgcaggcccgcctgttcggtggccagagcctgggcacggctttcgaacagccggcgttgcagactaagggtggaggctgcttcaggatcggccagcagctcaggagcaaactcgatggccggcaaaccttcgctttctgcactcaagcgcgcttcgctggccagggacgcgaggtattggctgcgcagcgactgcatctgcccgcgcaacggagtttccttcaagcgcaacaacacctggccggcactgacccggtcaccgtcacgcacctcgatacgctcgacgatcccgcccgccgggtgctgcaccgtcttgcgatggcccgagaccatgaccttgcccggcacggccacgcccttgtccaacggtgccagcgccgcccagccaagaaagccggcaaagcctccaagcaccagccaccaacccaggcgcgaatattttttgtcatccagcgccagcacgttgtgcggcggctcactgacccatgcagctttgctctggctcatgcgggttttccttcaccgaagcggtagctcatgctcatgctcgacaccggcttgctgaccacaggtttttgccgcgcctccaacacccgcgccgtcgggccgaacgcctgcatctggccgtccttgaggatcagcaactggtcggtcaggctcagcacattgggtttgtgggtgatcagaatcagggtgcggcgctgttgcttgagctgggcgatggcttgcagcagcgcctgctcgcccacttcgtcgaggttggcattgggctcatccagcacaatcagcgccggcaggccgtacagcgcacgcgccagggccacccgttgtttttgcccgccggacaagcctgcgccgccctcgcccagttgcgtgtcgtagccttgcggcagttgcagtatcagctcgtgcacgccggccatttgcgccgcagcgaggactttgtcggcctccaccgtttcaaaacgcgcgatgttttgcgcaatgctgcccgcgaacagctggatgtcctggggcaagtaaccgatatgcggacccaattgctgcttgtcccacagagccaggtcggcgccatcaaggcgcaccttgccggccagcggtgcccaggcgcccaccagcacccgggccagggtcgacttgccgcagcccgacggtccgataacaccgagtacgtcgcccgcaggcaggctgaaacccaggttggccagcgccggccggcgactgccaggggcgcaggcgctgatctgctccaggctcacctggcccttgggcacgggcagggccatgcgtaccgggcgcgccgggttatcctggagcatcagtgacaagcgctcataggccagacgcgccgaactccactgcttccacacgccgatcaactggtcgatggggctgagcacccggcccatcaggatcgacccggcaatcatcatccccggggtgatgtcgccgttgaccgccaaccaggcgcccaaacccagtaccagggattgcagggccaggcgtacgcccttggaccaggcggtaaccacggcagtcttttcactggccaggttctgctgtaccagaaatgcctggtgttggctgaaccagcgcccgcgcagtgtggcgagcatacccatggcctcgatggtgtcggcattgcgcaggttggccgtggcctgctgactggcactgatcgacaattggctggccagggccatcggcgcctggctgacatggtggttggcccacgccagcgcgatcagcagcagcgcaccacccagcgccagcaggcccagccaggggtggaacagaaagatcaccaacaggtacaccggaaaccatggcgcatcgaaaaaagcgaacaacgcctggccggtggcgaactggcgcaaggtggtcaggtcgtgcagggcctggcccgcggcctgggtgccgcccttgagctgcgcttcataggcggcgtcgaatacacgctggttcaagcgcatgtccatctgcgtgccgaggcgaatcaccacctggctgcgcacccactccagcgcccccatcaagccgaacaggccgaggatcatcagcgtcagcatcaacagcgtcatctggttgcccgaggccagtaccctgtcatacacctgcaacatatacagcgccggggcgagcatcagcaggttgatcaccgccgagaacaggccgatgttgaagaaggcacttttataggccgtcagtgcagccagcatctcattcgtgcgcttggcaccgggccgagtcatggtggttgttccattgaagagtcgagcaagggcccgcccggtgcgttgacggcacctgcggcgtgcccacaggattcgcaaggccgatgaaggcgtgaccctccatcggctcttttgcatcaggcggccatggcgaagtcttgaggcgcgtcctgaatgccgaccaggcccacatcggctgcgccgagcgcagccgagtcctgatgcgccacaccggccgcggccagttgatcgaaggtggaattgaccgacaggcttgggtcgatgcccttgagcaaggtatcgatggccgaggccaatgccgaactgtcaccgctcatcaggccgtacacgattttgtgcacctggccgtcacggccttcggactgcaggctcgacaggcccaggttggtgaagctgacttcctggttggcgatgctgtagccaccactgcttgcgccaccggccagggtgtcgcccagggtcagagcgtcgagcgaaccccacagcgtgtgagtcggcggattgaacagggtgtaatgcaggctgccttcggcgaccacggcggcatcactgacactgctcgaaacgccgtattgagtgccgtcgaacggcccaggattgaaaccaccggtgttcacaccctctttgaccgaaccttcacggtggttgagatcaccgaagtaggccgaccaatcgctcaggtactgggcgacggtgttagcggcgtaggtcgtgctgtatgaaatagaaatgctcatgcaaaactccaagtcatggggtggtcactccgcagcaagccaatgcctgctgtggttttgcccgtcactgggcaaaagcggtcagaactgatattcaacggtgccctgcaaggtgcgcccacgccccagggtgaaggccagcacatcacccagcggcaccaggtaggcgcggtcggtgacgttttccatggccaggcgcagggtcaactgatcggtggcgcgatagctgccgtacaggtcgtagacggtgtacggcttccagtcggcggggtagacgccggtttgcgaagtggtcaccccggcgccgcctttgacgtaataaccggcgctgtagcgggcgcgcacgcccacatccagcttgcgttcgaagaaccgtgcgcccagggtcgcggtgccgcgatccatgggcatgtgttcggaggagcccaggatcgcgctgcagcccacgccggcattggccgcgtcgtccggcaccatcgcgtccaccggtgcacggttgcccgggcgtttctgggtcttggtcacgccgccgagccaggcggtcttgctgcagaatttgttgctgccgagcatgcgcgtgtagttgaactggccgtaggcaaacccggcgtcgtaatcgagctggtattcgagaccccgaaaacgtgtggtctccaggttgttcacatacgctgcactgccgatattgacgttgccataaccgggcggttgtacgcccagggccatataggagaaatcatcgacccgggtgttgaagtaggacaccttcatgcccacgcgatcctcggcgaacagcaggtcttccttgagcacattgaagccgacctcccacgcggtggatcgctccggcttgaggtaggggttgggcagaatcgactccgaaccaccgccatggggccggccgctgaccatggtttcggtcaccgccggcgggcgccagcccttgccgtaggtggcgaacagttgcagccaatcgacacctggcttgatcgacaggccgaaggtcggcgagaagcgaccttcctcgcgatccacgtcgtagttcaccggcacgccgatctggcgggtggtgccgatgatgaacgtgcgggtgttcaagccggtttcgccgcgcagccgatagcggtcataacgcaagccggcgttgaggttcagccaaccgtcgtagtcgaaatccaggcgcccgaacacgctgcccatcgcacgatcacctttgggcgtgatgctttcggctgccgaggccttcaccgcagaaccagcttccacggcctgattggaatccggccgtaccttgtcgtagaaaaactccagcccatagttggccttgagtgcggccagttccgtcagggcaaaggtcgaaatgttctgcgcctgcaggccgtaggtattggtttgataggtgacgtcgtaagccttgttgataccccgggccagggtggattgctcattacgggtgtctacgtagtagagcttggccttgaagtcgatcagcgggttgtccggcgcatagctgtaatccagcgcaacgttctgtgctctgacgtcgctgctaccgagcttttcccataactgcgccttttcggcggtcatcatgttgacgtcgtcgtagtcgacgtcggtaaccaggtaactcagttgcaaacgctggtcagccggcaggttcagccccagcttgagcaggcgcgaacgcatcaccgaacccgaataggccacggtcgtgttcttgatgcgctcttcactggccggcatgaacgccgcgccggtacgcaactcgccaatgctgcccttggtgccagggttgtaatcacccaggtgccgttcactggcagccaccaacatatcccacacatcggtgcccacggcaaacgccgagctgccgatgaaatgggtaccgttgctgcgcccacccaaccctgaggtgaggcgaatgcgcccgccgatttccttgccgcccttgagcaggtcagcggcctccaccgtacgaaagttggccaccccgccaatcacgcccgcaccgccctgggtggaggtcgcgcccttttcgatcacgacttcggacaacaactcagggtccacatacaacgtgccgttgcgttgctggtgaccgctctgctggtaattctggcgcatgccatcgacagacatattgacccggccatagtcctggataccgcggatattcacggacagccctgggtcttgctggctgacggcggagtagaccccaggcgcctcctcaagcatctcggcggcatgccggggcgggttgcggtccagctgttcgcgcccgaccacgctgaccgagcgcggggttgaatacacccagtcctgcttatgcaggccggtgactgtagtggtcgccaaagccagggcaccggcctgttgctcaacccggttcaaggtgacctggcgctccccggtaaagcggtattcaaccggcgcggcacccagcaggcggccaagcccttcctgcacgccaaagctacccttgagcgcggtgctgctcaggccttgcaggcgttgactgtcgaacagcacttgcagcccggcctggtcggcgaaagccaacaccgcactgccgagcgattgcgcagggatatcgaaccgcagcaccgcggattgggcggtaccggccgcaggttccacggcatggaccggcgcggcgacggccaacacccccaggtgaatggccagggccaaccgactgccggtgatacgccccttggtgagtgctgacatgtgtgtgatccctgcgctgagcgttttttgtttatgcgaatgcttctcacctagcaagacgtgcgaggcgcgggaagtcagtaatatttttttgcagaagcgagcttgctcgcgaagaacggcaacgaaaacgcggtgccctcggctttttcgcgagcaagctcgctcctacaagggcagcaggtttctaacgggagagggtcaatagatcaggctgaggccggccagatccaggcgttgcacttggagctcccgggtcaaggtgccaagggcggtgtcgagcatgtcgaggcggaataccccgctgacttcacgctcgcccagcgccgggttggtcaataccacacgcccggggcggtaacggttgagttgctcgataaccttggccaacggctgccgatcgaagatcaacataccgcgccgccaactggtggcgcgatcaacatcaagctgatcaaggctgagcacaccatccttggggctgtaacgcgcagcctggccttgctcgaggatacgcttggccgtgccattttctggcgaagcctgcacagacacctcgacgctgtgctgcaacacgccgacccaggcttggctgtcgccctcgcgctcgaccacaaaccgcgtgcccaatgcccgggtctggcccgcggcgctgtgcaccacgaagggccgggtctcttcgcccgccattggcgccacgtcaaataccgctgagccctggagcaggctgatgccccgctgtaccccatcgaaatccaggcgaatagcactggcggaatccagctccaccgtactgccgtcagccaggtgcaccgtgcgcacttcacctttgcccgtgacatagtcagcctgcatgcgcagcaacacatccggcccgcgcacccacccgacacccactaccactgcgaccagcgccgcggcggccacacgctgccacggccttcggcgcgtggagcggcgtaccggtgaaaccgctgtcggcggccgctgacggtatacagattcgtccttgtgcacctcgcccagcgccgcccaagtctgctcggcaaagcgcaaggccgcttcgtgacgactgtcgcgggcgatccattggcgcaactgggcctgttcctgttcgctcaaggcaccggcgtgcaggcgcaccgcccactcggccgcctcctcggtaatgctgtgctgttgcggaccttggctattcacgtgtgaatctcgaattttcgttatatagacgctgtgacgcctggcctggcatttttcggtaattcattcgtcggatggcttcacctcgccttcctgcaggcgctgcatcacatacgccagggccttggccaggtgcttttgcacggaactgtcgctgatgtccaggtgctgggcgacctgggcgtgggtcatgccttcgatacggttcaagcggaaaatttgctgggtgcgctccggcaactccgccagtgcctgcttcaatgcctgtcgctgttgctgcgccattgcctgagcctccaacccggccacgtcatcttcaatctcggccagcgcctcgtggggcacggtgtcagtcttgcgccgtgcttcctggcgaatatggtcgatcagcagattgctcgccgttcgatagagatagccttgggagttgtcgatgcgctcgctggcaggcttttgcgccaggcgcaggaagctctcctgcaccaggtcagcggctaattgcgggtcccgtaccttgcgggccagatacccgcgcagcgtatcggcatgcttgagaaacaagcccttgagatccacgtccgacaaaccgactccctggaatgttaaggaaacaggcgggcatcttaagcgttgtcgagaatgattttcaattgatatctaatctgattgccatgtgccgtagcattgattaacggttcgataatcgaacggaaccgctgccgacaattgaccaaattaaccatccagtacattttgtctccacaaccaataagaaactgtggagaaccctctatgccgcccatcgtgctggtgctcaacggccccaacctcaatctgcttggcacccgcgagcccgctacttatggccacgaaaccctggccgacatcgccgccctgtgtggtcgcagcgcggacaagctcgggctgaaaatcgagtttcgccagaccaaccatgagggcgaactgctcgactggatccacggcgcccgcgcccgctgcgctggtatcgtgatcaacccggcagcctggacccacacctcggtcgcgatccgcgatgcactggtggccagtgaagtaccagtgatcgaagtgcatttatccaacgtgcatgcccgcgaggcttttcgtcatcactcgtttgtatcccctatcgcccaggcggtgctggccgggtttggcagccacggctaccacctggccctggagcatttcagccatacgctgaagggacgcgcttgatgaaaacacgcattctcgccggcctgatcggtgccggtatccaggcctcccgcaccccggccttgcatgaagaggaaggcgacgcccagggcttgcgctacctgtatcgactgatcgaccttgagccgctgcgactggacctcaatgccctgcccgacctgctgcgggccgccgaattgatgcacttcaacgggctgaacattacctacccgtgcaagcaggcaatcctaccgttgctcgatgacttatccgacgaagccagaggcattggagcagtcaacacggtggtgttcaaggacggtaaacggatcggccacaataccgactgcctggggttcgctgaagggtttcgccgcaacttgcatgacgtcgcccgtcggcacgtggtgcagatgggtgccggtggcgcaggggcagcggtgagccatgcgctgctggcagaaggcgttgagcacctgagcattttcgacgtggacgtctcccgcgcccgcgaccttgtggataaccttacgcagcgtttcggccccggtcgcgcccaggtcggcactcatctggaaaatgcgatggccgaggctgatgggttagtgaataccacgccgatgggcatgaccaagctgcccgggacaccggtgtcagctgcgttgttgcgtacagaactgtgggtcgcggaaatcgtatatttcccactggaaaccgagttgctacgcgatgcccgcgccttgggttgccgtaccctggatggcggcaatatggcggtgtttcaggcggtgaaggcgtttgagttgttctgtggtcaagtgccagacgccgatcgaatgctggcgcacttccagagcatgaatggctgactgccgaaacagagttcaaatgtgggagggggcttgctcccgattgcggtgtatcagtcagcacatgcttggctgacagaccgctatcgggagcaagccccctcccacattggtcctgcgctgaactcaggcctgcaggtagcgcaacaccgactcgcaaatcatctcccgatgccgctgcttgatcgcctcgtccgaaagttcgatctggaagatctcactgaaggtatgccggttggatacccggtaaaagctgaacgagttgatcagcaggtgcacgtccaacggctcgagcccttcacgaaacaaccccaattgggcgccacggcgcaaggtctcacccagcccctcaaggatcttgctgttcatcgccttgatggtgttggtgcgtttgacgtactcggcgttgtggatattttcgatgctgacgatgcgcacgaaatctacgttctggtcgtggtgatcgaaggtgaattccaccagccggcgaatcgcctcacgcggttccaaggcggtgaggttcatgcgggtctcggtgttgcggatatcgccgtagagcttctccagcacctcgacgtacaactgctccttgctgccgaagtagtaatagatcatacgcttggaggtatggatacgctcggcgatggcgtccacccgggcgccggccagaccctgctgaacaaactcgacaatggcttcctggagaatattctcgcgggtcttttccgggttgttcttacgactcttacgcggtgcgtctgacaccgcgggaagatcgggactcgaggtcatggggcgctcacagccattgttgtgcaggcgctgattatgggccgcggcgctcgccgaaggaagcactcggccggcagttataaacgcgcctgacgcaccgcaccgctgcgtgacttggccatcgcggccaaacgcactgccacgttggctgcgccatagccggcatagccgttcttgcgctggatgatctcgaagaaaaaccgcccttcgaacggttcggtgtacacgtgaaacaactcaccgccctgtgcgtcacggtcgtacagcacgttgtagtacgccaactcgctaagaaactcatcgtcaaaatcgaagcgtgctgccaagtcgtcataatagttgagcggaatgtccagcaacggcaccccggcctccttcgcccgacgcacctcggcgaaaatatccgcgcaatcgaaggcgatgtgatgcacccccgaaccacgatagctggagagtgcgtgggaaatcgcggtgttgcggttttcggaaatattcaacggcaggcggattgagctgcaacggctgcgcaacgcacggcttttcaccaggccgtacgggtcgggcaacaccacttcgtcatcggcttcgaaatccagcaggctcttgtagaacagcacccaactgtcgaggctgtcggccggcaaggccatggccatatggtcgatgcgcagcaagccgccgctggcgacagaggccggttgcaggttgaaatcagtgtcgtacagcccgccttcactggggtcgaccaggtaaatcaggctgccatccggcgcacgtaccgccgccagctcgagctcattgggcccgaccaggccgcgatacggctggcccttgtaggccaccgcccgctccagggccttggcgctgtccttgacccgaatcgcggtggcgcacagcgatgggccatgggcctcgaaaaagttgtgggcgaaagaatagggttcgcagttgaggatcaggttgatgtcaccctggcgcaacaggctcacgttcttcgagcgatgctgaccggccttggcgaaacccaggcgctccagccagtgagtcagtttggcgccgaggctttcatccacggcaaattcaagaaactcgataccgtcgtattcgctggccgccggggtttcaaacaggatgtccacgggcgcagcggggccttgttcagccaggcgttggcgggttttttcttccaggtataacagtgaacgcaagccatccgccgcattcgcccgggtcggcgcggcgcggaagccatcgttgaaaatctccagggacaatggcccggtgtagccgctctggataatcggtgccagaaaaccggccaggtcaaattcgccctggcccgggaagcaacggaagtgccggctccactccagcacatccatggccaggatcggcgcgtcagccatttgcacaaaaaagatcttgtcgcccgggatctgggcgatgccgctcgggtcacccttgagcgacagggtgtgaaaactatcgagcaacacaccaaggcttgggtggtcgacctggcgcaccaggttccatacctgctgccaggtgttcacatgcctgccccaggccaacgcttcatagccgatgcgcaggccacgcttgccggcgtgttcggccagcaggcccaggtcatcgagcaaaatattttcgtcgcccacgcaatcggccgaagcattactgcacaccagcaccaggtcggtgcccagttcctgcatcaggtcaaacttgcgctcggcgcgctccaggttgcgcgccaggcggtcgcggcggcagccttcaaaatcgcggaacggctggaacagggtgatggcgatgccgaggtctgcacacatctgcctaacttcgcgggggctgccgtcgtaatacaacaaatcgttctcaaagatttccaccccatcaaacccggcggcggcaatggcttcgagcttttccggcaaggtgccgctcaaggaaacagtggcgatggaacgttgcatggatgactcccggcagttgttatttgtggcaaattattcgcccccagcctacacccagcaattaaaatgtacgaaccggttagtttttggtgcgattatcgaacactatgcccctttggcgaattgacgactttttaaccactgcgcaccatcgaccgggcaactcgttcaagtaacaagacccagaacacaccataaaaatttcaaaaaacgggtacgacctcatgcctctgcaaaacccaaccctggccgcacgcccgggtaacccgcacgccggcatcggcgacaagatccgcggcgccctggccgtaggtaaaacgcgctggggcatgttggccctggtgttcttcgccactactctgaactacatcgaccgcgccgccctcggcgtcatgcagccgatcctcgccaaggaaatgagctggacggcgatggactacgccaacatcaacttctggttccaggtcggctacgccatcggctttgtgctgcaaggccgcttgatcgaccgggtcggcgtcaagcgcgtgttcttctgcgccgtgctgttgtggagcctggccacgggcgcccacggcctggccacctcggcggtgggctttatggtctgccgctttatcctcgggctgaccgaagccgccaactatccggcctgcgtcaagaccacccgcctgtggttccccgctggcgagcgtgcggttgccaccggtatcttcaacgctggcaccaatgtcggcgcaatgatgacgccaatgctgctgccgctgatcctgcacgtgtggggctggcaggcggcgttcttgtgcatggcggcgctcggaggcatctggctgttgttctggggtttgaaatactacaacccggaagaccaccccaccgtaaaacaatccgaattggactacgtgcaacaggaagtcgagccagaacagccgcgcgtgccgttcagccgcatcctgcgcatgcgtggtacctgggccttcgctcttgcctactcgctgaccgcaccagtgttctggttctacctgtactggctgccgccgttcttgaaccagcaatacaacctgggcatcaacgtgacgcagatgggcatacccctgatcatcatctatctgactgccgacttcggtagcgtggggggtgggatcctatcgtcattcctgatcggccgaggaatgaactcgatcaaggcccgcctgctgtcgatgctgctgtttgcctgctgcattgtcggcgtggtcatggcggccggttccagccagctgtgggtcgcggtgttcgccatctccctggccatcggcgcgcaccaggcctggaccgccaacatctggagcctggtgatggactacacgcccaagcacatgatgagcacggtgttcggtttcggtgggatgtgcgcggccattggcggcatgttcatgacccagatcgtcggtcacatcctcacggtgaccaataacaactacaccgtgctgttcaccctgatcccggcgatgtacttcatcgcgctggtgtggatgtacttcatggcgccgcgcaagattccgacggtagacgtctgatcaacgccgccgctgctgccaggcagcggccaacccgctcatgcagatcaccccgatgccgaccaccgtggtcgtatcgggggtatgactgaacaccagccagcccaacaaccccgcgaacacgatctggcaatagccgaacggcgccagcaaggccggtgccgcgaagcggaaggcctgggtcagcatcaggtgcgccgtcatcccgcaggtccccagcgccagcatcaatacagcatgccacaggctcggcacctgccagaagaacggcaccatggcactcatcaccaaggtgttgcacagcccggcgaagaagttgctggtggtgggcgtgtcgaacttactgaggatgcgcgtaagcagttggtagaagcagaagaacatcgccgaacacaagggcaacagcaccgctggtgtgaacagttcgccgcccgggtggatgatcaccagcaccccgacgaacccgcagatcactgccagccattggccgcgcgtcacgtgctcgccgagcagcggcaccgacagcgccgtcaccaggatcggcgcgagaaagttgaccgccgtggcttccgccaacgggatgtagtgcagcgccgcggtgaaaaacaagctggtgcccaacaggcacaaggcacgcaccacctgcatgcccggccgcttgctgcgcagtacgcgcaagcccgactgcggcaggaagatcccggccatcagcaaggtgtgcaccaggtagcgcgcccacaccaccatcacgatggggtagaacccggccaggtatttggacaaggcgtcatggctggagaacagaaacgtcgccagcacaatcagcagaatgcctttgaagggatggttgacgccggaaagcggggtactgacagtcatggaattctcttgcgtggcgagttcaacgcggtagcactcaaccgagtaatctagcagccgggcatgggtctgccccaagagcataaccaaacagtgggcgaacagcgcactaaatcaccgcaatcgagtccaaccctgcacgcgcgccccggcgttgcacactttttaatcaaggccttgccgctatgaaaaaaatcttctttgttctgtctgctgtcgccctgcttaccgcctgcgataaagccaaggaagcgcccaaacctgcgccaccctctgtacaggcgaccctgttgccggaaacgcccccgaccgatcaatgggtcggcaagtggatcggcgtcgaaggcttgaacctgaccattgccaaggacgacagcgttggccgcggtcactacctgctcaccatgcaatacggcctcgatgccgatgcctccggcaccttcaaaggtgaagccgccgaagacggtatcgccttcacccgccccgacggcccacacctgttgcgcgctggcgacggtgctgccaccggcctgaaatggctggcggataaaaaagactgcctgatcgtcgccaccggtgaaggctattgccgttaataccgaccataatcactcacggttagcacacagaggattgctcccatgctatggaaaaaaggccgacgcagcgacaacgtggtggatgcccgcgatgacagtggtggtggcggtggcggcatgcgctttggcggcggcaagggcctgagcctgacggccatcgtgctgatcgtaggcattggctggttgaccggccaggacccgatgcagatcctcggccagttgagcggccagatggaacaggcgccgtcggtcagcacccagccgcgccaggcgccgcctgccaatgaccagcaggccgatttcgtgcgggccgtgctgggcgacaccgaagacacctggggccaggtgttccaggaaaacggcctggcctacaagaacccgaagctgatcctgttccgtggccgggtgaactccgcttgcggtggcgccacctccgccagcggcccgttctattgcccggctgaccaacaggtgtacctggacctggatttcttccgggaaatgtcccagcgctttcaggcctccggcgagttcgcccaggcttatgtgatcgcccacgaagtcgggcatcacgtgcaaacgttgctgggtatctcatccaagatccaggccgcacgccagcaaggtcgacagatgcaaggcgatggcggcctgctggtccgccaggaactgcaagccgactgctttgccggggtgtgggccaaccgcgcacagaaacggcttaactggctggaaccgggtgatatcgaagcggcactgaacgcggccaacgccattggcgatgaccgtttgcagcaacagggccaagggcgcgtagtgccggactcgtttacccacggcacctcggcccagcgcgtgcgctggttcaagaccggcttcgcccagggccagatctctcaatgcgacacctttaccgccaagagcctctgaatgaataggcgatttgggttagtgctggggttgctggccagctggtccaccgccacttgggctgtcgaaaaagcccatggcgtcaaggtggtcagccctgatcgttttcacctggaggccggcgacctcagtgtcggcgtgagccaggactggcgccagccgttgcccaagataacgcgcgcgctgatcatcgtgcatgggcgcctgcgcaatgcgcagacctatctgcacagtggcgaaagtgccgccgcacatgccggggttggtgcaagcacgttggtgattgcgccgcaatttctcaaccagtcggatgtgaagggcaaccacctgaataaccaggtactgcgctggcagggcaacgactggatggctggagaaccttccaccggccctggccatctcagcgcctatggcgccctcgaccagatcatcaagcacctgggcaatcgcaagttgttcccggcgttgaaagagatcgtggtcgccggccattccggcggtggccaggtggtacagcgcttcgccctcaccggccatgaccacccgttgctgcaaaccgaaggcatcagcctgcggtatgtggtggccaacccctcctcctacgcctacttcagcccgcagcggccggtgacgttcgatgtcacccgctgcccaggtttcaacgactggaaatacggcatgcaaaacctgccggcctacgtcggtcagcaaggcacacagcaattggaacaagcctacgtctcacgcgatatcacctacctgctgggccaacaagacaccgaccccaaccacccggcgttggataaaggctgcgaggccgagacccagggcgcgtaccgactgattcgtgggcataactactttgactacctcaggcagcgtcatccgcaactgactcacaagctggtggaagtgccgggggtggggcatgacggggataagatgtttacctcgccagagggagagaaggtgttgttttcccaataatcactgaataaacccacatttgatctctattttctggattgcaacatctggagtaataccgagcaatccttggcatgccaatccgccaactccggccatgggttctccggcaggttcaccaacacggtcttcgtccccgctgctcggccacagtccaggtcaaaacgataatccccgaccatcaccatctcgctcggcgctaccttccacgccgctgccaacttcaacaaaccatccggatcaggtttgtgcggcgcatcatcacgccccagcacatcctcgatggcaaagcagtccgccaggccgatggcttccaaggtgatatgggccagctcgcgcgcattgcgggtcaggatacccagtcgataaccgcgtccggccaactcacgcacaagttccacagcgccttgtgccgcgaccgaaccgagtgccagctcgcgctcgtgctccagtaaccaggcatgcttggccgaagcgaccggcgccggcaaggtcgccaggtgcgtgaggatgtcgtcctcaggcggaatatccaacgccacgcgaatggcagcaaaatcatgcacggccaccgtgagggtgccgtccatgtcgaacacccagtgcttaacgtccgacaggctcatgcccagtccttgcgatgacggatcaaaccttcctgggttaccgaggccaccagttgcccagcgcggttgtacacgctgccacgggaaaagccccgggagttgccggcccacgggctatccatggcatacagcaaccagtcatcggcgcgcaggtcagcgtgaaaccacagcgcgtggtcgagactggcgacctgcatgtctttctgccacacagtcttgccatggggcagcaacgaggtggtcaacaggccgaagtccgaggcgtaggccagcaggtacttgtgcagcgccggcgagtccgccagggcgccgtcggcacgaaaccacacgtacttgaccgggtcggacggctgcgggttgaacgggtctttttcggtgaccgggcgcacttcgatgggcttggggcacagcaacttgtcgcgcatatgctcggggatcaggtgcgcacgttgcttggtcagctccagctccgagggcaggttttccgggccgaccaccaccggcatggtggtctggtgatcgaagccttgttcgtcgtactggaacgaggtggtgcacgtaaagatcgggttgcccttctggatcgccgttacccgccgagtgctgaaactgccgccgtcgcgtacgcggtccaccgaatacaccactggcaaggctgcatcgccagggcgcaggaaataaccgtgcagggaatgcacatgccgcgcctcttctaccgtctggctggccgccgacaacgactggccgagcacctggccgccgaacaactggcgaaagcccaggtcctggctgcgaccgcgaaagaggttttcctcgatcggctccagggtcagcaagtccaccagatcttccaatacttggctcatagagcaactcctgcaatcaatagggcattccgggctgcttatccatgcagcgtgtccaaccattgggcgcgggtgatgcggtacaaaacatgagggcgcagcgggtcatcggctgcgaccttggggtgttcaaaatctgcctgcggatcgtaatgcataccgatggcctgcatgactttttgtgagggcagattggcttgcgtggtgaaggccacaatctcatccagttgcaagcggtcaaagccgcaacgcaacgcggtccatgcagcttcactggcgtagcccaggccccagtgttcgcgggccaggcgccagccgatttccaccgcgggggtaaagccggcttcgaagctgacattttgcaggcctgtcaggccgataaattcacccgtatccttgcgctgcaacgcccaaaaaccgaagccgtattccgcaaaatgcccgcgaatgcggccgatcaatgcggcgctttccaaatggctcaacctggccggaaaatagcgcatcacttgcgggtcggcgcacatgcgcgcaaagtccggcaggtcgctgtcgcgccactggcgcatcaacaggcgtgcactttccaattgcaatatcggctccatgggtccccctcccttgccatgtgcgtgagtgtacagcgctgttaagatccttcgcaggttcccgtcagaaaatcccatgcctttgccattgatctaccacgaagactacagccctgagttcccggcagaccaccggttccccatggacaagtttcgcctgctgcgcgaccacctggtggatactggccttactgaggacagccatcttctacgcccgcagctttgcccagcggacatcctcgcgctggcccatgaacctgggtatatcgaacgctacatgagcggccaattggcccgcgaagatcaacgccgcctcggcctgccctggagcgaagccctcgcgcggcgcaccgtgcgtgcggttggcggctcgatattggctgcagagcaggcccttgaacatggcctggcctgccatttggccggcggcacccatcacgcccactacgattaccctgcgggcttctgcatcttcaatgacctggcagtgatcagccattacctgctggccagcggtcgggtcaatcgcgtgctgatcttcgattgcgacgtgcaccagggcgacggcaccgcacgcatcctccacgacacgccggacgccatcaccgtatcgctgcactgcgaaaagaacttcccggcgcgcaaggcccagagcgactgggacatcccgttgcctatgggcatgggcgatgccgactacctcaaagtggtggacgatacgctcaactacctgctgccgctctaccagcccgacctggtgctatacgacgctggcgtggatgtgcacaaggatgacgccctcggttacctcaagctgacggatgaaggtgtcgccgcccgcgatgaaagcgtgatgcgccactgtctgggccgtgacattccagtgatgggcgtaatcggcggcggctatagcaaggaccgcccagccctggctcgccgccacggcatcctgcatcacagcgcccagcgggtatggacgtcatcaggttgtcactgaaccgtgagcgttacccacaatggctgtggaatggcctgtggataacttgagcgtaagcacctgcaagctagtagccgtatagcctgtaggaaagtgtacgttttttgatcaggcagctgcgccgtcgtcgggtagaatgcttggcctattcaagcgaccgtagccctgccatgcccaagacctcttctcaacatgtcaccattatcggcggtggccctgccgggctgatggccgccgaagtcttgagccaggcaggcgtgggtgtggatctgtacgacggcatgccctcggtggggcgcaaattcctgctggcgggcgtgggcgggatgaacattacccactccgaggactatccggcgtttgtctcccgctacgccgaacgcgcgccgcatatggcgccgttgctgcgggcgttcggggcccaagcgttgtgcgaatggattcatggcctgggcatcgaaacttttatcggcacttccgggcgtgtgtttcctaccgacatgaaagccgctccccttctgcgagcgtggcttaaacgcctgcgcgatcaaggcgtggttatccacacgcgccatcgttggctaggctggaatgccgaaggcggtttacttatccacagcccggacggcgacaaagttgtccacagcgatgcggtgttgctggccctgggcggaggcagttggtcgcgtctaggttctgatggtgcctggctcaagctgctggaagataaaggcgtgccctatgtgcgcttgcaaccgagcaactgcggtttcgacgtgtcgacctggagtgagctgctggtcagcaaatttgctggtgcgccgttgaaaaacgtcgccattggcctggccgatgacccgcctcggctgggtgaatgcgtgatcaccgccaccggcatcgaaggcagtttgatttacgcgttgtcggcgcccattcgtgaagcgatcaaccgcaacggttcggccacggtgcatatcgacctgctgccgagcaagccgctggacaaggtgcaggcggcattggccaagccacggggctcgcggtcgatgagcaagcatttgcacagtcagttgggcttggacggggtcaaggcggcgctgttgcgcgagttggcgccgactgaacatttcaatgatccggcgcaattggctgtggatatcaaggcgctgccgctgacgttagtgaagacgcgaccaatggatgaagcgatcagcaccgctggcggcgtgccctttgaagcattggatgaacgactgatgctcaagcaagtgcctggcgtgttttgtgcgggggaaatgctcgattgggaagcgccgaccggtgggtatttattaacggggtgttttgccagtgggcatatgagcgggcaaggaatattggcatggctgaatgcttcaggtaaccgaatctgtttttaacttgagttgaaggatgctcctccttgagccacctgctttgatacttataaaaactgccttctcagcccgccatgaacgtaacgctgataccggctctggcgcttggataaatcgactgctaccggctgcacagaccgttgcaagacgcgcagggagttgaggagatgctcatcaaccggaagccgctcttcggcactcttatttgaaacgcgaaacgatgcaccatagtccttcgctatactctcgggctcaggaacatcaagctcatcaggaagctcttgtcgcacatggtacattttagggaccttcttcaatacgtcatccttccccttgcacacacatcaaaaaccttaattagttgcccacccatacttgtgaaacgagtagttcacgccaaaggactcctcaataactttaagttgcggcgcgcctgcacctaacaacccctcaaacttgccaagcatctcctcttgaagcttaaaaagattatgaccgtcatcatcaaactcaagctcttttgaccgttcctgatactcagccttcaattcttgatatttagcctgagcggctttcaagctatcgtcaagaacagcatcaagctgctgctcgagctctggcgataaattgtaattatccttcacatagttcacataatccctattggccctatgagcaggaaaaagccgccctgcttcagcgtgctccattacctttgacgtcaattcatcaattttctcttgattcgctttggcatttgcttctttttcggcgtcggactttgctgattctacattgagagtatcaactacaagccccgttgccactagcgctgcaaatacaaccggaagtactggaaatgccatattcaccacctaattagaagtttattttcatacagcctttttgccttttatatgtgggaaccagcgaaaggcagttccaagaaagaagaaattactcattacgaaaagtttccgggcaaatcataaaaaaaatgtctcagcctcaacgaaagggcgcggcgtgccctttgaagcattggatgaacgactgatgctcaagcaagtgcctggcgtgttttgtgcggggaaatgctcgattgggaagcgccgaccggtgggtatttgttaacggggtgctttgccagtgggtacatgagcggacagggaatactggcatggctggaggcgtcaggtggctgaacctgtattaacttgagttgaaggctcgtccttcagccacctgccttaatgcttataaaaactggcttctcagcctgccatgaatatggcgctgataactggtctgtcgcctggacagatcattttctatcgactgcgcggcgcgttgtaaggctagcaaggaggtgatgagttgctcctgcgctgaaagtcgctctacaactttcttatttgaaacgcggtatgaggtattgtcgtccttcgctttgctgtcgagctcaggcacttcgagctcactgggcaactcttgcagtacaccataagttctacggatattctccaacacgtacttccccccttggcagatatgtctaaaacgccgaaaactctgacagccttctatgaaaaatctttaattagtagctcaaccatattttagagccgcgcaatttacgttgaagcatttctctatagttttaatttgctgcacttaaatagcttgggaatcggggtacttctgctcaaacccttccagttcccttcgtaaaaattcgtcaccttctggcagggctaccgacagtgcgtctatgtaagtgcggtgcgcagcttcaagcgccacgggttgatctttcaaactctcctgctcaactttgaagccgcgactgagagctagccccttgtcctggctcttatattcaacctctttgataacctgattcaacggcaaggtttcgtgagaatttacgccgacatgatgctgctgcaaagaagccaattctttatacaacctgatttggtgcgcataagcctctggttgggttttcttaatatcggtcagctctttctccagcgcgctgatacgcgcctcatgactcctctctgacgcggcagcagtgtctctatgcgtttgtgctgcgcgcctcatgtactgcccgaaggtttcctctcccggcctgaaggatagcgatgcaaaagaagccgcaaattccatatcaattacctccactcaaaggctgctgattaacggtcagtttcctgacgcctacctgagtggtgatcgagcattttgagttcagttttaccacgcggaaaaaaattacaagaagattccatccgcagtggacgggattgccccgcccactctgtgcgccaacccttataaaacctttacttcttcttgcgcggcccggtattgaacactggcaccttgcgcaccggcttgatcgacggctcagccggcgccacatcaccactgtccacccacttacccaggttgcgcttgccgccactaccggacgttttaggcttcttcggttttttcggtttcttgacaacttgcccactggcatcggtgtcgggcacgcggtgctcgggttcgaagtccggttccatcttgcggctcaaggtctggcgggtcagcatctcgatggccgagagcatgttgacctcgtcggcacacaccagggaaatcgcctcaccggtgttgcccgcacgaccggtacgaccgatacggtggatgtagtcctcggccacgattggcagatcaaagttgaccaccagcggcagatcttcgatatccaggccacgggctgccacgtcggtggcgaccaggatctgcacctcgctggccttgaaacggtccagtgcgcgctggcgggtcgcctgaggtttgtcgccatggataccatcggcgttgatgcccagtccctgcaacttatccaccagtgcgtccacgccgttgcgggtcttggcgaataccagcacctgcttccagcggcctttgcgcatcaggtgcacaaacaactcggccttgcgcttcttgtccaccggcaccacccactgcttgacggtgttggcggcgacgttgcgcgggctcacttcgatgctcagcgggtcgttgagcatctgcccggccagcaggcggatgtcatcggagaaggtcgcggaaaacagcaaggtctggcgctttttcggcagcatgcgataaatgttggcaagctcttcggagaagcccaggtcgagcatgcggtcggcttcgtcgagcaccagggtttgcagctggttgagtttcagcgcgttctggcggaacaggtcgatcaggcggccaggggtggcaaccaggatgtcgacgcccttgcgcagcttcatcatctgcgggttgatgctcacgccgccgtacaccgcgtaagtggtcagcggcagatgctgggcgtactcggcgacgctggcgtgaacctgctcggccagttcgcgggtcgggcacaggatcagcgcacgcgccgagttggcggcgactttcggcccttccatggtcagcaattgcagcagcggcaaggcgaagcctgcggtcttgccggtgccggtctgggccgcagccatcaggtcgcgtccggccagcaccgccggaatggcttgcgcctgcaccggcgtcggggtctggtagccaagcgtctcaagggcgcgcagcaagggttcgatcaggccaagggtggcgaaagtcatgtgtttaccgtaggaaaaattcagcgcaaaggcgtaatgcgcggcagtttaccttatttccgccttgggcttgcgccactggggcaggctgatcaacagcacggcgctgatgatcaccagcatcgccagggcttcttccaggccgatggtctcgccaacgaacacaatccccagcaacaccgccaccgccgggttcacgtaggcatagctggtcgccgccgccgggcgcacgtgcttgagcagatacatataggcgttgaaggcgatgatcgagccgaacaccgtcaggtaggccagggccagccagccttccagcggtggcatggcctgcaggtgctcaccggagagcgcgctgacgatcaacagcgccacgccggccacgagcatttccgcggcactcgccatggccccctggggcagcggcaagtgtcggctccacaccgaaccgaaggcccaggaggccgccgccaccaacagcaagaccgcccccaatgggcttgattgcagggtactgcccatattgagcatggcgatgccgatgatgcccaggataaccccggcccactccagccgcgtattacgcgcgccccagaaaaacccacacagcaaggtgaacagcggcaccgtcgccaccgccagcgcggccacgccggacgacacgcccatgtgttcggccacactgacgccgccattgcccacggtaagcaacaagatgccgatcatcccggccgccttccactgcggccatgtcggcgccggcaccccgcgccaccggaggaagccatacatcaacacgcctgccgtgcaaaaccgaatgcccgccagcaacaacggcggccagtactccacgccgatacggatcaccaggtaagtagaaccccagatcacatacaacgcaaaaaaggcggcgatcaacggtaagggaaagcgacgtgggccaggcattgggcggctctatggcaggagatgggaggcttattctagaaaggcaggtggctaaacataagttacaaaacctgtttaaaccgcccatacacttttcaaaacatggttatgaaggctataaaccgtgctttcgaaagccacacgcaactggagccttaccatggacaaatacgaccgcatgctcctcagcgctctgctcgaagacggccgcgcctcctacgcgcaactggcccgcacggtaaacctctccgcccccgccgtggccgagcgggtcgccaaactggaagccagtggcgtgatcaccggctaccaggccaaggtggatttgtccaaagtcggcttgccgattcagtgcgtaattgaactgcggctgaccaatcacggcagccaaaaggtatacgacgccctggcgcaaattcccgagctgaccgaatgccaccgggtcacgggcgacccgtgcgtgatcatgcaagcggcggtaggcaccatgccgcagctggaagacctgattaatcgggtagcgaagttcgggttcagcaagacctcgattattttgtccagcgccatagagcggcgggtgccgttggggcagttggaagccaacgggaaaaatggtggctgacctaccgcgcactgtaggagcgagcttgctcgcgaaggacctgagagcgccgcgtgcattcaggacgccagcgtcaccgttgacgttcttcgcgagcaagctcgctcctacaaagggcttgatctgcgctggacgatcaaatcaacgatctgctcgatggtcgtaatgcgatcccaatcctcctgcgtcgcttgcagcttgaactgccacttgatctgcatgacaaagcaggtcaggtcgtcatcaatgatgtcgtagtcatggatgaaatcggtttgctccgtcacttcgcttcggtcgataaaaccgatgatatcgacgaatagctggatgactttttcgctgatttcgactcgcatcaaactcattttccttatggtcacgagagccggagattaaaggtctgttgagaaatcctcttgagcaaaaggaaaaccggaacgctccgacagcaacgcaggacttaacctactgactgttccgacgacacataaaaacgccatcaaccgcgcggtgtttcagtggccagcaagatcgatccctttcatttgcgggacgtttccgagagaatcccacggccttgtttccgtcggattcggtagctagtctcgccctgtcatcgaatgttcggtgaccggacgtgcaagtccgatggcaagcaagatcataaataaaccttcagccgatatgcctgttatggcggctgtgcgtgggaggccttcgggcctgctgggtttggatccttgccccggtcttgcacacctacgcacagttgccaccctaattcgcgtgcaagcgaacggtgtcgacttcttccagcaaggagtttcaccatggccaaaaaagtcacccccgatccacccaaatccaaaaccgacttcctcagcgaagacgccctgctccaccgtcgcgccatcgactactacctcaaggcatccgccccggatgcgccgatctttatcctgaatgacaacctgagcttcgaagacgccctggcccatgcggcggatttgttgcattgcgcggtggagacggcacatgcctcgagtgaggtgatgaaggcgccacagcgggcggtgatgcatttggtggaaatggcgaaaggcgtagtggaccaggcgttggagtgcacacagcctcgataggcgacacataacccatgtgggagggggcttgctcccgatggcggtgggtcagatacagatgagctgactgacacactgctatcgggagcaagccccctcccacatttggatctttggtgtgcttgagagggtggctggtttagaacccgcgatgctttttcaggtgctcattgattttggcggcaggcactttctgcaaggtgcataacaggtcatgggacagttcgcgcaggccgtgggtctggcgcagttgctgggccaggtgcgccgtgaggttggcggccatttccgcatccgccagcgcccggtgagcctggccggtgtggggcagtttggcgtaggcgttgagggtgccgagtttgtggttgggcgcagccggcatcaggcggcgggccagcagcagggagcaggcgaatttctgcaggcgggtgcggcggatcaggcccagttcaaagtcccagaacttctggtcgaaggcggcgttgtgcgccatcaagggcgtggtgccgacgaattcattgacttcgttcatcacccgctcagccggtggcgcgctgcgcagcatggcgttgctgatgccggtaagttgttcgataaaagccggtacgcgcacgccggcgttcatcaggctctggtagcggtccacgatttgtccgcgctcgaggatgacgacgccaatctccgtagcccggcagtggctgctgggggtgatgccggtggtttcaaagtcgatgaccgctatacgttccaaacctgttcccactccgtctaacaatttatttgagcagcaacgcgccttcgatcggcacgtagcggctggcggcgcggatcaatgaattggccgtcagcccgggcacgccataggccacggcttcgacgccatgcttgtgaatgacacggtcgagcagcatgtcgaaatcgccatcaccggaggccagcacgatttcgtcgacatggtcggcggcgtccatgatgtcgatggtgatgcctacgtcccagtcgcccttggccgaaccgtcgctgcgctggatatacggtttgagttttaccgtaaagcccaggttacgcaggatctgctggaattgctgctgcttgctgtcgccacggtcgatggcataagcataggcctcgacgatctgcccgcgggcgccgatgtcagcccacagggcggcgtagttgaagtggcagccataggcttggcgcacggtgtagtagaggttttgtacatcggcgaacactgcaattttcttcaccgcacttcctcatggacagccaggcgccagcgcccggaaagggcgccagtatgccagccaagggagcgtttccgggaaaaaatcagaccggagcgccgtggcgccccgggccaagaggtgtcagacgaaagaatcgtcgtcgccaaaggaagaggaatcgtcggaataatcgctgtcagcgaagccgtcggcattgttgctgccccaactgtcattgccggcaaacttctggtcatcgttgccccagtcaccctggtcgctggtcggtgccggttgttcaatgatttcttccaccacctgcggctgctggttgtgatggaacaggctgctgatgccttcggcgagcaacacaccaccagccacaccagcggcggtcttcatggcgccgccgagaaaaccgctgcccactggcgcggaggctgccggtgcttgcggttgctgatagttctgctgcggtgcaggcgggttgaacgacggccgcgccggctcacgccagccgccgccggagttgctcggcgcaggttgcggctcgcgggagctaccgccaaagatgctcgacagaaacccaccaccactggctggcgccggttgcgtcgacttggcccgctgcagttcgtcctgcaattgctggatctgttgcgcctgctgcttgttttgcgcatccagagcctgaagcgcgtgttcctgcaccagtaacgactgggtcatgtagtacccggcggccggttggcgagtcatgtgctccttgatccgcgcttcggcctgggcgtcgcggggggctgagtccgtttcggcttgctgcaaccgtgaaaacagtccatcgatcagggtttgctcttcgctgttcatggcgacctcgttagattgccgataaaaaattctggtcccgcctgtggtcaggccgggtgccctccagttatggggatgttacgagttgtttcaatggtctttactcaaggtttacgtttgtgccccttggaccccgatcggttaaagtgtcgccctctgcttccaggcctgtgatgatcctgatgaatccgttagacgttttgcgcgactccttgcgttttacccagcgcaacctgggcgccatcgtgcagttgtgcctgccgttggtgatcctcgaagccctgctgcaacaaatactggaccacacgctgggcccggatgcgtttcccggctacagcgtggtcgtgggtttattggtgtacccgctgtacaccggcgccctgatcctgtttctcgacgcccgcacccgtggcgagtcgccacgcaccaaggatgtatgggccatggcgctgagcctgtggccgcgcttcgccttgctgacggccatgagcacgttgctgatattgctcggcctgtcgctgtatttcctgccgggcttgtggctgatggtggtgttggcgtttgccgaatacctgctggtgctgcgcggtatgccggccctggaggcgatgaaggagagttttcgcctgacccgcgggcatttctggcgaatcctggtgtgcctgctgtgcgtgatgaccccgttgtggctgctcaagggcgccagcgtggcggcctatcctgagcccgcgccgttgctggggttgctgatggacagcgcccacagcttcctgcaattgttcaccagcgtggtgctgttccgtttattcatgttgatcggtggcgacgccgacgcgcggtgatatgctccgtgcctcttctgacacgcaaataagccgagccgatgacccgtttattgcgcatcaccctgttgagcctgttgatcatcgccggcctgctggcggcgctgatccaaagcttgacctggcgccccgccgataaagagaccttgcccgtcagttgcgtggcgccccgcgccccgaccctgctgccggggcaggcgctcaaggtgatgacctggaacgtgcaatacctggccggcaagaactacgtgttctggtacgacccccccgacggcagcggcccggatgaccgccccaccgttgaagacatggcgttcagcctcgacgaagtagcacgggtgatccgcgacgaacagcccgatatcctgttgctgcaagagattgacgagggcgccaaaccctctcactaccaggaccagctggcgctgttgcaagagcgcctggtcgacctctacccctgcagcgcccaggcgttcgactggaaagccgactttgtgcccaacctgcacattttcggcagcgtcggtcgcaagctggcgacactgagccgctaccagatcgaacatgctgagcgcctgcaattgccggccgccgacgccaacttcatcagccgccagttccagcccaagcccgccttgctgttgacctacctgccgctgagcgacggtggccagctggcggtgctcaatacgcggctagaggccggcatatccggacgcggtgccatgcaagagcaagtcgaggccacggtgaagctgctggacaagtttgaaggccgcggcacgccatggctgatcggaggagatttcaacttattgccactggggcagttcctgcgtttggatgcgcaaaaacgcgggcagtattcgccggacagtgagctgcacctgctgtgggacaaatacccgatgatcccgagtaacagtgaatccagcggaataaaccgtgagcaatggttgacctattaccccaatgatccgagcctggacggcccggaccgcaccttggattacctgttcttcagcccaaggatcaagcgggtggaggcgaaagtacggcaggaagatacattgcgtatttccaaccatatgccagtgatcgctcgttttctcctgcccgctacgttttaaacgccgaactcaatctgaaagtcgacttcccgagagttgttgtgcacagccaaagaaggtggccctggacagactgatcagcgccgctcgcttgtgtgggaagtcaaactccttgagtttctcgaagccgagcatttcgctgcaacgcaacaaacgttcattgtctgcgcggggctctgccataacgcgctgggtgcgaacgtcatcaagaaacatgtagtggagcaaggacgggtaccaggcctccaaccattggcgccccctgaaggcctcttcgcccactagcaggtggaagccacgatcaaagtccgtcgcctggcaaaacggcgcgagcctgtcctccttggcccaatacacctcaaaatagccaaatgcctgcgcatcaaaaaagccgatgagaggaataacccgagagtcggcaagttgcgtttcaaggaacgcccggtgatagtccaggtccccttcctcctcccagaaaaatgaaacccggggatcattcatccagcgattgaactggaccaggtccctgtcaatatcagccactttgaaactcagggttttccccagccagggaatataccgggcataaacatcaccggtaggctgccgagggcgaaccgggatgctgggctcacccgatcctgcataacaaagtgggtaactgttgatcatgcccttggaacaccaaggcaatgacaactgccaaaacatctcggccagtacccaacacttttcgttctgaaagagggcgatgcccaattcgcacagttgggcactcaatggatcaggcaacagcacctcgaccctgtcgcgcagagggttatcagcaaaccatgcctccagcgccgcgagcacgtgacttggagaggttgatttctcaatggccagtttgctggctgagcaagaggggtcaatcattttaaaatcgccgtgcgcgctctgtaattcgaaacagacagtcccggactcaagatgcacggcgatttctgagcgatcaacgatgacatgggctgctgccccggtaatctggccaacccttgtgactcgatttgtgtgttcgttcataagcaccacagtctctctcctatcccagccccataaggtcaagacgtggtgcgcccacataaatttaagtgggccttatacagtgacgttggctgctcatggcttcctgggcttcgccctggccgtcgcttcggccaccaatggatcttcgggccaataatgttttgggtaccggcctttaaggtctttcttcacttcggcataggtactgcgccagaaattggcgagatcctgggtcacctgcaccggcctgcgagccggtgacagcaagtgcaaggtcagtggctgttttccctgggcaattgtcggtgtttctgacagcccaaaaagctcctgcagccgcactgcaagcactggagggtgttgcgaatagtcaatgcgaatgctcgagcccgagggcacctggatggactggggcgcttgagcgtccaatgtgtgcttgagcggccagggcagcagattcctgatgatcgaagacaggtccaactgactgaagtgactgagccgggtgatcttgcccagatagggcgtgagccactcttcgagcgtatccagcagattggcatcgctgaggtcgggccattgactggtgccctggccattctggatatcgaactgacgcaacaactcgactcgagcctgccactgacgcaactcagggttccagggcagcagttcaatgcccttgcgcctcacgaggttgaccagcgcgagcgaacgggcgtgctcgtcgaggttgggcagcggcgttgtggaaagcaccagttgccccaccctcaattgccgctcggccttgagcaccccttccctatcatcccaatcgatctcatcgactgaccttaccaggtcgcttagctgatcctcgaacagtgccgggtccaggtcgctcgccaggtaaatccgttcctcacgctggccctgccgactgcccaggtctgccactaccagccactcatgcttggtgagcgcatcgggttcggcgaagactgccgcgcgcccgttggaaagacgatactccgctacgcttgcacgccgttgcaggccaattcgatcagggtaggcgaatgccaacaggcaaccgacccagcgtggatgatcaggcgcgctgaccgggctggaggcacatcctcgcagcagggatcgatactgccgggcagactgcttaacgcgttggaaggcgccgctgccacggcgtgcgttctgctcgccagacaatgcactgagccgggtatgaagatcagcacctgcgccacgcagaatgtccttctcccccagcagggctgcgatgttgcaggccaagtcatccaggcccatggcgtggcccttgatgagcagatgagcgatgcgcggatgcgccggcagctcgctcatggccgacccgtgaggtgtgagctgacccttatcatccagcgcgcccaggcgcttgagcaggtccctggcttgggcaaaaggcgccgagggtggttggtcgagccaggtcatttcatctggcttcatgccccaccgggccaattccagcgcgaggccagccagatcggcttgtagaatttcgggggtgctgtaacccgccatttgctcgtgttgcgactctgaccatagtcggtagcagacacccggctccaggcgcccggctcgccccatccgctgagtcgcactggccctggagatacgctgggtatcaagccgggtcatgccactacgcggatcaaacttcggcacccgttcaagaccgctgtccaccaccaccctgaccccttggatggtcaagctggtctcggcaatgttggttgccagcacgatcttgcgcgagcctgcgggtgccgggtcaatggcagcacgttgtgcgttcagatcgaggtcaccgtacagcggacagagcatgacgtctggacgactgcccagttgctccttcagggactcggccacgcgccgaatctctgcctgacccggaaggaacaccaggatacttcccggctgctcatggagggcggccaggcaggtgtcagtgacccgtgtgtcgagaggctggcctggctgataagggcttccccagagggtggagaccggatacatccgcccttcactggtgatcaccggcgcgtcattcaaaaccttcgagagccgagcgccttccaatgttgcagacatcagcagcagcttgagtggcggctcatcacgcagcagttcacgcgcactcacgcagagggccaaggcaagatcggagtccaggttgcgcaggtgatactcatcgaagatgaccagccctacaccgtccaacgccggatcggcctgaaggcggcgcgccaggatcccttcggtgaccacttcgatccgggtgcgagggcctactctactctcgaggcggatgcggtagccgacggtttcaccaaccttttcgcccagctcgctggccagccgctcagcagcggcccgcgcggccaggcgccggggttcgagcatcaggatggtctgcccggcgagccagggctcgttcaatacggccaagggcacacgggtggttttaccggcgccgggtggcgcttccagcaccacttcatggcgatgcgccaaggcgtcacgcagggcgggtaaaacatcatcgatcggcaacgaattcatactggctccaaagcagagcggcgagtataacggcgaactgctgaaagccggctgtggtctcaacaacacctgcccctcccacattcgatcatcggcgcccggcagatctggcttatagtcacccataaacatgttcaggagacttttcatgcgtatcgcttcccgtgtcatcggcgctgcattagccgtcaccctgctgagccaactcaccgcctgcgggtcgattttctatcccgaccgccgtggccagatcgacggcaagatcgacccggccattgccgtactcgatgccgtcggcctgctgttctacgtcatccccggcttgatcgcgtttggggtcgacttcgccacgggtgcgatctactacgaacccggcaagaccgcccaggtcgcccccgagaaactgcgcgaagccatcggcgccgacggccaggtcgacaacgccaagctgcagagcatcatccagaaggaaaccggccgtaccttgccgctggacgacccacggctgatccagttcaagggcagcgtgcagcaacttgcgtccctgggcctgcaacccgccgcgtaaggacagcccatgaccagcagccccgaacacgcccggcttctgcgcctggccactcgcgcctcggtgggcgtggcctgtgtgctgattatcaccaaggccatcgcctggtggctcagcggctcggtgagtatgctcgccgggctgaccgactcgctgctcgacggcgtgacctcgctgttgaatctgctggccgtgcattacgccctgcgcccggccgatgacgatcaccgttatgggcatggcaaggcggagtcgctggcgggcatggcgcaagccttgtttattgccggcagtgcggtgctgattgcgctccaggcctttgaacggctcaagcatcctgagccggtcggcgcaccgtggctgagcatcggcgtgattatcctgtcgctggcgctgaccgtggccctgctgatgctgcaacaccgcgtggtgcgcgaaaccggctccaacgccgtgcgtgccgactcgttgcattaccgctcagacttgctgctcaatggcagcatcctcatcgcactggtgttgacgggctttggctttcatcaggtcgatgcgtggtttggcctgggcatcgccggctacatcctgtggagtgcgatccagattgcccgggaaagcttcgcggtgttgatggatgaagagctaccgccggacgtcagccagcacatgctggaactggcccgtggcgtgcccggggtactgggtgcccatgacttgcgcacgcgcatctccggcagccactggtttgtgcagttgcacctggaactgccgggggaactgaccttgtcggtggcccatggcatcagcgaccaggccgccgacgccattcaccaggcctacccgcgtgccgaagtgctggtgcacgccgacccgctggaagtggtcaccggcaacaaggcctagtactgcacctgatacccacgactgcccaggcagttgccctgggcctggcggtaggtttgcaccaccgccggatcaggcgcgtaggtaacggtgcgcgggtcgaagccactttgttgcacggcccagcgataacagtcgtagccgtcctgctgcacctgggccggcgactggccgttggcgggataggcaaccacatcatagccattgccttgcggcgccggctggggcgatggcacttgcgccggcggctgcaccaccacgtattgctgggtgctttgctcataggcgtagtaggcgccagcggcaaggaacaagagtgagtcacctacccacacttcacgcgcatagtccggcaggtactgcacacgaatgccatacggcggcgtcactaccacgtagcgcggaccttgggggcgataccaatagccgccggagtagaagtagtcctggccacggtaaggcacgcgatagttacggtcggggaagcggtccaccacatagccgggacggtgctgcgggcctgggccccagccgttgccgtgcccgtcggggcggcctggccagcggttatcaccaggacgatcataaccaggccgcgaacctgggccgccagcctcccaatgccggttgtcatcgttgcgtcgaggaatatcgcggtaatacccctggcgcggctcctgggtctgacgcacggtatcgggcctgccctggatcggcaggttattggagggttgcggctgcggtgccggtcgccctggctcattaccttgagggcgaccttgccattgcccctcgtgctggccgccgcgatcaaaatgcgggttttgtgggcgtggttgattgttttcaggccgttgcgccgggcccggtgagttatcgcgctcgtcggccattacctgcgtgccgacgctgaccaccagcaaaccaacacctgccatacgccagatgcgcttcatgctattcctcactgcggattagggccttacagatgagactggaaaagccccacccggttctcaggcaggttatcagtcgcgggcagtattttctcaaggcaaaagaaaaggggtgacccgtcggccaccccttgagaacttcgtccatgctcaacgcttttgacgttggctcacctcacgccgtcttgtggacagtgtgcagcctggaggccggctcaaccctgctggggcggcggccgcagcgggcctgattgggcgcgctgctgtggactgttgtccaggcggtgattctgttgataaagatacccgccaacgcccgacggatgattgcgaagattgcgtcaataaacagtgcttgcgcaatttttaacccttcatggataattcaacgcaatagttacgacaaaggccaacccaatgagcaagcttgaccgatacgatctgagtattttggcggaattgcagcgcgacgcgaggatctccaaccaggagctggccgagcgtatcggcctgtcgccttcgccctgctcgcgccgggtcaagcagctggaagacgacggctacattgcgcgccaggttgccctgctggatcgcaagatgctcggcctgagcctcacggcctacgtattgatcggtatggaccggcacacacctgagcgcttcgagaattttgaagccgccatccgcaccttgccccaggtgctggagtgcagcctggtgaccggcatggatgcggactatcagctaaaggtcgtggtgccggatatggaccactatcagaaactgcttctgggccacctcacccgcattgaaggcgtgaccagcgtgcgttccagctttgtgctcaaccaggtgctcaacagcaccgaactgcccctgacccacctgcgcacctgagcacactgagattcaaatgtgggagggggcttgctcccgatagcggtgggtcagttgataaataactcactgacactcagtcatcgggagcaagtcgaatcgtcgcaccgcccctcccacagtttgaccgcgtacgactcaagtcaatgttgcgtctgtgacgctgccgtatactgctcgcttgtcttgctggaagagtcccatgaacaacatcgaccccgccctgtttgaagaatggatgatgaccggcctggtcaccatcctcattattttcatgggcttcatcgtctgggacctggcaaagaaatccaaggctgggcgctttggttcgttcatcctgttcttcgtgctgggcctgggcgtggccgcgttcatcatcaagagcgtggtgatcggcctgatcgagtccggcgctctataaacgcgccggtactgccttccattggccctgatccaggccatcgatagaccaatcaccaatgcgcacgcgcaccagtcgtaacgtcggcaggcccaccgccgcggtcatgcgccggacctggcggttacgcccttcgcgaatgaccagctccagccaatgggtcggcacacttttgcgaaagcgtaccggcgggttgcgcggccataacgcgggttcatccagtagccgcgcctcggcaggcaaggtcatgccgtcattgagttccacgccatcgcgcaggcgttgcagctgttcttgcgtcggctcgccttccacctgcacccaataggttttcgccagcttgtgcttggggtcggcaatacgtgcctgcaactgaccgtcattggtcagcaacagcaggccttcgctgtcacggtccaggcgccccgccgggtaaatgccgggaatgtcgataaagtccttgagggtcgcacgcccactttcgtcgctgaactgagtcagcacgtcgaacggtttattgaacaggatcagcttcggctcggacggtggcgccttggcgacacgacgggcagcggcatgtggaggtttcacgccagggcggcgtgaatcaggtcgggtaggacggggcatggcaaaaggaacatccagcggtcaggaccgacaatgctagtggcctgaccgccaaatgaccatcccaaccgcttagcggaacggcggctcgtcgaagctgcgcaatttacgcgagtgcaacgagttgagttcggtgcgcaacagatcgaccgcctcgatgccgattttcaggtgctggctgaccgcacgttcataaaacgcgttggccgagcccggcagcttgatctcgctgtgcaagggtttgtccgatacgcataacaaggtgccatagggcacgcgcagacggtaaccctgggcagcgatggtgccactttccatgtccacggccacggcacgggacaggttgatcaacggacgttcctgggcccagcgcagttcccagttgcgatcgtcgtaggtcagcacggtgccggtgcgcaggcgttttttcagttcttcacctttttcgccagtaacattcgccgcggcttgctgaagggccaactgcacctcggccagggccgggatcgggatgttcggcggcaccacacgatcaagaatgccgtcacgacgcatataggcgtgagccagtacgtagtcaccgatggtctgggattggcgcaggccgccgcagtggccgatcatcagccagcaatgcgggcgcagcaccgccaggtggtcggtgatgttcttggcgttggatgggccgacgccgatattcaccagcgtcacgccgtggccatcgctggcttgcaggtggtaggccggcatctggtagcggtgccagaccacgcctgcggcaatcgccgaggcctcgccgtggtccatgctcttgtcgatcaccacgttgcccggcaacaccatgcggataaaccgtgggtcgctgcgcagttgctccaggccgtgcaggatgaactggtcaacgtagcgatggtagttggtcagcaggatccacggctgtacatggcgccagtcgctgccggtgtagtgcaccaggcgacgcagggaaaaatccacgcgggccgcatcgaacagcgccaagggcagcgggtcggtgttttcccagtcgtagaggccgtcggcgatgccatcggtggcggcggacaggtcggtactggggaagacccgggccagggtcgcggcagttacgccggagccggccagttcgtcgccctgctcgaccacgtaggggtaagggatgttctgctggctgacgcccacttccaccgtcacggtgaaatcgtgcatcagcggcaccaattgttcgagcaagtacttacggaacgcggccgggtgggtcacggtgacgctgtaggtgccgggtaactggaccttggcatatgcccgggtggtctgtgggacttcgccatggcagtggtaggtcaggcgcagttccgggtagcgaaacagcgcgcgttgtgcggcgtcgggctcgatgcgatccttgaggtattgcttgagggcttgattgagcgcactggtagcacgctcatgcagggccgccagccggtccacggcctcttcggcggttttaacgacaacaaaagcttcggtcacggtaagcatcctgtgttctggacttgcagacctttatcttgcctgtatccaggcttcaccgaaacaccaggattggaatgcattttaaaatgtgaaggtgacaagccctaataccatgtaggagcgagcttgctcgcgagaaacccataggcgccgcgtttattcagaaagtacgcgttatcgttgacgtttttcgcgagcaagctcgctcctacagttgaccgtgtttattcagggggatggcggggttgagcgcgcgactatggcgtctacatccacccctcgcggcaaggtaccgtacacacgccccgacgattcgcccaaccggctggcgataaacccatcgctgaccgccgcattcccggcctccaacaacaacttggcctgcaacgccacggcgatatcctcagtcagctgccgtgcgcggtactgaatgtcctgggtgtccataaaagccgacttcagttgctcgatatgccgcgtcaacagctggtcgccatgcccaccgcccagttcgacaaacagcgcctccagcacgcccggctctttcgacaatgcgcgcaacacgtccaggcactgcacgttacctgagccttcccacgttgaattcactggtgcctcacggtacaggcgcggcaggatgctgtcctccacatacccggcaccgcccatgcattcggcggcttcgttgatcatcgcgggcgcacgcttgcagatccaatacttgcccaccgccgtgaccagccgggcgaacttggcttcctgctcattatcaagatgatccagcgcgcggcctatgcgcaggctcaaggccagggccgcttcgctttccagggccaggtcggccaagacgttttgcatcagtggttgttcgccgagtacgcggccaccgactaaacggtgggcacagtgatggctggcctgggtcagcgcctggcgcatcaaggcgctggagccgaccatgcaatcgaagcgggtcatggcgaccatttcgatgatggtcggtacgcctcggccttcttcgccgaccatccaggccagggcgccgcgaaactccacttcgctggaggcattggagcagttgccgagtttgttcttcaaacgctggatatagaactcgttgcgcgtgtcatccgggcggtgccggggcagcaggaaacaggtcaggcccttgtcggtctgggccagggtcaggaaggcatcgcacatcggcgccgagcagaaccacttgtggcccaccagttcgtaggcctggccgggcccgcccgcgcccacggggtaagcgcgagtggtgttggcgcgcacgtcggtgccgccctgcttctcggtcatggccatgccgatggtggcgccggccttgtgggcgataccgacattgcgcgggtcgtattgggtattgaggatcttcggcaaccagaggtccgccagctccggttgcaaacgcagggccgggacgcaggcgaaggtcatggtcaacggacaaccggtaccggcttcggcctggctgtgcaggtaggtcatcgccgcacgcgccacatgggcgccggattgcggatcagcccagggcaacgacggtaggccatgctcgacggcggtgcgcatcagctcgtgataggccgggtgaaattccaccaggtcgatgcgatgaccataacggtcatgactgctgaacaccggtttgttctggttcgccaggaacccggcttccatcaacggcccaccggccagtgcaccgtaggcatcgatacgcgattgcgcccagccagcgccaaagcggcgcgaccattcttgcaggggcagatcgatgcggtaaaggttggtgccgtccagggacggtggctggttggtgacgtcgtgggtttcagcaaactgatgcaggttcatgacgggcctcttggagataaggccacatcgatttcaggttgtctgtaggagcaagcttgctcgcgcctacacaaggcaccgttcgattgaggccggttatttcagttaagcaccgacctcacgctcaaaaaagtggcatacccgccgaatgttcggcgctttcgccctctgtcgtgcacagcacatggcgctccagcacggcctgcaaggcgtcgaaacgcaggggtttggccaggcgatcagtcatgccgataccgtggcaacgctcacgttccggcccatcgggcgaggtagtcagggcaatcaccggcaactcaccgcagccgggcaaagcacgaatctgacagcacaacgagaaaccaccttcaggtacgtccagcagtactgcatcaaaacgctcaccttgcagttctgccagtgaggccgggccgttatccacggttttgacctggtagcccagtttgagcagcatgccacgcaccgccaactggcccacgctgttgtcgtccaccagcagcaccttgcattcatggggcgaacgttgggcgtggtgccccggcgcgcgctgcttgggttgcgcaggcgcaaggccgacgtccacttccaactggaagcggctgcctttgcgcggctccgaatgatgggtcaaacgcccgccctgcagttcaatcaactgccggcaaatcgccaagccaatgcccaggcccccgtattcgcgggtcgtcgagccgtcgagttggaagaagcgctgatacagcgtggcctcgtcgagaaaggcaaaaccgataccggtgtcggtcacgataaagctcaggtgcaatccgccatccgcttgaggcacaccgaccacacgcaagcgcacaacgccgatgtgggtaaatttgaacgcattgtccaacaggcaatccaggcattggagcagcttgcccgcatcgccgatgacccggtccggcagttcatccgcgacgtcgatggaaaactccaggcccttggcttgggcactggcggtgaactgctggcgcgcagtatcaagcgccccacgcaggctgaacacttggggctgtgccaccaggcggccggcctgcaattcggtcagggtgaggatgccgttgaccatgcgcatcatgtcccgcgccgagccggcggcggtttgttggtactgcgccaggtcatcggtcagggggacggtctgcatcagctccagagaaccgatcacaccgttcatcggcgtgcgcagttcgtgggtcagggtggcgaggaattcatctttgaggcgattactgcgggccagttgctggttgagcgcctccagcttctggctggcgtcgaggaggatttgcgcctgctgctcacgcatgccgttgatgcggtcggccagggccagggacagcagcgccacttcaatggccgagccgatctggctggcatacatggtcaggaacacgttaggcaggtaacccagcaccatcagggtgttgaccaccccgccaagcaggaacgccgaccaggcgatgatgaagtagcgcgccatacgctgcccgcagtaccaggccttgatggcggcgacaaaaatggtcacggtaaataccagcgccaggcccgtggccaggcgcagggccacggcgtagctggtcagcagcgccagcgccatcaccaacccaccacaggccgccagcgccagcagcatccggttgatccagcgactgtgctgcgcggtatgcaggaagctgcgggcgaacaggctgccgaataacgccgccgaaccgatcaggaacggcaccgccgcgttcgcccaccacgggttgttgggccagaagtactgcaccgcgacgccgttgaccgagagctggtacaaaccgaacgatgcgatatagaggatgtaataaaggtagctggtgtcgcgcacgctcagatagatgaacaggttgtagatcaacatgcccagtaacacaccatagatcgccccaagcacatacaagcgcagcggctgttcttccaggtatgccgtacccgcccataacgtcaacggcgcctggatcgagccctggctttgcaggcgcaagtagagggtctgttgctggtcgggcaggaagttgagcttgaacaagtagttgctctggctcacctcacggctggaaaacggcaaggcgctgccggtgcgggcggtcagccggtagtaaccggcgctgtcgctctggtagaggtccaggcgattgagcggcgggtaggccagctccagaaaccaggcgcgtggtgcacggggatccttggcagtgtaatgcaggttgaccttgagccagaacaccgagcgcgaatagccggcgttgagggtggctttgtcatgggtcttgaactgtgcggcgtaggcgggggagctgacatcggcgatggtgagggtatcggtgggatcttcgagcacttgcatgacctggccaagcggcaggcttcgcgtgtccgggttgaactcgacggcgccggcaagcatcggcagcccgcacaagataaagatcagcaaatagcgcataaagccccagcgtggcctgtccggctgtgtcaaaagccccccattccttttgagaagacgtacaccggcgatacagtaagttgtttggatgcactttagcatagccattaaaggccattggacagcattgaaatatttttttgaaaggctctggatcgaggctttcagcatttaaaccgcaggttcgagccgcagaaaaacgtcgtaactgcgggcagacttcaaccatcgccagacggccacgccaaaagcgtttggtggtaagctcgcgcaccatgaatatctacagctctcgccccgttgtcctctgtctctccggccacgaccccagtggtggcgccggcctgcaggcagatatcgaagccctgctcgcccagggctgccacgccgctgcggccgtcaccgccctgaccgtgcagaatacggtcaatgtcagtgacttccgcgtgcttgaccgcgagtgggtcatggcccaggccaatgccgtgctcagtgactccgaagtggcggcagtcaagctgggcatgctcggctccaccgcgatggtcgataccgtggtcgaactgctgcaggcgcacccgcatctgccggtggtctgcgacccggtgctgcgcgccggcggcggcggtagcctgggcaaggacgaagtcggctacgcgatgcgcgaacggctgttgccactgtcgttgatcgccacgcccaacctgccggaagcccgcatcctcgccgagttgcccgacggcagcgcggacgagtgcgccgagaagctgttgccgtacatcaagcacctgctgatcactggtggccatggcgacgagcatgaagtgcacaaccgcctgtacagccgcgacggcacgcgccgcacctttacctgccagcgcttgccaggcagctatcacggttcgggctgcaccttggccagtgcattggccggtcgccttgcccagggcgaggcgttggccagcgccgtgcaatcggccctcaactacacctggcgcaccctgcgtgacgccgagcaactcggccagggccagtacgtgccgcgtcggttgccgctggatttctgctcgtaacctatcgcctgtcacagcaaggggcttgcccgatgaaactacgtggcctttacgccattaccgacagccagctcttggccggcaagttcctcgcctacgtcgaggcagcactggacggcggcgtgaccttgttgcagtaccgtgacaaaagcagcgacgaagcgcggcgcctgcgtgaagcggaaaaactgcacgaattgtgttcccgctataagacccaactgatcatcaacgacgacgccgagctggcggcgcgcctgggcgttggtgtgcacttaggccagaccgacggcccactgaccccggcccgtgcactgctgggctccaaggcgatcatcggcgccacgtgccacggccagatcgaactggccgaacaggccgccaaggaaggcgccagttatgtcgccttcggtcgcttcttcaattccacgaccaaacccggcgcgcctgccgccaccgttgaaatgctggcccaggcccgcacgcgcttgcagctgccaatctgcgtgatcggcggcgtcaccctggacaacgccgaaccgctggtggcccacggtgccgacctgctggcggtggtgcacggcctgttcggtgccgacagcacccaggacgtcacgcgccgcgcccgcgccttcaacgaccttcttaaatattcagcttagagagcccgatcatgtcccgttccgaaaccctgtttgccaatgcccagaagcacatccccggcggtgtgaactcccccgtgcgtgcgttcaagagcgtgggcggcacgccgttgttcttcaaacatgccgaaggcgcctatgtcaccgacgaagatgacaagcgctatgtcgactacgtcggctcctggggcccgatgatcctcggccacagccacccggacgtactggacgcagtgcgccagcaactgcagcacggcttgtcctatggcgcgccgaccgccatggaaaccgagatggccgacctggtctgctcgatcgtgccgtcgatggaaatggtgcgcatggtcagctccggcaccgaggccaccatgagcgccatccgcctggcccggggtttcaccggccgcgacaacatcatcaagttcgaaggctgctaccacggccattccgacagcctgctggtgaaagccggctccggcgcgctgacccagggcgtgccgaactctgccggtgtgccggcagcctttgccaagcacaccctgaccctgccgttcaacgacatcgccgccgtcgagcagatgctcagcgaagtcggccaggacgtggcgtgcatcatcgtcgagccggttgccggcaatatgaactgcgtaccgccggccccgggtttccttgagggtctgcgcgagcagtgcgacaaacacggcgtggtactgatcttcgacgaagtgatgaccggtttccgtgtcgccctcggcggcgcccaggcgcactacggcgttacgccggacctgagcaccttcggcaagatcatcggcggcggcatgccggtgggctgcttcggcggcaagcgcgaaatcatgcagcacatcgcccccctgggcccggtgtaccaggccggcaccttgtcgggtaacccgctggcaatggccgccggcctgaccaccctgcgcctgatcagccgcccgggcttccacgccgagctgaccgactacaccacccgcctgctcgacggcctgcaacaacgcgccgatgccgccggtatcccgtttgtcaccacccaggctggcggcatgttcggcctgtatttcagcggcgccgacgatatcgtcacctttgatgacgtaatgggcagcgatgccgacctgttcaagcgcttcttccacctgatgctggaaggcggcgtgtacctggcgccgagtgccttcgaagccgggttcacctcgatcgcccatggcgaagccgagctgaaactgaccctcgatgctgccgaacgcgccttcgcggccctgaaataagtaacggcactctctgacgttgccccgggcggcgtcagatttgctactttgcctacagatattccctacatttttcgagaattatcctgcaaaccggcagataacttgcccaagcagcagaaaaacgagtaaagactttgtaagcaggggcctgcttatttcataatgcgcgctgattggactcccccgagagtccgcgtgccccgtcagaggtaagtcgattcccatgaaacgcaccggccgcaccctggttctgggctgcctgttgctccttcagccactgctggcacatgcccaggcaggcggcaactcgttgttaatcccagcgatgggtcgttgcaccctcaatacccagccagacagccaggccgaagcgctgagcgcgtgccagaaacaggctgatgacggggatgcgcaggcacaatacgagttgggcgagtactaccacgacagcaagaacccggccgtcgacctcaacaaagcgttgagctacttcgagaaagcctcgttgcagggtcatgcccaggcgcagttccaactgggtaacatgttcttccgcggcgaaggcgtgccggccaataacgtgcaggcgtacatcgtgctgaaaatggccgcggtcaacggcgccgaagacgcactggatactgccgacgaagtcgccgagcacatgcagcgcgatgagctggaagtggctacccaggtgctggggcagattttccgcaattacctgcaggaactgcagagtgccgatgggcgctcgcccttctcacccctgccctgatttcggctagccccttcttctattgccatcggtctaacgccctacttctcaggcatcggcatcggaaacggcatgacattgctagtgccccgcgcctcgctgatcttcggcgtgcccaggcgctcgacttcatcgatgcgtacgatcgaatgcatcggcacaaaactgcgcaccacgccttcgaactgggccttgagcttttcttcgcccgggtcgacgaccaactgggtgcgctcgccaaagacgaattcttccacttccaggaagccccacagatcactttgatagatctgcttggcgtacatttcgaacacctggccctggttgaggaaaatcaccttgtagattggagcttcacgtttggtcatggtgggcgcggaacacatggggatataaaagagggcgcgaactatagcatggcacccgatgcacagcgctaggaaccgatgggcatgccccctataatgcgcggttctttaccaccagttgacgattcccatggccaagaagctttatatcgaaacccacggttgccagatgaacgagtacgacagctcgcgcatggtcgacctgctgggcgaacaccaggccctggaagtcaccgcccgcgccgaagatgccgacgtgatcctgctcaatacctgctcgatccgcgagcgggcccaggaccgtgtgtactcccagctgggccgctggcgcgaattgaaactggccaacccggacatggtgatcgccgtcggcgggtgcgtggccagccaggaaggcgctgcgatccgtgatcgtgcgccctatgtcgacgtggtcttcggcccgcaaaccctgcaccgcctgcctgacatgatcgacgccgcacgcatcaccaagctgccccaggtggacgtgtcgttcccggagatcgaaaaattcgaccatctgcccgaaccgcgtatcgacgggccgagcgcctacgtgtcggtgatggaaggctgcagcaagtactgcaccttctgtgtggtgccctacacccgcggtgaagaagtcagccggccgtttgacgacgtactatcggaaatcatccacctggctgaaaacggcgtgcgtgaagtgaccctgctgggccagaacgtcaacggctaccgtggcctgacccacgacgggcgcctggccgacctggcggagctgatccgcgtggtcgccgccgtcgacggcatcgagcgcattcgctacaccacctcgcaccccctggagttctcggacagcctgatccaggcccacgccgaagtgccggagttggtcaagcacctgcacttgccggtgcaatcgggctcggaccgcatcctgtcggcgatgaagcgcaaccacacggcgctggaatacaaatccaagctgcgcaagttgcgcgccgctgtaccgggcatttgcatcagttcggactttatcgtcggcttcccgggcgaaaccgaaaaagatttccaacagaccatgaagttgatcgaggacgtcggtttcgacttctcctactcgtttgtctacagccagcgcccaggcacaccggctgcggacttggcggatgaaaccccggaagcgctgaaaaaagagcgtttgaacgcgctgcaacatcgcctcaaccaacagggtttcgagatcagccgacaaatggtcggttcgatccagcgcatcctggttacggattactcgaaaaaggacccgggtgaattgcagggccgtaccgagaacaaccgcatcgtcaacttccgttgcgatgaccccaccctgatcggccagtttgccgatgtgcacatcgatgcggcgcaaccgcactcgctgcgcgggtctctggtgtaataatttgcagatcaaaatgtgggaggggcctaatgcaacattccgatgacgtaagtgctttcgtacccgcgccactggcgttattctctctcccacctcatcagccaaagggcggctaaaagcaaccttgaacgcacccatagcagaaccccatcgttttctcctcgagccttttgaggctcgccgtttcgccaacctgtgcggacagttcgacgagcacctgcgcttgatcgaacaacgcctgagcatcgagatccgcaaccgcggcaatcagttcgaactcattggtgaaccccaacacaccacgtctgcagaaaacctgctgcgtcgcctctaccgcgagaccaagggcagtgagctgtcgccggaaacggtgcacctgtacctgcaggagtccgccgtggaagacctggccaacaacccggtggccgaagccagcgtggccctgcgtaccaaaaaaggcatgattcgcccacgcggcttgaatcagcagaagtacgtcaaggaaatcctcggcaacgacatcaacttcggcatcggcccagccggtaccggcaagacctacctggccgtggcctgtgcggtcgatgccctggagcgcgagcaggtgcgacgcatcctgctggtgcgcccggcggtcgaggccggcgaaaagcttggcttcctgcccggcgacctggcccagaaaatcgacccttacctgcgcccgctctacgacgcactctacgagatgctcggctttgaatacgtcgccaagctgatcgagcgccaggttatcgagatcgccccgctggcctacatgcgtgggcggacgctgaacaacagcttcatcatcctcgacgaaagccagaacaccacggtcgagcagatgaaaatgttcctcacccgcatcggtttcggttccaccgccgtgatcactggtgacgtcacccaggtcgacctgcccaagggcaccaagtccgggctggcgcaggtgatcgaggtgctcaaggacgtgccgggcatcagctttacgcacttcatgcccaaggacgtggtgcgccatcctctggtgcagcgcattgtcgaagcctatgagcgtttcgaccacaaggacgacgcaccggccaaggacgttcgccgcgatgcttgagcttgacctgcagctggccaccgaagcgcccgcccccagcgaagcccagttccgccagtggtgcgccctggccctgcgccagcgcagcgccgactcggaactgaccattcgcctggtggacgagcccgaaggccgcgagctgaaccatacctggcgccagaaagactacgcgaccaacgtgctgtcctttcctgccgacgtacccgacgagctgctggatatcccgttgctgggcgacctggtgatctgcgtcgaagtggtcgagcgcgaggcgaaggaacaacgcaaggaacttgaggcccattgggcccatctagtcatccacggctgcttgcatctcttgggctacgaccatatagacgatgacgaagccgaggaaatggaagcactggaacgaacgttgcttgccgaactgggtcatcgcgacccgtacgcagacgacgaaagctgatcaacactcaactgtcatatcaaaggatttagagtaatcgctatgagcgaagaccgatcgagcaacgggcagaagtcatggctgggtaaactgacccaggcttttgcccacgagccgaaaaaccgccaggagctgctggagttgctgcgcgaggcccaccagaacaagttgctggacagcgaagcgctggccatcgtcgaaggcgccatccaggtggctgacctgcaagtacgggacatcatggtcccgcgttcgcagatgatcagcatcaaggcgacccagaccccacgggaattcctcccggccgtgatcgactcggcgcactcgcgctacccggtgatcggtgaaagccatgacgacgtcatgggtgtgctgttagccaaggacctgctgccgctgatcctcaaggaaaacggcgacagcttcaacatcaaggacctgctgcgtccggccacattcgtgcctgaatccaagcgcctgaatgtgctgctgcgtgaattccgcgccaatcacaatcacatggccattgtgatcgacgaatacggcggcgtggcgggcctggtgaccatcgaggacgtactggaacagatcgtcggcgacatcgaagacgagcacgacgtcgaagaagacagctacatcaagccgctgcccagcggtgacttcctggtcaaggcgctgacgccgatcgagaacttcaacgagtttttcgacagcgaattctccgacgacgagttcgacacggtcggcggcctggtgatgagtgcgttcgggcatctgcccaagcgtaacgaaaccaccgagattggcgcctatcgcttccgcattttgaatgccgatagtcgtcgtatccatctgatccgtttgacacctattgcccgctaaggaatgacatgcagcgcctgaaccgccccggctggcccggtaacctgctggccgtggtggccggcgccatcactaccctggcgctggcgccgttcgatatctggccgctggcgctggtagcggtcggtttgttctatatcggcctgcgcgaactgacgccccgccaggccctgggccgtggctggtgtttcggtttcggcctgtttggtgccggcaccagttggatctactacagcatccaccacttcggcggcgcttcggtgctgctggcggggttcctgatgctgctgttcaccgccgccattgcctggttcttcgcgctgcccgcctggctatgggcgcgctggctgcgccgcaatgaggcgccattggcggatgcactgacgtacgcagcactgtgggtcggccaggaagcgtttcgaggctggttcctcaccggtttcccctggttgtactccggctacagtcaactcgacggcccgttgaccggcctggcgccgctgggcgggatgtggctgatttccttcgccctggcactgactgccgcgctgctgtgtaacctgccgcgcctgttggcgagcaagcgcaatgccttcatcggcgcgggcctggtgttgctggtagcaccctgggccatcggcctggccctcaagcatcacgcctggacctcgccttcgggcgccccgttgagcgtggccgcgatccagggcaacgtcgaacaaagcatgaagtgggaccccgatcagctcaatgcccaactggcgctgtaccgcgacatgagcctgagctccaagcgggtcgacctgctggtatggccggaaaccgcagtgcctgtactcaaggagtccgtcgagggctacctgggcatgatgggcaagtttgccgccgatcggaataccgcgttgatcaccggcgtgccgattcgccaggaagtgcaccaccagaagcgctactacaatggcatcaccgtagtcggtgaaggcgacggcacgtacctgaagcaaaaactggtgccgtttggcgagtacgtaccgctgcaggacatgctgcgcgggctgattgccttcttcgaccttcctatgtcggacttcgcccgcggcccatcggaccaagccatgctccaggccaagggttatcagatagcgccgttcatttgctatgaagtggtgtacccggaattcgctgccggcctgtcggcccagagcgacctgctgctgaccatcagcaacgacacctggttcgggcgctctatcggcccgttgcagcacctgcaaatggcacagatgcgtgcgctggaagcgggccgctggatgatccgcgccaccaacaatggcgtaaccgggctgatcaacccgttcggacagatcaccgcacagatcccgcaattcgagcgtggcattctttacggtgaagtggtgccgatgcacaacctcacgccgtacctgcaatggcgttcgtggccgttgattattgtgtgcctggggttgtttggctgggcgctgttggctggccggatgtccaaaaccgtttaaccggacaaacaccaaacaaatgtgggagggggcttgctcccgatagcagagtgtcagtatcaaatgtactgactgacacactgctatcgggagcaagccccctcccacatttttatcctacggtgttactgataaaacacccggtatcccacctgccccaccgcctcattgatcaactgcccgctctgccacaccgccttgacgtccggcatccagccgcccagcggccggccgtgatccacgcccagaaagcccaccggccctggcaccacggtgaatcccgccttctcaaagctccacaccgaacgcggcatgtgccaggcttgagtcaccaccaccacacgcttgataccttgcggtaatagaatctcagcgctcatctgggcgttttcccaagtggtacgactgcgctcttccttccagcgcacgctgacaccgaagtcatcctgcatcgacacggccatcatctcggcctcgctgggcggcgtgccgtagtgcaagccgccactggtcagcaccggcaaacctgaggccttggccagtcgcgccgcataacgctcacgctccaagccaatgccggtgggctggtcgctgccccaggcaatatccccacgctcacgtcccgagcccagcaccacaattgcatcggcacgctgggccagcgtggcccagtcttcgcgagccaaaggcggttcagtctcgagggcacgggcgccccattgcaccatcaccggcaggctgatcaaccacatcccgcccagtccgagggcaaagcataatccggccagacgcgggcgactgcgacgaaaccaccaggcaagcgccaacagcagcaaaaagataccgggcggcaacaacaactgtttaatgaaatagcgaaaaggcatcgggcatctccaaagatgcccgaagcctagatgcaacggggttgagcgacaatctttaccagcctgtttcgagaaaattaacggatggcactgtgcttcacttgcaccgtacggaccgggatttttccgagccgcgaccggccgccagatccttcagccagacaaccttggccgaacgaggaggctcttggataggcggggaggcctgtccatgagaggcgcggtggtgattcaactccaggtagttcttgatcagttcaagttcagcctggctcaagcctcgcaactccagctccagaggccgttcatcacgcaatcggcctgcggttcttgcggcatccaatgcccgacccaaacggtcgatcaatccctcatacaactgcggtttcgttaaagttcgctgcgattcaaccatcccctcacctcattgaagaaatacttgctccccactaaacagcgtagcccccgttgctgcgcctgcccgctgccgcgacagacggcccttgccgcgcaatcagggtttccctcgatagagtggggtcatgtatgctacggcgcttcctgtaactccacttcccgcagggtttgggcacggacgcgccgcttcttggtgtcgaacaacccggacagtgcaccgaagaggattaggccacccctatccagttcaaaagtagccatgcacgaacaatatcagccccgtgaaatagaaaatgccgcccaaacgttctgggacgagcagaagtcctttgaagtcagtgaacagccaggcaaggagacttactactgcctgtcgatgttcccttaccccagcggcaagctacacatggggcacgtgcgtaactacaccatcggcgacgtgatttcccgctaccagcgcatgctcggcaagaacgtcctgcaacccatgggttgggacgccttcggcatgccggcggaaaacgccgcgatgaaaaacaacgtggcccccgccaagtggacctacgaaaacatcgcctacatgaagacccagctgcgcagcctgggcctggcggtggactggtcccgcgaagtgaccacctgcaagccggactactaccgctgggaacaatggctattcactcgcctgttcgaaaaaggcgtgatctacaaaaagagcggcaccgtgaactgggacccgatcgaccagaccgtactggccaacgagcaggtcatagacggtcgcggctggcgctccggcgcgctgatcgaaaagcgcgaaatcccgatgtactacttcaagatcaccgcctacgccgatgaactcttgtcgagcctcgatgacttgccgggctggcctgaacaggtcaagaccatgcaacgcaactggatcggcaaatccaagggcatggaagtacagttcccgtacaacgtcgattcgatcggccaagcgggcacgctcaaggttttcaccacccgtccagataccttgatgggcgcgacctacgtcgccgtggccgccgaacatccgctggccacccaggccgcacagaacaaccctgaactgcaggcattcatcgccgaatgcaaaggcggcagcgtggctgaagccgacgtcgccacccaagagaagaaaggcctgcccaccggcctgttcgtcgagcacccgctgactggcgagaaactgccggtgtgggtcgccaactacgtactgatgcactacggcgatggcgccgtaatggcagtgccggctcacgacgagcgcgatttcgaattcgccagcaagtacgacctgccgatcaagtcggtagtacgcaccagctccggtgacaccaaccctgccccgtggcaggacgcctatggcgagcacggcaccctgatcaattccggcgagttcgacggcctggatttccaaggcgccttcgacgccatcgaagtcgcgctgatcaagaagaatctcggcgcctcgcgcacccagttccgcctgcgtgactggggcatcagccgccaacgctactggggctgcccgatcccgatcatccactgcgaaagctgcggtgacgtgccggtgccggaagatcaactgcccgttgtcctgccggaagacgtggtgcccgatggcgctggctcgcccctggcgcgcatgcccgaattctacgagtgcagctgcccgaaatgcggtgcaccggccaagcgtgaaaccgacaccatggacaccttcgtggagtcctcgtggtattacgcccgttatgcctcgccgcactatgaaggcggcctggtggaaaaatccgcagccgaccattggttgccagtggaccagtacatcggcggcatcgaacacgccattctccacctgctctatgcgcgcttcttccacaagctgatgcgcgacgaaggcttggtgagctccaatgagccgttcaagaacctgctgacccaaggcatggtgatcgccgagacgtactaccgccgtgaagccaatggtgcctacacctggttcaacccggcggatgtcgagctcgagcgtgacagcaaggccaaagtgatcagtgccaagctgaaatccgacggtctgccggtggaaatcggtggcaccgagaagatggccaagtcgaagaacaacggtgtcgacccgcagtcgatgatcgaccagttcggcgccgacacctgccgcctgttcatgatgttcgcctcgccgcctgacatgagcgccgaatggtccgactccggcgtcgaaggttcgcaccgtttcctcaagcgcgtctggcgcctggcccacgcccatgtcagccagggcttgccgggcaagctggacgtcgcagccttgaacgacgagcagaaagccattcgtcgcagcacgcacctggccatccgccaggccagccaggacgtagggcagaaccacaagttcaacaccgccatcgcccaggtgatgacgctgatgaacgtgctggaaaaagccccgcaggctacagaacttgaccgcgcgctgatccaggaaggtctggaaacagttactctgttgctcgcgccgatcacgccgcacatcagccatgaactgtggagccgtctgggccacagcggcgccgtaatcgatgccgcctggccagtgcaggatgacagcgccctggtacaggacacgttgcaactggtcatccaggtcaacggtaaactgcgcggccagatcgacatgccggccagcgccagtcgtgaggacgtggaagccgccgcacgcatcaacgaaaacgtgctgcgctttaccgaaggcctgacgatccgcaaagtgatcgtggtgcccggtaaactggtcaacatcgtcgccagctaaatcggatcgggcgcgaggcttgggccctgcgccgaactaaacctttagggcctcgatacggcccacatggtttcaaggggagcaacaaaatgatcaaacgcaatctgctggttatgggccttgccgtgctattgagcgcttgcggcttccagctgcgtggcaccggtaccaatgagctgtcgctcaaggaactcgatgtcagcgcccgcaacgcctatggcgacaccgtgacccagctgcgccagaccctggaaaacagcggtgtgcacgtgtacaacggcgcgacctacaaactgatcctgacggatgaaaaagaaacccagcgcaatatcagctacgccagtgccggccgtgcatccgacgtcgagttgaacactgcgctctacttcgaagtacaaggccgcgataacttgccgctgatgggtgacaagatccaggtgcagaaggttgtcagccacgacggcaacaacctggtgggttcagactccgagaccctccaggtgcgcaaggaaatgcgtcgcgagctgatccagcgcatgatgacgcgcctgcaaatgctgaccccggaaaagctcgccgccctgcagcaaaccgccgacaacaaggccaaggctgatgccgatgccctgaaagccgcgcaagagtatgaagacaacacgccgaaacaatcgcctgttgaagtcccagtcgagtaagccaggcggggcgcccctggcgccccgttcgacccgcctatgaaacttgcccctgcccaactcgccaagcacctgcaaggtggcctcgcgcctgtctatatcgtcagcggcgatgacccgctgctgtgccaggaagcggccgacgcgatccgcgccgccgcacgtcagcaaggcttcgacgaacgccaggtcttcagcgccgacgccagtttcgactggggtacattgctgcaggccggcgccagcatgtcgttgtttgccgaaaaacgcctgctggaactgcgcctgccttcgggcaagccgggcgacaaaggcgcggcggcattgatggaatactgctcgcgccctgccgaagacacgatcttgctggtcagcctgcccaagcttgacggcagcgcccagaaaaccaagtggggcaaggcgctggtagaaggtccgcaaacccagttcatccagatctggccagtggatagcaaccagttgccgcagtggattcgtcagcgcctgtcacagtcgggtctggcggcgacacaagatgccgtggagttgatcgccgcccgggtcgagggcaacctgcttgccgccgcccaggagatcgaaaagctcaagctgatggccgaagatgggcagatcactgtcgaaaccgtacaaggcgcggtcgccgatagcgctcgcttcgatgtgttcggcctggtggatgcgattctcaacggcgagcccgcccacgccctgcgtatgctcgaaggcctgcgtggcgaaggggtggaaccgcccgtgattctctgggccctggctcgggagttacgggtactggcgaacatcgccctgcaatacagccagggcatccccctggacaaatgtttcagccaggccaggcctccggtgtgggacaagcgcaaaccgctgatgagcaaagccctgcaacggcactcggcgcaacgctgggcacaactgttgctggaagcccagcgcatcgacgcccagatcaagggccaggccaccggctcaccgtggatgagcctgagccgtttgtcgctgttgatggccggccagcgcctgacgctgccagccgaatgacactctcttaaaaacaccatagatccaatgtgggagggggcttgctcccgatggcagcgtgtcaggaatttatatttcactgatgtaccgctatcgggagcaagccccctcccacattagacctgcatacatttcctacagatcgccgggctttacagtcgctcaacttcggcagattatttgcccgctccacttaaaccaatgagagaaccatcatgagcaaaaagccatccaagcatggccccaacaaggccaaatccatcatcgcccagcccttgttccgcagccgccaggaacgcgccggcaagggcaaaggcagctaccgccgcgaagccttccagtctaatagctgggaggcttcttactttctggctgcctgaaggcaagcgcccctctggcatgataaggtctatacctgatttgtaaccccctggacctgtgcatgccctctagtctttctcgtcgttggcaccttcgccaattgatcgctgcctccagcctcattctgctcgtcgcctgcgcggaaaaacctaccgccgcggatgcgcaacccctgcccaagctccagaccgcaccggccatcgcgccagccgtggttgccccgctggcagtggacaacctcgacatccaaccgacccagaccttcgccgaatggcaggcgggctttcgtgcgcaagccctgcaggccgggatcacagccgacgttttcgataacgcctttgccggcgtcacgcccgatatggcggtgatccgcgccgatcgcagccagccggagttttcccgcccagtgtgggaatacctcgacggcgccctgtcaccggtgcgcgtgcgtaatggccaggcgctgttggtcaagtacgccgatatcctgcaaagcattgagcagcgctatggtgtcgaccgccaggcgctggtctcggtgtggggcatggagagcaacttcggcgcgttccagggcaacaactcggtgatccgctccctcgccaccctggcctacgaaggccgtcgccctgcctttgcccaggcgcaactgctggcagcactgcagatcatccagcatggcgatattcaggccgaccagatgaaaggctcgtgggccggtgcaatgggccaaacccagtttatcccgaccacctataacacccacgccgtggacttcgacggtgacggtcgccgtgatatctggaacagcccgtccgacgccctcgcctccactgcgcattacctgcaaagctccggctggcagaaaggccagccttggggggttgaggtgcagccactgccgtcgggcttcgactacagcctggccgatgggggcatacgcaaaactgttgcgcaatggctgcaactggggatccaactgccgccaggcgtgagcctgccggccaatgtcgatcagttgtccgccgcgttgctgctgccggccggctaccgcggcccggcattcctggtactggataacttccgcgcgatcctcaagtacaacaattcgtcatcctatgcgctggcggttggcctgttgtcggagcgatttggcggcggcggtgtgattcgtggcagttggccaaaggatgaactgccgctgagtcgttcccagcgtatggatctgcagacggccctcagcgccaagggttatgacgcgggcaacccggacgggattatcggcgccaatacgcgcaaggcgattcgtgcggcgcagcaggcattgggctggccggcggatgggtatccgacggtgaagttgctggaatccctgcaaggccggtagattgacttatggcgactaccgtaatcgggggcaagccccctcccacacttggagtgcattccaaaaatgtgggggggcttgcccccgattgcggtttagcagactgtaaaaaactcagtggttgaacactacgccctgctccagcaccaactgctgctcccccgcatccaggcgcaccaaagcgcccatcggcaacgtcaggttcgggtcgcaatgaccactgcgccagcctgccagcaccggaatgcacagcggttcgaaggtctgcttgagcaaccgctccagcgcgacgttatccacacccgccacgtcccctaccagcacaccggcaacctgagccagcttgcccgccaggcgcaggtgaatcagcaggcggtcgatacgataaagcggctcgttgacgtcctcgataaacaggatgatgccttcggcgtctatctcatacggcgtgcccattattgcggcaatcatcgacagattaccgcccagcaagcgcccacaggcaatgcctggttcgatcgtggtcaatggataggccgcaggatgcgcaagcacgctgccggcgcccagttgaccacgcagcaggctgagcaatgaggattcggtgggttgttgcttgccgccaagcaggtcggcattgagcatcggcccgtggaacgttacaaaaccggcataacggttgattgccaggtgcaaggcggtgatatcgctgtagcccacgaatggcttggggttggcgcgcagcaggtcgaagtccagcgcgtcgagcaagcgcggcgtgccgtagccgccgcgcaggcaaaggatggcatcgatgtcggggttggcgaaggcggcgtgcaggtcgcgcaggcgcactgcatcgctgccggccaggtagccgtcgcgttcgtatacaccgggataaatgcgcaggtcgtagccacgggcacgcatccattgcccggctttttcaacgtccagtgcagcagggccggcgggggcgatcagggcgatggtgccttcagaacgaagggctggaacggctggcgtcatatacaactctccctagtcaacgcggaacgaaatgtgggagggggcttgcccccgatggcggtgtgacagtcaattcatgaagaactgatacaccgctatcgggggcaagccccctcccacattggacttgcggtgttgcaaaggcctctatcaggaaaccaggctcgccttgaccagcttggcctgctcatcggcatggtacgaagaacgcaccaacgggccggacgccacgttcttgaagcccatcttgtaaccttcctcggcgaaccaggcgaaggtgtccgggtgcacgaaacgctgcactggcaagtggctgcgggacggttgcaggtactggccaagggtcagcatgtcgatgtcatgctcgcgcatgcgcttcatgacttcgatgacttcttcgtcggtttcgcccaggccgagcatcaagccggacttggtcggaatgtgcggcatcatctgcttgaatttctgcagcagggtcagcgaccactggtagtccgaacccggacgcgcagccttgtacaggcgcggcacggtttccaggttgtggttgaacacatccggcggctcggcggcggtgatttccagcgcgacgtccatacgcccacggtagtccggcaccagggtttcgagcatcacattcggcgacaacttgcggatttcgcggatgcagtcggcaaagtgctgggcaccgccgtcacgcaggtcgtcacggtcaaccgaggtgatcaccacatacttgagtttcaggtcagcgatggcgatggccaggctttccggttcgttgacgtccagaggcttcggacggccgtggccgacgtcgcagaacgggcaacgacgggtgcagatgtcgcccatgatcatgaaggtggcggtgccgccggagaagcattcgcccaggttcgggcaggacgcttcttcgcacacgctgtgcagcttgtgcttgcgcagcagcgccttgatacggtcgacttccggcgataccgggatgcgcacgcggatccagtcgggtttcttcggcagttcggtggtcgggatgatcttgaccgggatgcgtgcaaccttctcggcgccgcgcagcttgacgccggcttccaccttggcacgcggggccggggctggacgctcggtgatgtccagcgtcgggatcatggtttgcactgcatcagtagtcataatcagtcgattccgcccgtgagggtcgtctgctcagcatagtcgaggtgtttgacgagctgcgcacgcagccgggcactaacctcggcaaatttaatcggtgtggcgtggtcactcagctgtgtcatcgccagcccggcgtaaccgcacgggttgatgcgctggaacggcgccaggtccatgtccacgttcagggccaggccatgaaaggaacaaccatggcgaatccgcaagcccagggaggcgatcttcgcgccatccacatacacaccgggggcatcgggcttggctgcggcgctcacgccataactggccaacagctcaatcaggcaagcctccatgcggctgaccaggtcgcgcacgccaaaccccagcttgcgcacgtccagcaatagataagcgacaagctgaccgggcccatggtaagtcacttgaccccctcggtcgacctgcaccaccggaatatcacccggaagtagcagatgctctgccttgccggcctggccctgggtgaataccggtggatgttccaccagccagatttcatccggagccgaggtgccgcgctcgttggtaaagcgctgcatggcatgccagaccggctcgtaggccatccggccgagctcgcgaaagcccaggacttctgacatcacagcaccatgtgcacgaagccggtggcccgcagttcgctgttgatgttgtagagctggtcttgatcggtcgcaacgatgtgcaactgaatcgtggtatacttgccggtggagctttgacgctcgtccacgcggttgtcgttgatcgtcgcatgcttcctgacgatttcgagaatcttgtccttgcggccgacaccggtatcgctgatcaccttgacgggataatccgtcaccgggaattcgatctttggcgcctttacttctacgtctttatcggtcatggcagaacagcctcgtaagcgctaagccgtggcgacgggcaaagccccgcgctggatcaacgcggggctttgcaggtgcacacaatcagttgaacaagccgtagaagaatagacggatgctatcccatacgcggcggaagataccaccttcgtcgaccgcgtccagtgcgatcaggtcggcgctgtgcaccaccttgtcttccagcttgacttcgactttaccgatcacgtcgcccttggcgattggcgcaaccaattgcgggttcagggtcatgctggcagcgagctttttcagctggcccttaggcatggtcagtgtcagatcgtcggccagaccggccttgacttgggaggtcgcccccttccagaccggtgcggtcgccagctcagcacccttctgatagaaggtctgggtttcgaagaagcggaagccgtaggtcagcaatttctgcgtctcggccgcacgggcctgctcgctgttggtgccgaataccacggcgatcaggcgctggccatcacgtacggcggacgacaccatgcagtagccggcttcgtcggtatggccggttttcagaccgtcgacggtcttgtcgcgccacagcaacaggttgcggttaggctgcttgatgttgttccagaagaattccttctgggagtagatcgcatagtgcaccgggtcgacacggatgattgcgcgcgccagcagcgccatgtcgtgagccgacgagtagtgctcagggttcggcaggccagtcgggttcatgaagtggctgttggtcatgcccaggtcgccggccgtcttgttcatcatgtcggcaaaggcgtcttcgctgccggcgatatgctcggccagggcgacactggcgtcgttaccggactggatgatgatgccgtgcagcaggtcgctcacggtgacttgcgaacccaccttgatgaacatccgcgaaccgccggtgcgccaggcgttttcgctgacggtgaccggatcgttttcgccgatctggccgcgacggatttccagggtcgcgatgtaggcagtcatcagcttggtcaggctcgccggcggcaggcgctggtcaccattgctctcgaccagcacgttgccactggcggcatccatgaggacccaggacttggcggccagttgcggggaggccggcaccatttcaaccgcccaggcggccggggtgatgatcagcgagataagcaggcacgtgcgtttggctaaggtggtgatgttcatccgtctctcgaaattgcttatggaaacttgccctcgcgggcaaaactattcagacagcccgcttccaggctgtcacgtattcggttgcccgctcaccccttgcccctgggtttttattgttcacgagccaacaacctgggctcgagcgcgcatgcgcgcctgagccatcaaaccaatactgcttattctgcggtgaccacgctgggttgccccaggttagccaggcgtacgctgttctgcacttgggctacctcgctcggcgagccgatcgggcccatgcgtacacggtgcaaggtttgctggttacgcacgatggagctgataaagactggcgcgctgaccatgccgctgagcttggaccttaacagttctgccgcatccgggttggcgaaagcgccgacctgcaggtactgcccgcccacggtagacgcgcccggcgctgcatggggtaccaccacggtatccggggcatgctgcgccggcggcggcgtccactgctcgatcttgccggtcgaggccgtcacctgcggttgcggagcctgcggttcgttgagcatcaacggcgccggcttgccgcgctgggcccagtactgcgcggggtcgataccttcgactttcacccgtgcggtgccggtttcggcataaccgagcttcttcgccgcggcataggacaagtcgatgatccggtccgaatagaacggcccacggtcgttgacgcgcaggatcaccgtgcggttgttgtccaggttggtcacgcgcacatagctgggcagcggcagggtcttgtgggccgcgctcatgccatacaggtcatacacttcgccattggcggtgttctggccatggaacttggtgccgtaccaggacgcggtacccgattgcacgtaggtcttggattcctgcagcgggaagtaattcttgcccagcacggtataggggttggccttgtaggggccggtgtgcagggtcggcgtggcatccgggattttcgacacatccacatcccaccacggcgcgccgtctttgtgcgcgcggttgatgtccaggcccggttgggcgcggaccaccgcaccgccggccttcttggcaggcgcacggttagggctggtggagcaactggcgaccagcaggcacaacgcggtgaacgccaccagcttgagcggttttttgaacggcgatacccgcattacttgttgccccgtgctttgaccagctcgtctgacagctgatgtacggccatggcgtacatcacactgcggttataacgcgtgattgcgtagaaattcttcaggcccatccagtattccgggccgtttgcgccttccaggcggaatgccgtcaccggcatgtcatcgcgtggcgcattctgactcgaccagcccagcgctcgcaactccccgacggtcttgaccggctcgataccctgggtcaggccctcatcggcgcgctcaccgctgacatcggcgcgaattaccaccggctcaccggctacccagccgtggtgcttgaagtagctggctacgctgccaatggcatcgtcggggttgctccagatgttgatatgcccgtcaccgtcgaaatccaccgcataggcgcgaaagctgctcggcatgaactgcggcaaacccatcgcacccgcgtaggagcccttgagggtcagcgggtcgacctgctcttcgcgggccagcaacaggaattcacgcagttccttgcggaagaattcggcgcggggcgggtaatcgaagcccagggtcgataaggcgtcgatcacccggtaactgccggtattgcgcccgtagaaggtttcgatgccgatgatcgagacgatgacctgggccggtacaccgtattcctgctcggcgcgggccagcaccgcctcgtgctggcgccagaagtcgacgccccgggctacgcgggcgtcggtgaggaacatcgggcgatattccttccactgcttcacacgttcggcggggcgggaaatggcgtcgagaatcgcctgcttcttctgggcttcgcggaacacgcccatcagttgctcaccggcaaaaccgtagtcgcgggtcaactcaccgacaaattcggcgacctggggtgaaccatcgtagtcaccggcctgcgcctcttgcgttgcgcccaggagcccaatcaggcccacacaggtcgcatgccgagtcgcccagccgcgcattacttgcattgacatcttcaccttattcaaacctgtgcgatccatttgcgatgcgtatgaatcgacatcaaaaccccaaacgctgacatcaatgtcaccagcgaagttccgccgtagctaatgaatggcaacggcaccccaaccaccggcagcaggccactgaccataccgatgttgacgaaaacgtaaacaaaaaaagtcatggtcaggctgccggcaagcaatttaccgaacagcgtctgtgcctgggcagtgatcaccaggccacgaccaatcaacagcagatagatcagcaacaaggcgcaaatgcctaccaggccgaactcttcgcccatcaccgcaatgatgaagtcggtgtggctctcgggcaagaagtccaggtgggactgggtgcccagtaaccagcccttaccaaatactccgccggaaccgatggccgccttggactggatgatgttccagccggtgcccaacgggtcgctctccgggtcaaggaaagtcaggatccgttgtttctggtagtcgtgcataaagaagaaccacatggccacggccacggggatggccgcggccagcacgctgaggatccagcgccagcgcaagccgcccatgaacagcacgaatgcgccgccggcgagaatcagcaacgaggtgccgaggtccggctggcgcacgataagaatgaagggcacgccgatcaggatcaggctgatgcccacatgcttgagctgtggcggcaaggtgcgcttggacaggtaccaggcaatggtggccggcatcaggatcttcatgaattccgacggctggaagcggatcacccccgggacgttgatccagcgcgtcgcgcccatggcgttgtggcccatgacatccaccaccaccagcagcagcacgccggcgacataacccaggggcacccagcgtgccatgaagcgcggctcaagctgggcgatcaccaccatcgacaacaggcccaggccgaacgaggacgcttgcttgatcagcaggtcccagttcttgccactggccgaatacaacacgaacaggctaccggccgccagggtcagcaggaggatcagcaacggcccatcaatgtgcatgcgttgcagcaacgtcgcacggcgacgcatcacgtcctcgctggagaggatgcggtcaaaattactcttcacgggccgtaacctcggggcttgaaggggggccgccatattcgggcttgagcttgccatcggcggccagcagccaggcgtccatgatctggcgcaccacaggtgcggcgacgccggagccggactcaccgttctcgaccatcaccgccaccacgatcttcgggtcctcggccggggcaaagccgacaaacaaagcgtggtcgcggtggcgctcctgaaccttggagcggtcatatttctcgccctgcttgatcgcgaccacctgggccgtaccactcttgccggcgatgcggtattgcgcgccggccgccgccttgcgtgcggtcccacgggcgccgtgcatcacttgctgcatgccatggttgaccttggcccagtcggacgggtcgcgcagcacaatgtcggggatcgggttttcatccactggcttttcgccttcgatggtcttggccaggtgcggacggttccagatgcccttgttcgctaccagtgccgtggcctgggccagttgcagcggcgtggcctgcatatagccctggccgatcccgaggatcagggtttcacccgggaaccatgcctggcggcgggtcgcacgcttccactcacgcgacggcatcaggccgggagattcttcgaacatgtccagggagactttctgacctaggccgaacttgcccatgtaggcagacaggcgatcaatcccaagcttatgggccaggtcgtagaagtaggtgtcgttggagcgcatgatcgcggtgtccaggtcgacatagccgtcaccggagcggttccagttacggtatttgtggtcgtagttgggcagcatgtagtagccggggtcatagacgcggctggaggccgtgaccacgccggaatccaggccggcaatcgccaccgccggcttgatggtcgaacctggcggatacaggccgcgcagcacccggttgaacagcggccggtcaatggaatcgcgcagctcggcataggccttgaaactgatcccggtgacgaacaggttagggtcgaaactcggctggctgaccatcgccagtacttcgccggtcttcgggtccagggccacgaccgcaccacgccggccacccagggccatctcggccgcttcctgcagcttgatgtccaggctcagcacgatgtccttgcccgggatagggtcggtacgcttgagcacgcgcaatacacggccacgggcattggtctcgacttcttcgtaacccacctggccgtgcagttcgggctcgtagaaacgctcgatgccggtcttgccgatatgatgggtgccgctgtaattgaccggatcgagggttttgagctctttctcgttgatccgccccatgtagccgaccgagtgggcaaagtgcgggccttgtggatagtggcgcaccaactgtgccaccacttccacaccaggcaggcggaactggttcaccgcaatgcgggcgatctgctcttcggtcagctcgaacaggatcggcaccggctcgaacggccggcgcccctgcttcatgcgtttctcgaagatcacccggtcttccggcgtcagttgcagtacctcgacgatcacatcgagcacctgctgccagtcgcctgaacgctcgcgggtcatgctcaggctgaagctggggcggttatccgcgaccaccacgccattgcggtcgaagatcagcccgcgggtcggtggaatcggctgcacatgcacacggttgttttccgacagcgtggagtgatagtcgtactggatcacctggaggaaatacagccgcgcaatcagcacgcccatcaacgccaccaccaggatggcaccgaacaccacccgcgcgcgtaccagacgtgcgtctttctcgtggtccttgatgcggatcggctgggtcatcgggggcggcgcagactatttgtgataagggtgcccggacaggactgtccaggcgcgatacagctgttcaccgatcaggatccttaccaacgggtgcggcaatgtcagggccgacagcgaccaacgctgatcagcgcgggcgcagacttccggcgccagaccttccgggccacccaccatgaaattgaccgtacgcgaatccaggcgccagcggtccaattccaccgccaactgctcggtgctccaaggcttgccgtgcacctcgagggtgacgatgcgctcgttggggccgaccttggccagcatggcttcgccttcctgacggataaagcgcgccacgtcggcattcttgccccgggtattgagcggtatttccaccagctcaagcgacagctcagcgggcagacgcttggcatactcgtgccagccttcttccacccacttgggcatgcgtgaaccgacagcgatcagacgcaggcgcacagccgttccttattcctgatctttgttgagcttgtcgaagtgcgcgtggcccacttccgggctgtggtgcttgccatcggcggcacggctctgctcagcgcctttccacagacgctccaggtcgtagaactggcgggcgttggaggtcatcatgtgaacgatcacgtcgtccatgtccagcagcacccagtcgctgtcgcccttgccttcttcacccagtggcttgacgccttgggctttgacggcttcgcgaaccttgtccagcatcgcgccgatctggcggttggaagtaccggtagcgatgatcatgaagtcggtgatgctttgcttgtcgcgtacgtcgagcacctggatgtcctgggctttaacgtcttccagggcggccacggcgactttcaccagctcttcgccagccagttccgggccaacgtgggcttcaaccggcagcggcgcgcttttgaaggtgcctttgcgcttaactttgcttacgtctttgttcgtcatataaaactcgttttgctcgtatgttcgggcgcttgctgcacaactcgtgcgttcaagcgcgccttttcagttcgacgcacggtaaagcccgtgcgcatcgatgtaggccaggaccgcgtcaggcaccaggaaacgtaccgacttcccgctggccagcagttgacggatctgggtggcggacaccgcaagcggggtctgccagacgaatgcaatattcccgttcggcccggtcagggccaaggggtcacttaccgaccgcgcggccagcaggttgcgcaaggcatccggcggttcgctgtcggcatccgggcgttgcaaaaccaggatgtggcaatgctggaggagttcctcccagcggtgccaagagggcaggccgcaaaatgcgtcccagcccaaaagcagaaataactggtcatccgcggccaactcggcgcgcatcaattccagggtgtcgacagtgtaggacggtttatcgcgcttgagttcgcgatcgtccaccaccagcggcgctatgccctctaccgcaaggcgcaccatttccaggcgctgttgcgccgacacttgcggcgtatcacgatgcggcggccggaaattgggcagcagccgcacctcgtccagcgcaagggcatccgcgacttccagggcactgcgcaggtggccgatgtgcacggggtcgaaagtaccaccgagcagcccaatgcgtttagccatcaactgcgcacgtgaccgtcaccgaacaccacgtacttctcgctggtcaagccttcgaggccaaccgggccgcgcgcgtggagcttgtcggtggagataccgatctccgcccccaggccgtactcgaaaccgtcggcaaaccgcgtcgaggcgttgaccatcaccgaagcggaatccacttcgttgaggaaacgccgggcatcgctgaagtgctcggaaacgatagcgtcggtatgcttggagccgtacttgttgatgtgttcgatggcctggtccaggtcatcgacgatacggatcgacaggatcggcgccgtgtactcggtgtaccagtcctgctcgctcgcctcgatcacgcccgcgccgagcaacgcccgggtacgctcgcaaccgcgcagctccacgcccttgtcgcggtagatggcagccagcggcggcagcacgcgctcggcaatgccggcgtgcaccagcagggtttccatggtgttgcacggggcatagcggtgggtcttggcgttgtcggcgatgcgaatcgccttgtcgaggtcagcggcgatgtcgatatagacgtggcacacaccgtccagatgcttgatcaccggcaccttggcatcgcggctgacgcgctcgatcaggctcttgccaccccggggaacgatcacgtcgacgaactccggcatggtgatcaacgcaccaacggcggcgcggtcggtggtttccaccacttgcaccacttcggccggcaattcggccacggccaggccttgctggatgcaggcggcgatggcgcggttggaattgatcgcctcggaaccgccacgcaggatggtagcgttgccggacttgaggcataggctcgcggcgtcgatggtcacgttcggacgcgactcatagatgatgccgatcacgcccagaggcacgcgcatcttgccgacctggataccggatggcaggtagcgcatatcgcggatttcaccgatggggtcaggcagcttggccacctgacgcaggccttcgatcatgtcgtcgatacgtgccggggtcagcgccaggcgatccagcagagccggttccaggccattggcacggccgttggccaggtccagctcgttggcggcggtcaactcggagcgcgaggcatccagagcatcggccgccgccagcagcgcacggttcttctgcgcggtgctcgcacgggcgatcaaccgcgaagcctgacgggcagcgcgacccaggcgggtcatgtagtcaagaacggactcagtcatggtcagggagtcttggcaaagaggaaagcggcagattatagctgtgacgcagcacgactgacagcggtgaggggcggatggtcgaaatgaactgtaaaaacctgcggttcaggcgtaattaagctgggagttgttattattcggtcacatttagccgtaataaccctgaacgccatgtccggttttacccctctgctccccgccagcgccctgcccgactgcttcttcgaccgcgatgcgcaactgcttgcgcgagaattactcggcaaagtcattcgccatcgcgtcggtgatatctggctctcggcgcgaattattgaaaccgaagcctattacgtggccgaaaaaggcagccacgcctccctcggctacacagaaaagcgtaaggctttgtttctggacggtggccatatctatatgtactacgcccgtggcggcgattcattgaacttcagtgcccatggcccgggcaatgccgtattgatcaaatcggcctacccatgggtcgatgaaatctccggcccggccagcctggcccagatgctgctgaacaacccgaacgccgatggcagccctcgcccgacgcaaaaactctgtgccggccagaccttgctgtgcaaggcgctgggcctgaaggtgccgatgtgggacgccaagcgctttgaccaggagctgctgtatgtcgaggacgttggccaggtacctacgcagattatccagaccacgcggctgggcatccccagcgggcgcgatgaacacctgatgtaccgcttcgtagatgctggttatgcgctttattgcacgcggaacccgctgcgccgggggcaggtcgaaggccgcgattatttcttgatttgaacaggtggacccacgcaacacatccaatgtgggagggggcttgctccctcccacagttgatcatcagcgtttcagcatatgcattacagagatggagtggattgtatgggccaatggctcgatagcattaccggctggctgaccctgaacccgcaatggctggcagcggcggtgtttatcgtggcgtgcgtggaatgcctggccatcgccgggctgatcgtgccgggcacggtattgctgttcgcgattgccgcgctggccggcagcggcgcgctgtccttaagtgaaacgcttttgctgggcttcctcggcggtttattgggcgatggggtttcctactacctcggccgacatttccatcagaacatccggcgcctgcctggccttcgtcaccatcctgagtggatgaatggcgcggaaacctactttcacaaatacggtatcgccagcctattggtcggacggttcatcggcccgctgcgccccatgctgccaatggtcgctggcatgtgcgacatgcccttcccgcgcttcgccgccgtgagcattattgccgcagcgggctggtcggtggcttacctgatgccgggctgggccgccggcgccgcgttccgcctgccgctgccggagtgtttctggccggaggcggcagttatcacagcctgcctggcggtcctgctggggctgagcttgaacagcagctggcgcggccatcgtcgcgccaccttgtggatcggttgcgccagcctggtcttgttgattgcgctgtttatcggctacccccacctcaacgacttcgatcagggcctgagcgcactggtgcaggagcatcgcagcccttggctggacgaggtcatggtgcgggtcacccaactgggtgagttcaggaagatgtttgtcgcaagcgcagtgttcaccggcttgctgctactggcacggcaatggcgccacgctctgtttgtcggcgccacgctcgccggcgcggcggtgatcaacaccggcaccaagctgtttttcgcccgtgggcgcccggaaatcctcacagacccgttgaccagcttcagcatgcccagcggccatgcctccggcgcctttgcattcttcctggcgcttgcggtgctggccggccgtggccaacccacacgtctacgcctgacctggatgttgctgggttgtattcccgcggccttcattgccctgtcgcgggtttacctgggcgcccattggcccacggatatcctggccggcacgttgctggcgatgaccgtgtgcgcgttcagcctcaccgtcagcgaacaccgcagcccattgcctgcgatgtcgcaaaaagcctggtggctggtgttgccggccgtggtggccgtactcggctttatcgcttttaccggcacgccccacgcactgctcaggtacgcctattgacccttggccgggccgatccagtccaccgaagcgctgcggcgctcaacacaacgttcgcgccgctccagtagcatttcatcggcaatttcagcggcgcgctcggcgatgtactccgggccccgcgttgcatcctgctggagcaattgtgtggtcacgctgacaaagtacgcgtcccaggcaacttgctccgatggtgtcagacgaatcatggtcatccccgatcaattagtgtgatcggaaaatattgcaggcggcgcagctgagatggccgagcaaactctgaaagctccgtcagataaatctgaatcaggtgaacagttcgccctgcagctcatccagcaacatttgaatcgcatccaggcgttgctgcgggtcgtcgagttgcagcaggtcgaccttgtcggcctcggtgaacggcaatagataagccagctgattgcccagagcttgctgcccctcagcgtggccgcccatgtccagagaggcgaccatcgggtgctcggccaaggcctggagcaacgcaagcaagtcggcgtcctcctcttcaagcggccggtccggcagctcttccatccattgcacgtcggccaccagcagttggtctttctgcacgccggcatcacgcacacggaaacgccgaccgccttcgacacgaatccccagcaggccgttttcctgttgcttgaagtcgcgaatcagcgcctcacagccaatcaacgcgtagccctccggtgccatgccgacttccttgccgtcgaggatgcacaccacgccgaagctttcgccctttttcatgcagcggctgatcatgtccaggtagcgagcctcgaacagttgcaaatcgagggtgcagccagggaacagcacagtgttgagcgggaacagcgccagactcataaaggtttccttaaacctgggttaaacaattaccgataccgccagcggcaggaacactgccgtggccacgcccatcaggctcatcgccagcgccgcgaaggcgccacactcttcgctttcctgcagggccaccgaggtgccgacggcgtgggcagtcatacccagcgccatgccgcgcgcttcggggctgtgtacgcccaggcgcgtcaggtacgccgggccgatcatcgcgccgaccaccccggtgatcagcacaaacaccgccgccaaggccgcaacgccaccaatctgctcggcgaccagcatggcgatcggcgacgtcaccgacttgggcgccatggtcatcagcaccatatgttcggccccgaaccaccaccccagccatacacacaaaccagtggccaacaccccacctatcaccagcgtagtaaaaatcggccagaacaattggcgaatccgtcgcaggttgagataaagcggcaccgccagggccactgttgcaggcccgagcaggatgcccatgatctcggtgctcttgcggtattcggcatagctcaggccacaggtgagcagcacgccgatcaccagcagcatggacaccagcaccggctgcaggaagacccagcgggttttctcgaaccccgccagcaccagttgataggcgcccagggtgatgccgatgccgaacagcgggtggtgaatgacggccgtccaggcaccctgccagtcaaagatcactgcccccgctccttgcgcttgaccatttgctgcatcaatacgccgataaagcccatggcgatcaccagcgacaataccagcgcaccgacgatggcccagaagtcggcggcgatgtccttggcgtataccatcacgcctacggccgggggcaccagcagcagcggcagataacgcaacaggctgctggccgccaggctcaggggctcgccgacttcaccgcgccagaccaggaaacccagcatcagcaacaggcccacaatcggccccggcagcaccggcaacagtaaatgattgatcgctgtgccgatcaattggaacagcaccagccaggtcaggccacgtaacagcattcgctctctccccttcaaagctcgcccgcattataagcatgcccactctatgccccggcattcgccaaaagcatggtgggttgaccaggcggggtgcccatgatgatctacattggttctctgtaacccctaaaaagcccccattctcgggcggataaaaacgatgaacccaggagagatgcaatgccctatgtacctgtagcgcagctcaaagattatgtcggcaaggaactgggacgttccgaatggctcaccatcgaccaggcgcgtatcaacctgttcgcagaagccaccggcgatcatcagttcatccacgtcgacccggtcagggccgccgagaccccattcggcagcaccatcgcccatggtttcctgtcgctgtcgctgatgcccaagctgatggaagacatcctgatcatgcccgaaggcctgaagatggcagtcaactacggcctggacagcgtgcgttttatccagccggtgaaggttgattccaaggtgcgcctgaacgtcaccctcaccgatgtcaccgagaaaaaaccgggccaatggctgttcaaggccaccgccaccctggaaatcgaaggccaggagaagcccgcctacattgccgagtcgttgtcgctctgcttcgtataaggcccggactgtggtgaggcgataaaccttgccacagtgtatgtaaatttatgtatgaatcctgcggctgcggcatactcggcgctcaattatccggatcccgctatgcgcccactcgttcccctcgcctttgccctgttgctcaccgcttgcggagacggcgaatcgctgttgccgcccgatgcgcgcctgcccgatggcggtcgctaccggggtgacgtggtcaacggcctgttgcaaggccagggccgcgtggactaccccaatggcagttggtacgccggccagttcgacaaagggcagtggcacggcaagggcgaatggcacggtagtaatggcgaagtctataaaggcgagttccagcagggcctgtttgatggccagggcagcctgaccaccgcgggcagcagttacgtcggggggttcaaaaagggtcgacgcaacggcgaaggcaccctcaaagaggggcaaatgacctatcggggtgaattcaaggacgaccagtacgcaggccttggccgcctcgagctggccgatggcagccaataccagggccagttcgcccacggcaagcccaatggcgaaggccagcgcaatgacgacagcggcaatcagttcagtggccgcttcgtcgatggccagttggaaggcaatggcaccttcaacagcgccgagggtgatatctatgtcggccaattcaagcagaaccagctcaacggtaaaggccgctacgaaaacgccgacggcgacgtgtggatcggccagttcaaggaaggcgccctcagcggccagggtgagttgatcggggtggatggcagccactatgtcgggcagttcagcgattggcgctttactggcgaaggccggctgaatctcaccgatggcagtttctacatcggcggcttcgacagcgacaactaccagggccgcggcaccctcgtcctcgccgacggcaccgtgcaggccggcacctgggtcaacggcctgcgcgtacgcgatgccgatggcaagctgctgcccgacccactggaaaccggcgtgctggcccaaggccgcttgctcgatgacgtcttggccgccgtgccaccatcgacctccgccgtggagctctacaccttggcattggcgggcgacggcaagcaaagcgtgttcctgcgcgaagccgattacgtcagcaacatgctcgccacccgcttcggcgcgcgcgggcaggtgcgcctggtcaaccaccgcgaccatattaccgaccgcccgctggccacccgcgaaagcctgagacgcgccgtgcaaaccctggccgaacgtaccgggccggaagacctgatcttcatctacatgaccagccatggcacacacgaacacgaactggtgctcgaccaaccgcgcatggaactggccgacctgcccgccgatgagctggccgcggtgcttgcaccgctgaaaaaccgcgacaagattatcgtgatctcagcatgctattccggaggcttcattccggcactcaaggatgaacgcaccctgatcatgaccgcctcccgtgcagaccgcgtgtcgtttggctgctcggaagaagcggacttcacctacttcggtgatgcccttttcgcacaagcttttaaccagacggatgatttgcaacacgccttcaaactggcacaactgcacgtggccgaacgcgaacaggcggacaatttcgaagcctccgaaccgcagatctgggcccccaaaggcgtgatcgcccgctggcaattattacgcaaacagcaggcacgaaaggcgctcgaaagcgtctcaatgaatagcaaggaagccaaaggcaactaagctgtaacgtgtaacaagggggaaacaccatgtacctgacacctcagcacatcttgctggccggggcctccgggctgactggcgagcacctgctcgaccgcctgctcaacgaacctaccgtaacccgcgtactggcaccgagtcgcaagccgctggctgagcacccgcacctggaaaaccccgtaggcgaccccgccgtattcctgccgcaactgagcggccaggtggatatcgccttctgctgcctgggcactaccatcaagcaggcgggctccgaagcggccttccgcgctgtcgacctggatctggtcgtggccttcgccaagcgcgcacgggagctgggggcgcggcacctgatcgtgatcagcgctattggcgccgacccgaaatcctcgatcttctacaaccgggtcaagggcgaaatggaacaggcattgaaggcccaggactggccgcaactgaccatcgtgcggccttcgctgctattgggcgaacgcttggaaccacgcctggccgagcaactggccgggccgttgtcgcgtttgattccaggcaagtatcacggcatcgaagtctgcgaactggcccgcgccatgtggcgcctggcgctggaagagcaggatggggtgcgagtggtcgagtcagatgagctgcgcaagctcggcaagtaaatgtaaacacacaaccaatgtgggagggggtttgccaccgattacggtatgtcagtcaccaaatagttgactggactaccgctatcgggggcaagccccctcccacattgttttgtgttgctggtggattttgcgttacaaaccgccggtggcgttgaagccgacgcccagcaccgtcaatatcgacaatggcaacaacagggtatcgagcaacgcactggccggcaggtcaacatggggatagctcggcgcctcggtaccaaagcggtccttggcacagcaaccgccattgatcgcatacaaatccaggcgcgtgccggcatacaccaccggcgcgccaggttgcgcggcgtccagggtgcgcgccgtggcgcagcccgtcagttgcagcgacagtaatagcagcagcgttttattcatcgccgcccaaatggtgctcgccccagcgcggcagcatgtcctgggggatgttcagcaggttcaggatgcgtgccaccacgaagtccaccagatcatcgatggtctgcggctggtgatagaagcccggcgacgccggcaaaatggtcacgcccatgttcgacaacttgagcatgtgttccaggtgaatgcttgaatacggcgcttcgcggggcaccaggatcaattggcggcgctccttcaaggtcacgtccgccgcccgttcgatcaggttgttgcaagcccccgtggcaattgccgacagggtgccggtggagcacggcaccaccaccatcgccgcgggcgcaccggaaccggaagctacgggcgacatccagtcttccttgccgtagaccttgatctgccctgccgctgcgccggtgtactcggtgaggaacgcctgcatcgtctgcaccttggctggcagtgcgacatcggtctcggtagccattaccaactgcgccgccttggagatcaggaagtgcacctcccggtcctcgcgcaccaggcaatccagcaggcgcaagccatagggcgcgccggacgcgccggtcatcgccaaggtgacgcgttccgggccgctcatttcagcgcctcggccaatttgccatgcaggccgccgaagccgccgttgctcatgatcactacgtgggtgcccggcttggcgtgatgtttgacctgttcaatgatggattccagggaatcgcacactgtcgacggcacggtgcacagtgcggcaattgccggcaggtcccagcccaggttggccggtgcgtaccacaccacctggtcggcatcgttgacgctttccggcaggccatcgcggtgcgcgccgagcttcattgagttggaacggggctcaacgatcgcaatgatctgggcgtcgccgacgcgcttgcgcaggccatccagggtcgtggcaatcgcggttgggtgatgggcaaagtcgtcgtagatggtaatcccattcacgtccgccactttctccatgcggcgtttcacgcttttgaatgcgctcaatgccgcaatgcccatggctggcaccacgcctacatgccgagctgcggccagggtcaccaaggcgttggccacattatgctggccggtcatgccccaatcgacgatgccttgagcttcgccttcgaacagcacttcaaaccgcgaaccatcttcgctgagcaacctggcctgccactgcccgcctgtaccggtggtctgtaccggggtccagcagcccatgtcgatcacacgctgcaaggccggctcggtagtcggatggataaccaggccttcactcgggatggtacgcaccaagtgatggaactgccgctcaatggccggcaggtcgggaaagatatcggcgtgatcgaactcgaggttattcaggatcgctgtgcgcgggcggtaatgcacgaacttggagcgcttatcaaaaaaggcgctgtcgtattcatcagcttcgatcacgaaaaacggcgtatcgcccagccgcgccgagaccgaaaaattctgcggcacaccgccgatcaggaaacccgggctcatacccgcatgttccaacacccaggccagcatgctgctggtggtggtcttgccatgggtgccggccactgcaagtacccaacggccctgcaacacatggtcggccagccactgaggccccgagacataaggcaagcccttgttcagtacatactcgaccgccgggttgccgcgggacatggcgttgccgatcaccaccaggtccgggacggggtcgaactgcgccgggtcgtagccctgggtcagctcgataccctgtgcctcgagttgcgtgctcatgggtgggtaaacgttggcatcagaaccggtgacgtgatggcccagttccttggccagaaccgccatcgagcccatgaaagtgccgcaaataccgagaatatgaatgtgcatagttgacctcgtaaacatcgcggcaggttagcgcagggacggcgaaatcgcactctttaggtgactgccttacctctatacccccgcgcgccccagcttcgcctgcatctgcgccaacgcgtcgttcatggcagctatcctttttttaaccaaggctgctcgttccgcaagccctttgttaggctggtcaggttcttcttccgggttccatattttgtagaaaacgccgaaactgtcagcgagttcgctggtgtgattttccaggataagcaactcgtcttccagctggcctatcattccctgaggttggtcggaccatgtaacatcatctatttccaggtccggccacaattcccgcaacgattgcgaaaccttcttcgcatccttcatggaagtctcaagctgagctcgtaaagcgggttcgacaggctcttgcgtcggatccagcgcgtcgccagaattccagcctggcacgcggacatcggggcgttcaaaatgcgcattaagctttatctgcaccaagtcggtaatgatggtagtcagaacgtcagtaacaatgtttgtggtaacgtcaataacggcggaactagggctacggacaaagcctcgcagcggggcgccataaggtgtcccagtggcgctatcaaatgcgtaccactttccgttgcgctctacagcgctgacaggaactgcatcactattggcgccgagtggccggtagatgccgttggcgatatcgtctttgccccccgcaagaggaagttcgaaatggccgctgcgcctgccgaaaccgcgtagtttcttgaaccctgctttaccaagtttaaacacaccacgacccgcatcataaacagcctgaagaggattaaccgccttcaatgccgcagtcccccctcccttaatgaagtctaaagctgcccccatcccggttttgactccaaacttgacaccttgaataccgccttttaaagcgggaataaaaaacccaaacagatccagagccagatgaaacattccctcgacaggcttgccattaacaaagctctctgccgcgttatagaaagggatcaaactcaaaaaaaacgcgtggatcgactttgtacgttgttcctcctgttcttgctgcgtgttgccattggcctcagtttttgcctcacccataccccgcgtgtaataagcactgacagagcccgccagctcttcggttctcgctgatgaaaaggtcgcaggtatatcgggatgctcgccccgcttctctttttccagcgatttattgggataaatagaaaaagccaaaaaatccacagggtcctgtttcggcgatgaactgcccactgtctgccacaaaatcgtcactgctggctctttgccttctggcgagtcaggccggggcatggagaagtacaaacgtgagcctgggaactgcaggcctggccttgtgggatcggcatccttaatgatgcgtccttgggacggggagtaaagataatggacagtcttcccattcagttcggcgcggatgaggattgcgccgctgtttatatacgggtgaattttatgatcggggcttacctgcccttgattggcttcgggtgtcgtcaagttgaaggttgtgaccttgccgtactcgatcattttacgatcttcgagcgacaacaacgaaagctgatatttgaattgctgtgtggctgcgtctttcaggccttgggcataggcatcaaacttatcatcaaatagttcttttatcttcggcagcttaggtattccctgactaacgatagccgtcgtgaagaccgggtcactggatatccaaggctgcttacccaagtcgcccgacatatatatatccagcaacgagtaaggcttacggtcgggagaacctggtgcttcctgcgcaagcagcggctgttcaaaaaatttctcgttctcggcaccatatactcgccgcaaatgagtgagcgccagctctcgccgggtaggcatcggcttagtcaatgcctccacggaatccgccagagccttctgttgtgccttcatagcatttacggcgagctctatctcttcgggagagtatgcatcgtcgttcttttgaacaatgacgccattggcaatcgcccagtcgataatggctgccaactgcgcgaattgctgctcgcgcttttctacctcggagacgggggtagtctcatcgagcgtcatgatctcctgatacgtcatgcctgccgtgctaccgggctgccttgcctctatccgagctacagcggcactgaacgctgcccattgatggctgccatataccatcgtcgaaggtattcccttgaccaaaaactcgggggccgaaatcgacagcaactgaaaggctatgaccttggcgtatgcctcgccgaaccgggtagccaaataagcttcgaaccgcttcacgatttcagcagggtggtagccccagttaccttgttgacgcaacggatacccagcaagctcgttgcgattaagacctccagcaggatccacatccagtgctaaagcgctcagcagaacgtccctgacactggttgcgcccgcaaacgcatcgatactgtcctgaagcaacttgcccaaggcttgaccttctggggagttgagaattgcatcgagcattttggcaggctcatccttggcagatcgttgcgcctcaggaatcgtgcgaagcagaagttcaataagactcggtgcatcgtggccagagccagaagccgactgctgctgacgcgctttccacgtggcaatgacctttcgtaactcatcttgagcgtcagcagtaagcggagcgtctttagttaatagcccgccataatcaactgtggcagtagagggggaggaggatgcggtgctacgtcgggatcgcgaaggcgcatgagcatttgatatgtctgtcgtggcagtatcatccgcagcattattttttgctatctggtctcgctgaaagagctccatccggcttgacgcccgccccaatgagctgaagcttgaaatcatatattcacgttccaaaatcctgtgcaaaacaggcgcggtgaaataagtatggcccttccatggccaatccagtgcatgtcagggccggcactgataaacgacaacaaaacacctttggcaaaatttacaagtacagcaacgctataagcaatacacccagcagttcgggttctcaataacgagtacgcttattccgatggtttagcttcagccttgggcgcggctttattcattttatccattacctctttttgtgcccgatccaactctgctattctcgcctcggccgtttctatgcgttgtttcaatccttccattcctgaagcagccggtttatccgcgagatggggtttaaaaaagaccttccattgttcagcaacgggcgcagtgtgctcttcggcataatccaataaatgctcaagtcgattcatgcgctcaagcgggtctttcggccattcctcattaggaaggaggcccatctcgatatccccatatcggagccctgccgcgccattggccaccgcgaatccagtaacctgaatctcgttcattctagggtaaaggttccccagatcaggctctgttgaacccgaaggccggtctaccgatgacttcgcaatgggagtgggtggcaccatcggctgaggtaaataggaagccttgatctgttcaccggccgcagtggaacccgcatacgaagcgatattaataggtgcggaaaccagccctgtgatcccggcgctgatcgcagcttcgcgcgcagtagcggccgcagacggcgaagaagaaatgaccccattctttaccagacttgtcgcgtcttgcaaacggattaccgcatccgcaacggtcatttttggttggctggggggagtcggagccttgtttagccaattgcttacgtgcgggttggctgtcggcgtatgcacgtccttatgagcttcattgttacctttcgcggcactggctttatcccttgcaaccttgccgtttttatcgagaggccttccgatcttatcaactagaaagccttctttatcgacccttttgccgtccctatcgatcaaatgcccttcagcgttgaccaagcggccctgaggattcacgaggcggttctcggaatcgataaggtgtcctttgtcattaatcggcttgccatgggtattgatcaactgccctttatcatttactgcttggcctttggtatttattttttgtcccagatgattaatggggtgattttgagcatttatcaattgacctttgttattgaccgcatgcccttgagtgttgataagctgcccatgttggttcactagcttattttgactattataataacttcccgccggcgcataatgaggtaacttcgccgcaccggaggtgccattcgcccccccagagccatggtgtaccgtaacaggatgtataacggggggtttcggagtaattgccatattattcacctcaaaaataacagatataattttcatcacgacgccctaaggcttcttttccctacgtggtttccaaataagaaatagttccttacgcaattctgctttacccagctggccggctattgaccacattttttaactgagtatcgagtaggaggcggattgtccccgctgtcctctcaagccaccggaggcagggttccgtatgaagttgtgccgcacccggccgtccagctcctcaagagttcgctcgctctagcctgaagtaacttcccgacaccgcagcatgggatttatccactcaatgacgttagccatcttatggccccgggcttccttcagattcgcagtcacctgcgacccccttgcctagcgcacacaaaaaagcccaccgatagattcgatgggctttgctggcatgacagaccttagccggggttagcttcaattttcgatttcagcgagcccatcaatgcagaaagggtagccatccgtgcctccatggcgattgcgcggggcttaatatcatcttcgtcagcatccgtgacagcgggctgaaacgaaatattatgcttgcgtgcttctttagcgaactcgccctcggcaaagtcaagcatggcttcgagcgcatccagacgcgtatcgttatccagcatcagccatttcagcgatatggacacaggctcctcattacgcagttcgcccaaggtattgacgatcttaaatacgctgctttgaatatgatcgacgatccgtccttcttccacactttgtacagtggcattgacgggttgcggattgatgattggtttgagcgcttcattaacgcttccggcaataagcaaccccatcgtactaaagggcgcactgattgctgtggtgatggctgcggtcttgaggagcgtcttggtcgtgggcggaagcgctgtctctttggctttcaccagttcatcggcattcttctcaagcttggacgaagaaaaaggttctacctcctgcccatcgactcgtcctgccgtgggctgtgcaaacaacttgtcgcgggcttcagcatctttgcgggcttgccattctttttgatgcttggctttgtattcatccaccccgggcgattgatgaacatctccccgactcgcctctcccggtagccgggcaccgctcgcaggccctggcccggcgaagtcgctgaccttggaatcaacgaacgcttgatcaaattttccatcggtggcccccgcccagctgctggcaggcacgtcgccggcttttggggcttctaacgtacgatttggaatgtcgactcgcgatccacccgttaggctctctagaattccgcctattcttgaacactttatacgctggtgggtgtgtgttgaatttgaaagtatcataatgagttacctgatgattaataattattagaaagccatccattaccttcacttgataagtgacaaaccacgcctaaaagttccactccacccttgttaaaatacagaagcataacgactggcaacgcgagaaatacataccacccacgccaactaagcactaactttccagagcgctgataacaccgaattgtgcagcctgaacaccaaatggcgtcttggtgatcacattataagcgtaccaagccccattcttcaggatcgccaccgtgggtcgccacaagttgtcgtccgccgatttgaaaaacccttttacgatatcgccctccttatagactttggagacatcataacttttataatggcccctcagtcttgacagcacctcatcgcctttacctgcgaggtatttgatatcccgatatccggcctgtgcccccttattcagatttttggcaatatctacggtgtcggtataccccaccgatgcgccgacgccggcaaatactccgcgtttaagaatagtcagcatgcctttacctgccttggaggctttgcgaccggcattggccgcaggaagggcaaaaccaagaatatcgaagccgatattaaacactgcccctttgacatcccccttgatcgcatcttgaacaccatcataaaaaggcacgaggctcaggaagaaacccttgaggttttcatcaatcgcacgtcctttctcaacctctgtcacccctgcggccttgagcttgaggtcctcataaacctgcccggcgaaacgccccgctgcctgagcaagcgcattggttttctttgaaaagtaggagcccggcatttcacccgccaggtctggtggatcacgatcttcattgagcgttccaaacgggttatacacatgcaacgagccgggaacatagcccttgcctgcgtcgctaaaatacgaactgtcattgaaaccagcctggctgcctgggacagtatgctccttgactattcgcccttcgaaaggcaaaacgctgtaagcagaaacttcgccctcgctgcccaccactttcatcattaaaccttgcgtgcccttgagctccttgagttcctgatcagtgggttccctaggccaaaaaactttagtggtcagcacgtcaagtacagagggaaacccattcaggaaaggtcgagacacttcgaaaaagctcacatccgattgactgatcttctctcgatcggcaatgggcaacaacgaaaacagatatttgaattgaatagcccatgcactttcgtgagttttcctgaactccaggaacgcttctgaaaacactttattgatatcaggcttaagctccccaatacgcgacttgattttgctgtatggaaagttcttttcgtcaagcgacttccatttatccaccttgattgggccactcatgtaaatatcaagcagggacagcggggtgtgtctgacctccctatcctgcaatactttgagtgtcgggtcgatatcgggaaaaacgcgcttgatctcctccagggccagcgcctctcgagttatggggagcgttttcaacacttcatgcgcccataaaatttctgtttgctgcttgatcgatgcttttcttatccgctctaactcatccgttgcgacagtgaacttcgaactgttccctgtcattctgtttgcaaaaccccaagcgagaatagagtcgtgcattgccgcgagcaactcactctcgccctcgaacgaaacagaaggtacagcgccataatccatcacttggttataggtcatatttgccgttgcgccaggtacttgcagctcaatacgcatcacgcttatgcagaaattcatccaggcagcagagccgaagacaatgccgaacggtatgttttttaccagaaattcaggcgctaccgctgctaataataagcgcgcaaccaaaggagccaacacaaccccaaccttcgtttcaaggtaagcgacaaagcgcttgacgattacatccgggggcaagccgacattatctttgtgatacaggtcatagcccgccacattgaaacgtgatttatctgcactgggatcaagttcatgtacgagtgccgcgtttacgctctcaatcgcgctggtcggggtcttgatcgacttgagtaaggtctgaatgtcgtcacccagcgccagcgccttgggcgagcgaatgagttggtccatgacccatgcagggttatccccaatcatcttctgtgtggtttggggaagcgcattgaacagcaggttaagtaaactccccgcaccaggtcccgcctgcgtatcggagacttggataagttgctgccttttccactcatctaccaagccctgcctcttgcgcagcaaggtgcggcccaactttatgtcccactgctttacaccacctgattcaacacccggcgcccggtgagcaagatcgaaagacagcgcctgcgccgtctcaccggcctccttggcattgacagggacccggttgccttgcagcgtgagcatttgcgcaacagtcatctcactgcgctgctcgctggcgaacaggctcgaacgagggtcaatggggaccctgactgcttccagatcaacgcgcacgctggcatcgcctgcctgggagcgcagtgccgtaataagggcatgacgatcagcgtcatcccccaaggcctgctggtgaatagacagcgcttcatcagaacgcgccggtacataccgatcaggtagttcgaagctcgggttaccgatcagttgcctgacccgagtcgtcacctgtgcagaggtagacggggtgggttcgccataaaattgcgccactagattaagcggaacttggccatcacgcccgtaaaaggggtatacaaactcttgcccgggctctggtgcaaacaccttggaaatagacaaaagggttcgagaaatatcagaccatccagagtcatctgtaagcgaaaacgttttaatcgagctgcctacataaccagaaatctctcctcgagatggatttacctttaaataacctgtgttgatattttgctgtttcgcccacgcgaggaagcctgggctctgaaatgcactatttaattgtgaacgccagcgccccagcgtggattgctgaggtacgtcaaccaacggtgggcgaccaagcgtcttgtcgacgccggcagccaaggtcttggcataagacctcgccatctcagcgtcagcggctgtacttgaaacggctgtggacccagcggcgccctcggggtaatcgactcgggggccaacgttaagttgctcggtagccgctttatcgtgagacgcgaggatagggtctgcagcgggtgccaaaatagaagttaaagcaggcgcaagcagaggtgtggtcagctgcgagatattcatgggttcacctcggtgcaaaggttaggcttcctgacaagaaacctttctatatgcacttagtggatcaccaggaaaaaatcgcccccctaaactttaacaaaaaataaagcatgctttaaaagcaccgctgaaagcacttacaccccgcgacttttatagcctcagtgatttccaaacaaaataataccgacgcgttataacccaccagcgtacttatttatcaccttttaaaaaataatcgaaaaaaccaggtgtagcctaaacaacactacctcgtgagatccggtgtttacgcaacttcctataaagtgtattgcgacttaaacccaggcagctagccgtttgggtcatatgccaacactgttgctccaacgtatcaagcagtacacgtcgctctgcgtcatccagaacggccccttggtacgcctcactgaccggttcaggccgagcctggcgaacctccctgggaagctcctcaagactgactttaccgctctcattcagtgccaccaatgtgcgcaacactgtgcgcaactggcgcacatttccaggccaggcgtatcccagcagggcttggcgagctcgcgcgtccagtaccaccgctagcctaccggcttcctgcgccagcaaaaagtcgagcagttgcgccttgtcactgcgttcgcgcaggggcggcaacccaatctccagaccgttcaaccgatagtacaagtcttcgcgaaaactgccgtcctgcatgcgctccagcaagttacggtgtgtagcgctgataatccgcacgttcacggcttgagcctcgccaccgatgggcaccaccaggcgatcctcaagcactcgcaacaggcgagtctgcaaagccagtggcatgtcgccaatctcgtcaagaaagagcgtgccgccatcggcctgttgcaacttgccgcgcatgccctccttgagagccccggtaaaactgccagcacggtaaccaaacagttcgctttcgatcaggctttccggaatcgcggcgcagttaagtgcgataaaaggcttatcagcacgttggctggcctgatgcacagccttggcaaaggcttctttgccggaaccggtttctccgttgatcaacagcggaacgtcacgctcgaacactcgcacggccctgcgaaaatcattttgcaaggccggatcgcccagacagatgccgggcagtcgtggtgcctcaggtgatttgaccacgggcgctgtcacactgcgccgttggccgcgcaacgcggcgaataaatgccgcccttctcgcgtacgcaggggccagctggcgctggcattggcactggctcgaccgagcaattggtccagggagcagtcgaaaaatgcttccacgggttgccccaacaaaccaccgcgcagctgccccagcaggttcaacgcgctctggttgaccgcgcaaatgcgcccttcaccatcgaacgccaacagcccctcactgaacaggcccaccgactcggcctgcaggtgaaagcgcagcagccagtggtgctcaaaatggcgtagaaagtagcaactctcgatcatcttcgccgacaggttcaccagcgccatggtgtggaattggctctggcgcgataccgcttcgcgtgccgaggacacatcgagtaccgccagcagctcaccgtgggggtcgaacaccggacttgccgagcaggtcagcccggtatggcggccacggaagtgttcatcgcggtgaatggtcaaggactggcgctccaccaggcaggtgccaatgccgttagtgccttcgcaggcttcactccagtccgcgcccagccacaacccggcgcgctcgaagatcttgcgctcagagggcgcggtgacacagttgaggatcaccccgcgcgcgtcggtgagcagcaccgcatgaccggcgccggacagttgttgatgcaggctgttcatctcgctgccggcgatatgcagcacttggcgcaagcgctcgcggctttccagcaggcggccgtgttcaagcaccgtgggggcgatggtctgcgcagggtcgaggtgataatcctccacgcaacgcagccaggaacgagcgatggatggatcgctgcccggcccctgggacagctcctgtccgcgggtgacggtcaagacttgctgggcatggcgactgaaatgatcgttatgcatgttcttattattctccctgcgtgagagcgcccagcatcccccagccctctgcccattgcaatcccgggacgacccaccggtcacaggctgtaccgtttatggcacaaactgtcacaccacctgtaccgcaagggtgacagcgacgcatggcgccaacgcccaacccgttgatttggctggccagcgctgcagtggcccaacctttgctctacgctttatcacgcgcttgtcgcgatgtactccaataaacataaaagcaggagatgccaccatgcgttacgcacaccccggtactgaaggcgcgatcgtttcgttcaaggccaagtacggtaactacatcggcggcgaattcgttgcgccggtcgatggcaactatttcaccaacacctcgccggtcaacggcaagcctatcgccgaattcccgcgctccacggccaaagacatcgataaagccctggacgccgcccacgccgccgccgatgcctggggcaagacctcggcccaggaccgctcgctggtgctgctgaaaatcgccgaccgcatcgaacagaacctcgagctgctggccatcaccgaaacctgggacaacggcaaggccgtacgcgaaaccctcaacgccgacatccccctggccgccgaccacttccgctacttcgccggctgcatccgcgcccaggaaggcagcagcgccgaaatcaacgaacacaccgccgcctatcacttccacgagccgctgggcgtggtcggccagatcatcccgtggaacttcccgctgctgatggccgcatggaaactcgccccagccctggccgccggcaactgcgtggtgctcaagcccgccgagcaaacaccgctgggcatcaacgtgctgatggaactgatcggagacctgctgccgccgggcgtgctgaacgtggttcacggtttcggcaaggaagccggcgaagcactggccaccagcaagcgcatcgccaagatcgccttcaccggttccacgccagtgggctcgcacatcatgcatgcggcggccgagaacatcattccgtccaccgtcgagctgggcggcaagtcgccgaacatcttcttcgccgacatcatgaaagccgaaccgcaattcatcgaaaaagccgctgaaggcctggtgctggcgttcttcaatcagggcgaagtgtgcacctgcccatctcgcgcactggtggaagaatcgatctacgacgacttcatgaaagtggtgatgaaaaaagtcgagtcgatcaagcgtggagacccgctggacaccgacaccatggtcggcgcccaggcgtccgagcagcagttcgacaagatcctctcctacctggaaatcgccaagggcgaaggcgcacaactgctgaccggcggcaaggtcgagaagctgacgggcgacctcgccaccggctactacatccagccgaccctgctcaagggcaccaacgaaatgcgcgtgttccaggaagaaatcttcggcccggtggtgagcatcaccaccttcaaggacgaagccgaagccctggcaattgccaacgacaccgagttcggcctgggtgccggcctatggacccgcgacatcaaccgcgcctaccgcatgggccgggcgatcaaggccggccgtgtgtggaccaactgctaccacctgtacccggcgcatgccgcgtttggcggttacaagaagtccggcgtaggccgcgagacccacaagatgatgttggatcactaccagcagaccaagaacctgctggtgagctacgacattaatccactcgggttcttctaacccgcaacaccctctcacctttgaaacgcaatcaaaggtgagagggggcttgctcccgatagcagagtgtcagtcgacatctaagtgactgacccactgcaatcgggagcaagcccccctcccacatttggatctccataagtatttgcgatgcgcattcggcatacagaggccgagttaaaacaataagaatgaaaggtacttccccatgcctagcgaacccactggctcttccgtcgacttcgaaaaagtcggcaccgaatacttccaacaacgcgaactgaaaaaaggcgccgccggctgggtactgttagtcggtctcggtgtcgcctacgttatctccggcgattacgccggctggaacttcggcctggcccagggtggctggggcggcatgttcctcgccaccttgctgatggcgacgatgtacctgtgcatgtgcttttcgcttgcagaactgtcgtccatgatccccaccgctggcggtggctacggttttgcccgcagcgcctttggcccttggggtgggtttctcacgggcaccgcgatcctcatcgaatacgccatcgcccctgcggccatcgcggtatttatcggcgcctattgcgagtcactgttcggcattggcggctggatgatctacctggcgttctacatcatctttatcggcatccacatctttggtgtaggcgaagccttgaaactgatgtttgtgatcaccgccgtcgccgcaattgccctgggcgtattcctggtgtcgatggtgccgcacttcaacgtcgccaacctgctggacattccggtgaccgaagccaagggcgccagcagcttcctaccgttcggctacgtcggtgtgtgggcggcgatcccttatgccatctggtttttcctcgcggtggaaggcgttccattggccgccgaagaaaccaagaacccgaaacgcgacctgccccgcggcctgatcggcgccattgtggtgctgaccagttttgccctgctgattctggtgatcgcgccgggcggtgcgggcacttacgcgctgatcaaatccggcaacccgctggttgaagcgctggcgttgtcctacggcggttcgacctggatgggcagcttcgtcaacctggtaggtttggccggcttgatcgcgagctttttctcgatcatctacgcctattcgcggcagatctttgccttgtctcgcgctggctacctgccgcgcaaactgtccgagaccaacaagagcaaggcgccggtgctggcgttggtgatccccgggattatcggttttggcctgtcgctgaccggccagggtgacttgctgattttggtggcggtgtttggcgcgacgatttcctacgtgctgatgatggccgcgcacatcaccctgcgcatccgtcgccccaaaatggaccgaccgtaccgcacgccgggcggcatcttcacttcgggcgtggcgctggtactggcctgcgtggccgtggtggcgggcttcctggtagatccacgagtggtgattggcgccgcggtcatctatggagtattaattgcttactttgctttctacagccggcatcacttggtagcaggcacgccggaagaggaattcgcggcgatccaggccgcagaggccgccttgcactgattgccgaaaacctcgacgcgggcgctttctctaggttttgcccgcgtcattcaggagacactgtatggcaagcttttcccacgcggtgggtgccctcacctaccgcttcgacgacctcaaggacgtgatggccaaggccagccccgcccgctccggggacttcctcgctggtgtcgccgcccaaaacgacggcgaacgggtggcagcgcagatggcgctggcgaatatcccgctcaagcacttcctgcaggaggtgctgatcccctatgaaagcgatgaagtcacccggctgatcatcgacacccacgataaacaggcgtttgcgccggtcagccacctcaccgtcggcggcctgcgcgactggctgctcagtgatgccgccgatgaacacgccctgcgtgcattggcgccagggctgaccccggaaatggccgccgccgtgtccaagatcatgcgtgtgcaggacctggtgctggtggcgcaaaagatccgcgtggttacccagtttcgcggcaccatgggattgcgcgggcgcctgtccacacgcttgcagcccaaccaccccaccgatgaaccggcaggcatcgccgcgagtattctcgacggcctgctctacggcaacggcgacgccatgatcggcatcaacccggccaccgacagcatcgcctcgatctgcgccatgctggagatgcttgacgcgatcatccagcgctacgaaattcccacccaggcttgcgtgctgactcacgtcaccacctccatcgaggcgatcaaccgtggcgtgcccctggacctggtgttccagtcgattgccggcaccgaggcggccaacgccagtttcggcatcagcctgagcgtgctgcaggaaggttacgacgccggcctgagcctcaagcgcggcaccctggggcagaacctgatgtacttcgaaaccggccagggcagcgccttgtcggccaatgcgcattttggcgtcgaccagcaaacctgtgaaacccgcgcctacgccgtggcgcggcacttcaagccatttttggtgaacaccgtggtcggctttatcggcccggagtatctgtacaacggcaagcagatcatccgtgccggcctcgaagaccacttttgcggcaagctgctcggcgtgcccatgggttgcgatatctgctacaccaatcacgccgaagccgatcaggacgacatggacaccctgctgaccttgctgggcgtggccggtatcaacttcatcatgggcattcctggttccgacgacatcatgctcaactaccagaccacctcgttccacgacgccctgtacgcccgccagaccttgggtttaaagccggcgccggaatttgaacagtggctggcaaaaatgggcatctttacgcaagaaggcggcaaggtgcactttggcaacagcctgccaccggcgtttcgccacgccttggcgcaattgggatgaaggagccgaccgtgcaaccagaactgcctgacaacccctggctggaactgcgccgcctgaccccggcgcgcatcgcattgggccgcactggcaccagtattcctaccagcgcccagctggatttccagttcgcccacgcccaggcgcgggatgcggttcacctgcccttcgatcacgccgggctcagcagccagtttgccgaacgcggccgcgacagcctgctgctgcacagcgccgcccccgaccggcacatctacctgcaacgcccggaccttgggcggcgcttgagcgatgagtcggcccagaccttgcgcgactacgccttggcacatcccggtggggtggacttggcgattgtggtggccgatggtctgtcggcgctggcggtgcataaacataccgcgccatttctggcacgcctggaagaacagacccacgccgaaggctggtccttgtcaccggtaattctggtggaacaaggccgcgtggcggtggccgacgagatcgggcaactgctcggggccaagatggtggtgatcctcatcggcgaacgcccggggctcagctcgccggacagcctgggcctgtatttcacctacaaccccaaggtcggcctcaccgacgcctatcgcaactgcatctccaatgtgcggctggaaggcttgagttatggcatggcggcccatcgtctgctgtacctgatgcgcgaggcgtgtcgccggcagttgtcgggggtcaatctcaaggacgaggcgcaggttcagaccctcgaatccgacgatccggacctgatgaagggcaatttcctgctcagcccaccggctgatcgatagcagcacgattgcgcttttttgtcgcattaggcagcatcaagccacggccgctcgcgtggtcataccccattaggaagttgaggcctggcatgcggattactcaagcgaccctggaacacctggacctgttgaccccgctattcgtcaaataccgcgagttctatggtgccttgccgttcccggactcatcccgggccttcctggaaaagcgcctgcgacgcaaggagtcagtcatctacctcgccctggctgatgatgatgacaagcggctgctggggttctgccagttgtatccgagcttttcctcgttatcgctcaaacgagtgtggatcctcaacgacatctacgtggccgaggatgcgcgtcggcaactggtggccgacaacctgatgcgcaccgccaaaaagatggccaaggaaacccatgccgtacgcttgcgggtctccaccagcagcgacaatgacgtggcgcagaagacctatgaatccatcggttttcgtgaagacaccgaattcaagaactacgtactgccgatcaacgaagactgatccccccccaaaacacctcagatccactgtgggagggggcttgcccccgattacagtgggtcaggcgcagattggttacctgacaccccgccatcgggagcaagccccctcccacaaaaaaccaagcccaaccgcttcacactttcacgacactccccgctacaaaagccacacgcttttcaccattcaatccgtataatgccgacctttcagggccgtaagaaccgcgacaactatttgtagccttattgcccgagcttccgcacaggcctgctgagccgggccgttcacacaggtgccatccatggatttcaacccgctcgaccttatcctgcatctcgacgtctacctcgacatgctggtaaccaattacggtccgtggatctacgccattctgttcctggttattttttgcgaaaccggcctggtggtcatgcccttcctgccgggtgattccctgctgtttatcgccggtgccgtagcagccggtggcggcatggacccagtactgctggccggcctgttgatgctggcggcgatcctcggtgacagcaccaactacgtcataggccgaacggtcggcgagcgcttgttcagcaacccgaactccaagatcttccgtcgcgactacctgcaaaaaacccacgatttctacgataagcacggcggcaagaccgtaaccctggcgcgcttcctgccgatcctgcggaccttcgcaccgttcgtcgccggcatcgccaaaatgccctatccgcgcttcttcggtttcagcgtactgggcaccatcctctgggtcggcggcctggtgactctgggctacttcttcggcaacgtgccgtttatcaagaaaaacctctcgctgctggtggtgttcatcatcctgctgtcgctggtgccgatgatcattggcgtggtgcgcagccgctttggccgcacctcctccgaagccaacccgcactgaccggcaatgtggtccctcagcgcctggcgtcgccggcgcctgctggccaagcacccgattgccgatgacacctggcagcgggtgcgccagcacctgaccttcctcgacggcatcagcgccgagcaagaccagtggctgcgcgaagcctgcgtggtcttcctcgccgaaaaacacctcaccgccctgcccggcgtcgaactgcaccaggaacaacgcctgctgctcgccgcccaggcacagctgccactgatgaacctcggcgatctcgactggtaccagggctttcatgaaatcgtgctataccccgacgacttcctcagcccgcaacgccatcgcgacgccagcggcgtcgagcacgagtgggacggtgaacacagcggcgaagcctggcaacaaggcccggtcatcctggcctggcccggcgtactcgccagcggtcaatgggaaggctacaacctggtcatccacgaactggcccacaagctggacatgctcaacggcgacgccaacggcctgccgcccctgcaccacgacatgcgcgtgcaggaatgggccagcgtgatgcaaagcgccttcgatgacctcaaccgccaactcgacgccaacccggacgccgagacagaaatagacccctacgccgcggaaaacccggcggaattctttgccgttaccagcgagtatttcttcagtgccccggatttgctggccgacagttatccacaggtgtacgcccaactcagccgcttttaccgccaggatcccctggcgcgcctgacccaactgcaagcccacgacccgcgctaccagccacacggcgaatgaccgtacgacgcttggcgcatggcatcggcgtcagaatatgcctataatcgccgccacttttaggccaatccggccatgtcatatggccaactacgggggcaacgcccaatgagctacagcaagattccggctggcaaagacctgccgaacgacatctacgtcgcgatcgaaattccggccaaccacgcgccgatcaaatacgaaatcgacaaagacagcgactgcctgttcgttgaccgtttcatggccaccccgatgttctacccggccaactacggtttcatccccaacaccctggctgacgacggcgaccccctcgacgtgctggtagtgaccccttacccggttaccccaggctcggtcatccgcgcacgcccagtcggcatcctgaacatgaccgacgacggcggcggcgatgccaaagtcatcgcagtgccacacgacaagctgtcccagctgtacgtggacgtgaaggaatacaccgacctgccgccactgctgctggaacagatcaagcacttcttcgagaactacaaagacctcgaaaaaggcaaatgggtgaagatcgacggttggggcaacgcagaagccgcccgcgccgagatcatgaagtcggttgccgcctacaaaggctgatacccacgcttcattgccacggcaaataaaaaagccccgttaattcggggcttttttatgggcaagtttaaacatcaagttcaatgtttatttaatcgtgtttaactaagcgccccacctgaaaaatcaagccacaactaagccaaatcctacatatgcaattcaacgcatggtttatttgattagtttttccggccagtaaactctgcgtttatgaatacatcaggtgatcgtttaaaagcgctacttcgggaagttcatctttccgcttccgacttcgccaagaaccgtggcgtcacgcctcaacacgtgaacaactggttcaagcgcggggttcccatgggccgactcaacgagatcgcagaactgctctgcgtctcaagccgctggctgcacgacggccgaggccccaaacatccgcctgccaactacctgttggaaggccccaccgcaaggattgcaactacccgcgaagacactggcaaatacctcacaggcccagcctgccgcccggaaaaaaccgacgtggagatcgcgctccaccccacattcacctcaaccgaacgcatccgcatctcgctgcacaccctcgaaaccctcaacgtcaaacccgaccgcgcggtaggcgcctacatggtcgacaacagcatgatcgacatcatccaacaaggcgccaccctcgccatcgaccgaggccgcacccaaatcatcgacggcgaaatctacgccgtcgaacacgacggcatgctacgcatcaaatacctctacaaccgccccggcggcggcctgcgcatgcgcagccacaacgccgccgaacacccggacgaatatctgaaccacgaagaacgcttcgaacaatgcttcaagatcgtcggctgggtattctggtggtccaccctcaacaaccgccgcccacccgtgccgctggatgaacacctgctgggttgggaaggctctaaatcggaaccggaggtgggcaattgaggtgaatgtgggtagaatgcgccgcacatttggcagggggatggcttagctatttgacctgcttggcgatgcggaggagttcccgctgatgcccctactattcagcccgacgcaatgtgggctgagcgatttgaaggctgctgaggtttgtcaaaaacaagctgaggcagtccccgagaagccggccacaagccggctttttaatatctgtcaataaatcccctgttggcctactccccctcaagctcattggacctttccttcccacgcaccgcctccagccttaagcgcaaaaagcccaccccccgcaaagaaacctcttacaatccctctctcaattttccaacatgcgtcagatccgttaaccaccaatcgagaggcgggcctgtgatcaaaacagacagcacacccgaacaactggtgaacgtcgaaaacctgtccattcgcctgcaacgttttgctgatgatcgcgactggcaccagttccattcgcccaagaatttgcttttggccctcaccggcgaggttggcgagctttgcgaagtctttcaatggatgagcgagaccgactcgattgcagcagcgaagcgtccggaaactgcccaagcggtgaaagatgaactggctgatgtcctgatgtacctggtccgtttagccagcgtgttaggcgtcgacctcgacgaagctacccgggacaagcttgcccttaacgcttcgaagtaccccgtcgataaagccagaagcaccagcaaaaaatacgaccaactctgataccccacgcgctaaggacttctcgtgatcgtttacgctgcgaccaaacagcaattcctcaaagacaacgataacgacgatatcgaagaagtcattctcaggcactacaaggaagccacggggaaaagagttggggcgtcggagatcaaatcctggcagggctcgctgacgtacatggcaaaggtgctccgagatgaagggctgccgaatgacgccggcttggctatcgagttgcatatcccacagtcttcgaagcgtattgatttcttgctgactgggagggatgcgaatcagggtaaaaatgctgtcctgatcgagttgaagcaatggagcaaatcaactgcaacgtccaaggacgcgatagtcaaaactgcgctaggcggcgggctagtggaaactatccatccgtcctaccaagtctggtcatacgccgcattgctcgaaggctttaacgaagccgtctatgacaaaagcatcgaggttcgaccctgcgcttatcttcacaactatgtcagcgatggggttataaattctgcgcattaccatgcatatatcagcaaagctccactgttcctcaaagggccggatgagcttgaaaaactgcgtacgtttctcaagacccacatccttcatggcgataacaaagaaattctctatgagctttccaatggaaaaattcgcccgtcgaaagcactagctgatgcacttaaaggacttctgaagggccagccggaattcatactgatcgacgatcaaaaggcgacgtttgaatccgcactggcggcggcgagcgctgcctcggaagcggcgccgaaggtgattatcatcgagggcggccctggtacgggtaaaaccgtgctggcgatcaacttgctcgtgaagcttacgagccagggattattgagcaagtacgtctcaaaaaatgccgcgccgcgaaaggtgtatgagagcaaattggtgggaacggtcaagcgtagccacttctccaatcttttttctggctcaggcgctttcattgataccgaacccaacacctttgatgcgctcatcgtagacgaagctcaccgtcttaacgaaaaaagcgggctttacggcaatttgggtgagaaccaaatcaaggaactgatcgagtcggccaaatgttcaatcttctttatcgacgaagatcagcgcgtcacgttgaatgacataggcagcaagcaagccgtacgtgcttttgcgaaagccaaaggcgcggaggtagaggaatatacgttgtcctcgcagttccgttgcagcgggtctgacggttatctggcttggctcgatgacgtactggagatacgcgcaaccgccaatccgctgctcgacaatagcgaatacgagttcaaaatctttgacagccctcaagccatgcatatggctatcgaacaaaaaaaccaaggtaacaaagcccgggttgttgccggttactgctggccgtggcgcagcaagaaagatgctcgagaatccgacatcgtcatcggcgacgactacgaacgccaatggaaccttgatcaggacggcagtttgtggatcatcgcggagaattcagttgatcaggtcgggtgtattcatacatgccaaggcctagaagtcgattatatcggcgtcatcatcgggcccgatctcatcgtgcggaatgggcgcgttcttacctctgcccttgagcgagataaaaacgacaagtccattcgcggctggaagaaaatgatgaaggagcaacccgatctggcaaagcaggaaacggacttgatcatcaagaacacctatcgaacgctgatgaccaggggaatgaagggttgctacctctactgcaccgacccagaaaccgcgcagtactttgcgagccggcttgacgatcacgcgaacgctaaatgacctgctggtgcttgcctcaataaggttgagacaagcaccctcacattacttggactgcaaacagtccacagcccggtccgtcaccatcttcgccatctccaccaaatgcatcaccgctctctgtggcgcggccagcggctccccatgcaccttcgacgtcgccaccgcacagtgcagcaactccgccacacgcacccaagcatcctcaaagctcagatcttcattaacgacaaatgggtaggtcacactcgatgatgacgaatcggaaacaacgttatccatagcaaaactccaatcgatgatttgaagctgccatctacgcgactaaacgaaaggcggcagctgtacgcaggttagtcgaccggtcgattggtaacccggcgcacccgaaggtgccctgcgcacagccaccataagatgcaggcgaaggggtgcctgactcatgagttgcttatgcgccaatcgaagctgggcgactaaacccgatcactgaattagcagtgacgatccgcagcttagtcacagagtttcgctggcgcaagcggctggaattctctaggaaatgtcccgcaaatgaaagggatcgaacctgctggctactcaaaatcaggcaattcattcgcgttatgcgcagcagtacggggcccccaatcgctcgttcattattgtctgctttaagttgacagtaagactcctaccacccgatttatccccggtcacccacccattaatctgtgcccatgttgaacgcaacgcccaaccaacctaacaaaaaaggattcaatcatgagcgctccaacctacaaccgcttgaacaaagacgacgccattgttctgctggtcgaccaccagaccggcctgatctccctggtgcaggacttctcccccaacgagttcaagaacaacgtgctggccctggcggacctggccaagttcttcaacttgccaaccatcctcaccaccagtttcgagcaaggccctaacgggccgctggtgccagagttgaaggaaatgtttccggacgcgccgtatatcgctcgccctggtcagatcaacgcgtgggacaacgaggatttcgtcaaggcgatcaaggccacggggcgtaagcagatcatcattgccggtgtggtaaccgatgtgtgcgtggcgttcccgaccttgtcggcgctggcggaagggtttgaggtgtttgtggtgacggatgcgtctggcaccttcaataccacggtgcagcaagcggcgtggagccggatgacgcaggccggtgcgcagttgatgaactggttctcggtggcgtgtgagctgcaccgcgactggcgcaacgatatcgaaggcttggggaatctgttgtcccagcgcattcctaactatcgcaatttgatgaatgggtatgcggcgctgactgcccagtctaagtaagtaaccatgctgtatgacaagcctgcttgtgaaaagcaggctttttcatgccacggcttacccagccagcaattgcccaaccaccgcctccagtttcgccactgcttctactcgcttcgcagtagatatccgcctgacgttatgcagcttccattgcaccgcaggcaactcttcgatcccaggcaaattcaacttcgcccaatcaggctctccttgttttagcgagatcagaaaggcggcatcctgctcgcagaattgttgctggatcgcagtcagcaaagcctctctggtcacctctaattcttcaagagtgaccggtgctcgcgtcatgccagcaaattcagcctgaaacatatccgccagtggcttccaccgtggagcaagcagctcagccatgggccgcccatgactgatcaaatataccaagaagccttcaaaaatttcgcgtgtcagcccttcttctcgaagcatcaccatcacgtcgaaaaggtctcttggatgttgccgatccagtgcagcgcaaattttaccgccgtagaggtcgggcaaggacaccaccgctatcgaggcgaacccaaactcatcctcgaccaacggcactacgtcacgctccaggggctgcagggcagtcccgcgcagcacaggcgaaacctcaattttaatttgggcctgagcgtttcttacgagaatccgaagctcatcctctcgatttgcttgaacggtcgcaatgcccaaagggaggcctcgtgctatggcaccggcaatgcgctccaacgcctgacgaacgtcggccaatgcctgcttgcgggcagagttgggcagatacgccaggtctatatctaccgacaaccgaggcaagtcccgcacaaacaggttaatggcggtcccccctttcagtgcgaaacatcgttctgccgctacgtaaggaatgacctgcacgagcagacgaacctgagcggcataacgtggttcaagtggcattggcaaaacgctccggaacggtaatgaggaactctttatcgagtcgaccgccccggatgatttgccgcttgcccttacccatgtcgatgctggaacgatctatacgcccataccacgcatggttcgcattacgtgccagcaaaaggaacacgcgtttgacgcggatcgagttgcacgcttcaagcagcttttgcaggcgtttgggactgagtgtggccagaccgctcaatacatcggccacaccgctgaacagcatttcatcgtcgctttgatggataagctcaagcaccgcacgctccggggtggagatttttagcgcaaattgacggtaaggcacttggaaaacttgtaacgccatatcttccagttccgcaaagagtgcgcctcggtagaaatttacttgggcctcccattcgtgcttgcggaaccagcctggtagaagggcttctggtgtgccgaatagatcgactgtctgctttccgaaggtcaggtagtggctgtaaccggccaggctcaacgccgtcgcaccacccggccaaatctgcaccgttgcgtcttgttgcaatgcgaagacaccgccgtgccagccaagatcgtcgccgctgcgtttccacgcaccatgccccacacgctctacccagcccgtgtgctgatacttttggatgaggctcggcccaacaccgttctcgtgcagccacacttgagtagcaatggagcccgatggccatttcgcgagaaggtggtttattttcatgataaatatgaccctataagtatatttatattaaaaatattaaaccacgagaaagttggatgtgactatccttgcgaagcttttgattgcaactgtgaatgggtacgttcaataccagggtgcagtgacgcgcagcgtcactggatgcgttaccacgcgtgtggcaacgatcaagtggccgagtgggttatttagtccaggatcaggtgtggtagaaaccggcttgagtccttggtgatcaagctattgtcctcgcgtacaccgatgccagcggcctggtcgccaattacccaagagccgatcagcgtgtagctgtccccaaatttcggtagtggtgcaaactcttgaaggatgaaaggcgcatccgtgtagggcccgccctctttcacaatcagcccatcagccgtttgcagctcgatgttcgccccttcccgcgagaagaacggcttgcgtacccaacccttcggcacggctttacctgggtcagtatccaggtgcgacgcgagcaaattcgggtggcctttgttgaactcccacaacaacggcaggatgcctttgttggagaggatagacttccacgccggctcgaaaaactgcgtatcgctctcggcaatggcggcgccgaagggttcgtggaagatgaactcccaggcatgcaacttgaacagatgggggatccagcgatcttgtaggtcgacgaagcggccttcgttggtcaggccgatgtcttcgatgtcgatgtggcgtgattcgatgccgactttttccgcgacgaggcgcaggtagtcggtggtgcctttgtcttcgatcgagtctttcatcgaggcgaagtagaacggctggttgacctgcagttgggcgaaggcctggtgcagtttggtgtcgatgctgttgaattggtcggcgtgtttgggcagcaggccgcgttcgatgcattgctcgagccagccccactggaatgccgcggcctcgtagaggctggtgggggtgtcgtagttgagctcgagcagtttggcggggccggtgccgttgtaggagaagtccatgcgcccgtacaggtgcgggtggccttcaagccatgaggtgcggatcatgtcgtagaaaggcgcggggatgctcaggcgttcgagcagttcttcactgtggaccacgcgggccacgaggtccatgcacatgtcatggatctcggtggtggggtcttcaaggtcgcgctcgatttgctggagcgtgaactggtaatacgcgcgctcgtcccagtagggttcgccgtcgatggtgtggaacagaaagccgaggctgtcggcggtctgtttccaatcatgacgctctgcgcagtggatcttcttcatgcctgccttccttaactgctcgacccgccgccgccccagccgctgcgggcgctggccttgctgccgaagccgccacgggaggtggccgaggacaccgagctggacttgttggtggagcgcagcgtgttggtgtaattgctgctgccgtaccgggcctggttggagcggccgaaggtggccccattggagacgcgctggttgagcgtggagttgccgtagttgccgcgatcatcgcggtagcggtacaccggctcggaacggtagctgttgcgattgctgctcagcatgttgccgatcagcaggccggtgagcaggctgctggtggagaaacccgagccaccgccgcttgcttgggcgttggtcgcttgggcattggcggcgtcgacctgggattgagtcacctggccttcggcggtcagctcaaagccgccgagccttgggatgaacttgccggtggagtcttgctggcaccagtcggcgacgaagtcagcatcgcaatcggcctggctgtcgtacaccggcgcaatgcggcgatgctcggccatggcggtcatgtaggcgtccgagcagacgtctaccgggagtttttcatcggcgcattgctgcaccgactggaagttgtacttcttctgcaaatcgtaggttttttccgttggcccgcagccggatatcgccatggcgaccgacgcggccagcgacagctggacgtacttgcttcgtttcatcgagagctccgtgcgcaatcagttcgaggtgggcgtcatgcacgcggcattcaacatgccgacgctgatggccacggcggccacgtagatgccggccgcgagttcgccctttttgatgcgctcggacgtgcctttgagcaccaggctggtcagcaaaaacgccaacagttggacgacggctgcaatcaccgcccagaccacgaagtcgacgaggctgacggagtaggcaatcacgttgctggccggaatggcgaagccgacgatggcaccgcccagggcgaccgctgcggatgtgttgcccgcccggatcagctcgaattccttgtgcggggtgatgcgggtgtagatgaactggaacagcgcgaacagtaccgcagcccccaggatgtagaggacaaagccgaacacggcagctttgttcagggaaatggagagagcttctagcatgggatgcttccttttttagagcgcagtcagatcggttgtgtacagcgaaatgcccagcgacgtgctcaggctgatggtgccttcggcgtcttcttcgacggaaaacagcaaaaactcgcggcggtcggtcaggccggtgtcgcgtgcgtataacatcgaacggtgctcaacgctgtaggccgcctccgggctgacgatttgttcgttcattgctaccaattcggtctggccgtcttcgctgccccactcacggaagaactcgacgccgtcgtgggtgtaggtcggcaacccgatcaggctctgtgggcccgccagccggcgcagttccgcttcactgctgacagtgacgttactgaggtagttgaagaggatcaccgactcgacctgcccggcgatgtcacccgtggtgtgcacctgcagccaatagtcttcgtcgttcatgtaatagcgcgacagccagttcgactgcccgaggtcaacgatgccgttggcccagatttcctgggaaccgggtattaccaccgaggttttctcatcgagcaacagtttcaggctcgtgtcgaacatcaggcctttgcccggtgccaggcccaatggcccggtgaccggcagcgcctggttggccggcgctttagagtcagtagtggcgttcggagcttcgagccccatcagttgtttaaaccatcccatgggagatttccttgagccgggtggaggcgatatagaagagttcaccgccctcgacgcgtgtggcgctcggcgggttgatcgcgggttgctgggcacctttggcgcgatagccgataagggtggcgttgtgctgttctttcagtcgggtgtacagctcgccgaacgtggcctcaaaggcctcgggcaatttcatcaggtattgggtggcaccctgccccacgcacagcagctcattgataaccacggacgagcctgggtcctgggaggcacgcaccagcatttcaatcgccatgcttgaggtgcattccaggcgaggtgcgtaggagctggcgagtgcggcgatttcactttcgttgaagtgggcgaccacatgcccgacggggctcaattgattgaccgccagtactgtggccagggtcaggtcgtcagatggggttcgcaccaacacacgttcagcaccgggaacaccggcacgcagcagaaacgcggtggaggacaggctctcaccgcggatgaacgccgctttgcccggcatcgggttttcttcgagggtgcagtcgcaaatcacgatcaggttgtcgttggaggtttcatcttgtagcaacaactcgatgacccgctcactggatgcgccctcccagccgatcagcacggtatggccggccttgccggtgaaatcgcctttgcccttcatgccttttctccatgcatcgatgacactgctggtggttttgccgatggcggccgtaagcagcgcaatgccgccgagcatgacccaggtcgccacgaaaatgcgccccgccgcggtctgcggggcgagatcgccatagccgacggtcagtgtggtagtcagatagaagtaaacaaaggttgcgggggcggtgaggtgttgctcgcccaggaacaccatgcccagatatgccacgcccaggtgtacgcccaaggcaacgaccaggcctgcccagccgaagcggtgaaagagggacgaagcgtaccggcgcaataaaagaaagatcgacatttcatccctggttccgtgggtactgggttcctgacgaggcgctcacctcggcatttggatgcttgagtgcgctcacccggcattaaacctgctgcgcggtgcagagagaagtaccttggcggcaataaacccggcgaacgcaccgaagagatgaccttcaaaggaaacaccctgccgaggcaggaagccaaagatcaggccgccatacagtaccgccaccacaccagcggttatcaggttgctccagcttctgtggaaccaggcgcgtgcgagcaggtaggcccatagcccgaatacccagccgctggcaccgacgtgaacgcctgcaaaaccgaacagccagaccaacgcgccacccagcagaatcacgattgcgctgacggcaataaagcggtggagtccgtcgaggataaccagggtgcccaggaccataaaggcaatcaggtttgcgctcaggtgggcaaaggacgcgtgcagaaacggtgatgtgaggatgccaaacaggccgtgcagcgttctcgggaccagcccgaatgccatcaggctgtaaccggtcgctacattgagcagttgcagcgcgaccatcaagagggccaggcctgcgattgtcttgaaacccttgaaggcgtccattctcacctcggcataaaaaagaagggcacaaatgcccttctttcagctgcgtcgcttattcagccgacttttgcttcagacgctcaagaatcgcattggcactgccttcgttcggcgtgatgccagcgtcgcgcagtttgcgctccaggtcggtgcccgtcgacgcctcaaccagttcatcctgggcttgcagttccgcggcgcgttgctgctgtttggcctgcaagcgattcagcgtaccgacggcggtttccagcttgccgttggcaccgccgctggcaatggatgcgctgacctgggccttctgcacgctgtcgcgagccttggccatgtccacttgctggcgcaagcttttgatccggctctcggccttggtgatgtccttgcgcatgctctcggcgtagccaccgaactcggcggtttgtttttgctcgacgtcccgctcgttggtcaaggtcgaaatggcttcggcgacttccagggccagatcttcacgattggcctggatcgcggccatcgccttggtttccaggtctttgatcttggcgtcgtactcgccaacacggtcagcggccagtttgtgcttggccatgatgctgaccaactcacgcttggcattggccagggcgctgtcagcatcgcggatttcctggtccaggatgcgcagggcctgttggtcgacgatcgattcgccgacttcgttggcaccgccacgcagcgcggtgaacaatttgctccagatggactgagtcattaggttttcccgaataattagttgaagaaacgttcgaaggcttcgctggcgcgctgcacgttgtcgaccagggttttcacctcggtcacgatgttggtcaggctggagtcggagctgagcgcgccgaacatgttgtagaccacctgcccgttgggcattgactcgatgccgatggaagacaacgggaacatctcccggctgcgcagcaccgcgtcgttgaacttggcgacatcgtttatggactcgacgtcgaccagcacggtgtccacgatgatctgctcgcccaccactgcgatgtaaatcggcaggcccccgaagtcgttcatttccagcttgatgctggactcggagccttggacgagggaaagcgtaatgtctttggacgtcacttcatccagggcctgcagcgcactgaagaggcgatcgatgttccagttggtacctgcgctcatgaaattctccgacatgaatgagccagccagaatcggttggcgaagctgtttctccatctgcttgagcaagcttcggttttcgggaagcacccaagcctcgtgtttcacataaccggcggccgccaggcccgcgcgcatctgcttcatgtaaaagctcgatggcttttttgcagactgtttcaagcgctctccctgaaggctggctgaatcggtatcgggccctgcagcagggctcgatggagagctgctattcatcgtactgacctcgctgtgaaaaactcacgtgtgagaaaatctacaggcaatgttcgttgcactcaatagctcacgcgtgagatttttccgaagctgattccgcccatgggaaagaccatatctagtgagtgaccaggcattgtctcttctgagttgacggtattacccattccagccgatttatcccccaccactcacccattaatctgtgcccatgttgaacgcaacgcccaaccaacctaaacaaaaaaggattcaaccatgagcactgcaacctacaaccgcttgaacaaagacgacgccatcgtactgctggtcgaccaccagaccggcctgatctccttggtgcaggacttctcccccaacgagttcaagaacaacgtgctggccctggcggacctggccaagttcttcaacctgccgaccatcctcaccaccagcttcgagcaaggccccaatggcccgctggtgcctgagttgaaggagatgttcccagacgcgccgtacatcgcccgccccggccagatcaacgcctgggacaatgaagacttcgtcaaggcgatcaaggccaccggtcgcaagcagatcatcattgccggggtggtgacggatgtgtgcgtggcgttcccgaccttgtcggcgctggcggaaggctttgaagtgtttgtggtgacggatgcatcgggcactttcaacaccacggtgcagcaggcggcatggagccggatgacccaggccggtgcacagttgatgaactggttctcggtggcctgtgagctgcaccgagactggcgcaacgatattgaaggcctggggaatctgttgtcccagcgcattcctaactatcgcaacttgatgaatggctatgcggcgctgactgcacagcagaagtaagccagccgagtgtgacgataagcctgccctgaaaagcaggcttgcggtgtttgagccggacctaccccgccaactctcgctcaatttgttcaatgctgggcaagctggattgcaactctgccggcaaagactccaccagttgatattccgccacgccgataggccggttgttatcgcgcagtgcatattctgccaccacctcatttttacccttgcacaacaacaggccaatggtcgggccatcctgtgggtgcttcagctcggcatccacagcggcgagatagaaactcaacttgcccagatgctcgggcttgaacttgcccgccttgagctcgatcaccacgtagcaacgcagcttcaggtgatagaacaacaggtcgacgaagaactcatcaccgccgaccttgagcaacacttgccggccaacgaaggcaaagcctgcacccaactccaataaaaagtcagtgacatgcttgatcaaggcgttttcgatatcacgctcttgtgcattcaggcccaggctgaggaagtcaaagcggtaagggtccttgagggattcgcgagccaggtcggattgagctttgggcagatgactttcgaagttgctgactgctttgccactgcgctccagcaggcgattttcaatgtgcatcaccagcgtgttgcgcgaccagctgtatttgatcgtttgggtgatgtaccaacgacgggtttcaggaccgggaagtttgtccaacaatgcgatctgatggtaccaaggcaattgtgcaagcaccccttgcacaaattccgcatccggccacgcttcggcaaaagcgcgcatgtacttgagattgcgcggcgaaaaacccttgatgtcgggaaaggccgcccgcagatcctgtgcaaggcgttcgatcactttgctcccccagccttgatcattctgacgggtcagaatatcgcggccgatctgccaatagagcagcaccagttcacgattgaccgcgattgaggcgcgctgttgtgcgttatggatacgacctttgagatctgtcagccaatcgctgtagccctcgggaggctcggccaggccgatagcggtttcgctcatgccttttactcttgtgttttcagcaggctagtcaggccatcgtgccgtcacaagggctcatgaatactccaggaagggtcctgcacaccttacggaacggtcctgctggcactggttgcggcccttgactctcccctatacggcaccccctaccctgaatgctcatttcaggagccttcagcatgagtcaacgcgtcctggtcattctcggccacccgtccaccgatagtttttgttcagccctcgcacagacttatatccactccgcgaaaatcgcaggccacgacgtacgcgtcctacgcctgggggacctcaggttcgaccccgtccttcaccacgggtatacccaggtccaagcgctggagcccgacctgctcagcgcccaagccgacattctttgggccgagcacctcacatgggttttccctgtctggtggggcggtatcccggcactgatgaaaggcttcatcgaccgagttttcctacccggcttcgccttcaaataccgcgcaggcaaggcattccctgacaagctgctaaagggccgaaccgcgcacttgctagtgaccctggacacaccggcgtggtattaccgctgggtctaccgcatgccggccatccaccagatgcgtcgcaccacgctggcgttgtgcggcatcacaccgagcaagacgctgctgttcgggccggtgctgggctctacattgacgcagcgggcccggtggctgaaacaggccggcgcattatttgagaaagggaattttcatgtacatcggcaaagccgcgcagttgtccggcacgaccatcaaggcgattcgtcactatgaggcgattggattgatgcccgagcctcaacgccaaggcggctaccgcgtttacacggtgcagagcgtggagcgattgacctttatcaaatgcgcccagcagctggggttcaaactcaaggagttgcaggaaattttgctgggatacgacggtgacgcccttccctgggaccgggcggaacaagcaatcgccaacaagaagcacgcgttatctacacaaatcgccgtgctgcaacgaatgcaggcgggcttgattgcgtttgaaacccaactgaaagacgcccaagggcactgctcgtcaatcagcagcgtcgccatttgacgcagcctttacgcatgagttggcgctgacttttacgagccccttgtaagggcaatctgattttccaaaccgttcatccagccgcttttcgctgcggcagactccggcgccttgccttctgtcgagacgtcatggatgacccacgccaccctcatcgccgctatcgaacacgagctgaatggtttccatcagagcctggtggagtaccgccagcagatgggcgcctggtattcgcgtgcgctggattcggtcagtcatgcagcggatatgccgtcgttgctgggcatggaccgggtgttacgggttggggattcccagcgttcggtaagccttagcgacgcggatttttctaccgtggcccgctgcccggtgggtggcgtgctgaagatcgagagcaaattcgaatcagcgtatgacgtgccgattggcgatatccctgtcgaggtgattggcctggatgacggcagttccacgcgggtgatgctcgataagcacggcaagggttcgcactactgcgccgccggcgggcgctatcaggtgcgggttcagggtggtgtttcagcgcaacaagtggacgccttgtttacctcctatgccgggctgacggcggacttggaacagtggcttcggtcgcagtggaaaagcttcaaaccccactgggaaagctctactgccagcgcgattggcagcggcgtgctggcaggcagttgggcggcgatccatgacgtgtgggacagcatcaagctggtgcaggcgatgcttgaagacccgttgaagtacgtcgaacaactgggcagcgaggcggccaagttggcgcagatcgccaccgatgcgcccagggtcatggagcaggcgatgctgctggccagtgatgaagcggcgctgtacctgttactgcgcaccgccacgatctggctggacgcgttaccgcccagtgaagttgcgcaggcagccgccagttttatggtgtcgctgctgattgatctggtgattggcgcagtgttgaccatcgcgttgccagcggcgggcgtggcgtacttgagcatgcgcctggtcaagtacggcaagcagattcttgcggcggcagtggacttcgtgaagggcgtgctggcgatcctcacgaagttcatgcaggcggtggaccgctacaaagcggtggcggttcgcggggtggtcggcgggctgaagcagggcacgatgcagatgcgctggaaggcgcggcagaacgcggtgctgaagcagaaagagcgtgtggatgatgtgcctgtcgtggcttcgaatccgaagggagatgcggcggcgcctgcggacaagacggtcactcatggctgcccggtgtcgatggtcaccggggaggaattgctgaccctcaccgatggtgcgctggacgggatcttgccgtttgagtggacacggttgtatcgcaccagtgcggtggaactggattgtgggttggggtttggctggagtcatgcgctggcgcacaggcttgttgtgtcgggcgattcggtggtgtggaccgatcatgagaaccgtcgtacgcagtttccgttgcccaccgattctcgaccggcgatcaccaatagcctggcggaagcggcgatctacctgggctcggcgcctgatgaactggtgctggcccaggcgtcgcggttttatcactttcgcgacggtgtgctggtctcgatcagtgatgcgtatgacaaccgcctgcgcattgtgcgtgattgttccgggcggattgagcgtttggataacggttgtggccgttcgcttttgttgcgctatgagctggaccgtatcgtcgcggtggactaccaggttcatcgcgccaaagggcgcgagccctacgtctgggagaccgagcagaacgtcgtttcctacgcctatgacgaagacggacgactggtttgtgcgaccaatgctgtcggtgaaagcgagcgttatcggtacgacgatcagcacgtcattgtcgagcggcagttggccggtggggcgagtttcttttgggcgtgggaaggctccggcaaggcggcgcgttgcgtccggcattgggcgagtttttcgcagatggacacgcgttatgcctggggggatgacggccgtgtcaccgtgcataacgctgatggtagccaggaagtttatgtccacgatgaacgggcgcggttggtacaacgcatcgatccggacggcgcccagcatttcaaatcctacgatgacaagggtcgactgaccgtcgagcaagacccgctgggcgcggtgacggcctatcagtacgacgaagccggacgcttggtggcgctgtttccgggggatgacgagccaacgtcctacgagcatgacaacggtttcgtacgcgtagtcaggcgtggcgaggcggtctggaaatatgagcgtaatgaccagggcgatgttacgcgcaggaccgatcctgacgggcaggtcacggactacagctacaacaaacgtgggcagttaaccggagtttggtatcccgatcacagctgtcatcggctggtatggaacgaacgtgggcagttgcttgaggagcaattgcccactggcgggatcaagcgttatcgctatgacgatctagggcggcaggtttcgcgtgaggatgagcatggcgcgcagactctttatgaatgggacgccgtaggacgtctgctgaaactgacccagcccggcggcgcttgccgggaattgagctacaacccctacggaaaaatcatcgccgagcgcgatgaactcggccacgtcacacgctacgaatacgaaggcggcctgcacctgatcagccgccgcctcaacgctgacggcacccaggtcaagtatcgctacgacaacgcccggctgttgctcaccgagatcgaaaacgaagtcggcgaaacctaccagctcacctatcaccccaacggcctgatccaacaggaaaccggcttcgacggccagcgcaccgcctatgtctacgacctcaacggcaatctgcaggaaaagaccgaatacggcgacgacggcagtcagctcattactcgttacgagcgcgaccatgctgggcgcctcgtccggaaaaccctgcccgatggcagcctggtcgattatgcctacgaccgccaaggcaacctcctcagcgtcgaagacggccattgggccctggcctacgaatacgaccggcaaaaccgcctcaccgccgaacaccaaggctggggcaccttgcgctacggctacgacgcctgcggccagctgaaaaatctgcgcctgcccgacaacaaccgcctcaccttcaaccacgacaaaggcggccacctcaccaccgtcgagctcaacggcgaagtgctcacctcacacctcttccgcgccgggcgtgaacaccaacgccaacaaggtcagctgctcagccactaccactacgacgaccagcaccgcctgcacgcccacgccgtcacacagcaggaaaactacctttaccagcgccaatacgactacgacaaatccggcaacctcacccgcctgctcgacacccgcaaaggcgaacacgactaccgctacgaccccctcgcccgcctgacccgcgccgatcattcgcaagacgtccaggaacgctttgcccacaacccggccggcaacctgctcatgcaagaccgtcccggcccggacatcgtcgcagcgaaccgcctggtgatccagggcgaccgccactacgactacgacgccttcggcaacctgatccgcgaacgacgcggcaaaggccatcagctcgtcactgaatatcgctacgactgccagcaccggctgatcagcgtgacgaagcccaacggcgaaaccaccagttatcgttatgacccattcgggcggcgcatcagcaagaccgtggagggcaagaccacggagtttttctggcaaggcgacaagctgattgccgagcatcatgcggaccgccaccgcagctacatctacgagcccggcagcttccgtccactggcactgctggaaggcttcggaccacaagccacaaccccctaccactaccagctcgaccaccttggcacgccgcaggaactgaccgacaccgtaggcgaaatcgtctggtccgcccactaccgcgcctacggccaaatcgcccgactcgacgtaggcaagatcgacaatccactgcgttttcaggggcagtatttcgatcaggaaagcggactgcactacaaccgccatcgctactacaatccggatattggtcgttacctgacgccggatccggtgaagttggcgggtgggatcaatgggtaccagtacgcgctcaatcctacggggtgggtggatccgctaggcttgaacagttgccctggtggcgataaatgcaagtcgagcatcagtcataaagacccggcaggaataccgcaagttaatgagagcggtcctttcggcccgacaagctcaaacacttcaccggaaatgggctaccacaaggaggtctatgccaataaaccagtaaagccggaggacgccgctcaaaaatgggaagattttttgggacctggtccttatacaaatacaaacccacggactggcaaacctgatcgcgacagaatcgtttccagcgacgcaaagagaagtattcgttacggtccccatgagatgaacagcaagccaagcaagcatcactatcatgaggagacatggacgatcgagctaaaaaccaacactatgaatgtggacaacactgtcgtaagagttccactaacgaaaaaataaaatgaatataaaattaattgatgttatttctgaccaaaacattctaagcgtgagattcaattcacccttcgggaatggcgtagctttatggagcagttccacaccagaaattggtgaagatctagacgtggagttcgagctgaacgaagtgtttttttggaaaaaaaacatcataccctcgcttaaaaagacgccacagatcacttttactaatgacacacactcaataattggcaaactaattcaagataaagatgatggttgcgccgcattaaagcttggcgactcaataatactcattgaacttgacgaaccaataaaagaggagtgcgatttcgtagaattgaaagtaaattccattcatctatacccaacaaacgtctaagtacgacctcaaccacttcgccgcgtactccggacaagaggccagccctctagaccatgagccaaattcgccgcacaatcggctcaccaaatgagccgaatacatcccctattcggctcacgcacccaggcgctttcccatgaatcacccgcactggatctggcaacacaccgactggccccacttccactggcagcccgggcgtctggcggccttgctacgggagtgcgggcaagcccaaggcaagcttctgggcatgctcggttctgtcacccaagcggtcagtgcgcaaaatgaattggatgcactgctgcaaaatatcctgacctcctcggccatagaaggtgagcaattgaacgtcggctcggtgcgttcatcactggcgcgacgaatgggcttggaagccacgaaggacggtcaggtaagccgccgcagtgaagggctggcggatttgatgatggatgccacccagcaattcgaccaacccttcacccgcgctcggttattgaattggcatcatttattgttccctgctcccgaagcaggctacgccgcgcgcgcagtcaaggtcgctgaattgcgaggcgatgagcctatgcaggtcgtgtcagggcgacttgatcggccgaccgtccatttcgaagcaccaccacgtaaaggcctggagcaggctctggatgatttcctcgagtggttcgaaacaagccgcgatcaacctgagctggatccattggtacgcgctggcgtcgcgcacttctggttcatcaccttgcatccgttcgatgacggtaatggacggctgacgcgtgctatcactgacttggccctggcccagggtgagcaccaagccattcgattttatgcaatgtcggccagcatcctcgaagatcgcgccggttactacaaggcattggaatccagccaaaaggccacgctggatattaccgactggctggaatggttcttgaaaacgctgctgggtagtctgcagcaggcgatggcgcggattgaccgggtgctgaacaagagccggttctggcaaaaacaccatggcgttcctttgtctgtcgaacaggttaaggtactcaaccgcctgctcgatgggggtgagcggggcttcgaacagggcatcagcgccgcgcagtaccaagcggtggcaaaagtgtccaaggcgacagccacaagacacttggccgacctactggaaaaaaactgcctgacacgcctccccggaggcggccgcagcacgcgttatcagatcaatcccacccacgagtagccccctactcatttgcccccatcccccatgtctgctagtgtcgcgccggtttaccgtctaccggaattgccgccatggcccgcaaaaaagttgcactggatttcgaacaatccctcgccgacctgcaaaccctggtcgagcggctggagaacggcgagttgtcgctggaggactcgttgacggcgtttgagcagggcatcggcctgacccgcgactgccagagcgcgttggcgcaagcggagcagaaggtccaggtgttgctggagcgtgatggggagttggccgaagagcctttcgatgcggaacagccggaatgatcgacgcgtaccaggccagtagccaagcccgggtgaatgcggcgctggagcccttgtttatagcgccaagcccggaaatggcgcgcctctatgaagcaatgcgctacagcgtcatgaatggcggcaagcgtgtacgcccgttgctggcctatgcagcatgtgaagccctgggtgcacctgccgaagaagccaatggtgccgcctgcgcggtggagttgatccacgcctattccctggtgcatgacgatttgccggctatggacgacgacgatttgcgtcgcggccagcccaccacccataaagcctttgatgaagcctatgcgatcctggccggtgacggcttgcagagcctggcgttcagcgcattgctggacccgcgcttgagcagcgtcgacgccgagatccgcctgcgcatggtaaccgccttggcccacgccgcaggcccagcgggcatggtcggcgggcaagccatcgacatgggttcggtcagcctcaagctggatcaaaaagccctcgaacacatgcatcgccataaaaccggcgcgctgattgaagccgctgtgcacctgggcgccttggccagtggccgtgcccaagccgcgcagctggcggccctgcaaacctattcccgggccatcggcctggcgttccaggtacaggacgacattctcgacgtagaaagtgacactgccaccctgggcaaacgccaaggcgccgatatcgcaagggacaagccgacataccctgcattacttgggctggaagctgccaaggcatatgccattgaactgcgtgaccaagccctggatgcactgcgacctttcgacgcggcggccgagcccctgcgggacctggcgcggtatatcgtcgagcgccgccactgacaaccccggccatttgcgccgcatatcggccaagttcggcgctctgcgtgggcagtttgcacggcttgaggtaaactgccgcctcttctatacctataacgattcgcctgatgcccacgacgtttcaagagattccccgcaaacgcccgtccacgcccttgctcgaccgcgctgccacgccggacggcctgcgtcgactgggtgaagcagagctggaaaccctggccgatgagttgcgcctggaattgctctatacggtcggccagaccggtgggcatttcggtgccgggctgggcgtgatcgagctgaccatcgccctgcattacgtgttcgacaccccggatgaccggttggtgtgggacgtgggccatcaggcgtatccgcacaagatcctcaccggccgtcgcgagcgcatgggcagcctgcgccagaaggacggcctggccgccttcccgcgacgttcggagagcgagtacgacacctttggcgtcggccactccagcacctccatcagtgcagcgctgggcatggcgatcgccgcccgcctgcaaggcagcgagcgcaaagccattgccgtgatcggcgatggcgcgctgaccgccggcatggcctttgaagcgctcaaccacgcgccggaagtggacgccaacatgttggtgatcctcaacgacaacgacatgtcgatctcgcgcaatgtcgggggcctgtccaattacctggcgaagatcctttccagccgcacctacgccagcatgcgcgaaggcagcaagaaagtgctctcgcgcctgcctggtgcgtgggaaattgcccgtcgcaccgaagaatacgccaagggcatgctggtgcccggcaccctgttcgaagagctgggctggaactacatcggccctatcgacggccacgacctgccgaccctgatcgccaccttgcgcaacatgcgtgacctcaagggcccgcagttcctgcatatcgtcaccaagaaaggcaaaggcttcgccccggcggaagtcgacccgattggctaccacgcgatcaccaagcttgaacccctcgacgcccccgccgctgcgcctaaaaaagccagcgggccgaagtattccggtgtgttcggcgaatggctgtgcgacatggccgccgccgacccgcgcctggtgggcattaccccggcaatgaaggaaggctccgacctggtggcgttcagcgagcgtttcccgctgcgttacttcgacgtggcgattgccgagcagcacgccgtcaccttcgccgccggcatggcctgcgaaggcgccaagccggtggtggcgatttactccaccttcctgcaacgcggttatgaccagcttgttcacgatgtagcggtgcagaacctcgatgtgctgttcgccatcgaccgcgccggcctggtgggcgaagacggccccacccacgccggtagtttcgacctgtcctacctgcgctgcatccccggcatgctggtgatgacgccgagcgacgagaacgaactgcgcaagatgctcagcaccggccacctgtacaacggcccggccgccgtacgttacccgcggggcaatggcccgaacgcggtgatcgagaaagacctggaaccgattgagatcggtaaaggcatcgtgcgtcgccaaggcagcaaaaccgcattcctggtatttggcgtgcaactggccgaagcgctgaaagtcgccgagaaaatcgacgccactgtggtcgacatgcgtttcgtcaaaccgctggatgaagcactggtgcgcgagatcgcagctagccatgagctgctggtgacggttgaagagaacgcgatcatgggcggcgccggcgcggcggtcagcgaattcctggcgcgggagaatatcctcaagtcggtgctgcacctgggcctgccggatctgtacgtcgagcatgccaagccggcgcagatgctggccgagtgcgggttggatgaggccggcatcgaagcctcggtccgcgagcgcatggcattgctggccctgtagaaaccgggactaaaatgtgggagggggcttgctcccgatagtggtggatcagttaaaaatactgagactgacagaccgctatcgggggcaagccccctcccacatttattttgtgtcaccttcaaacgctatggacagcccatgaaccgcctgtgccttgccctactgcttctaccttgcgccgacctgctcgccgacacccgcgaccaggcgcttaagctctccgacgtggttatcagcgccaaccgccaggtgcaggcgcgcaacgacagcagcgctgccaacacagtgttcacccgcgccgacatcgaccgcctgcagcccggtagcgtcaccgacctgctcagccgcgtgccgggtgtgcaggttgcgccgacaggtgggcgtggcagtttgccggggatcttcattcgcggtaccaagacggctcaaagtttggtgctggtggacggccaacgcattgccaatgccacatcgggtgacagcggcctgcagttcttgagtgtggatcagattgagcgggtggaagtgctgcgcggctcacgctcggtggtctatggcagcgatgcaattggcggggtcatccagattttcacgcgacgcaatgccgaagccggcatctacccgcgcctgcacctgggttttggtagccaccagacctgggaacgcagccttggcttgtcgggcggtgatgggcgcacgcgcttcaacctcggcgccagcctggatgaaacccagggcatcgactggacccgagaatcctttgcaagcgacggtgatcacgatgcttatcgcaacaagtccatcagcctcaacctcagccactcgctgaatgacgacgtggaagtcggatttaacctgttggatggccgaggcaaggccgagtatgacaaccccttcggccgcaatatcagtttgactgaggccgtgggtatgaggccctacactcactacaccgtgagcagcgccagcagttatgtcgatgccaagctcaacgatgcctggcaaacccgcgtagaaatgggccacagcgagaaccgcgacaaaaagcgtgaccgcttgagcgactacaacagcgccttcaatacctatcgcgattcggttaactggcagaacgacttgagcctgactgagcgtaacagtctgatcctgggcggcgactggtatgaagaccgcgtccacaccagtgaaaacctgaaagccgatagccgctggaaccgtgccgtgtttatccagcatcgattcaaggccgaggcgttttccactgagttgggcctgcgccacgacaccaaccagcaattcggtagccagaacacttggagcggcaccctaaccctgccgctcaacccgaataacgatctattactgtcctacagcgaaggcttccgcgcgccgagcttcaatgacctgtattacccgttcagcagcaaccccaacctcaagcccgaacattcgaaaagctatgaattgcaatggcgtagccaactgagcgacacaacgcgcctggaggcttcgctgtatcgcaccgacctcaaggacgccatcgttgcgcagcagatagatttctatatgccgcgcaatgtggcgtcagcccggatcaatggttttgaagctgcgctcaagcaggagttgtttggctggcaaggtaaccttgggctgtcgatcatcgacccacgcgatcgggacagcggccacacgctggaacgtcgcgcacgccgcaccttgagcctggatctggatcgtcagtttgatcgtttgggcgtggggggcagttggcaagccgtcagcagcagctatgacgacgcagagaacaccaagcgcctgtcgggctatggcttgctggggctgcgcagcagttgggcattgacgcggggcgtgttgttatcggtcaaggttgataacgtgctggacaagacttatgcgcgggcgaggtacagctatgacgagcccaattatgagaacaatcgtgactatcgcgaagaaggccgggtgtggatgtttggggtgacttggacacctgagatctgaaccgacgtcattgcaggcaagccagctcccacatttgaaatgcattcccctgtgggagcgggcttgctcgcgaaagcggcctcacaggtccggcgcaatcacctgacacaaccgcgccaccgcctccaacatctgcccactgggccgctccaaccccttgtctggcactaacaagacgcgtgccgccatcgtcggccatgctttccacgcatccatctgcgcctggtcacccaccagaatcaactcgggatcacgctgcagtaccgattccagactgacctgcggggccggcagcttaagatcatcgaacacattgcgcgccccgcacacccccagcgcatcgctgatgatctgcccaccgcccacggtatacagcggctggttccatacttgataaaacacctgcaagggctcggcacgccgatagcgctggcgcagttcggcgaggcgttggcgcagcttatcggccaacacctggccagcctgcgcgcggcccaattgctcggcaatggcctggacctgggtggtcagctgttcaagactatggggttcggcgacgtacaccgggatattcaggcgctgcaattgctcgcgctgggccgggccaatactgccaggccacagcagaatcaagtcaggcttgaggctgagcaggcgctccatgtccaactggccgtaatgcccgaccgacggcactttcgccaacgctgctgggcgttcgccgccatcgagtacgcccaccagctggtcggcggcgcccagttcaaccacgatttcagacagtgacggcgccaggctgaccactctctcggccgccatcgcctggacactgaataccagcagcagtgccagccggtaacggctcatcccagttgacgcggaatgcggtagaggtaaaacagcaccatggtcgacattgccagcagaaacagcggcactgcttccagcccgacaaacaccgccagcgcaccgatccaggccggcagcgcggccaccagcaaggccgtgcgccgacgcgccgccagggtgatccaggcagcgggttcctcaggggtatcgagggctttggaggtagcgatcagcgcatgtttataaccgtggaaataacgcaggctgagaaacatcgaccccacgccagcaatgaaaaacggcatggccagcacgggaagcagggattcggcgcggccaaataccaggttgatcacaaacaatgggagcaacgccagggccaggtactgccaccagttgaaagacagtcgccgctttacctggcctcgggtcacgcgcggtcgacctcgccctggtgctcgttgcccatcatgtggtcgagcttgctggccttggtggccaggtagagcttgttgtgcgggttgtgcccggtatgcagcggcacgcgctcggccacggtgatgcccatctcggtcaaggccttgaccttgcgcgggttgttggtcatcaagcgcagggatttgacacccaggtgctcaagcatcggcagacagatcgcgtagtcacgttggtcagcggcgaagcccaggcgttcgttggcttccacggtgtcggcgccgccatcttgcagttcgtaggcacggatcttgttcagcaggccaataccgcggccctcctgacgcaggtacagcagcacgccacggccttcacgggcgatggcttgcattgccgcttccagttgcgagccgcagtcacagcgctggctgaacagcgcatcgccggtcaggcactcggaatgcacacgccccagcaccggcgcgccatcggtgatgtcgccgaggctgagcacaacgtgctcgcgcccggtggcttcttcgagaaagccgttcatggtgaacgtggcaaaaggggtaggcagcttggaagcagcgacgaaaacgacgggcaccgtgtgctcctgatttcagatttcacagaggcggccattgtaacagtacgttcctacagacgcttaagctgaattatcgctgataaagatcaataggttcgattggccttcggattgattctatgtaggcgcgagcttgctcgcgaaagttgtcaacgttaatgcggccattctgaagcaacgcggcgcctatggtttttttcgcgagcaagctcgcgcctacagtgaactagaacggatagggctggttccagcgtgcgaaaatccctttcaactcgcccgtcttgaccagactggtcaggcgctggtcatacaccgccatcaacgcccgcccgcgctcggaatcggcaaagccgatgtaaagcggcaactcggcgatatgcgtgagtttgaacagcgccggctcgtgggattggctgagcaaatacttggcttcagtgagggcgtcgatataaaaatcggcgcggccgtgttgcagcatcggcaggatgccgctgcgccgctcgatctggttgaagcgacgcacgctgggcatgtattgctcgtacttgtagccccgcacccaggcgaggcggtagtcgcccagcgtcgccaatgtcggcgttggcgctgttgccagcccgagggcgtaaatgtggtcggcgtcgaagttccaccggggatacaacactgcgctggcttcattgcgatagctgccgacataaccatccacctcgccgcgctgcgtcaggccgaccgagcgggtatagggcacgctgcgagtttgcaaggtgataccagcgggctcgaaaatctgacgcaacaggtcccaggccaggccgctgccatcttggttggtgtagtcgttccactgctcactggccagcacgatcttaccaggcacaggcatctgttccgcctcggccacgaaggcaaaggcacacagcacggtcagcagccagcggcgcacagccatagtgacggcctctcctggagtaaacctattaagggtagcaggacgccagcttagggcgcccggcgaaaatgctggtagccgcgcaccgccggggtgacgtcctggccgttggcatcgagcagcgtcacgccctgcccggcttcgacccgaccgatcacatgcactggccagttgcccgcctgcaacggcaccaattgagacgctggcaaagtgaacgccagcacgtagtcatcgccgccgctcaatgccgccacacgggcctggtcttcgccgacaaatgccagcaaggccgtggataacggcaacctgtgacgttcgaccaccaggcggaccgccgaggccttggcgatatgcccacaatcggccagaagcccgtcggagatgtccagggccgcagtcgccttgccccgcagcgccagccccagggccaactgcggttgcggcgaccagtaatgggccagcagcggctcggtgattgccgcatccgccgtgcgctggcccaataccagcggcaaagcgccggcggcattgccaagctcaccgccgacacatagcaggtcacccggccgtgcaccgctgcgcgtcaacgcctgcccggccggcacactgccaaacacggtcagggtcaggctcaacggcccgcgggtggtatcgccgcccaccaagcccacgccgcagctttgcgccatggcgttcaagccttgggcatagcgttgcagccagtcgatatcgacgctcggtgtggtcagggcaagggtgaatgcgagggggttggcgcccatggcggccaggtcgctcactgccacggccagcgagcgctggccgagcaggaagggatcacacgggtcggcaaaatgcacaccggccaccagcgtatcggtagagacagccaactgctccccggcggggagcgccagcaaggcgcagtcgtcgccgatccccagggcaatgccttcgccgccttgcgcacagggcgcagcggcgaagaacctgctgatcagctcgaactcgcccattcgggaactcaagcgcaggttagcgcttgtgctccttcacttcggcttcgcgcaagcgcggggccagtttgtcgagcacgccattgacgaacttgtggccgtcggtcgaaccgtagactttcgccagttcgatgccttcgttgattaccacgcggtacggtacgtcaacgcgcttgagcagctcccaggtagacaggcgcagtaccgccagctcaaccgggtccagctcttcgagggtcaggtccaggcatggcgacagcgcagcatcgatctcggcctggttggccggaacaccgtgcaggatatcgtggaagtagctctggtcagcaaaggtgaagtcgttatcgacgcgaaattgcgcttcgatctcgttcagcgaagtgccggccatgtgacgctggtacagcgcctgggtggcgagctgacgggccgcacggcgcttttcacttttcgagggcttgccggcatcggccggacgctcgtcgcgcgggttgaaacgatcgctctcgtcggaaatcacttggcctccaactgcgacagcaggctgaccatttccagcgcggacaaggcagcttcagcgcctttgttaccggccttggtgccggagcgctcgatggcttgttcgatggagtcaacggtcagcacgccaaaggcaaccggcacgccgaactccatggacacctgggccaggcccttggtgcattcgccagccacgtattcgaaatgcggggtaccgccacgaatgaccgcgcccagggcgatgatcgccgcgtactcgccctgttgagcaactttttgcgcaaccagtgggatttcgaaggcgccaggggcacggataagggtgatgtcgctctcgctcacaccgtggcgaaccagggcgtcaacggcaccgcttaccaggctttcaaccacgaagctgttgaagcggccaaccaccagggcatagcggcctttgggggcgatgaaggtaccttcgatggtcttcagggtcattcgacaaatctcttaaagagccgggacgcgaaaagtgcgtccctcagtgatgatttaaccgcgaacaaggggcagaaatcgccagcctttattcggagggcacgtattctacaacttccaggtcgaatccggatatcgcattaaatttcatcggtgcgctcatcaggcgcattttgcgtacaccgaggtcgcgcaggatctgcgaaccggcaccgacgatgctgtaggtggtcggttttttcactggcacggcgtcagcggtttcgcggatatgcgccagcaagacatcgccgtccaatgggtgaccgagcaacaacaccacaccgctgcccgcctcggagaccgcagccatggcggcgcgcaggctccaacgacccggttgcttgaccatcagcaggtcgcgcaggggatccatattgtgcacccgcaccagggtcggttcttcggcgcaaatattgcccagggtcagggccatgtgtacgtcgccttccactgaatcacggtaggtcaccaaattgaattggcccagttcgctgtccagcggctgctcggcaatccgctgaacggtacgttcgtggatcatgcggtagtgaatcaggtcggcgatggtgccgatcttgaggttgtgttcggcggcaaaggcttcaagctcagtacgacgggccatggtgccgtcgtcgttcatcacttcgcagatcaccccgctcggctcgaaaccggccatgcgcgccaggtcgcaggcggcttcggtgtggccggcgcgtgccagggtgccgcccggctgggccatcaacgggaagatatggcccgggctgacgatgtcttcggccttggcgtccttggcggcagcagcttgcacggtgcgcgcacggtcagcggcggaaatgccggtggtgacgcccgtggtggcttcaatcgatacggtgaacttggtgccgaaacccgagccattgcgcggcgccatcaatggcagcttgagcaattcgcagcgttcgcggctcatgggcatgcagatcagcccgcgagcatgcttggccatgaagttgatgtgctcaggcaggcacgcctcggcggccatgatgatatcgccttcgttctcgcggtcttcgtcatccatgaggatgaccatcttgccttggcggatgtcttcaaccagttcttcgatgctattgagcgccacgcggcacccccttggtcaggatttcaggtagccgttggcggccagaaaactttcagtgatgttcccggatgcaggctctgcggccttttcgcccatcagcaggcgctccaggtaacgggcaagcaagtcgacttcgagattcacccggcgacctggctggtatgacgccatgatggtttcgctcaaggtgtggggaatgatggtcagttcaaattcggcgccattgacggcgttcacggtcaggctggtgccgtcgacggtgatcgagcctttgtgggcgatgtacttggccagctctttgggcgcgcggatacggaattccacggcacgcgcattttcgctgcgggccactacttcgccgacaccgtcgacatggccgctgaccaggtgaccgcccaggcgcgtggtaggcgtcagggctttttccaggttgaccgggctgccggccttgaggtcgttcatcgcggtgcagtccagggtttcccggctgacgtcggcggcaaagcctttgcccggcagctcgacgacggtcaggcacacgccgctgacggcaatgctgtcgcccagcttgacgtcgcccaggtccagcttgccggtttcaaccagcaggcggacgtcgccacctttgggggtcattgcacggatgctgccaatggcttcgataatgccggtgaacatgtcgttctcctgaaaacgagggcgggcgctcaagcgcaggccgggaattatacgctcgctgccgggacgggaatggcagtgactcgccagtcgtcgcctacagcacgcatttcagtgatcttgagtcgaggggcgtcggccagcttttcaagcggccagtccagcagcggccgggcggcggatccgaggaatttgccggcgatgaaaatcacgtattcgtccaccaggtcctgttgggcaaacgcacccgccaggctcgggccggcttccaccagcacctcgttgacgccacgtgcggccaacgccaccagagcagaacgcaggtcaacctgaccgtccacgcccggcaccaccaggcactcggggccgcgggggtactggttttgcgcggtgacgcaggtgatgaccaatgccggtccggctttgaaaaagggggcgttgagcggcacccgcagccggccatcgatcaacacgcgcaacggtgggcgcgacatggccagggccgtggtggcttcatccagacccagctcagcggcacgtacggtcaagcgggcatcatcggccagcaccgtgtcggcaccggtcaacaccacactggcctcggcacgcaggcgctggacggcggcgcgggcagcggggccggtgatccattggctttcgccgctggccatcgcggtgcggccgtccaggctcatggccaacttgacccgcacaaacggcaggctgtgctccatgcgcttgagaaagcccgggtttagcgcccgcgcctcagattccaatacgccgctgcgcacctcgataccggcctgggccagacgctgcataccgcgcccggccacttccgggttggggtcctgcatgcctgcgaccacccgcgccacgccagccgtcaccagcgcatcggcgcagggcggcgtatggccatggtggctgcacggttcaagggtgacgtacaccgtcgcgccacgggccttgtcaccggcggcgcgcaaggcattcggctcggcgtggggctcgccggtgcgctcgtgccagccttcgccgacaatctgcccgtcacgcacaatcacgcagcctacccgcgggttggggtgagtggtgtacaggcccttgcgcgccaattcgagggcgcgggccatgtaatgggcgtcaaggaccgcctgttcagcgctgggtgggttcatttcttcaccggctcacgggccaggcggtcgatttcttcgcggaactcattgaggtcctggaagcgtcgatacaccgaggcaaaacgaatataggcgacttcgtcgagcttttgcagctcgcccatcaccagctcgccgacgaccaggctcttgacctcgcgctcgccggtcgcacgcagcttgtgcttgatgtgcaccagcgccgcttccaggcgctcgacacttaccgggcgtttttccagggcgcgctgcataccggcgcgcagtttttcttcgtcgaaaggctggcggctgccgtcggacttgatcagacggggcaataccagttcggcggtttcgaaggtggtgaaacgttcaccacaggccaggcattcgcgccgacgacgcacttgatcgccctcggcgaccagacgcgaatcaatgaccttggtgtcgttggcaccgcagaagggacagtgcatggttggcaggcaacaaaaaatgggagggccatggtagcgcatccccgtggcaagacaagccatagcctttacggtatataggcaggcctatatgtttcatatttttaagccacggattttgtcctttctggagccgtacatgcagttacgaccatttgttctactcaccctgttcagttttctggtcgcctgcagcagcgaagcccccaagccggccgcgcctcaaccgacaccggcgcaagagaaaaaagtcccgggcattgaagacctcggccccctgcccgcctatcaacgggaaatcagcggcagcctgaccaacgtgcccgccggcgccgaagttgaaatggcgctgctggtgatcgacgaccgttcgcgcccgcaacaactgctcgccagcagcgtgctgagcggcaatggcaagccgctggccttccgcctgcgcttcaaccctgaagccttcccggccggtgcgcgggttgaattgcgtggccgcgccagccagtctggccagttgatcctgcacctgcctgcggtacgcatcacccaggcgatcacccagagcaccggccccctgcaactcgtcaaggcgccatgacaccaccgcagcacctgcagtgtgccctgagcgagttgatcggcgacgcccaattggtgccctgcccgctgccgggcaccgacctgtcgctgtggctgctcgacgccgacaacatggaccgcgccttcagccaggaagaaacccggcgcatcctgcatgagccgccctactggagtttttgctgggccagcggcctggcgttggcacgctacctggcggcgcattccgagtgggtcgcgggcaaacgcgtgctggacttcggcgccggctctggcgtggccgggattgccgcggtaaaagccggcgccctggaagtggtggcctgtgacctcgacccgctggccctggcctcttgccgcgcaaacgccgaactcaaccaggtggaactgggctattcggcagactttttcgccgaagccgaccgcttcgacctgatcctggtcgccgacgtgctttacgaccgcgccaacctgccgctgctggatcaattcctcagccgtggccgcgaagcgctggtggcggattcgcgggtacgggacttccgtcacccgcattatcaacggctggagatcctggacgcgctgaccctgcctgacttggccgagccttgggagtttcgcaaggtgagcctgtaccattcgcggcgccagcccttatagttgcccccattcccgctttattcgagacgccccatgagtgagcccacgccgtacatcttcgacgtcaccaccgccaacttcgaccaggcggtgattcagaattctttcgaaaaacccgtgctggtggacttctgggccgagtggtgtgcgccctgcaaggcactgatgccgatgctggcgcagattgccgagagttatcagggcgagttgctgctggccaaggttgactgcgaggccgagcaggacatcgtggcgcgctttggcattcaaagcctgcctacggtggtgctgttcaaggatggccagccggtggacgggtttgccggtgcacaaccggagtcggcagtgcgggccatgttggaaccccatgtgcagatgccaccaccagctgcggcggatccgctggaacaggcccaggcgttgttcagcgaagggcgtatcagcgaggccgaagcgctgctggtggcgctgttgggcgaggacaataccaacgccccggcactgatcctgtacgcacgctgcctggccgaacgcggtgagttgggcgaagcccaggccgtgctcgacgcggtgaagggcgacgaccacaaggccgccctggccggggccaaggcgcagatcaccttcctgcgccaggctgcggacctgccggatgctgcagacctgaaaagccgcctggcgcaaaacccgcaggacgatgaagcggcctatcagctgacgatccagcaactggcgcgccagcaatacgatggggcgctggaaggtctgctcaagctgtttatccgcaaccgcagctacagcgaaggcttgccccacaagaccttgctgcaggtgttcgaactgttgggcaatgatcacccgctggtcacggtgtaccgccgcaagttgtttgctgcgttgtactaatcagcgatccaactgtacagcggcgtatcaccgccgctgctcactttgaccttggcgctgtggcgcaggcgtaccagcaggcgcttgcctgccccggcatcgccagccaacccttccagttgatcgagcaattccagaccattgagctgcccggcgttgcgcagcaaatcctgggcgtgcagccacagatcctcgctctgtttgactggcgtcgtcatcgacgcactgggcgttggagcagcctgtaactgtgcgcccagccgcgcccaatcaccgtcatccagttccagggtcaagtccaccggcaggtcgccgacggttccacgaattcgcaacatcgttcttactcctgcatttttctgatgggcatgctcccatgccgcttgcgcaacgccaagcgggcggtcaaactcaaacttattgttataagatcacataacataactttcatcttggagccgtcccatgcgccgtttgctgctcgctttgccgtttgccctgctgccactggctgtcgcacatgctcacgaagatcatgaccacgagcatggcagtcttggcgcccacgaacacggcgtcgctcgcctcaacgcggttctggacggccaggccctggagcttgaactggacagcccggccatgaacctggtggggttcgagcatgccgcgaccagcgccgccgacaaagccaaggtcgccgccgcgcgcaagcagctggagaacccacaggcactgttcaacctgcccaaggccgcaggctgcaaggtcagcagccaggaactcaacagcccgctgttcggtgacaagcccgaagccgagcatgacgacgatgaccacgccaccgacggcaaaggcgctgccgcccacgagcatcatcacgaccacagcgagatccacgcccactatcagttcacctgcgccacgccgacggccctgggcaacctcgacctgaggcaagtgttcaagaccttccctgcgaccacgaaaattcaggtacaactgatcggcccaagcggtcagcaaggtgttgacgcgacggccaccgcagccaccctgaagttctgagttcacatgacccacccattgatcgaactgtccaacctgagcttcaactggcccggtcacccaaagttgctggacatccccgcgttccgcctggagcctggggaaaccctgtttctcaagggcccgagcggcagtggcaagaccacgctgctggggctcttgggtggcgtgcagaaacccagccagggcagcatccgcctgctcggtcaggaattgaccgaactctcggccggcgcccgtgatcgtttccgcgtcaaccacaccggctacatcttccagcaattcaacctgctgccgtttctgtcggtgcgtgaaaacgtcgagctgccttgccacttttccaagctgcgcgcacagcgggcccggcagcgccacggcagtgtcgaccaggcggccgcgaccttgctcgcgcacctgggtttgaaggacaaggatctgcttgagcggcgctccgactcgctgtcgatcggccagcaacaacgggtcgccgcggcccgtgcgttgatcggccaaccggagctggtgatcgccgacgaacccacctcggccctggactacgacgcccgcgaagccttcatccagttgctgttcgctgaatgccgcgacgctggcgccagcctgttgtttgtcagccatgaccagagcctggcgtcgctgttcgaccgcaacctgtcgctggccgaactcaatcgcgccgcaacgcccgcagaggtttgagatgtatctgttccgtctagccatggccagcctggctaaccgccgctttaccgcgatcctcaccgccttcgccatcgcgctttccgtttgcttgttgctcgcggtggaacgggtgcgcgtcgaagcgcgcaacagtttcgccagcaccatcagcggcaccgacctgatcgtcggcgcacgttcgggctcagtgaacctgctgctgtactcggtgtttcgcatcggcaacgccaccaacaacattcgttgggacagctacgaacacttcgccgccaacccccaggtgaaatgggcgattccgatttccctcggcgactcccatcgcggttaccgggtgatgggcaccaacgaatcctacttcgaacactaccagtacgggcgcaagcaaaacctcgaactggccagcggccgcgctttcgccaccgacccgttcgaagtggtgctcggcgccgaagtcgccgacgccctgcattacaaactcggcgacaagctggtgctggcccacggcgtggctgtggtcagcctggtcaagcatgatgacaaacccttcaccgtggtcggtatcctcaagcgcaccggcaccccggtggaccgcaccctgcatatcagcctgggcggcatggaagcgatccatatcgactggcacaacggcgtgccggcccagggcaaaggccgcgtcagcgccgaccaggcgcgcaatatggacctgactccacaagccatcaccgcgttcatgctcggcctgaacaacaagatttccaccttcgccttgcaaagggagatcaatgagttccgtggcgagccgatgctggcgatcctgccgggcgtggccctgcaagagctgtggagcatgatgggcaccgccgagaaagccttgttcgtggtctcgctgttcgtggtgctgaccggtttgatcggcatgctcacggctattctcaccagcctcaacgagcgccgccgcgagatggcgattctgcgttcggtgggcgcgcgcccatggcatatcgccacgctgctgattttcgaagccttcgccctggccttggccggcgtggtggcgggcgtggggttgttgtacctgtgcatcaccgtgtcacggggttacttgcaggccaactacggcctggatctgccgatgtcctggccgagcgaatatgaatggaccctgctggcgggtatcctcgcagcagcgctgttgatgggcagcgtgcccgcgtggcgtgcctatcgacaatctttggccgatggcctgtccattcgtttatgaggaaggcttcgatgcgtcgtgccctgtttgccctgttgctgctggtgagcgtgcccgtgtgggcggatgagccgcccagggacttgtcctggcaggagatgatcccgccggatgcaccgccggaaatccccaatatgaaaccgctgcacgacctgtcgaacatggccgatgccttgtccgtcgaggctgcccccgcggccaagcaggacctgcccaacgcgccggtggtgcagggtctcgacggccagcacattcgcctgccggggtatatcgtgccgctggaagtcagtgaggaaggtcgtactaccgagttcctgctggtgccgtatttcggcgcgtgcattcatgtgccgccaccgccgtcgaaccagatcgtgcatgtcaaaagcgaagtcggcgtgaagctcgatgagctgtatcagccgtactggatcgaaggtgcgatgcaggtcaagccgtcgtcgagtgaactggccgacgccggttaccagatggatgccgagaagatttacatgtacgagctgcaggagtagcgctgatcaacctttcattgagctgagtcaaaagactgaacggaacgatctttaccattggacgtacaacttttaacgtcctctggagctcccatgaacaagtctctgctcggcgcgtccctcttcgcgctcgccctcgtcgccccggtcgcacacgctcaccaagcgggcgatatcctggtgcgtgccggtgcaatcaccgtgaacccggacgccgacagcggcaaagtcaaggttgaccagggcccactggccggcaccaacttgggcggcaaggcgaccatgagcagcgacacccagttgggcttgaacttcgcctacatgatcaccgaccacgtgggtatcgaactgctggccgccacgccgttcgagcatgacgtgaaactcaagaacaccgccctgggcgccgccaacggcaagctcggctcgctcaaacacctgccgccgaccctgagcgtcgtgtactacccgctggacaacaagtcggcgttccagccctacgtgggtgccggtatcaactacacctggatctacgacgaacacgttggcggccgtgccgaacaagccggtttcagcaacttcaaggccgagaactcctggggctgggccgcacagatcggcgccgactacatgatcaacgacaaatggatgatcaacgcccaggcgcgctacatcgacatcagcaccaaggcgactgtggataacaacgcgctgggccaaggcactcgcgccaaggtcaatgtggacgtggacccaatggtttacatggtgggtatcggctacaagttctaagcgatatttcacgaacaccacacaaccaatgtgggagggggcttgctcccgatagcggtggatcagtccatgaacctgttgactgacactctgctatcgggagcaagccccctcccacattttggttttgtgtggtgtcagctatggcgatagaagcggtccagcaacgccggcaaccctgcccgccacgcccggggcttgatgccgaaggtgtggaggatcttcttgcacgccaacaccgcgtgctgcggttcttctgccgcatccggccgcgccgcgtgggcctgggcggtgggggattcaatggccagcgcgtggaaattgcgcgcctcggtgaggatcgcctggccaagcgccagcggcgtggtcgcttcatgcccggcatagtggtaggtgccccacaacggcgccgcgcaatcgagttgcttgagcaccgagatgatcacccgtgcggcatcgtctaccggcgtcgggttgccgcgacggtcgtccgccatcagtaactcgtcgggtttctcggcacgggccagaaaacgcccgagcgttccgtcaacgctgtcatccagcaaccagccaaagcgcagcagcacatgctgtgggcaggtggcgcgcacgctttgttcgatacgccacagcgcctggccgcgcaggcccaggggcaccggctcgtctttctcgctgtaggcggtggcccgggagccatcgaacacacgatagctggacggttgcagcagcgtgatgctgtggtgctgacacagttcggcaaggcgctcgatggcgaattcctggccggccaggcgtgtttcgcttacggcttcggcctggaaccagtcgaaatagtaggcgagattgatcaacgcatcgggacgggtgtcgtcgagcaattgggtgaggcttgcggcatcccagccgtcttggggcggtttgggtgcgaggaaaccgatgtcttcctctgcaccgaggcgaatcagcgcctgcccgagggcattcccgccgcccagtaacataaggcgcattcgcatagattgagcaggcccggtctgtttggaacgatggttgttgtcggcaggcgcgtgagccttgccgtaggtttattccagaatcgttgcattttgcgggtttgtagcgcaaccgtcacggataaagtacgtgtttgcaacttgttggagcaggtggcatcaatcactacatgaacagtcccgaatcaacgaacagcgcactggacggattccaccccgccgtcagcacctggttccgtaacacgttcccttcggtgaccggcgcacaggcccaggcgtggccattaattcgccagcgccgctcaacgttgatcgccgcgcccaccggttccggcaagaccctcaccgcctttctcgcagtgctggacgatctggtgcatcaaggcttggcgaacggtggacaactgccggatgaaacactggtggtctacgtctcgccgctcaaggcactttccaatgacatccagatcaacctgcaaaccccgttggcaggcataaccgagcaccttgaaaagctaggcctgccacccctggtcattcgcaccgctgtgcgcaccggcgacactccgcaaaaagaccgcgcccagatgcgcaaacgcgcaccgcatatactggtcaccactccggaatcgctctacgtgttgctcggctcggattccggccgacacatgctcgccagcacgcgcacggtgatcgtcgatgagatccacgcgatcgccgccggcaagcgtggcagccacttggccttgagcctggagcgcctgcaagggctgtgtgccgagccattgacccgtatcggcttgtcggccacgcaaaaacccatcgaagccgtcgcccgctttttagtcggcaccgaccgtaattgcgccattgtggatatcggccacgcccgcccccgggacctggcgatcgaagtaccgccggtgccgctctcggcggtaatggccaacgacgtgtgggagttagtctacgaccgcctcgcgcaattggcccgcgaacaccgcaccacgctggtattcgtcaacacccggcgcctggccgaacgcctggcccggcacttgagcgagcgcctgggcaagaccgccgtggccgctcaccatggcagcctggccaaggagatgcgcctggacgccgaacagcgcctcaaggccggcgaactgcaagtgttgatcgccacggcatccctggagctggggattgatatcggcgaggtagacctggtctgccagatcggctcgccgggttcgatcaacggctttctgcaacgggtcggccgttccgggcaccaggtcggcggcacgcccaaggggcgcctgtttgccaccactcgcgacgacctgattgagtgcgccgcgctgctcgactgcgtgcgccgtggcgagctggataccttgcatattccggtggcgccgctcgatgtactggcccagcagatcatcgccgaggtcagcgcccaagaatggccggaacaggcgttgctggcgcttgtccaccgcgccgcgccctacgccgaactggatgaacgccactaccaggcccttttgcagatgctcagcgagggctataacggccgccagggcatgcgcagcgcctacctgcaccgcgacgccgtgacccacaccctgcgcggccgccgtggcgccaggctcaccgcagtaaccagcggcggcacgatccccgacaacgccgactacagcgtgttgctggagccgcaaagcctgaatatcggcagcgtcaacgaagactttgcggtggaaagcatcgctggggatatcttccagctcggcaatacctcctatcgcatcctgcgggtcgaagccggcaaggtgcgggtcgaggatgcccagggccaacctccgaccattccgttctggctgggtgaagcccccgggcgcagcaacgagttatcggtggccgtggcccgcttgcaagggcaattggacagcttgctcggcgccacgcccggcgacctgcaaccggccctcgactggcttaccggcaccctgggcctcaatgtcgccagcgccgatcaactgttggactacctcgcccggtcgcgccttgccctgagcgccctgccgtcccaggacacattgatcatggaacggtttttcgacgcatccggcggcacccaactgatcatccacacgccgtttggcagccgcatcaaccgcgcatggggcctggccttgcgcaagcgcttttgccgcacgttcaatttcgagctgcaagcggcggccagtgaaaatgccatcgtgctgtcgttgtccaccagtcacagcttcgcgctggatgaggtgtggcgttacctcaacagcaacagtgccgaacacatcctgatccaggccgtgctggatgcgccactgtttggtgtgcgctggcgctggaatgccggcgtcgccctggcgctgccgcgttataccggcgggcgcaaggtggcgccacagatccagcgcatgaagagcgaagacctgatcgccagcgtgtttcccgaccagatcgcctgcctggaaaaccttgccggcgaacgcgaaattcccaaccacccgctggtggagcaaaccctcgacgactgcctgcacgaagccatggacagcgacgcctggctggcgctgctgcggcgcatggagcgcggcgacgtgcggttgatcagccgcgacctgcccgcgccctcgcccatggccgcagaaatcctcagcgccaagccctataccttcctcgacgacgcgcccctggaagagcgccgcacccaggccgtgctcaaccgccgctggagcgacccgcagagcaccgacgacctgggcgccctggatgccgacgccgtcgccggtgtacgcgaagaagcctggcccgcgcccaatggcctggatgaaatgcatgaggcgctgatgagcctggcatgcatcgcagcgagcgaagttacgccgcaatgggcccaatggctgctggcattgcgcaacgccgggcgggcctatcagttgtctaacggaatatgggtcgccgtggagcgcttgagctgtttgcaggcgctgtatcccaacgatctgccgttgctgccggggttcgatgagccctggtccttcgatgaagcgctggtggaagtgctgcgtgcgcgcctcagtggttttggcccgctgaccctggtcgagatcgcagcgcccctggccttaccggtggagtcgattacccaggccctggcacgcctggaacaggaaggctacgtgctgcgcggccacttcagccccggcgtgggtgaagaacaatggtgcgaacgtcatttgctggcgcgcattcatcgctacacggtcaagcgcctgcgccgggaaatcgagccggtggcattgcaggatttcatgcgctttctgttcgattggcagcacctgtccgacagcacccgtggccagggcagcgcggtgttgccgcagattgtcggccagttcgaaggctatgccgcggccacgtcggcctgggacaccgacctgctcagcgcccgcatcaaggattactcatcgacctggctcgatgacctgtgccgcagcggcaagctggtctggacgcgcctgagcaacaaggccggcgccatggcgttgcgcagcaccccggtggttttgctcccccgtagccaggtagcgttgtggagcgggctgaccgagcctaccgacagcaccaccttgtcgcccaaggcccagaaggcccacctggccctgcgcgagcatggcgcgctgtttttcgatgaactggtgcacgaggcccatttgctgcgcagcgaactggagatagccttgcaggaactggtaggcgccggcctggtgaatgctgacagtttcgccggcctgcgcgccttgaccatccctgccagcaaacgccaggcgcgcagcagtcgacgtgggcgcggggcgtttgtcggcggtatggacgatgccgggcgttgggccttggttcgccgctcggcgaccgccgccggcgcgcattcggccgagaccctggagcatgtggcgatgaccctgctgcgccgttatggtgtagtgttctggcggctgctggagcgtgaggcggactggttgccaagttggcgtgagctgctgcgcactttccatcggttggaggcgcggggcgaaattcgtggcgggcggtttgtcagtgggttggcgggggagcagtttgcattgcctgaggcgataccgctgctgcgcgaggtgcggcggcggccccatgatgggagtttgattgcagtgtgtggggccgatccgttgaatcttgtgggcacgctgttgccgggggccaaggtgccagcggtgagcggtaatcggattgtgtatcgtgatggggtgccggcggcggtgatggtcgccggcaagcaacaggtgttgctggaggtggatcagcaagcggtgcaggagaagttgatcaggcgctgaccttgagggcctcatcgggggcaagccccctcccacacttgaaatgtgttcacaaatctaaatgtgaggggcttgctcccgatggggcctcatcattgagacctgggctgctcagtcagcaccagcgcatccggctcttccacctgcgccacacgttttggcaacaacacctgctgtggataagtctgcgcaaagtgcacctcatcacagttatccacaagttttttcaaccgctggttaaacgcccggctgaccgcatattgcccacccgacaccgtacggaactgtgcggtaagcaccacgccattgaggtccatcttgtccacgccaaatacttccagcggcccttgcaggttgtatttgaggaacacgtcgtcgcgaatcgattggcccgcttcgcggatcagttccacggccttgtccacgtcggtgtcgtaggtgaattgcaccgagaagaaggcataggcgaactgccgcgactggttggtaaccgccttgatctgcccgaacggcaccgaatgcacaaaacccttgccgtcgcgcaagcgcagggtgcggatggtcaggccttcgacggtgccggcgtggccggagtcgagcaccacccaatcgccgatggacagggtgtcttcgataatgatgaacaggccggtaatcacgtcctgcaccaactgctgggagccgaaaccaatggccaggcccaccaccccggcacccgccagcaacggcgcgacgttgatgccaaggtttgccatggtggtgatcgcgcaaatcaccaccaggataatcttcaccgcattgcgcagcagcggcaggatggttttcacccgggtgctgggctggcggctggagcgtttattcaccggcggcttgagcgcttcctggatcgccgtgtcgagcaccacccagaacagccaggtcaccaacaggatcaggccgatgctactgagggaatcgctgatggcccggcccaccgagttgcgctgggcaaattcgaatagcgaaacaccccagatacgcccgaggatttcgataaacgcgatagccatcacgatacgcaggatcgcgtgcagcaaactgaggaagcgctccttgtaggcgctgctgcgttggatcgacacttggctgcgggatttgaacaggtgttgcagcacggtgctgagaaacacggtgccgatcagcagcagcgtggtgagcagtgcgcaacgcagggccttttggttgtcgtcgccggcgccgatcaggttgaccgccgacaccagcaccatcaacaggatcggccagtaccaaagcccggaaaacacccgcagcgattgctgcaaggccggatgtttgaggcgctgggccaacggccggttacggatcaaatgggccaccggacggcgcaggcgcaccaccagcacaccaaaaattactgcggcaaacaggccggtaaataccgcgatactgctggtgatattgccgcccagttgacgagcgatctgcgggctggtcaacgcgtcgctgagggcggcaaggaagccgatcaggaacagcggcttggggcagtagtcacgaataatctgcacggcgggccgtttgtgcccgacgttaaacatcacaatgacgcacagcagcatcgaggtcgaaaagatgccgctgctggtggcataggcaaaacacagcgccagcgcacggcccaccgaagcggccaagaagtggcttacatagagggtaagcggcaggcagatcaacgctggaatcgtgtagggcactatgtagccgagcaagccttgcaagcgctggcgtcgtgcgacgaacgggcgccggctggagcgctgcacgacccagtgccccagtaacgtcaacacggcaaaggcaccgatccacaccccggacaacagcagaaaatcgccggccacactccacggtgagcgcgcggcggtctggtcgaccaggcgccccacttcatccgccgcccgatcggcacgcaggcgccaggcatcgacgaggttctgattgaggtcgagcttgtcctgcacgtcatcgatactggaactgatggccccgagcagcccgccctccaccaacagctccggcttggccggcgtttcggtggcaggcgcggtggccgcggcttgcagtgcgccgttgccgcacagcaacagtgcggcgagcagtaatgcagtctttagattcagcaaaacaacgggctccttcagcagggtctgtaaggaactgacgggtttggccttggatcgttccctgcgctttttgggcatgtgattcaaaaaggtggaaggggcttgtccctcccacatttggcaccccgtaccgtctgtaggaatgtggaaactttcaggcaaatatcgcagtcatcccataacggaggtcaatccacccatcatttacgggagcaagcatggcggcgattcatatcggcatttccggctggcgctacacgccctggcgcggggacttctaccccgaggggctgacccagaaacgcgagctgcagtttgcgtcacgtgccgtcaacagcatcgaaatcaacggctcgttctacgcgctgcaaacccccaagcgctacgccgaatggtatgccgatacgcctgagggcttcgtattcagcgtcaaggcgccgcgctatatcacccatatcctgcgcctgcgggaggtgcacaagccaatggcgaacttcttcgcctccggggtattggagttgaaggaaaaactcggccccatcctttggcagttcccgcccagcttcaagttcgacgccgcgctgtttgaaaccttccttgccgaactacccaccgacacccatcaggccgctgccctggcccgccaacatgagtcacgcctgaacggcaaggccagcatgaaagcctatgccaagaagcctttgcgccatgccgtggagattcgccacaagagttttgcagtgccggaatttgtgcagatgctggacaagcacggcgtcgccctggtggtggcggacaccgccggcaagtggccgtatatcgaagacgtcaccgccaacttcatgtacttgcgcttgcacggcgacaagcagttgtatgccagtggctatagcgccgaagcgctcaagcgctggggtgaccgtatcgagcgctgggccaacggcaagcagcctgcggacgcgcacctcgtcgacccacaacacaaaccccgtgcccgcaaacaacgcgacgtgttctgctttttcgacaatgacatcaaggttcgcgcccccttcgatgcacgccaattgctgcagcgtttcgaactggacaagcacctggccaccgagcccggcaagttgccggaacccggagtattgccatgacccagcccgaattgattccgatcacgccgactactcccatcactcgtttcaccgtgctgacggtcaatatccacaagggcttcacggccttgaatcggcgcttcatcttgcccgagttgcgtgaggcagtgcgcagcgtgggcgccgacatggtgttcctgcaggaaattcacggcacccacgaacgtcatccccagcgctacagcgactggccaaaaatgccgcaatacgaattcctcgccgacagcatctggccgcagtttgcctatggtcgcaatgcggtctacccccatggcgaccatggcaatgcactgctgtcgaaattccagatcattcgctacgacaacctcgacatttcccaaagcggccacgaaaaccgtggcctgctgcattgcgtgctgcgcttgccgggtggcgagcgcgagatacatgcgatctgcatccacctgggcttgcgcgaggtacatcgccagcagcaattgcgcttgctggagcagcgcatccgcgagattccggccgatgcgccgctggtggtcgccggcgattttaacgactggcgccaaaaggccgacctgagccaaagcggcctccatgaggtgtttgtccatgcccatggcaagccggcacgcactttcccggcacgcctgccattgctgcctctggatcgcatctatgtgcgcaacctgacgatccataatcctcgcgtgctcaccacgcggccctggtctcacctgtcggatcatgtgcccctgtcggtggagattgagctatgaacgttgcggtagagcatatcgccaccgaccagccgccggacgacagcaaggcgcgcgacatggattacggctggcagagcggcaaccgtgtggagttgctggagaatggcgaggcgtactttcccgcggtgttcgacgccttgcgcggcgcccagcgcgaaatcctgttggagaccttcatcctgtttgaggacaaggttggccatgagctgcaaggcatccttatcgaagcggcgcagcgcggggtgaaagtggtggtcagccttgatggctttggatgtggcgagctgagcccggcctttcttggcgaattggccgaggctggagtgatggtgcagatgttcgacccagcctccaagaccctgggcatacgcacaaactggttccgccgcctgcaccgcaagatcgtggtggtggacgccagcgtggcgtttatcggcgggatcaatttttccgccgaccacttggcggatttcggccccgaggccaagcaggattattcagtacaggtgatcggcccggcagtggctgacctgcaccactttgccctggcccaaagtggtcgccaggtgcgcagccgtcgtggctggcgacggcgtcagcagcggccttcgccctggaccaacgagcaaggtgacggtttggtgcgcctgatttatcgcgacaatatccagcatcgcgacgacatcgaagaggcgtatatccacgccctgagccaagcccgccagcgagtggtgatcgccaacgcctacttcttccccggctatcgcctgctgcgcgagattcgtaacgcggcgcgccgcggcgtgcacgtgcaattgatcatgcagggccagcccgatgtgctgctggccaagctggcggcgcgcatgctctacgactatttgctcaaggatggcgtggtgattcacgagtattgccaacgcccgttgcacggcaaggttgcgctggtggacgacgaatggagcaccgtgggctccagcaacctcgacccactgagcctcgcgctgaacctggaagccaatgtgctgattcgtgaccggacattcaatcagcagttgtacgaacgcctggaagcacttgccaggaatcattgccagaccatgcctgcaaagcgcaagccgcgcctgtggctgtggcgcctgaccgtgggctttttggtgttccatgtgatgcgccacttccctgcgctgaccggctggttgccagcgcacaagccgcgcttgaaaccttttgagagtaggccccatgacgtctgaaaccagcggttcgcggttcaagcgctggaagaaaccgctgacgattgcgttcttcctgctgctgatcgtcctgttcaccctgctcgcccggcgtatcgactggagcgaagtgttccagaccctgggcgacttcaagctgcgcacgttgctcatcgctggcgccctgaccttgtgcagttttatcgtctatgcctgtttcgatctgatcggccgcacctacattcgccagccgctgcgctggaagcagatcctgccggtgggcatcatcagttacgcgttcaacctcaacctcagcgcctgggtaggcggcatcgccatgcgctatcggctgtactcccgactgggagtgagcaccagcaatatcgccaagatcctcggcctgagcctggccaccaattggtttggctatatggcactggccggggtggtgttcagcagcggactggtcaccatgccgcccggctggaagctcagcagtggcgctctgcaaggtgtcggcgtgctgttggtaatcgcaagccttgggtatctggcggcgtgccggttttcaaaaaaacgcgcatggtcgatccgtggcatcgagatcaacctgccgtcgctgcgcatggcctgcctgcaactggccctgggcgccttgaactggtcgctgatggcagcggtgatctttaccttgctgccggccaagctggattacccgctggtgttgggggtgctgctgatcagcgcgattgctggagtggtcacccatatacctgccgggcttggggtgttggaggccgtgttcattggcctgctgcaacatgaagcgtcacgagggagtttgctggcagggctgatcgcgtatcgggcgatttatttcatctgcccgctgttgattgcgttggtgatgtacctgggcgtggaagccaaggccaaggccctgcgagtgaagaaaacacccgcttagcgcgtcagcgggattgaatgatgcttaaccgctcgcccaccaccatctcggtaatccagtccaccaggatcgaggtgtaggcctgttgcgacaccgggtcactcagggaatggtcggcaccatcgatgatgcggtgggtcagggagtgagtctgctggcaggccgcacgatagctcatgatggtggcgtggggcacatgatcgtcggtttccgattcgacgatcagcacatcgccagtaaattgtgcgcaggcatgcagggcacggttggtctcggcatgcacgagggtgccgcggtaatccatcaagtcggctttatccaggtcgcgcttgggcttgagccattcctggtcgcggtacagcgcgggcacccgcagcgccagccaacgcactgggcgtaacgaggtgaggatggctgccaggtagccgccatagctggtgccaaccaccgccaccgccgaggtgtcgatagccgggtgagacagcaggcggtcgtaggccgctatcaggtcgcgcaggttgtcttcacgggtaacgcgggataacggaatgccggtgccggcgtggccgcgcaagtcgaaggtcaggcatacgcagcccagcccggcaatgcctttggctcgctccaggtcgcgctcctggctgccgccccaaccgtgcacgaacaacacgccgggcactttggattttggactgaggaatgtcccgctcatctgttcgtcgtctatatcgatggtgatgctctcgcttctagccgtcataaggtttgaccgtcacatatttgagaagaaattcgctgttttcggccgggcctcgatatacctcaatggcatccgccggcagcgcttgatccacgtaggtttccaccgaggacacacgaatggccttgaggcctgggttgttgataaagctctgcagcgccgcgacctccgcgctgcttgctccacccatgcgccaggattgttcgagtacaccactgcggcgctgcccatcgctgtccaggccttgggcaatgtcgtagttgcgccgcgaggcgtagaagcctgggtaggcttcgtcggcagcgttgtcgaacacccgagcctgctcgatggcttcacgcacctcctctggcaagtccaggttgagcaggtcttcgtagtaaccgcgcacgaccaagaggttggagccgccgtaaacctcttcgccctgcccgtcccgggtcaggtactgctcgccgcagtagctgaatacgtgagcgccgataaagctctggcccacactgtgggtgactacgtcgtgcaggtcctgttccagcaccacgccctcgctgaacatcttgctcgcttctggacgtgccaagaccacgtcgaactcatcgaggctgtggataacttcctggccacgtcctgcgcaggcatgcacgggcttgaggcgaatcggtccgctgtagagcagacgagtagcggcgggcctggcgtcctcgaggctgaacacagtcaatccatccaacacgacgtcgcgcactcgctcgcagaataacggcgaccacccttcaggcgcttttgcctcggggcccagcaggccatggctgatggctttggtgcagatgaaatcatggtcgacataaccgccccacaagtcttctggccccttgatattgagctcacgtgcttgggcgggcccaaccagcgtttgtgtgggcaaaagatacagttcacgcccagcgtgcaaatcggggtcgtaactgccaccgaatttgagcccgaggatctgcgccagccagcgggccaaggcgaggttggtttcaacttcatgctgcggcgcaccctctcgcgtggagtatgcgaccaccagtttcttgcgattcgttggggtcatgcgttcccccttggttatcccgctcttatgtgtagcacaaaggctgcatggatcaggccaacgcacggctggcagggatagtatttaaatcaataagttgcggggaaagtgatggccgttagcctgtcttattctgcacgacctgcgttacaccacacggcgttctgcacgattaaaacaccaaaccggttgcggtaatcgctgggggccaggccggtaatcttcttgaagatcgcacgaaaggcgctgggatcctgatagcccacggtccaggcgatgtggtcgatcgtgccgttggtgaactccagcatctgtcgcgccttgcctacccgcaggtgctggtagtattcggtgggtttcaacccggtcgcagtgcgaaaccgtcgcaggaacgtgcgctcctcaaggttcgcctcccgtgccattgccgccacgccgacatccaccgcgccactggcttgcaaccaatgctggaccttgaggattgcgctgtcgccatgcctgagaatcggcgcaaagttactgccgcactggctggcgctgtcgcggtgttcgatcaccagaaaccgcgccgtgtcggccgcgatgctggggcccatcagccggtcgaccaggcgcaggcccagctcggaccaggccatcagcccagcggtggtgatcaggtcgccgtcatcgacaatgggtttatccgcttccaggcgcaccgccgggtaacgggccgcgaaggttttcgcggatgaccagtgggtggtggcgctgcgcccgtccaaaagcccgctgcgcgccagcatgatcgagccgatgcacacgccgccaagcaccgtaccggcggcatgctgctggcggatccactccagcagcgccggcggcgcctgatcttcggtgaattcaccaatcgacgggggcaccagcacggccatcatcgattggtccggacctgggtggctgtcaaacccgcgcgcaggcgtaccgtgggcatccacctgccagtggctgacccgcaacaggggcagttgcccggctcgatgctcggcggcgatgcgattagccaccccgaacaagtccgtcaggccatgcaccgccgccagttgcgcgccctggtagatcaacacccccagctcgacggtcccgcgttccacggtcattgtcagttttccccctgttattgtcggtgcagccaatcctcggtctgatcgccagctaagatactaggcccatcaaaccatcacgaggcgatacacatggccaagcaggcgctcatcctaatcgatatccagaacgactacttcccacaaggcaagtggcccctcgacggcgtggaagccgcggcggacaaggcggcgcaagtgctacaggcgtttcgccaggccggcgatgcagtgattcatgtgcggcatgaattcgaaggcgacgacgcaccgttctttacaccgggctccgaaggcgcgcacttgcatgccaaggtgttgaacgagggcgatgaaccgatcgtgctcaagcactttgtgaatgcgtttcgccaaaccaacctacgcaccttgctggaacagcgcagcatcaccgatctggtggtagtcggcagcatgagccatatgtgcgtggatgccgtggtgcgggcggcggcggacctgggctacaaagtcacggtaatccatgacgcgtgtgccactcgcgatcaggagttcaacgggcaggtcatcccagcggctcaagtacaaggcgcatacatggcagccctggccttcggctatgcgggcgtggtgtcaacggatgaattcttgaaggcgcaagcggcggccgcgtgaccgccacccggatcgatggctctagcgtgtagcaatgatgaacagccgcgggaacggcagcaacacagtgccatcggccagggccggataggcctgggtgattcgcgccttgtacgcctgcaggaaagcggttttttcatcactgctcaacggcgcgagaaagggccgcaatgccgacgccttgaaccactccactaccgccgcgtgatccgccagcgggtgctgataagtggtgcgccacacatctacggcactgcaatgcttactcagcagttcgtagtagtagctggcggtgtgccgctcattgtgtttgaccgtgccgatcttcgcggaccatgggccgtcggccgcgacttcgcgggccagccggtgagcaggctcgtcaaggttatccggtgtttgcaccgccagcgtaccgcctgggttcagttgcttgatcaagtgcgggtagagcgtggcgtggtcgggcagccattgcagcgaggcattggccaggatcacatcgaaactctgtgccgaactccaggcaccgatatctgccagctcgaagttcagcgccggcaggcgcttgcgggcgtcagccaacatgtcatcggagctgtccatgccgatcacctgcgcctcggggaagcgtttggccagcacttcagtggagttgcccgggccgcaccccaagtcaacggctgtgcgcacgtcagcagtgggaatggccgcgaccagatcacggacggggcgagtgcgttgctgttcgaacagcgtgtactgcttggcagaccaggtcatcgcaattttccttgttctagagatgaacgacagcctaaaacttgtgagccatgagaacaaatagccgaattgatcgccgcccctgttaaaagcctgtccgtgagcggaaaactcggcgctgtcggcacacgcctcgcctgtacggactagaattactatcgacccgaacaggttgagtcttcttagggtcatcaacttaacgccagcgtagtgtccacggacgatttttctggcctccaccagccaaaaatcattcacacgtcaatggagctgagccatggcctatttgaaaactcgcgaaggtaacgatctttactacaaggactggggtagtggtcagcccgttgtgttttgccacggctggccgctgaacagcgacagttgggagtctcaaatgctgcacttcgccaaccatggttttcgtgccattgcgcatgaccgccgcgggcatggccgatcaagtcaaccgtgggccggcaatgacatggatcactacgcagatgacttggcgcaactgatcgagcacttggatctgaccgccgtgattctcttcggtttctccaccgggggcggggaagtggcacgctatatcgcacggcacggcactgcacgcgtggccaaggcagggttgatctgcgccgtgacgcccctgatgttaaaaacccccagtaatccgcaggggacgccgatagatgttttcgacggcctgcgcgccgactccattgccaaccgttcgcagctctatcttgacctcgcaagcggaccattctttggattcaaccgaacaggggtcgagccgtcgccaggcttgatcaattcgttctggatgcaaggcgtaatgggagggcacaaaaatacgtttgacagtatcgaggctttttcggaaaccgacttcagggatgatctgaagtacttcaacatccccacgctgatcatccatggaggcgacgatcaaattgtaccgatccaagcttcggccctggagagcaagcgcttgatcccacacgcccaactgctggtatacacaggcgcccctcatgggttgaccgacacgcacaaggagcgagccaatcaagatatgttgcgctttgcgcaattgtagtcggcagcagtacacaaaaaacgcgcggccttaggcagcgcgttcttttgcagcgagtcgcttcgatgtggcctagaacggaatatcgtcatcaaaactgtcgaaatcctgggccggttgctgcgcagcctgttgtggcgctgggcgcgactcacgctgtggctgctgggctggctgcggacgcgactgctgtggacgcggtgccgagttggacatgccgccctggccctgttggtcgccctgtggacggccgcccagcagttgcatggtgccttgcatgtcgaccacgatttcggtggtgtagcgcttgataccgtctttttcccactcgcgggtttgcagcttgccttcgatgtatacctgcgaacctttgcgcaggtactcaccggcgatctccgcaaccttgccgaacatcgacacgcggtgccattcggtcttctcgactttctggccggtctgcttgtcggtccactgctcgctggtcgccagactcaggttggtcacggcgttaccgttaggcaagtagcgaacttcgggatcctggccgcacgtaccgaccaatatgactttgttaaccccacgggccataacgttctcctaagctgggcgcgctgtcggcactgggttgaccagttgctcgagcgtcgcgcgatccaataattcggtgtctagtttgatgtagatggcggcttcttcagcgacaaccacggcatcggtaaccccggtgacggtcttcaggcgctcggccaggcctgcttcgcgcatcgcgtcgggcgataacggcaagcgcagactcgtcacatagggaggttcgcgcatggtaacagcaaaggccagccaaagtgcagccagcccggcgcatcccaggaaaacaaccgacaaaccgccatgctggaacatccagccacccatgatgccgcccagtgcggaacccaggaactggctggtggaatacacccccatcgccgtgcccttgccgccggccggtgaaactttactgatcagcgaaggcaatgaagcctccagcaggttgaacgcggtgaaaaataccaccgtgccggtgaccagcgcccgcaggctgtcgccgaactgccagaagaatagctcagtgagcatcagcgtcgcgacggcgccgagcagaactcgtttcattttgcgttttttctcgccgtagatgatgaacgggatcatggcgaagaacgaaatcagcagcgcggtaaggtacacccaccaatgctgttccttgggcaggccggctttttccaccagggccaggggcaaggcgacgaagctgcacatcaacatggcgtgcaacacaaagatacccaaatccaggcgcagcaggtctgggtgtttgagcgtgggcagcaacgcctggcgggcgacaccggattcacgatgggccagcgtgccagtagagcgcggcaccataaaggccactatcacgataccgaacaatgccatgccaccggtggccaggaacaacccgtgcaagccaaacgcacgggtcagcaaagggccgactaccatggccacggcaaacgacaggccgatggtcatgccgatcatggccatggccttggtgcggtgctgttcacgggtcaggtccgacagcaaggccatgaccgcagcggaaatcgcgcccgcaccctgcaggatgcgcccggcgatcacgccccagatcgaatcggactgggccgcgagcacgctgcccaaggcgaatacgatcagcccgagataaatcaccgggcgacggccaatgcggtcggaaatgatcccgaatggaatctggaaaatcgcctgggtcaggccataggcgccaatcgccaggccaatcaaagcgggggttgcgcctgcgagatccattccataggtcgccagcaccggcaacaccataaacatgcccagcatacggaaggcgaacaccagggccagaccgcttgccgctcgggtctcgccgctactcatgcgttcgctgtggggatcgtgcatggaaaaacctcgtgtgaaccggcggcgattctaccagtcccatcgattgagagggtatatgcggcgctttgccgcgcagctttcatgtaaggctgcaagcggccttttgacagtgtatattcatccagtctttagccgtatactccggcattatttacgcccgccgtgcgaggccatcttggacaagatcctgattcgtggggctagaacccacaacctgaagaacatcgacctgaccctgccccgggacaaactgatcgtcatcaccggtttgtccggctccggcaagtcgtccctggcgttcgacacgctgtatgccgaaggtcagcgtcgttatgtggaatcgctgtcggcctatgcccggcagttcctgtcgatgatggaaaagcccgacgtcgacaccattgaaggcctgtcgccggcgatctccatcgagcagaagtcgacctcccacaacccacgttccaccgtgggcaccattaccgagatctacgattacctgcgcctgctgtacgcgcgggttggtattccgcgttgcccggaccacgacattcctctggaagcccagaccgtcagccagatggtcgacctggtgctggcccagccggaaggcgccaagctgatgctgctggcgcccgttatccgcgagcgcaaaggcgaacacctttcggtcttcgaagagctgcgggcccaaggcttcgtacgcgcacgcatcaacggcaagctttatgagctggatgaagcgccgaagctcgacaagcagaaaaagcattcgatcgatgtggtggtcgaccgcttcaaggtgcgcgccgacttgcagcagcgtttggcggaatccttcgaaaccgcgctgaagctggccgatggcattgccttggtagcccccatggatgacgagccgggcgaagagatcatcttctccgcacgcttcgcctgcccgatctgtggccacgccatcagcgagctggaacccaagctgttttccttcaataacccggccggcgcctgcccgacgtgcgatggcctgggcgtgaagcagtttttcgatatcaagcgcctggtcaatggcgacctgaccttggccgaaggcgcgatacgtggctgggacaggcgtaacgtctactacttccagatgctggggtcgttggcttcccactacaagttcagccttgaagtgccgttcaaccaactgccggccgaccagcagaaggtcattctccacggcagcggttcgcagaacgtcgacttcaagtatctgaacgaccgcggcgatatcgtcaagcgctcgcacccgttcgaaggcatcgtgccgaacctggagcgccgctaccgcgaaaccgaatcggcgagcgtgcgtgaagagctggccaaattcctcagcacccagccttgcccggattgccgtggcacgcgcctgcgccgtgaagcacgacatgtgtgggtaggcgagaaaaccctgccggcggtgaccaacctgccgattggcgatgcatgcgaatactttggtgtgcttaagctcaccgggcgtcgcggggagattgccgacaaaatcctcaaggagattcgcgagcggttgcagttcctggtcaacgtcggcctggactacctgtcgctggatcgcagcgccgataccttgtcgggtggtgaagcacagcggatccgcttggccagccagattggtgcgggcctggtaggcgtgctgtatatcctcgacgagccttcgattggcttgcaccaacgggataacgatcgcctgctgggtacgttgaaacacctgcgggatatcggcaacaccgtgattgtggtcgagcacgatgaagacgctatccgcctggcagattatgtggttgatatcggcccaggtgctggcgtgcatggtggacatatcgttgccgagggtacgcctgccgaagtaatggcccaccccgattcattgaccggcaagtatttgtctggccgggtgaagatcgaagtacctgccaagcgtactccgcgtaacaagaaaatggcgctgcatctcaaaggcgcgcgcgggaacaacctgcgcaatgtcgacctggagattccgctgggcctgttgacctgcgtgaccggtgtttccggctcgggcaaatcgacgctgatcaacaacacgttgttcccattgagtgccaccgccctgaacggcgcgaccaccctggaagcggcagcccatgacagcatcaagggcctggaacacctggacaaggtggtcgatattgaccagagcccgatcggccgcacaccgcgttccaacccggcgacctacaccgggttgtttacgccgattcgcgagctgtttgctggcgttccagaatcccgttcgcgggggtatgggcctggccggttctcgttcaacgtcaagggcgggcgctgtgaagcatgccagggcgacggcctgatcaaggtggagatgcacttcctgccggacatctacgtgccgtgcgatgtgtgcaagagcaagcgctacaaccgcgaaaccctggaaatcaaatacaagggcaaaagcatccacgaaaccctggagatgactatcgaggaagcccgggtgttctttgacgcggtgccggcgttggcgcgcaagctgcagacgttgatggacgtgggcctgtcgtatatcaagctcgggcaatcggcgactacgttgtccggtggcgaggcgcagcgggtcaagttgtctcgcgagctgtccaagcgagataccggcaagaccctgtacattctcgatgagccgaccaccggactgcacttcgcggatatccagcaattgctggacgtactgcaccgccttcgcgaccacggcaataccgtggtggtgattgagcacaacctcgatgtaatcaagaccgctgactggttagtggacctcgggccagaaggtggctccaagggtggccagatcatcgccgtgggcacaccggagcaagtctccgagatgtcgcagtcacacacgggttattacttgaagccgttgttggcgcgcgaccgggcctgattttcaggccccaataaaaagcccctgtcacgttgcggtgacaggggcttttttgtagccggaagttagaactgcgattgcagataattctccaggccaatcaacttgatgaggcccaactgcttttccagccagtaggtgtggtcttcttcggtgtcattcaactggacacgcagtatttcccgggtgacatagtcgttgtgctgctcacacagctcgatgcccttgcacagggccgcacgaaccttgtactcaaggcgcaggtcggcagcgagcatgtcaggtaccgttgtgcccacatccagatcatcgggacgcatgcgtggcgtgccttcaagcatcaggatgcggcgcatcagcgcatcagcatgctgtgcctcttcttccatctcatggttgatacgttcgtaaagctcggtaaagccccagtcttcgtacatacgcgagtggatgaaatattgatcacgagctgccagttcgcccgtcagcaacgtgttgaggtaatcgattacgtcggggtgaccttgcatcgccctacatctccctacttgaaaggctgtagtttgaaccatgatgacttgaaggtcacgggatcaacggcagaaaagtgaagatttccggagaaaagtagctgaaataacgcaaaaaccgcccaaatgagggcggttctgcttatcgtttagagtcagttaagcgatacacccagtgtctttgcgattgcttctccataagccgggtcggccttatagaaatgctgcaattgacgctggaccacatcgctggaaaccccagccatcgcaccggcaatgttgctggtaagcagggctttttgctcatcgttcatcaggcggaacaacgcacccgcatggctgtagtagtcggtgtcttcacgatgatcgtaacgatccgcggcgccgctcagggccaatgcaggctctgcatattgcggggcttgtttcggcgcatcggcgtagctgtttggctcgtagttgggagccgcaccaccgttactgccgaaggccatcgaaccgtcacgctggtagctgttcaccgggttgcgtggcgcattcaccggcaattgctggtggttggtgccgacacggtagcggtgggcatctgcgtaagcgaaaacccgaccttgcagcatgcggtccggcgacaggccaacacctggaaccatgttgcttgggccgaatgcagcctgttccacttcagcgaagtagttctgcggattgcggttgagctccagctcacccacttcaatcaacgggaactctttttgcgaccaggtcttggtcacgtcaaacgggttctcgtagtgagcattcgcctgggcctcagtcatgatctggatgcagacgcgccatttcggaaagtcaccgcgctcaatcgccccaaacagatcacgctgggcatagtcaggatcagtccctgcaagtcgggcagcctcggctggcgccaggttcttgataccttgcttggtcttgtagtgccatttcacccaatgacgttctcccttggcattgatcaggctgtaagtgtggctaccgaagccatgcatgtgacgatagccgtctggaataccgcggtccgaaaacaggatcgtgacctggtgcagcgcctcaggagagtgtgaccagaagtcccacatcatctgcgcgcttttcaggttgctttgcggcagacgtttctgggtgtggataaagtccgggaatttcaatgggtcgcggatgaagaacaccggggtgttgttacccacgatgtcccagttgccttcttcagtgtagaacttcaaggcgaagccacgtggatctcgctcggtgtcagccgaaccgcgctcgccacctacagtggagaaccgcaggaaggtcggcgtttgcttgccaaccgattcgaacagcttggcgctggtgtactgggtgatgtcttttgtcacagtgaacgtaccgtaagcacccgaacctttggcgtgcacacgacgctcggggatgttttcacggttgaagtgagcgagcttctcgatcaggtgaaaatcgtcgaggagcaacgggccgcgagggccggcggaacgcgagttctggttgtctgcgacgggggcgccgctggcggtggtaaggactttattctggctcatgcgcaatcttcctcaggtcgggcttggaactgccggctaatcggcttggagggagtattgatcatcaacatgacgtgtacaaattcattaaatcgtaagcatcaatagaaaataactaataaccttccaatattcatagtacccaacgccgatgagtgaaagcttgtatctattgagctttccttgcgcgcacaaaaaaccgggcacaaggcccggttcttcgttacagcttgtcgtcttactcggcggatacagcttcgccagcagtagcacgatcaaccaactcgacatacgccataggcgcgttgtcgccagcgcggaaaccgcacttgaggatgcgcaggtagccaccctcacgggtagcgtaacgcttgcccaggtcgttgaagagcttaccaacgatagctttcgaacgagtacggtcgaaagccagacggcggttagccaggctgtctgtcttggccaaagtgatcagcggctcagcaacgcgacgcagttctttggctttcggcagtgtagttttgatcagctcgtgctcgaacagcgacaccgccatgttttggaacatggccttgcggtgcgagctggtacggctcaggtgacgaccacttttacgatgacgcatggttcattccttaccaaactcacgttcggtgattacgacgatcaggcagtcgccttgtcgtccttcttaagacttgcaggcggccagttgtcgaggcgcatgccgagggacagaccgcgggaggccagaacgtccttgatttcagtcaaggatttcttgcccaggttcggagtcttcaacagttctacttcggtacgctgaatcaggtcgccgatgtagtaaatgttttccgccttaaggcagttagccgaacgtacagtcagttccagatcgtcaaccgggcgaagcaggatcggatcgatctcgtcttcttgctcgattaccactggctcgctgtcacccttgaggtcgacgaacgcagccaactgctgttgcagaatggttgcagcgcggcggatagcctcttcaggatccagggtaccgttggtttccagatcaataaccagcttgtccaggttagtacgctgctcgacacgggcgttttccaccacgtatgcgatacggcgaaccgggctgaacgaagagtcaagctgcaagcgaccaatgctgcggctttcgtcttcatcgctctgacgcgagtcggccggttcataaccacgaccacgagctacagtgagcttcatgttcagggcgccgttagacgccaggttagcgattacgtgatcggggttaacgatctcgacatcatgatccagctgaatatcggcagcggtaaccacccccgaacccttcttcgacaaggtcagcgtaacttcgtcacggccgtgcagcttgatagccagacctttaaggttcaacaggatttcaattacgtcttcctgtacaccttcgatggcgctgtactcgtggagcacaccgtcaatctcggcctcgactactgcacagccgggcattgaggacaacaggatgcggcgcagcgcgttgcccagggtgtggccaaaaccacgctcgagaggctcgagagtgatcttggcgcgggttggactgacaacctgcacatcaatgtggcggggtgtcaggaactcatttaccgaaatctgcatggatgcacctattttctagcccttacttggagtagagctcgacaatcaggctttcgttgatgtcggcggacagatcactgcgagcaggaacgttcttgaaaacgcccgacttcttctcagtgtctacttctacccattctacgcggccacgttgggcacacagatcgagagcttggacaatgcgaagttggtttttagctttctcgcgaactgcgaccacgtcaccagcacgaacctggtaggacggaacgtttacggtctgaccgttaacgctgatcgacttgtgcgataccagctgacgggattcggcacgagtcgaaccaaagcccatacggtatacaacgttgtccagacggcattcgagcagttgcagcaggttttcaccggttgcacctttcttgccagcagcttctttgtagtagccgctgaactgacgctcgagaacgccgtagatacgacggaccttctgcttttcacgcagttgggtgccgtaatcggactggcgaccgcggcgttggccgtggataccaggtgctgcttcaatgttgcacttcgattcgatcgcgcgcacgccgctcttcaggaagagatcggtgccctcgcgacgagcgagtttgcattttggaccaatgtaacgagccattctttacaatctcctggattacacgcggcgcttcttcggcggacggcacccgttgtgcgggattggcgtcacgtcggtgatgctggcgatcttatagccacagccgttcaaagcacggacagcagactcacgacctgggcctggacctttgacgttaacgtcgaggtttttcaggccgtattccagcgcagcttgaccagcacgttcagcagctacttgagcagcaaacggggtggacttgcgggaaccgcggaaacccgaaccaccggaggtagcccaagaaagcgcgttaccttgacggtcggtgatggtcacgatggtgttgttaaaagatgcatggatgtgggcgatgccatcaaccactgtctttttaacttttttacgaggacgagcagcaggttttgccatgataattttcctgtcgattcgctggggcgattacttgcggatcggcttacgcggacctttacgggtacgcgcgttagtcttggtacgctgaccgcgtactggaagaccacgacgatgacgcagaccgcgatagcaaccgaggtccatcaaacgcttgattttcatgttgatttcgcgacgcaggtcaccttcagtggtgaacttcgccacttcgccacgcagctgttcaatctgctcgtcgctcagatccttgatcttagcggctgggtttaccccagcaactgcgcaaattttctgcgcagtagtgcgaccaacaccatagatgtaggtcagcgagataacagtgtgcttgttatctggaatgttaacgcctgcaatacgggccattcagtgggactccaattgacagctacctacgccccggaagccaagaaatagggcgcgagataatatcgctgtaataacaaataatcaacccggcagcgcactagctgccgggcttcaagcggatcacactcagccttggcgctgtttgtgacgcggttccgcgctgcaaattactcgaacaacaccttcgcggcgaataatcttgcagttacggcacagctttttcaccgatgcacgaactttcatcaccaactcctcgaaccttatgggtactcagcgcaacatgccgctgccgtaacccttcaggttggctttcttcatcagggattcgtactggtgcgaaacgaggtgcgattgtacttgggacatgaagtccatcacaaccacgaccacgatcagcaacgaggtcccgccaaggtagaacggaacgtttgctgcaaccaccaggaactggggcaacaagcacacggccgtcatatatagagcaccgaacagggtcaaacgagtcagaacgccatcaatgtagcgtgccgactgctcacctggacggatgcccggaataaaggcaccggacttcttcaggttttccgctacgtctttcggattgaacatcaacgccgtatagaagaagcagaagaaaataatccctgcactaaacagcagaatattcaacggctgaccaggagcgatcgactgagagaggtcctgcagccagcccatattttcggactgaccaaaccaggtacccaacgaagccggaaacagcaagatgctgctcgcgaaaattgccggaataacgccggccatattcactttcagcggcaagtggctggtctgcgcagcaaagaccttgcggccctgctgacgcttggcgtagtgaacagcaatacgacgctggccacgctcaatgaacaccacaaaaccgataatcgctactgccagcaaaccgatggcaaccaaggcgaagatattgatatcaccctgacgcgcagactcgaaagactgcccgattgccctcggaagaccggcgacgatacctgcgaaaatcaacatcgagataccgttaccaacaccacgctcagtaatctgctcacccagccacatcatgaacatcgcaccagccacaaatgtggataccgcgacgaaatggaagccaaagtcaccagtgaacgcaacgccctgccctgccaggccaacggacatgccgatagcttgaaccagggcaaggacgacagtgccgtagcgggtgtactggctaatcttgcgacggccagcttcaccttccttcttcaactgctccagttgcgggctgacggctgtcatcagttgcatgatgatcgatgccgaaatgtacggcatgatccccagtgcaaagatgctcatccgctccagcgcgccaccggaaaacatgttgaacaagctaagaatggtcccctcattctgtcgaaacaggtctgcgagtcggtccgggttgatacctggaaccgggatgtgtgcgcctattcggtagacgataatcgccaggaacagaaaacgcagacgagcccaaagttcagacataccgcctttgccgagcgctgagagagcaccttgcttagccatttattcctcgaacttgccgccagctgcttcgatagccgaacgcgcacctttggtggcgccgattcccttgccgatagtgacagcgcgagtcacttcaccggacagcatgattttcacacgctgtacgttgacgttgatcacgttggcatctttcagggtctgcacagtaacgatgtcgccttccactttagacagctcggacagacgcacttctgcgcggtccatggctttcagggatacgaaaccgaacttaggcaggcgacgatgcagcggctgttgaccgccttcaaagcctggagcgatggtgccaccggagcgggaggtttgacctttgtggccacggccaccagtcttacccaaaccgctaccgataccacggcccggacgatgcttttcgcgacgggaacccggcgctggactcagatcattgagtttcatcgattaaccctctacacgcagcatgtagtaagccttgttgatcatcccgcgattctcgggagtatcctggacttctacagtgtgaccgatgcgacgcagacccaaacctttaacgcacagtttgtggttagggatgcggccggtcatgcttttgatcagcgttactttaacggtagccatgatcagaagatctccttgacagtcaggccacgcttggcagcgatggactcaggagattgcatagctttcaaacccttgaaagtggcgtgaaccacgtttaccgggttagtcgagccgtagcacttggccagaacgttctgaacgccagcaacttcgaggacagcacgcatagcgccgccagcgatgataccggtaccttcagaagcaggctgcatgtacaccttcgaagcgccatgggcggacttcattgcgtactgcagagtggtgccgttcagatcaacttggatcatgttgcgacgagcagcttccattgccttctggatcgcagcaggcacttcacgtgacttgccacggccgaagccaacacgccctttaccatcacctaccacggtcaacgcggtgaaagtgaagatacggccgcctttaacggttttggctacgcggttaacttgaaccagcttctcaatgtagccttcgtcgcgcttttggtcgttatttgacataacttagaactccagcccagcttcacgagcagcatcagccagcgctttcacgcgaccgtggtacttgaagccagagcggtcgaaagccacttgcgagacgccagcggccttagcacgcgtagcgaccagctggccaacctttgtggccgcgtcgatgttgccagtggcaccatcacgcagttctttatccaaagtcgaggcgcttgccaggactttgttgccgtcggccgagatgacctgggcgtagatgtgctgcgacgagcggaacacgcagagacgcacgacttcgagttcgtgcattttcaggcgtgctttgcgagcgcgacgcagtcgagtaacttttttgtcggtcatttgctatgccctacttcttcttggcttctttacgacggacgacttcgtccgcgtagcgcacacctttgcctttgtacggctctggtggacggaagtcgcggatctcagcggccacttgacctaccagctgcttgtcgatgcccttgatcaggatatcggtctggctaggggtctcagcagtgatgcccgctggcagttcgtaatccacagggtgcgagaagccaagggcaaggttcagaaccgtgccttttgcttgcgctttgtaaccaacaccgaccagctggagcttacgctcgaagccttggcttacgccttggaccatgttgtttaccaacgcacgcgtggtaccggccattgcgcgagtttgttgatcgccattgcgagcagcgaaacgcagctcaccagcttcttcaacgatctcaacggacgaatggatgttcagttcaagagtacccttggcacccttcaccgaaagctgttggcctgcgaatttgacttcgacaccggctggcagcttaacggggttcttagcgacgcgtgacatgcttatccccccttagaacacagtgcaaagaacttcgccgccgacaccggcagcgcgcgcagcacgatccgtcatcacacctttgttggtggagacgatagacacgcccagaccgccacgaactttcggcagatcttcagcggacttgtactgacgcaggcctggacggctaacgcgcttcacttcctcgatgaccgaacggccttcgaagtacttcagctcgatggacagcagtggtttgatttcgctgctgatctgataacccgcaatgtagccttcgtctttcaggactttggcaacagctaccttcaacttggaagatggcatgcttacgacggacttttcagccatctgggcattacggatacgagttagcatgtccgctaacgggtcctgcatactcatgggctagacgctcctaatacaaaaaaattagccttgcggctacatatgtcgccgagaatctccgagcatagaaaacacgggctcaggcgagccgggtattctagacacactccggaaatgaaacaagccccaaaaggggcttgttccagattcaaggtcaccggcggtcagtatcttgcgatccgaaccgcctggacttcgaacgtacttaccagctggctttaaccagacctggtacgtcaccacgcattgccgcttcacgcagtttgttacggccgaggccgaacttgcggtaaacgccgtgtggacgaccggtcaggcggcagcggttacgcatgcgcgaagcgcttgcgtcacgtggctgcttctgcagagcaactgtagcttcccaacgcgcttctggacttgcgttcagatcaacgatgattgctttcagtgctgcacgctttttggcgtacttggcaaccgtgagctgacgcttcagctcgcggtttttcatgctcatcttggccatggtcctactccaatcagttgcggaacgggaatttgaaagcacgcaacagggcgcgaccttcatcatcgttcttggcagtggtggtcagggtgatatccagaccgcggagagcatcgatcttgtcgtagtcgatttccgggaagatgatctgctctttcacgcccatgctgtagttaccacgaccatcgaaggacttggcattcaggccgcggaagtcgcggacccgaggcagggagatcgacagcagacgatccaggaattcgtacatacgctcacggcgcagagtcactttgacgccgatcggccaaccttcacggactttaaagccagcgatggatttccgagcgtaagtcacaacgactttttgaccggtgatcttttccaggtcagcaaccgcgtgctcgatgacttttttgtcgccgatcgcttcgcccaaacccatgttcagggtgattttggtgacgcgcggaacttccatcacgttcccgagcttaagttcttccttaagcttgggggcgatttccttccggtaaatctcttgtagtcgtgccatggtcttatctacctagcagtgttcaagcatcaaccgctttttgggtcgacttgaagacacgaattttcttaccgtcttctactttgaaaccaacgcggtcagccttgttggtttcgccgttgaagatggcgacgttagaagcgtgcaatggcgcttctttctcgacgataccgccctgtacgcccgacatcgggttaggcttggtatgacgcttgaccaggttaagaccaccaacgaccagacggtcatcagcgagaaccttcagcaccttaccgcgcttacctttgtctttgccggcgatcacgatgatctcgtcgtcacgacgaatcttttgcatgtcggatctccttacagcacttctggggcgagcgagacgatcttcatgaacttctcagtacgaagttcacgggtcactggcccaaagatacgggtgccgataggctcttgcttgttgttcagaagaacagcagcgttgccatcaaagcggataatggagccatctgcacgacgtacgccgtgacgagtgcggactacgacagcagtcatcacttggccttttttcaccttaccgcgaggaattgcttccttcacggtaactttgatgatgtcaccgataccagcgtaacgacgatgggagccacccagcaccttgatgcacataacacggcgagcgccgctgttatcggccacatcgagcatggattgagtctgaatcatataatttctccgacccctagtccttagacttccacagcgcgttcgagaatatcaaccagtgcccaagacttggtcttggccagcggacgagtttcacgaatagtgactttgtcgccgatgtggcactgattggtttcgtcgtgcgcgtgcagcttagtcgaacgcttaacatatttaccgtagatcgggtgcttaacgcgacgctcgatcaaaacggtgatggttttgtccatcttgtcgctgacaacacggccagtcagcgtacggacagtcttttcggcttcagccatgatcacttacctgcctgctggttgagcacagtcttcacgcgagcgatgtcacgcttaacttgcgagagcagatgagactgccccaactggccagttgctttctgcatgcgcagattgaactggtcgcgcagcaggccgagcagttgctcgttcagctgctgtgcggatttttcacgaagttcattcgctttcatcacatcaccgtccgtttaacaaaggaggtggcgagcggcagctttgcagcagccagggcgaaagcctcacgcgccagctcttcagaaacgccctcgatttcatacaggactttgcctggctgaatctgggctacccagtattccacgttacccttacctttacccatccgaacctcgagaggttttttggagatcggcttgtccgggaatacacggatccagatcttgccgccacgttttacgtgacgggtcagagcacgacgcgctgactcgatctgacgagcggtgagacgaccacgagctacagacttcagcgcgaactcgccgaagctgactttgctaccgcgctgagccagaccacggttgtggcctgtcatctgcttgcggaacttcgtacgcttaggttgcaacatttggcgtaccccttacttagcagcttttttacgaggcgctggtgcttgtggtttcagttcttcttggcgaccaccaattacttcgcctttgaagatccaaacctttacaccgatcacaccataagtggtgtgagcttcgtagttggcatagtcgatgtcggcacgcagggtgtgcagtggcacacgaccttcgcgataccattcagtacgtgcgatttcagcaccgccgagacgaccgctcacttggattttgatgcctttggcaccaatacgcatggcgttctgtacggcgcgcttcatagcgcgacggaacattacgcgacgttccagctgctgagctacgctctgcgcaaccagcataccgtcgagctccggcttacggatctcttcgatattgatgtgcacaggcacacccatttgcttggtcaggtcctgacgcagtttctcaacatcttcacccttcttcccgataacgatacctggacgagcggtgtggatggtgatacgtgcagtttgcgccggacgatggatatcgatacggcttacggacgcgctttttagtttgtcttggagatactcacgcaccttcagatcagcgaacaaatagtccgcataagtccgaccgtctgcgtaccagacggaggtgtgctccttgacgattcccaggcgaatgccaatgggatgtactttctgacccatctcttcgactccgttacttgtcagcaaccttgacagtgatatggcaagaccgcttgacgatgcgatcagcacggcctttggcacgtggcatgatgcgcttcagcgaacgcccttcgttgacgaaaacggtgctgactttaaggtcatcaacgtctgcgccttcgttatgctcggcgttggctacggccgactccagcactttcttcatgatctcggcggctttcttactgctgaaagccaacaggttgagcgcttcgcccaccttcttcccgcggatctggtcggcgaccaagcgggctttctgggcggagattcgagcgcccgacaacttagcggctacttccatttccttaccccttaacgcttggctttcttgtctgccacgtgcccacgataagtgcgggtaccggcaaactcgcctagtttgtggccgaccatgtcttcgttaacgagaactgggacgtgttggcgaccgttgtgtactgcgatggtcagaccgaccatttgtggcaggatcatcgaacgacgcgaccaggttttaactggtttgcgatcgttcttttccgccgccacttcgatcttcttcagtaggtgaagatcaataaaaggaccttttttcagagaacgtggcactgtcgtatccctctatttacttgcgacgacggacgatcattttgtcggtacgcttattaccacgagtcttcgcgcccttagtcgggaagccccatggcgataccggatgacgaccaccagaggtacgaccttcaccaccaccgtgtgggtggtcaaccgggttcatggcaacaccacgaacggttgggcgaacgccacgccagcgtttggcaccagctttacccagcgaacgcaggctgtgctcggagttcgagacttcacccagggtcgcacggcattcagccagcactttacgcatctcaccagaacgcagacgcagggtcacgtagacaccttcacgagcgatcagctgagccgaagcaccagcggaacgagcgatctgtgcgcctttacctggcttcaattcgatgccgtgtacggtgctaccaactggaatgttacgcagttgcagagcgttgcccggcttgatcggtgccagggcacctgcgatcagctggtcgccagcactcacgcctttaggggcgatgatgtagcgacgctcgccatctgcgtacagcagcagagcgatgtgagcagtacggtttggatcgtattcgatacgctcgacagtggcagcgatgccatctttgtcgttgcgacggaagtcgaccagacgataatgctgcttatggccaccaccgatgtgacgagtggtaatacgaccattgttgttacgaccaccagtcttcgatttcttctcgagcagcggtgcgtgaggagcgcctttatgcagctcctggttgaccaccttgaccacaaaacggcggccaggggaagtcggtttgcatttaacgattgccatgatgcaccccttccttactcagcactgctgctgaaatcgagatcttggcctggctgaagggagataactgccttcttccagtcattacgcttgcccagaccgcgagcagtgcgcttgctcttacccagaacattcagggtagtaacacgctctactttcacgctgaacaggctttcgacggccttcttgatttccagcttggttgcgtcagttgcaaccttgaaaacgaactggcctttcttgtcagccagaaccgtagccttttcggaaacgtgcgggccaagcagaactttaaatacgcgttcctggttcatcccagcagctcctcgaatttcttcacggccgacacggtgatcaacaccttgtcgtatgcgatcagactaactggatcggaaccttgcacgtcacgtacatcaacgtgtggcaggttgcgagcagccaggtacaggttctgatcaacagcttcagacacgatcaaaacgtcggtcaggctcatgttgttcagtttgcccagcagatctttggtttttggactttcaacagcgaagtcttgaaccacgaccaggcgatcagtacgcacgagttcagcaaggatggagcgcagtgctgcgcggtacatcttcttgttgagcttctgagagtgatcctgaggacgagctgcgaaagtggtaccgccgccgcgccagattgggctacggatagtaccggcacgagcacggccagtacctttctgacgccaagggcgcttaccgccaccacgaacgtcggaacgggtcttttgctgcttgctaccttgacggccgccggccatgtaggccacgactgcttggtgaaccagcgtctcgttgaattcgccgccaaatgtcagttcggaaacttcaatcgcttgagcgtcatttacatttaattgcatgtcagcttccccttaaccgcgagccttggccgctggacgtacaaccaggttgccgccagtagcgccaggaacagcacccttgaccaacaacagattgcgttcagcgtcgacgcgcactacttcgagggactgcacggtcacgcgctcagcgcccatatgaccggacattttcttgcccttgaatacacgaccaggagtctggcactggccaatagagcccgggacgcggtgggaaacggagttaccgtgagtgttgtcttgaccacggaaattccaacgcttgatcgtaccctggaagcctttacccttggactgaccggttacatcaaccagctgaccagcggcgaagatttcagcgttgatcagatcgccagccttgtagtcgccgtcttcaagacggaactccatgacggtgcgaccagctgcaacgtttgctttagcgaagtgacctgcttgagcagcagtcacgcgcgaagcacgacgctcgccgacagtgacttgcactgcacgatagccatcggtttcttcagttttgaactgggtgacgcgattcggttcgatctcaatgaccgtgaccggaatggagacaccttcttcggtgaaaatacgggtcataccgcatttacgaccgactacaccaatagtcatgttgtaaacctcatgagtgtacggggctttcacccgctatggccgcccatttcagagcgttacacgactaagacccaagtcttagccgaggctgatctgtacttccacaccggccgccagatcgagcttcataagtgcatcaacggttttatccgttggctggacaatgtccagtacgcgcttatgagtacggatctcgtactggtcacgcgcgtctttgttgacgtgcggggagaccagaacggtgaaccgctctttacgggtaggcagtggaattggaccacgcacttgagcaccagtacgtttcgcggtttccacgatttcctgggtggattggtcgatcaggcgatggtcaaaagccttcaacctgatacggatttgctgattttgcattggatttcagactccggctgctattcccagcgagcgcaatacgcccgttaaaaggaggcgcaattctatagacggccctgataggtgtcaacccaataaaaaaggcccccgctgagcgggggccttttcaaaacatcagaactatctcagaagagataattactcgatgattttagctacaacgccagcaccaacggtacggccgccttcacggattgcgaaacgcagaccgtcttccatagcgatggttttgatcagggtgacaaccattttgatgttgtcgcctggcattaccatttctacgccttccggcagttcgcagttaccagttacgtcggtagtgcggaagtagaactgtggacggtagcctttgaagaacggagtgtgacggccgccttcttctttgctcagcacgtagacttcagcttcgaacttggtgtgcggcttaaccgaacccggcttgaccagaacctggccacgctcaacgtcgtcacgcttggtaccacgcagcagaacgccgcagttctcgccagcacgaccttcgtcgagcagcttacggaacatttcaacaccggtgcaggtggtgacggtagtgtcacgcagaccaacaatttccagtggatcttgaaccttgacgataccgcgctcgatacgaccagttacaacagtaccacgaccggagatcgagaatacgtcttcgattggcatcaggaacggcttgtcgataacacggactggatctgggatgtagctgtccagagtctcaaccagtttacgaacggacgtggtgcccatttcgttatcgtctttgccttccagagccatacgagcagaaccgatgatgatcggagtgtcgtcacctgggaagtcgtaagtgctcagcagatcgcgcacttccatctcaaccagttccagcagctcagcgtcgtctaccaggtcagccttgttcaggtaaaccacgatgtacggaacgccaacctgacgggacagcaggatgtgctcacgggtttgtggcatcggaccatcagcggccgaacaaacaaggattgcgccgtccatctgggcagcaccggtgatcatgttcttcacatagtcagcgtgacctgggcagtcaacgtgagcgtagtgacggatcagcgagttgtattcaacgtgcgcggtgttgatggtgataccacgagctttttcttctggtgcgctgtcgattttatcgaaatcaacgattgcagaaccgaatacttcggagcaaacgcgagtcagagcagcagtcagagtggttttaccgtggtcaacgtgaccgatagtgccaacgttgacgtgcggtagggaacgatcaaatttttctttagccacgacaattaactccttgcctaaaggactgaatcagccttgttttttggatacagtttcagcgatgtgcgccggagctgtgttgtattttttgaattccatagagtagcttgcgcgaccctgggacatggagcgaacgtcggtcgcataaccgaacatctcacccaacggaacctcagcgcgaatcactttgccggaaaccgtgtcttccatacccaagatcatgccgcgacgacggttaaggtcgcccatgacatcacccatatagtcttcaggtgtaacaacttctaccgccatgattggctcaagcaactcaccaccgcccttctgggccagctgcttggttgccatggaggcagccaccttaaacgccatctcgttggagtcgacgtcgtggtaagaaccgtcaaaaacggttgctttcaggccgatcagcggatagccggcaacaacaccgttcttcatctgctcttcgatacccttctggatagcagggatgtattccttaggaacaacaccacctactacttcgttcacgaattgcagaccttcctgaccttcgtcagcaggcgcaaaacggatccagcagtgaccgaactgaccacgaccgccggactgacgaacgaacttgccttcgatttcacagttcttcgtgatgcgctcacgataggaaacctgaggcttaccgatgttggcttcgacgttgaactcacggcgcatccggtcaaccaggatgtccaggtgaagctcgcccatgcccgagatgatcgtttgaccagtctcttcatcagtcttgacgcggaaagatggatcttcctgagcaagcttgcccagtgcgatacccattttttcctggtcatccttggtcttaggctctacggcaaccgaaataaccggctccgggaagtccatgcgaaccaggatgattggcttgtcagcgttgcacaaggtttcaccagtggtgacgtccttcatgccgatcaaggccgcgatgtcaccagcgcgtacttccttgatctcttcgcgggcgtttgcgtgcatttgcaccatacgacccacgcgctctttcttgcctttaaccgagttgatcacgccgtcgccggagttcaacacgcccgagtaaacacggacgaaggtcaaggtacccacgaatgggtcagtggcaattttaaatgccagagcggagaacggttctgcgtcgtctgcatgacgctccagctcgatagtctcgtcatccgggtcagtacccttgatggcaggaatatcgattggtgccggcaggtagtcgatcacagcatcgagaaccaggggaacgcccttgttcttgaacgaggagccgcaaacagccaagacgatctcaccagcgatagtacgctgacgcagagcggccttgatttccacgttggtgagctcttcaccttcgaggtacttgttcatcagctcttcattggcttcggccgcagcctcaaccatgttgttgcgccattcgtcagccagttcctgcagctcggcagggataggcttgcgaacagggaccatacccttgtcggcatcgttccagtagacagcttccatggtcagcagatcgatctgcccctggaagttatcttcggaaccgatagccaactggattggcaccggagtgtgacccaagcgctgcttgatctgaccgatcacgcgcaggaagttcgcaccggcacggtccatcttgtttacgtaaacaaggcgtggaacgccgtatttgttggcttgacgccatacggtttccgactgcggttcaacgcccgaggtaccgcagaacacaacgacagcgccgtcgagtacgcgcagggaacgctcaacttcaatagtgaagtctacgtggcccggggtatcgattacgttgaagcggtgctcatccttgtactgcttctcggaacctttccagaaggcggtaatagcagcagaagtaatggtaataccacgctcctgctcctgaaccatccagtctgtggtcgcggcgccatcatgcacctcgcccatcttgtgacttttgccggtgtaaaacagtacgcgctcggtggtggtggttttaccagcatccacgtgagcaacgataccgatgttacggtagcggctaatcggagtagtacgagccataaagccctcgcaaaattagtgaagctaaaattagaagcggtagtgcgagaaagctttgttagcttcagccatacggtgcacgtcttcacgcttcttaacagcagcacctttaccttcagcagcgtccaacaattcgccggccaaacgcagagccatagacttctcgccgcgcttacgggcgaagtctaccaaccagcgcattgccagggcgttacgacgggacgggcgaacttcaaccggaacctggtaagtagcaccgcctacacggcgcgacttcacttcgaccagcggagcgatggcgtcgagagctttctcgaagatttccagggggtcgctgttcttgcgttctttaaccttttccagcgcgccataaacgatacgctcggcaacggctttcttgccgctttccatcacgtggttcatgaacttggccaggatttggcttccgtattttggatcgtcaagcacttcgcgcttggctgctacgcgtcttcttggcatggataagccctcaaacggtcttcaggttcgctcggaatcggtgccctttcgggacgcctccgaccttactcttatcgactcagaaaataagatgattcaggtttacaaaaagccgctactacttaggctttttagtaccgtacttcgaacgaccctggttacgacctttaacgccggaagtatccaaggagccgcgtacggtgtggtaacgaacacctggcaagtcttttacacgaccgccgcggatcagtaccacgctgtgctcttgcaggttgtggccttcaccgccgatgtacgaggaaacctcgaaaccgttggtcagacgcacacggcatactttacgcagtgccgagttaggttttttcggcgtggtggtatacacacgggtgcatacgccacgacgttgcgggcagttctgcagcgcaggcacgtcggatttctcgacgatacgcttacgcggctgacgtaccagctggttgatagttgccatctactagctccactgttgtcttgcgacgctattgtcttgcaagaaaagcaaaatggcaggaacgaattcccgccaaatttaggggtacaagagtctaaagaggatcttgtccccagtcaaggcaaggccccgacctcccctctcgtcgaaccagggcaaaaatgcctcgatccgacgaatgggactgccagggcccagacttatctactgcagaactcagttaccgcttgagttcagcgcttcggtcagtgcagcttccacttcactggcgcttacgcgcaacggcttgtcagcatcacggcgacgcttgcgctcgctgtggtaagccaaaccggtaccggctgggatcagacgacccacaaccacgttttctttcaggccacgcaggtaatcgcgcttgccagttaccgctgcttcggtcagtacgcgagtggtctcctggaaggaggccgccgagatgaacgactcagtggacaacgacgccttggtgatacccagcagcacgcgagtgaacttggaaacgaatttctcttcgttcgccaggcgctcgttttctaccagtacgtgagtcagttccatctggtcgcccttgatgaaactggaatcgccggattcagcgatttcaactttacgcagcatctgacgcaggatggtctcgatgtgcttgtcgttgatcttcacgccctgcagacggtaaacgtcctggatctcgttgacgatgtacttggccagcgcactcacacccagcagacgcaggatgtcgtgtggatcgctcgggccgtcggagataacttcgccgcggtttacctgttcgccttcgaagacgttcaggtgacgccacttcggaatcagctcttcatacggatcgctaccgtcgttcggggtaatgaccagacggcgcttgcccttggtctctttaccgaacgcgatggtgccgctgacttcagccagaatcgacgcttctttcggacgacgagcttcgaacaagtcagcaacacgcggcagaccaccggtgatgtcacgagtcttcgaagtttcttgcgggatacgcgcgataacatcaccgatcgcgatcttcgcaccatccgccacaccgaccagggcgttggctggcaggaagtactgagcgattacgtcagtgcctggcagcaacagatccttgccgttgtcgtcgaccatcttcacggcaggacggatgtctttaccggcagctggacgatctttggcgtcgagtacttcaatgttggtcataccggtcaattcgtcagtctgacgcttgatcgtgatgccttcttccatgcccacgtaggtcacggtacctttcatttcggtaacgattgggtgagtgtgcggatcccacttggccacgattgcgccagcgtcgaccttgtcaccttctttaaccgaaatcacagcaccgtacggcagcttataacgctcgcgctcacgaccgtagtcatcagcgattgccagctcaccggaacgggaaacagcaacgaggtggccatccactcgctcaacgtgtttcaggttgtgcagacggacggtaccgccattcttcacctgaacgctgtcggctgcggaggtccggcttgccgcaccaccaatgtggaacgtacgcatggtcagctgggtacccggctcaccgatggattgggcagcgataacgccgaccgcttcaccgatgttcacctggtgaccacgagccaagtcacggccgtagcacttggcgcagatgccgtagcgggtttcgcaactgatcggcgagcgaacgatcacttcgtcgatgctgttgagttcgatgaactcgacccacttttcatctaccagagtgccggcaggaacgataacttcctcggtacctggcttgaacacgtcacgggcaatcacacgacccaatacgcgctcacccagcggttctacaacgtcaccgccttcaatgtgcggagtcatcagcaggccatgctcggtgccgcaatcgatctcggttacaaccagatcttgtgcaacgtctaccagacgacgtgtcaggtaaccggagttagcggttttcaacgcggtatccgcaagacccttacgagcaccgtgagtggagatgaagtactgaagtacgctcaaaccttcacggaagttcgcggtaatcggcgtttcgatgatggaaccgtccggcttggccatcaggccacgcataccggcgagctgacggatctgcgcagcagaaccccgtgcgcccgagtcggccatcatgtacatcgagttgaaagattcctggtcgacttcgtcgccgtgacggtcgatgactttctctttcgagaggttggccatcatcgccttggaaacttcgtcgttggccttggaccaaaggtcgatcactttgttgtacttctcgccctgggttaccaggccggaggcgtactggctctcgatctctttcacttcgtcagtggcggcactgatgatgcgagctttttcatccggaataacgaagtcgttaacgccgatggaaacgccggaaatagtcgagtaagcgaaacctgtgtacatcaactggtcagcgaagataacggtctctttcaaaccaaccacgcgatagcactggttgatcagcttggagatcgccttcttcttcatcggcaggttgacgacatcgtacgacagaccttttggcacaacctggtacaacagcgcacggccgacagtggtgtcgacgatacgggtgttgctcacgctgccgccgtcacggtcattgacggtttcgttgatccgcactttgaccttggcgtgcagtgcggcttcgccggcacggaacacacggtcaacttcctgcaggtcagcgaacacacgaccttcgcccttggcattgatcgcttcacgggtcatgtagtacagacccaatacaacgtcctgcgaaggaacgatgattggctcaccgttggctggcgacagaatgttgttggtcgacatcatcaacgcgcgcgcttccaactgggcttccagtgtcagcggtacgtgcacggccatttggtcgccgtcgaagtcggcgttgtacgcggcacagaccagcgggtgcagctgaatagccttaccttcgatcagtactggttcaaacgcctggatacccagacggtgaagggtcggtgcacggttgaggagaaccgggtgttcgcggatcacctcggcgagaacgtcccaaacctctggcagttcgcgctcgaccattttcttggccgctttgatggtggtcgcgagaccgcgcatttccagcttgccgaagatgaatggcttgaacagctcaagtgccatcttcttgggcagaccgcactggtgcagacgcagggtcgggcctacggtaattaccgaacgaccggagtagtcaacacgcttaccgagcaagttctgacggaaacgaccttgcttacccttgatcatgtcagccaaggatttcagaggacgcttgttggaaccggtgatagcgcggccacgacgaccgttgtcgagcaaggcatcgacagcttcctgcaacatacgcttttcgttgcgcacgatgatgtccggagcggacaggtcaagcaggcgcttcaagcggttgttacggttgatcacgcggcgatacaggtcgttgaggtcggacgtcgcgaaacgaccaccgtccaacggtaccagcggacgcaggtctggcggcagaaccggcagaacggtcagcaccatccactctggcaagttgccggaaccctggaaggcttccatcaacttcagacgcttggacagcttcttgatcttggtttcggagttggtttgcggaatttcttcgcgcagacggccaatctcgtgctccaggtcgatagcgtgcagcagctcgcggacagcttcggcacccatacgggcatcgaaatcgtcaccgaactcttccagcgcttcgaagtactgctcgtcgttcagcagctgacctttttcaagggtggtcatgcctggatcgataacgacatagctctcgaagtagagaacgcgttcgatatcacgcagagtcatgtccatcagcaagccgatacgggacggcagcgatttcaggaaccagatgtgggcaaccggcgaagccagttcgatgtgcgccatacgctcacgacgaaccttagccagtgcgacttcaacgccgcacttctcgcagatcacaccacggtgcttcaagcgcttgtacttaccgcacaggcactcgtaatcctttaccgggccaaagatcttggcgcagaacaggccgtcacgctcaggtttgaacgtacggtagttgatggtttccggctttttaacttcaccgaacgaccacgaacggatcatctcaggcgatgccaacccaatacggatggcgtcgaactcttcgacttgaccctggtttttcagcaaattcagtaggtctttcaaggcctttcctcctggcggagcagagagcggaccaaacggccacgctctcgattcgcgtcacgtgttattcggtttccagatcgatatcgatgccgagggaacgaatttctttgatcaacacgttgaaggactcgggcatgcccggctccatacggtgatcgccgtccacgatgtttttgtacatcttggtacgaccgttcacatcgtccgacttcactgtgagcatttcttgcagagtgtatgcagcaccgtatgcttccagtgcccagacctccatctccccgaaacgctgaccaccgaactgagccttaccacccagcggctgctgggtaaccaggctgtacgaaccagtagaacgagcgtgcatcttgtcgtctaccaagtggttcagcttcagcatgtacatgtagccaacagtaaccgggcgctcgaacttgttgccggtacggccgtcgaacagctgcatctggccgctttctggcaggtctgccagtttcagcatggccttgatttcgctttccttggcaccgtcgaacaccggggtagccattggaacgccgccgcgcaggttcttcgccagatccaggatttcctggtcggagaaggtatccagctcttcgttgcgaccacctatctcgttgtagatctcgtgcaggaacttacgcaggtctgcgaccttgcgctgctcttcgatcatgcggttgatcttttcgcccagacctttggctgcgaggcccaggtgggtttcaaggatctgaccaacgttcatacgcgaaggtacgcccaacgggttgaggacgacatcgaccggggtgccattggcatcgtgcggcatgtcttcaaccggcatgatcacggagaccacacctttgttaccgtgacgaccggccatcttgtcgcccggctggatgcgacgacggattgccaggtaaaccttgacgattttcagcacgcctggagccaggtcatcgccctgctgcagtttgcgcttcttgtcttcgaacttgtcgtccagcagacgacgacgatcaacgatataggcctgagccttctcgagctgctcgttcagagcatcttcagccatgcgcagtttgaaccactggccatgctcaagaccgtcgaggatttcgtcggtgatgtcctgacctttcttcagacctgcgccgccttcagccttgtggcctaccagagcggaacgcagacgctcgaaggtcgcgccttcaacgatacggaactcttcgttcaggtccttgcggatctcgtcgagctgggtcttctcgatggacagtgcacgagcatcacgctcaacgccgtcacgggtgaagacctgtacgtcgatgacagtgcccttggtaccggtaggtacacgcagggaagtgtctttaacgtcgctggctttttcaccaaagatggcacgcaacagcttctcttccggagtcagctgggtctcgcctttcggagtgaccttgcctaccaggatgtcgcctgcaccaacttcagcacctacataaacgataccggcttcgtccagcttgttcagtgcagcttcacccacgttagggatgtccgcagtgatttcctctggcccaagcttggtgtcacgtgccacacaggtcagttcctgaatgtggatcgtggtaaagcgatcttcttgaacaacgcgctccgacagacagatggagtcttcgaagttgtaaccgttccaggccatgaacgcgatgcgcatgttctgacccagtgccagctcacccatgtcggtggacgggccatcggccatgatgtcgctacgctgaacgcgatcacccttacgcaccagcggacgctggttaatgcaggtgttctggttagaacgggtgtacttggtcaggttgtagatgtcgacaccagcttcaccggtttcaacttcgtcatcggcaacacgaaccacgatacggctggcatcaacagagtcgatcacaccaccacgacgagccacgacgcaaacgccggagtcacgggctacgttgcgctccatgccggtacctaccagcggcttgtcggcacgcagggtcggtacagcttgacgctgcatgttggaacccatcaacgcacggttggcgtcatcgtgttccaggaacgggatcagcgacgctgcaaccgaaactacctgcttcggcgaaacgtccatcaaggtgacgtcttccggcgccttgacggtgaactcgttcaagtgacgaacagctaccagttcgtcgatcaggactttcttgtcgttcatcgtggccgaagcctgagcgatcacatgatcagcttcttcgatagcagacaggaatacgatctcgtcggtgaccagaccctctttcaccacacggtacgggctctcaaggaagccgtactggttggtgcgcgcataagcggccaaggagttgatcagaccgatgttcggaccttccggcgtttcgatcgggcaaacacgaccgtagtgcgtagggtgtacgtcacggacttcgaaacctgcccgctcacgggtcagaccgcccgggcccagtgcagagacacggcgcttgtgggtaatctcggagagcgggttgttctggtccatgaactgcgagagctggctggaaccgaagaactctttcaccgccgcagccactggcttggcgttgatcaggtcttgcggcatcaggccttcgctttctgccatcgacagacgctctttgaccgcacgctcaacacgtaccaggccaacgcggaactggttctcggccatttcgccaacgcagcgaacacgacggttacccaggtggtcgatgtcatcgacgatgcctttgccgttacggatgtcgaccagggtcttcaagaccgcaacgatgtcttccttgcacagtacacccgaaccttcgatctcggtacgaccgatacgacggttgaacttcatccggccgaccgcagacaggtcatagcgctcagggctgaagaacaggttgttgaacagggtttcggcagcgtctttggttggtggctcgccaggacgcatcatgcgatagatctcgaccagcgcttccaattggttgctggtggagtcgatcttcagtgtgtcggagatgaacggaccgcagtcgatgtcgttggtgtacagggtctcgatgcgaacgacctgggccttggcgattttagccaggatctcggtgttcagctcggtgttgcactcggccaggatttcgcctgtggccggatgaacgatgaccttggcggtagtacggcccaggacatagtccagaggtacttccagctccttgataccggctttttcgatctgattgatgtggcgcgcagtgatacgacggccagcctcaacgatgaccttgcctttttcatcctggatgtccaggacagcaatttcaccacgcagacgcgaagcgatgagctccagcttgagggtttcatccttcagactgaatacgttggtggtgtagaaagcgtccagcacttgctcggtggtatagccgagcgcacgcagcagtaccgaggccggcagcttgcgacgacggtcgatacgcacgaacacgcagtctttcggatcgaactcgaagtccaaccacgaaccgcggtacggaatgatccgcgcggagtacaggagtttgccggagctgtgcgtcttgccgcggtcgtggtcgaagaacacgcccggggaacggtgcagctgggaaacgattacacgctcggtaccgttgataacgaaggtaccgttctcagtcatcaatgggatttcgcccatgtagacttcctgctctttgatgtccttgatcgctttgttcgacgattctttgtcgaaaatgatcaggcggacttttacccgcaaaggtacggcgtacgtaacgccacgcaacacgcattctttgacatcaaatgccggttcgcccaggcgataaccgacgtactccagcgcagcattgccggagtagctgatgatcgggaaaacggatttgaaggccgcatgcaggcccacgtcgcggaactgatctttggtcgctcccgcctgcaagaattcacgatacgaatccagctggatagccagaaggtacgggacatccatgacgtccggcaacttgctaaagtccttgcggatacgttttttctcagtatatgagtaagccatcagcgttccccagcttggtcacctgcttgtttggccctcccgacgggagcagccagaaaatcttgcaaaccccatggtttgcaccaccgcatcgggtggctacagcgcgttaatggcggcgaccgagtcgacagccaagaacggaaaaaggccggtggcaagagccaccagccatcagccttcagcttaacgcttgggctggagacgcaaggtcgatgcttacttcagctcgactttagcgcctgcttcttccagagtagctttggctttgtcagcagcgtctttcgacacagcttccagaacctgggcaggagcgccgtcaactacagccttggcttctttcaagcccagaccggtcagttcacgtactgccttgatcacgtttactttcttctcgccagcttccagcagcatgacgttgaattcggtttgctcttcagcagcaacagcagcaacagctgggccagcggaagcagcggcagcggaaacgccgaatttttcttcgaaagctttgatcagctcaacaacctgcagaaccgacatttcagctacggcgttgaggatatcgtcttgggagatagacattgctgtatttcctgaattgggggacggcctacgcggccatcgaaataaacaaaaatacgcgagagaggttgctcagccttaggctgcggcagcttctttttgctcgcgaactgcagccagagtacgagccagcttgctggtagcgccttgaatcacgctcatcagctgcgaaatggcttcgtcgcgggtcggcagtgttgccagtacgtcgatttggttagctgcgaggaacttgccctcgaacgcagctgccttgatctcgaacttatcctgactcttggcgaattccttgaacaaacgggcagcagcgcctggatgatccttggagaacgcaatcagagtcgggccagtgaacacgtcgttgagaacactgtattcagtgtcagcaacagcgcgcttgagcagggtgttacgtacaacacgtacgtatacgccagcttcacgagcctctttacggagtccggtcatagcgcctactgtcacaccacgggcatcagccacgacagcggacagagcagctttggcagcctcgttgacttcagcgacgatggccttcttgtcttcgagattaattgccacgggtttaactcctgcttgttaccgtttcatctggccggagccggatgtcgttttggtgtctgattcggtaaggaaccgggagcaccatctgcgtaggcttgttggtttaagacttgcgtcgcctacggtcttggatagcccccgccaggcagggaccccaatctttcaattggcgcaatcgcttgcgccaacttgcgtcttatacgtccagcgagccttggtcgatgaccagacctgggcccatagtggtgctcagggtaacgcgcttgacgtagatacctttcgaggaagccggcttgatacgcttcagatcagcgatcagggcctcaacgttttccttcagcttgacggcatcgaagccgactttgccaacggaggtgtgaatgatgccgtttttgtcggtgcgataacgaacctgaccagccttggcgtttttaaccgcggtagctacgtctggggttacagtgccgactttagggttaggcatcagaccacgtggaccgaggatctgacccaactggcctacaacgcgcattgcatccggggaggcgataactacgtcgtagttcaggtcgccgcctttcatttcggcagccaggtcatccatgccaacgcgatcagcgccagcggccagagcagcttcagcggctgggccttgggtgaagacagcaacacgtacagtcttgccagtaccgtgtggcagcacagtagcgctacgaacgacctggtcagatttacgtgggtcaacacccaggtttacagcaacgtcaacagactcgctgaacttgacagtcgacaactcggtcagcagggcagcagcgtctacaaagttgtaggacttgcctgcttcgattttgccggcgatagccttttggcgcttggtcagcttagccattacacaccctccacgttaaggcccatgctacgagcagaaccggcgatggtacgcacggctgcatccatatcagctgcagtcagatccgcgtttttggttttcgcgatttcttccagctgagcacgagtcacggtgccaaccttaacggtgttaggacgagcggaaccgctagtcagaccagcagccttcttcagcagaaccgaagccggggtcgacttggtttcgaaggtgaagctacggtcgctgtatacagtgatgatcactggagtcggcagacctggttcaagaccctgtgtacgggcgttgaaggccttgcagaattccatgatgttcacgccgtgctgacccagagccgggccgacgggtggacttgggttggcctgagcggccttcacttgcagcttgatgtaagcggtaatcttcttggccatgaggcactccaattacgggttcaaacgcctcgaaaggctccccggttacttgcgcgtttatcccagtgacgacaaaaccccacagcctaaggctgcggggttgggatgcttgtccagctagaccttctcgacctggctgaactccaactctaccggagtagagcgaccgaaaatgagcactgccacttggatccggctcttttcgtagttaacttcttcgacggtgccattgaaatcagcaaatgggccatcagtcacacgaacaacctcacccggctcgaacaacgtcttcggcttgggcttgtcgctaccatcagcaacgcgacgcagaattgcttccgcctctttgtcggtgatcggagcaggcttatcagcagtaccgccaatgaagcccatgacacgaggagtgtccttgaccaagtgccaagtaccttcattcatgtccatctgaaccagcacgtagccagggaagaacttgcgttcgcttttgcgcttctggccattgcgcatttcaaccacttcttcagtggggaccagaatctcgccgaagccatcttccatgcctgcaagctttacgcgctctagcaaagagcgcataacatgcttctcgtaacccgagtaagcatgcacaacgtaccaacgcttagccacgggacacccttagccaacaatcaaggaaacaagccagccgagcagggaatcaagcccccacaacagcaacgccataaccagaacaacagccacgacaatcaatgtggtctgcgtggtttcttggcgagtcggccaaacgactttacgtatttcggtgcgagcttcctttaccaggaccgcgaaagacttgcctttggcagtctgcaggcctacaaaggcagctacagcagcaagggcgagcaaagcgagcacacggtacaggatcggcgaagcagaatagtactgattgccaacaacgcctacgaccaccaaggcgactacagcgagccacttgaccatatcgaaacgagagctttgagcttcagccttaggagtcatctatgaagatcctgtgaaaagaaagccagacacaccacgtgaatctggcaggtcaggagggaatcgaacccccaacctacggttttggagaccgtcgctctgccaattgagctactgacctaaaacaaaatcaggccgaccattatgcaggcctgaaaaagactttacaacaaccaaccccaacagacttgaaaccatccgacaatcaaagccagacacaacacgaaacaagccgaggcagctgttaaaacaaaggcagatattttcatatctgccttgttatatggagctcttgagcggatttgaaccgctgacctcacccttaccaagggtgtgctctaccaactgagctacaagagcaaaacaccgtgcacaatctgcaaacttggagcgggtagcgggaatcgaacccgcatcatcagcttggaaggctgaggttctaccactaaactatacccgcggagcttgcagctcacgctaaaatggtggagggggaaggattcgaaccttcgaagtcgtagacgtcagatttacagtctgatccctttggccgctcgggaacccctcctaagcgagccggcattctacatcacgccggccttctgtcaagcattttctcattaaaaatatgaggttagctgcattgaccttcgcttcgccatgtagcccttaaaggtcttcactgcgaagcgggcgccattctatgcaaactattcgagagttgcaatgccttcgcacagcattattttatgttttaactcattgaattccttagcaaggttttcaaacggcagatcatcagccaggcgccggctttcaggggctacacgcaaccagtaacccgaggcatcaggcgcactcaacaattgaaccttgacctttatatccaggctcgtcagtcgctgctcgacagatagggcttggcgccgatcagagaaaccaccgatgtatagacaggtattttgcccttcagatggctttattcgatcacgccgagccaccccatctacagattcactcaagagccgaatgtcttgctgcgctccacgataaagactcaaaggcgtaacatccttggcacgcaacggagcctcttgctgatgccagacgtaatagaaagcattgaggacaagtaaaagcaaaaacagccaacgcataatcacctcaagacaaagggcatgccatcgccagaccaacaaatacaaggtccggaaccagctgagcctggggcgcagcatccgagaccaactcagcatcccctccagtcaggaagacggtgaaatcgtcaccccagtagcttcgcgccagctcaagctgggtcagcacaaaccctctaagcatgagcgtacagcctcgctcgacggcctccacggtggtccgccccggagagaggcgctccagagccctctcagccgccgcgtcgccataacgtatcttgcgcgtatgggtacgcagctgattgcgcatgaggggcatgcctgggcaaataaaccctcccaggtgctcaccatctgaactgataaaatcggcggtcgccgcggtgccaaaatcaagcaccaggcatgcacctgacgccaatttgaacgccccgagcatcgccaaccaacgatcaagcccgagacgctcgaaatctttgtagccgttgcgcacaccagccatttcccgctcagggccggcacatgaaacggtaacgccaaatgcatccaccaaagcagctaccagcttgtcggtttcttcaagtgcacgaacactgactaatcggcagcgcgtaagcagaagatcgggaagagccaccaagctgtcaatcaatgatgcatccgaacctgctatgccttccacgcaagcgcttgcctcactcgactcaagtacacgccatttaatgaagctgtttccacagtcgagctcaagaatcatcacgcaacctcaggcttagctcaccgccgctatagattttctcaaccccatcgacattcaaacgcaaggcgccctgacgatccacacccagtaccaccccctcaatccggttggtgccggcaatgagagatacaggcctggcctgccacaagtgatgctgctcccactcttcttgcaatccggcaaaaccagtagccttatggcgatcaagatagatttgcagctgtcctcccaggcgcgccaccaggtggttgcggtcaatagaggttccagtctcaagctgcatcgacgtccactgttgatcgacctcaacagccttctgcatattcacattgatacctatgccaagcacaacgtgacagatgtctccaggatccccgactaactcaagcaagatgccagaaattttcttgttcccaaccaagacgtcgtttggccacttcaaagcagcgccctggacccccgactcgcgcaaagcctgcatgacagccaaacccactacgaggctcaacccctccaactgtcgcaggccgccgtcgatgcgcaacacgagactgtaataaagattttgcgcatatggactgacccattttcggccacgccgcccccttccagccgtttgttgttctgccaagacaacaaagggtggcacgcagcccgactccacaagacgcaaagcctcggcattggtggaatcaacggaatcgtaaatgtgaaccggccaggccgaagaagccgcctccagagaaatgtcctctgcattcaaaaacaccagcggcgcagccaattgatacccacggccacggactctatgaataggcagattcatctcggcttcaagatgctggagctgcttccacacagcacttcgactaatccccagggcagcgccaagcgcctctccagaatggaatcgaccatctttcagaagtttcaacaacgtcagcatgcaggtatcgcctcacaatgaggcacgcatgatagccatgcgtagggtcattgcatagaaagcccgttcgttagcactcaaggcataagtgatatttatagattttccgagcgcccaaaacaaaaccccaactgctttcgcaattggggttctggaatttaatcttgacgatgacctactctcacatggggaaaccccacactaccatcggcgatgcatcgtttcactactgagttcgggatgggatcaggtggttccaatgctctatggtcgtcaagaaattcgggtactgagtcgtggccagcaggcctcgcttcagcaaattgggtatgtgacagcggtcggtgctttgtgagcgtcgaactttcggttcatttcgtcttcacacaccgcaatctgatgctcgttagagtagtcaaattgcttgggtgttatatggtcaagcctcacgggcaattagtattggttagctcaacgcctcacagcgcttacacacccaacctatcaacgtcgtagtcttcgacggcccttcaggggactcaaggtcccagtgagatctcatcttgaggctagtttcccgcttagatgctttcagcggttatctattccgaacatagctacccggcaatgccactggcgtgacaaccggaacaccagaggttcgtccactccggtcctctcgtactaggagcagcccctctcaaatctcaaacgtccacggcagatagggaccgaactgtctcacgacgttctaaacccagctcgcgtaccactttaaatggcgaacagccatacccttgggaccggcttcagccccaggatgtgatgagccgacatcgaggtgccaaacaccgccgtcgatatgaactcttgggcggtatcagcctgttatccccggagtaccttttatccgttgagcgatggcccttccatacagaaccaccggatcactaagacctactttcgtacctgctcgacgtgtctgtctcgcagtcaagcgcgcttttgcctttatactctacgaccgatttccgaccggtctgagcgcaccttcgtactcctccgttactctttaggaggagaccgccccagtcaaactacccaccatacactgtcctcgatccggataacggacctgagttagaacctcaaagttgccagggtggtatttcaaggttggctccacgcagactggcgtccacgcttcaaagcctcccacctatcctacacaagcaaattcaaagtccagtgcaaagctatagtaaaggttcacggggtctttccgtctagccgcggatacactgcatcttcacagcgatttcaatttcactgagtctcgggtggagacagcgccgccatcgttacgccattcgtgcaggtcggaacttacccgacaaggaatttcgctaccttaggaccgttatagttacggccgccgtttaccggggcttcgatcaagagcttcgcgttagctaaccccatcaattaaccttccggcaccgggcaggcgtcacaccctatacgtccactttcgtgtttgcagagtgctgtgtttttaataaacagtcgcagcggcctggtatcttcgaccggcatgagcttacggagcaagtccttcaccctcaccggcgcaccttctcccgaagttacggtgccattttgcctagttccttcacccgagttctctcaagcgccttggtattctctacccaaccacctgtgtcggtttggggtacggttcctggttacctgaagcttagaagcttttcttggaagcatggcatcaaccacttcgtcatctaaaagatgactcgtcatcagctctcggccttaagatcccggatttacctaagatctcagcctaccaccttaaacttggacaaccaacgccaagctggcctagccttctccgtccctccatcgcaataaccagaagtacaggaatattaacctgttttccatcgactacgcttttcagcctcgccttagggaccgactaaccctgcgtcgattaacgttgcgcaggaaaccttggtctttcggcgtgggtgtttttcacacccattgtcgttactcatgtcagcattcgcacttctgatacctccagcaagcttctcaactcaccttcacaggcttacagaacgctcctctaccgcatcacttacgtgatacccgtagcttcggtgtatggtttgagccccgttacatcttccgcgcaggccgactcgactagtgagctattacgctttctttaaagggtggctgcttctaagccaacctcctagctgtctaagccttcccacatcgtttcccacttaaccataactttgggaccttagctgacggtctgggttgtttcccttttcacgacggacgttagcacccgccgtgtgtctcccatgctcggcacttgtaggtattcggagtttgcatcggtttggtaagtcgggatgaccccctagccgaaacagtgctctaccccctacagtgatacatgaggcgctacctaaatagctttcgaggagaaccagctatctccgagcttgattagcctttcactccgatccacaggtcatccgctaacttttcaacggtagtcggttcggtcctccagttagtgttacccaaccttcaacctgcccatggatagatcgcccggtttcgggtctattcccagcgactagacgccctattaagactcgctttcgctacgcctcccctattcggttaagctcgccactgaaaataagtcgctgacccattatacaaaaggtacgcagtcacccaacaaagtgggctcccactgcttgtacgcatacggtttcaggatctatttcactcccctctccggggttcttttcgcctttccctcacggtactagttcactatcggtcagtcagtagtatttagccttggaggatggtccccccatattcagacaaagtttctcgtgctccgtcctactcgatttcatgactaagagattttcgcgtacagggctatcacccactatggccgcactttccagagcgttccgctaatctcaaagccacttaagggctagtccccgttcgctcgccactactaagggaatctcggttgatttcttttcctcagggtacttagatgtttcagttcccctggttcgcctcttgcacctatgtattcagtacaagataaccatcttatgatggctgggttcccccattcagacatctccggatcaaagtctgtttgccgactccccgaagcttttcgcaggctaccacgtctttcatcgcctctgactgccaaggcatccaccgtatgcgcttcttcacttgaccatataaccccaagcaatctggttatactgtgaagacgacattcgccgaaaattcgaatttctcagttaagagaactcacaaattttaccttagcctgatccgttaccagtgaaagtaacgttcagtctatctttctatcacatacccaaatttttaaagaacgatctaatcaaagactagaaatcaacattcaccatcacaacgattggaatgctcatttctaagctttatacaaacagaagcagtagtggtggagccaaacgggatcgaaccgttgacctcctgcgtgcaaggcaggcgctctcccagctgagctatggccccgtatttctacaggcgtttcccacacaaaattggtgggtctgggcagattcgaactgccgacctcacccttatcaggggtgcgctctaaccaactgagctacagacccaatttcgggctgcttcttatcgtcttcttcaatgaatcaagcaattcgtgtgggaacttatggagcagctgatgtcgtcgattaaggaggtgatccagccgcaggttcccctacggctaccttgttacgacttcaccccagtcatgaatcacaccgtggtaaccgtcctcccgaaggttagactagctacttctggtgcaacccactcccatggtgtgacgggcggtgtgtacaaggcccgggaacgtattcaccgcgacattctgattcgcgattactagcgattccgacttcacgcagtcgagttgcagactgcgatccggactacgatcggttttctgggattagctccacctcgcggcttggcaaccctctgtaccgaccattgtagcacgtgtgtagcccaggccgtaagggccatgatgacttgacgtcatccccaccttcctccggtttgtcaccggcagtctccttagagtgcccaccattacgtgctggtaactaaggacaagggttgcgctcgttacgggacttaacccaacatctcacgacacgagctgacgacagccatgcagcacctgtctcaatgttcccgaaggcaccaatctatctctagaaagttcattggatgtcaaggcctggtaaggttcttcgcgttgcttcgaattaaaccacatgctccaccgcttgtgcgggcccccgtcaattcatttgagttttaaccttgcggccgtactccccaggcggtcaacttaatgcgttagctgcgccactaagagctcaaggctcccaacggctagttgacatcgtttacggcgtggactaccagggtatctaatcctgtttgctccccacgctttcgcacctcagtgtcagtattagtccaggtggtcgccttcgccactggtgttccttcctatatctacgcatttcaccgctacacaggaaattccaccaccctctaccatactctagtcagtcagttttgaatgcagttcccaggttgagcccggggatttcacatccaacttaacaaaccacctacgcgcgctttacgcccagtaattccgattaacgcttgcaccctctgtattaccgcggctgctggcacagagttagccggtgcttattctgtcggtaacgtcaaaattgcagagtattaatctacaatccttcctcccaacttaaagtgctttacaatccgaagaccttcttcacacacgcggcatggctggatcaggctttcgcccattgtccaatattccccactgctgcctcccgtaggagtctggaccgtgtctcagttccagtgtgactgatcatcctctcagaccagttacggatcgtcgccttggtgagccattaccccaccaactagctaatccgacctaggctcatctgatagcgcaaggcccgaaggtcccctgctttctcccgtaggacgtatgcggtattagcgtccgtttccgaacgttatcccccactaccaggcagattcctaggcattactcacccgtccgccgctctcaagagaagcaagcttctctctaccgctcgacttgcatgtgttaggcctgccgccagcgttcaatctgagccatgatcaaactcttcagttcaaacatctttgggtttttaagaaaccctaaacttggctcagcaatcgttggttacatctttgatttctcgcggagtaacttgtgatgctgataatcttgttgactatcagtctgactccacaagcacccacacgaattgcttgattcagttgttaaagagcggttggttaagatctttcgtctcaaccgaggcgcgcattctacagcagcctcatttgctgtcaagtggttattttcagaagttttcgaagatttcttcaacaacttcaaccacttgcgctttcgatctctcgttagcgggaggcgaattctacagcgttacacgctgctgtcaacacctctttttcaacttccttttggcttcgatgaactgaagcaacttgctgccgaaaacttcataactcattgtttaccaaggagttttccgtttcgactgcgccggaagtggggcgaattataggacagatataattcgccgtcaacacctaatttcagacttattcggatttgagcgtaatgcgcgcaaatgccttctttcctgcctggcacacatgggtagcgcccagctcgtatataaaggtgcgatcaactacctcaccatctatacgcacgccgcccgaccccaagagatcacgagcgaccgccgagttctttaccaggcccgccttattaaggacagccgcgatcggcatcgcctcaacagccgtcaactcaatctccggcagatcgtcaggcagctcgccatccttcatacgattacccgcagcgcgatgagcattggccgcagcctcctcaccatggaagcgcgcaacaatctcttctgccagcttgatcttaacatcgcgaggattggcacctgcctttacatccgcacgcagcgcgttaatttcgtccatcgagcggaagctcaacagctcgaagtaacgccacatcaaagcatccggaatggaaaccagcttgccgtacatcacacccggcgcttcctgaatgccaacatagttacccaaggacttggacatcttcttgacgccatccaacccctcaagcaacggcatggtcagaatgcactgagcctcctgaccatacgcacgctgcagctcacgtcccatcagcaggttgaatttctgatcggtgccgcccagctcaacatccgcacgcagcgctaccgagtcatacccctgaacaagtgggtaaaggaactcatggatcgcgattggctgattggtggagtagcgcttgtcgaagtcatcacgttcaagcatgcgcgccaccgtgtactgggaggtcaggcgaatgaagtctgccggccccatcttgtccatccaggtggagttgaacgccacctcggtcttggccggatcaaggatcttgaacacctgcgtcttgtaggtctcagcattgtcgagtacctgctcgcgagtcagcggcgggcgcgtcgcgctcttaccgctcggatcaccgatcatcccggtgaagtcaccaatgaggaagatgacctggtgacccaactcctggaactgacgcagcttattaataagcacggtgtgacccaggtgcagatccggcgcggtcggatcaaagccagccttgatacgcaggggctggccacgcttgagcttttcaatcagctcagactcgaccaacagttcgtccgcaccacgttttatcagcgctagctgctcttcaaccgacttcataacagacccgcaaggctcagattcaaaagggaaccaaccatacaagatcagggactaattacaagttttgccctgcgcacggacaccgttcagcgagcccagcattcgcgagcttgcgccacagatgatttggttatattttatacagttatttcatcttcatcatgtcattcatcttttccatttcatcttcaaagtcaaaattacctatgaccactgaaccgtctaaagcgccgccgctttacccgaagacccacctgctcgccgcaagtggtatcgccgcccttctcagcctggcactcctggtattcccttccagtgacgtagaagccaaacgaacatcccttagccttgacctggaaagccctgttgagcaactgacacaagatcaagacgcttccgacgcccaacaagccacaaataccccgaccgaatcgcctttcgcacagatcgaaagcactcccgaagatacccaacaagccacccaggaccaacctgtggtagccgcagccaagagccctcagcatcgcgaggtcatcgtcagcagaggcgacacgctatcaacgctgttcgaaaaggtcggactgcctgccgctaccgtcaccgaggtgttggccagcgataagcaagccaagcaattcacccagctcaaacacggtcaaaagcttgagttcgaactgacgcccgacgggcagttgaacaacctgcacaccagcatcagcgacctggaaagcatcagcctgagcaaaggcgccaaaggctttgccttcaaccgcatcaccaccaagccggtcatgcgttcagcctatgtacacggcgtgatcaacagctccctgtcgcaatcggccgcccgcgcaggcctttcgcacagcatgaccatggacatggccagcgtatttggctacgacatcgacttcgcccaggacatccgccagggtgacgaattcgacgtgatctacgagcagaaagtcgccaacggcaaagtagtaggcaccggcaacatcctctctgcacgcttcaccaaccgtggcaaaacctacaccgctgtgcgctacacgaacaaacaaggcaatagcagctattacaccgctgatggcaacagcatgcgcaaggccttcattcgcacccctgtggacttcgcccgtattagctcgcgtttctccatgggtcgcaagcatccaattctgaacaaaatccgcgcgcacaagggcgtcgactatgccgctccgcgcggtacgcctatcaaggcagctggcgacggcaaagtgctgttggcgggacgtcgcggcggttacggcaatacagtgatcatccagcacggcaatacctaccgcacgctgtatggccacatgcaagggttcgccaagggcgtcaagactggcggcaacgtgaaacagggccaagtaatcggctacatcggcactactggcctgtccacggggccgcacttgcactatgagttccaagtcaatggcgtacacgttgacccattgggccagaagctgccaatggccgacccgatcgccaaggccgaacgcgcacgcttcatgcaacagagccagccgctgatggcgcgaatggatcaagagcgttccacgttactggcttcggcgaagcgttaaggtatgccgctctatatcggtgtgatgtccgggaccagcctagacggcctggatatcgccctcattgaacaaggcacggcgatcaatctgatcgccacccgctacattcccatgcccgacacattgcgcactgagctattgagcctgtgcgccagcggcccagatgaaatcgcccggtctgctattgcccagcaacagtgggtcacgctggccgcccaaggcattcacgccttgctggatcagcacaacctgaagcctcaggacattcgtgcaattggcagccatggccagacgattcgccatgaacccgcccgaggctttaccgtacaggtcggcaaccctgccctgctcactgagttgaccggcatcaccgtagtcagcgacttccgcagccgtgatgttgccgctggcggccagggtgcgcccttggttcctgcgtttcatgaagccttgttcggcgaacacaccggcaaccgcgcggtattgaatatcggcgggttcagcaacctcagtctgattgaaacgaacaagcctgtcgccggcttcgactgtggcccaggcaacgtcctcctggatgcctggattcacctgcagcgcggcgaacactttgatcgcgacgggcaatgggctgccagcggcagggtccagccccggctactcaacacattgctcagcgatccgttcttcttgaccaaaggcccaaaaagtacgggtcgcgaagtcttcaacctcgcctggctgcaggagcaccttgcccgcttgcctgtctttgaacctcaggacatacaggccacgttactggaactgacggccttcaccatcgtcgagtccctgcaaagcgcccaaccaaccacagagaccttgctgatctgcggcggcggcgcccataacaaaacactgatggatcgactgacagcactgttgcccaccacccacgtcagcagtacagctatctacggcgtagatcccgactgggtcgaagccatggccttcgcctggctggcacattgctgcctggaaggcatcgcggccaaccgccccagcgtcaccggtgctcgcgggcttcgggtactcggcgcgatctaccccgcctgaatcccagacagcaaaacgccgcgtggctaatcaagccaagcggcgtttttttgttgcgcgcgaggctaccgatcagatcgagaacgaagagccgcaaccacaagtagtggtggcattaggattcttgatcacgaaacgcgaaccttccagaccttcctggtaatccacctcggcacctgccaggtactggaaactcatcgggtccacgaccaggctgacgccctcgcgctcgacgatggtgtcgtcatcggccacatcttcatcgaaggtaaaaccgtactgaaaccctgaacaaccgccgcccgtaacgaatacgcgcagcttcaagcgatcattaccctcttcatcgaccaggctcttcaccttgtgcgcagcaccgtgggtaaattgcaaagccgtgggggtgaaggactcaacgctcatgctgataatctcccggcgtagcgccgtcatatgcgtaatggccggtattatccgcttctcctagaaaagcggtcaactattgttacggtatatcaatctgcacagccgccattaaaaacacaaaaggcccgatcaacgggccttttatgtaacggcctatcagcgctaaggcagcatgcccgcatgggacagacccaacttctcatccaagccgaacaggatgttcatgttctgcaccgcctggcccgacgcgcccttgaccaggttgtcgatcaccgacagcaccacgaccaggtcgccatcctgcgggcgatgcactgcaatacggcacacattggcgccacgcacactgcgggtttccggatggctgcccgtcggcattacatcgacgaacggctcattggcataacgcttttcaaacaatgcctggaggtctaccgagcggtcagtaacggtcgcatacagcgtggagtgaatcccacggatcatcggcgtcaggtgtggcacaaaggtcaggcccacgtccttgccggcagcgcgacgcagcccctggcggatttctggcaagtgacgatgcccctttaccgcataggctttcatgctttccgacgtttcagagtacagagaacctaccgccgcgccccgccccgccccgctgacacccgacttgcaatcggcgatcaggcgcgaagcatccgccaaaccagcttccagcaatggcaggaagcccagttgcgtcgcagtcggatagcaacccggtaccgcaatcaggcgtgcttgcttgatctgctcacgattgacttccggcaggccgtagaccgcctcctccagcaactgcggcgcaccgtggggttggccgtaccatttggcccactcatcggcatcctgcaggcggaagtccgccgacaggtcgatgacctttgtaccggccgccaacaactcacccgccaacgcatgggcaacaccgtgaggcgtggcaaagaacaccacatcgcaagcgcccagggtcttgatatccggcacgctgaacgccaggccatcatagtggcctcgcaggttcgggtacatatcggccacggccagcccagcttcggatcgggaagtgatgaccaccacctcagcctgcggatgctgggccaacagacgcagcaattcgacaccggtgtaacccgtgccgccgacgataccgaccttgaccataaacctgccctcaacgaacccactggaaagccgtcgataataggggccgcatcgtcctgcgacaaccgtcaacgtgacgtatgggcgcatgagccactactatcttggctaccgtgaacctgggaataactaaaaatgctctatctatggatcaaagccttccacatcgtcagcatcgtctgctggtttgccggtctgttctatctaccgcgcctgttcgtctaccacgcccaaagcgaagacacagtcagcaaagaacgcttcagcatcatggagcgcaaactgtaccgaggcatcatggggccggcgatggttgccacactggtcttcggcatctggatgctggcgctcaatccaggcattttccaatccggtgcctggatccacgccaagttgaccctggtcgtgctacttatcggctaccaccatatgtgcggcgcgcaagtgaaacgcttcgcccgtggcgagaacacccgcagccatgtcttttatcgctggttcaatgaggtgccggttctgatattgctggctatcgtaattttggtcgtggtcaaaccgttctaacttcaattactcggggaacctccaatgtcgctgcccgctttgctggaacaacatctgcgcctgcccgtggtggctgcgccgatgtttctgatctccaacccgcaactggttctggcctgctgccgcaatggggtggtcgggagcttcccggcgctcaaccaacgcgaaagcagcggtttcaaggcctggctggaagaaatcgaagcgggtctggcgcagctggacaacccagcaccctatgccgtgaacctgatcgtgcataacagcaacccacggctggaggccgatttggcgatctgtgtggagcacaaggtgcccatcgtcattaccagcctcggtgcggtgaaggaattggtagatgccgtccacagctacggcggcctggtgtttcatgacgtcacgacccgacgccatgccgagaaagccgctgaggcgggcgtcgatggcctgatcgccgtagccgctggtgccggcggccatgctggcacctggagtcccttctcgctgattgccgaaattcgccaattcttcgacaaaaccctgctgctggccggttgcctcaaccacggccacgaaattctcgccgcccagttgctgggagccgacttggcgtatttcggcacgcgctttatcggtactaccgaaagccacgcgccagatgcctataaagagatgctgctcacatcgcgcgccgccgacatcgtgcacactccggcagtctccggcgtacctgcgagctttatgcgccagagcctggaaaatgccggtttcgacctcgccgcgctgcaaggcaaaggtgaagtcaatttcggttccaaactcaaaccattgagtgatgaggccaaagcgtggaaaactgtatggtccgccggtcagggcgtcggtgaaatcgatgatttacccagcgtcgatgaactcgtcgcccgcctggatgccgaataccgcaaagcacgcgagcatgccgcgcaactgcgctggccacgctgacccactgcacggcccgccgattggacgggcctgcacaccctccctgattaagtgacaaggatgcccgcatgagcgacaaccgtttcaagattgtgtttgacggagccttgctcccgggtgtcgaaagcaccaccgccaagctgaacctcgccgagctgttcaagagtgatgtcgaggcgattgaaaaactctttaccggccgcccggtcgcgctcaaacgcgacctttcccgccccgatgccgaaacctatctgacggcattgaaaaacgccggggtcgacgcacgtatcgaagccgaacaacccgtagcattcagcctggccgaaacccacgagacgagctctcctggctccgacttttcccgctccgaagcttcaccatatgccccgccacgcgctgcggttggcgatgacttgccggagttcgccaccctcaaggtattcaccataaacgggcgcatcggccgcctgcgctacctggcctggacgctggcactgaccgtcgcgatgctggtggctgctggcatcatcagtaccgtcggcttcgcggtggcgactgcctcgccaacaatcgccatcattctcggctcgctgctgggtttcgcgctatttgttggactcgtcgtggtgagcgtgcaaatcggtgtgcagcgcctgcacgacctgggctggtctggctggctgtacttgctgaacctggttcccctggtcaatagcgttttccctatcctgttgctggtattgccggggaacgcgggtgccaaccaatacggcgcaccgccaccaccgaactctactgcggtgaaaatcctggcctcgctgtggctggcgtttattccattgatgctcatcatcggcctgaccctgggcatgaacggttatctggaccaacttgaagccaatatggacagcagttacgaaagcagctccatcacctccgatgaagacgtcgatcaaagcgtgattgtggatgaagccgcagcgcaaagtgctgacgacgcggccgaacctgtagactctccagaacagtgaagaaacgcccgccacctgtgatgccactgtcacaggtcggcggcgttgcgatggagaaaggcatgacccgttacgctctgatcaccggtgcctccagcggcatcggcctggctttggccgaagccctggctcgacgcggccgcagcttgattctggtggcccgccagcgtgatcagttggaaagcattgcattggaattgacccaacgcttcggcgtcgaggtgttgtttcgtgcctgcgacctgggcgaaccgctgcgtttgtccggctttttgctggagcttgaagagggcgagcgacagattgatcttttggtcaactgcgccggcattggtaccagcgggccgttcctggcccaggactggatgaccgagcaggacctgatcgaagtcaacatcctggccctgacccgcatgtgccatgccctcggcaatgccatggcgctgcacggtggcgggcagattctaaacgttgcttcggtcgcagccttccaaccgggcccatggatgagcagctactacgccagcaaagcctatgtactgcacttttcagaaggcttgcgcgaagagttgaagacgtgtggcatcaaggtctcggtactttgcccgggccctacgcgcaccgccttcttcggcaccgcgcaaatggatacggcgaaacttgaccacagccagcaactgatgagcccggaagaagtcgcgctctacaccgtgcgcgcgctggaaaagaacaaagccatcatcattcccgggcgccgcaaccgctggctcgcattcagcccacgcctcagcccgcgctggctgacccgcaagattgccggcgccatcaacaaggcctattgcccgcgctgatcgcctgggtacactcaccctgcattttcataatggagaaacagctgtggatactctgttcaccaagatcatcaacagagaaatacccgcgaagatcatctacgaagatgatcaagtcctcgccttccatgatatcgccccgcaggcgccggtacattttctggttattccgaaaaagcccgtccgcaccctgaatgatctgactgaagatgataaggccttggccggccatatcctctttacagcccaacgcctggccctggagctaggttgtgaagagggttttcgggtcgtgatgaattgcaatgagttgggcgggcagaccgtttatcacatccatatgcatgtgcttggtcagcgtcagatgaactggccgccaggctgagggccgaagtcgaattgactcagcgcaaacgcttcgccctctcttgcggtaaactggccgccgagattcttcccggaggtcagcatgactacccaacgtcactactcgccgattgaccgtctgttgctgcaagccgacatggccatgcgcacactgctgccattcagcggccaaccctaccgcccatcgcccgccatcgtgcagcccgatgcgcagctgagcgaaacggatacccgtcacgtggccggcctgatgcgtatcaaccatacgggtgaagtctgtgcccaggcgctgtatcaaggccaggcgctgaccgccaagttgccgcaggtacgtgcagcgatggagcatgcagccgaggaagagatcgaccatctggcctggtgcgaacagcgtatccgccagttgggcagccaccccagcgttctgaacccactgttttatggcttgtcgtttggtatcggcgctgccgccgggttgatcagcgacaaagtcagcctcggatttgtcgccgcgaccgaacatcaggtctgcaagcacctggatgaacatctggagcagctgccggccgaagacgaaaagtcccgggcgattcttgagcaaatgcgcatcgatgaagaacaccatgcagaaagcgctctagacgccggcggcttccgttttccagcaccggtgaagttcggaatgagcctgatggccaaggtcatgaccaaaagcacctatagaatctaaaagtgcgtcaaattcaaaccgaaaaaagggcgctcgcagcgccctttctcttgcctgcgattccagcagtcagcccaactcgatgatttcgtaatcatgagtgatgaccacacctgcggcacccagcatgatcgacgccgagcagtacttctcggcggacaactcaatggcacgcttgacctgggcttccttgagcgcgcggcccttgaccacgaaatgcatatggatcttggtaaataccttgggatcctcagtggcgcgctcggcttccaggaaggcttcgcagctttccacggcctggcgcgacttcttcaggatgctgaccacatcgaaattgctgcaaccaccgacgcccagcagcaacatttccatcggccgcaccccaaggttacggccaccggcttccggcgggccgtccatgaccaccacatggccgctacccgactcaccgaggaacatggcttcgcccgcccattggatgcgtgccttcatcgcccagactccactgctaaaaaagggtcgccagcttagcacagggccttaaaaccgcagcgctctggctgaatttgataaatgacagcgtttgccaagcaatttcgctaatcgaggcagaatgtgtctggtaagctggcgccaaatcaatggcgcattgccatgattttacagtgcgtatcaatattgagaccactggataaaaacaacgccaaccacaccgcgcagtctttcgggaaacaaccatggttgctcttactcccacacccaagatcaagaacctcgacaagctgctgatgcattgccagcgtcgacgtcatccggccaagcacaacatcatttgcgccggcgagcgctcagaaaccctgttttttattatcaagggctcggtcaccatcctgatcgaggatgaagacggtcgcgaaatgatcattgcgtacctgaacactggagatttcttcggggagctggggctgtttgagcaggcgggcaaggaacaggagcgcagtgcttgggtccgcaccaaggttgagtgcgaagtcgccgagatcagctatgcgaaatttcgcgaactggctcagcatgatccggatatcttgtatgccctgagcggtcagatcgcgcaacgcctgcgtgataccacgcgcaaggtcggcgacctggcgttcttcgatgtcaccggtcgcgtagcgcgctgcctgctggagttgtgcaaacagcccgacgccatgacccatcccgacggcatgcagatcaaggtcacgcgtcaggagatcgggcgtattgtcggctgttcacgggaaatggtcggccgtgtgctcaaggacctggaagagcgcaatctggtacatgtcaaaggcaagacgatggtggtattcggcacccgctaacccggcaggaagctggccagcatctgacggtacaacctgtcgagccgactgatcgcatccggtgcgggaaacgcttcgtgcagggcgatatggctctcggcacgcacccgctgttccaggccacaggcttgattgaagcggttgaccgcattgatcagttcttcacgatcgttatccagcaacaaggcgccgtggatcaagcccaccggacgaccgccactttggcgccaacgctgggcggtaccgaccatcttgcggccattgagattgacgttataccgaccatcgcaaaaagctccgtcgatttcgccaacggaggcatcgccgcccaactcgagcagaaaatcgcagatcggctggcacaagcgctggtaaccggtttcgatgcggccttggtcgccctcactgcgcggcggcgcatacaccaaggcgatattgaccgtggcagcggactgcggcacgggttcacccccagtttcccgcagcaacaccggccaaccagcatccgccgagatttggctggccaccgcaaatgccggcagccgactcaaacggcgcggcatgaccagcgcctgatcgctgggctgccagaacaacagcccgaagtcctgctcgcccgcgccaacggctgccaacagctgctgctcggcggcaaggcccgcttctacagtcatgatcacgggctgagtcatcgaacacctacctctcagattaaacacaaggcccaatgtaggagggggcttgcccccgatagcgaaccgtcagccgactgatcatcaactgaaggaatgctatcggggcaagccccctcccatattttatagcgcatttggatcagtctaatgtcgaaccgctgactgtcacgccacgctctgggaagaacaggcgttgcaattccgcccctgggttctcggcacgcatgaacgtctcgcccaccaggaacgagtagacgccgctgatttccatcagctccacgtcggcacgattgacgatgccactttcagtaatcaccaagcgatcacggggaatacgcggcaacagatccagggtattttccaggctgacttcaaacgtatgcaggttacggttgttgacccccaccagcggcgtgtcgagggttttcagtgcgcgctcaagctcgtcgccgtcatgcacttcgaccagtacgtcaagaccgacgcttttggccaccgccgccaactcggccattttcacgtcatccagtgcggagacgatcaataatacgcagtcagcgcccaaggctcgggcttcgacgatctggtaagggtcaaccatgaagtccttgcggatcaccggcaacttgcatgcagcgcgagcctgttgcaggaacaggtcggaaccctggaagtaatcaatatcggtcagcacggacaagcaagtcgccccgcccttctcatagctggcggcgatttcagccggtacaaagttttcgcgaatgacgcctttgctcggcgaggcttttttcacctcggcgatcacggccggctgcttgagcttggcctgggcgatcaaggcattggcaaaaccccgtggcgcatcggcgaccttcgcctgcgcctccagctcggccaggcttacgcgggcgcggcgctcggccacttcttcggcctttcgggccaggatcttttccagaacggtcggcacactcatccttcattctccatcttgaatacggcagtgaaggctcccagctcttcgagcttctcacgagccagaccagtgtgcagcgcatcgtgggccaaggcgacaccttccttaagactataggcgtggtcggccgcgtaaagtgccgcgccagcattcagaacaatcatctccgcggccttctgaccgttttcggtcttacggcgccccagagcatcacgaatcagttccagcgaagccgccgggctttccaccgccaagccgtgcaagctctgactcttcatacccaagtcctcaggctcgacccaatactcagtgacctcatcgttcttcagctctgcgacaaaggtcggcgccgccaggctgaattcgtccaggccatccttggaatgcaccacgagcacatgcttgctgcccagacgctgcaagacttcggccagtggccggcacaacgcctgactgaacacacccaccacctgatgcttcacaccggccggattcgtaagcgggccaagcatgttgaacagggtacgcaggccgaggtccttgcgtgggccggcagcgtgcttcatcgcgccgtgatgggactgggcaaacatgaagccaatgccaacgctgtcaatgcagcgtgctacttgtaccggcgtgaggttcaggtagatacccgccgcttccagcaaatcggcactgccgctcttgccggataccgcacggttaccatgcttggcgacggtgcagccagcggcagccaccacaaaagatgaggctgtcgacacgttgaaaatattcgcaccgtcaccgccggtgccgaccacatcgacaacgccgtcgagggtcttgagttcgaccctgtccgccagctcacgcatcaccgacaccgcaccgacgatttcatcgatgctttcgctcttcatgcgcattgccatcataaaggcgccgatctgcgcgtcggtacattgaccggtcatgatctcgcgcatcacatcgctcatttcggcagtgctcaggtccagatgaccgacgatacggttcagggcagtcttgatatccatgaaaagtccttagcgcgtgccgccgctctgcttgagaaagttggcgaacagctcgtagccctgctcggtcaggattgattcagggtgaaactgcaccccttcgatattcagtgtcttgtgacgcaggcccatgatctcatcgaccgagccgtcctccagctgggtccaggcggtcaactccaggcattcgggcaaggtttcgcgcttgaccaccagcgagtgataacgggtcaccgtcacgggcaggttcaggccatgaaacacacccagatccttatggaacaccgggctggtcttgccatgcatgacttggcgcgcccgtaccacgtcaccgccaaacgcctggccgatggactgatggcccaggcatacgcccaggatcggcagcttgccggcgaaatagctgatggcttcaagagagatgcccgcttcggtcggcgtgcaagggcctggcgaaaccacgatacgctccggattcagggcggcaatttcggcgacggtcagttcatcgttgcgcacgaccttgacctcggcaccgagctcgccaaggtactgcacaacgttgtaggtaaaggagtcgtagttatcaatcatcagcaacatgtggggttcaagcctcttgaattcactgatttcaaatgacggccttcctagagagtgacccgctgccagacgcacgttccgattgccgggggtagccggcaaggggcgtcagacaacgggtgaagaaggcaaatcgttacaggtccggccgggccggcggagaaaaatgtcaggcgcgccaacgccaacgggcgtgtgccttgactactcgcatcaagagtttgctgatgatcaacacggggagggtctcattcatacgttcaggcacagtaacgtagcctagccagcggtgcaatatggagtagtaaatacgggggggaacgtaggcgaattcggtatatccctacagaaaatgccagaagttttgctagtgtttgagttccgatacaaaaacaaccaaatggaaccttgcatgttcagaccagcatttttcgcgccccttgccagctgtctcttgtcactggcatgcgcccaggcgttcgcagcgccgtcaccgtattcaacgatggtggtttttggtgacagcttggccgatgcgggccagtttcccgatggctcgaatggctccacgctacgctttaccaaccgcacaggcccgacattccagggtgaatacggcctggtttcatcgaccctgttgggcgcgaaactgggagtagcccccaacgacttgaacgcctccacctcaccggttcgcgcagcccaggggttgccagatggcaacaactgggccgtcggtggctaccgtaccgacgatatcctcgactccattacctcggtttcagatgccgccatcccagccggcaaccctggtgcgggtacagttttgcgcagccgccagggatatctgccagccaacggcggacgtgccgaccccaatgcgctgtattttctctccggcggcggcaatgacttcctccaaggccgcgtactgagccccgaacaagccatcgccgccggcgggcgcctggctgacagcgcccaggcgctgcaacaagccggtgcgcgttacatcatggtgtggatgttgcccgaccttgggttgacaccggccatcaatggcaccccgcagcaggccgcaacctcggccctgagcactatattcaaccagtcattggtccagcgcctgtcgtacgtcgacgcccaggttatccctttgaatatcccgttgttgctgaaggaagccttcgccgatccagcgcgcttcggcctggccacggggcagaatctgaccggtacctgtttcagcggaaacagttgtaccgccaacccaacctatggcatcggcggcaccaacccggacccgaccaagctgatctacaacgactcggtccaccccacggtggcgggacaacggttgattgccgactatgcctattcactgctggcggcgccctgggagctgaccttgctgccggaaatggcccaaggcacattgcgcgcccaccaggacgagctacgcaatcaatggcaagcagacaacggcaaatggcaagccgtcggtcaatggcgtgcaatcgtggccggtggtgggcagcgtttggatttcgacgaccagagcagttcggccagtggcgacggcagcggctacaacctgaatatcggcagcagctaccggctcgatgaaaactggcgcgtaggtgttgccgctggcctgtatcgacagacgctcgaagccggcactaacgactcggactacaaactcaacagctacatgggcacggccttcgctcaataccagcaaaatcactggtggaccgatgccgccttgaccggcggcaaactggacttcgacagcctcaagcgcaagttcgccctgggcgttaacgaagcgtccgaaaaaggcgataccgaaggctggctctgggccttgagcggccggctgggctatgaccttgctgcaccgggaagcgactggcacctgtcgccgttcatcagcgccgactatgcacgcgtcgaagtgaatggttactcggaaaaaaacagtcgctccaccgcactgaccttcgatgatcaacaacgcgactccaagcgtcttggcgtcggcctgcagggcagctaccgcatcacaccgcaaacccaggtgttcggcgaagtggctcacgaacacgagttcgaaaatgacacgcagaaggtgaatatttcgctcaacagcgtgcagggaatcgacttcaagctggacgggtatacgcctcgcagcaattccgatcgcttgagccttggggtcagccataaactgactcaagagctggcgttacgggcggcgtataacctgaggaaggatgacaatttgacccagcaaggggtcaatgtcggggtgagcctggatttctgacacggactcaaggcaacgcaaaactaatgtgggagggagtaagccccctcccacacttagatctgaatcgccgttagtcctgcggggtttgctctgccagcgccacggcacggaacatcgcccggcgcttgttcagggtttcttcccattcaagagccggcaccgagtcagccacaatcccgcccccggcctgcacatgcagttcgccgtccttgatcaccgcggtacggatcgcaatcgcagtgtccatattgccgttccaggcaaaataccccacggcaccgccatagacaccacgcttgaccggctccagttcatcgatgatttccatggcgcggatcttcggcgcacccgacaacgtgcccgccggcaagatcgcccgcaacgcatccatcgccgtcaatccggctttcagttcgccggtgacgttggacacgatatgcatcacgttggaataacgctcgatgaccattttctcggtcagtttcaccgagccgatttccgagactcgcccggtatcgttgcggcccaggtcgatcagcatcaggtgttcggcgatttccttgttgtcgctgagcagatcttcttccagcgccacatccgcttcttcggtcgcgccgcgcgggcgagtaccggcgatcgggcgcacggtgatcaggttgtcttcgacacgtaccagcacttccggcgaactgcccacgacgtggaagtcaccaaaattgaagaagtacatgtagggcgtcgggttgaagcaacgcagcgcccggtacaggtcaatcggcgcagccttgaagtcgatggacatacgttgcgacggcaccacctgcatgcagtcaccggcaaggatatattccttgatggtgtcgaccgcatgctcgtagtcggcctgggtaaagctggaacggaacaccgggtcggccgccggtggacggctaaggtctaggccgcgacgcggggtgatcggccggcgcagtttttccagcagcgcttcaaggctggcctggccttgctcgaaggcggcctcttgggcagggtcggcgagaacaatcgcatgcatcttgccggcaaggttgtcgaacaccaccaccgcgtcggagaccatcagcaaaatgtccggtacacccaaagggtccggattcggacatttccccaggcgcttttccacataacgcacgcagtcgtagccgaaataccccaccaagccaccgttgaaacgcggcaggccaggaatagttggcacgttgtagcgtgccttgaaggtttcgacaaaggccagcgggtcttctacgtcatggctttcgatctcgacgccgtcatgggtgatgctcacatgatggtcgtgtacccgcaacacggtgcggcatggcaggccgatgatcgagtaacggccccacttctcgccgccctgcaccgactcgagcaggtaggaattgggctcgtcggccagtttcaggtagatcgacagtggcgtatcgaagtcggccagggtttcgcaggccaggggaatacggttatagccggcagcggccaaacgcaggaattcttcacggatcatggggtgcctcgtggcatgagggacaaacggtcaggtaggcaaacgtgccgcagcgcggcgaggatcagtcaggcgcgccaacgccagcgggccagggccttgatgactttcatccagagtttgcgagtgaccaccacgatgacgtttccagaaggggacggatcaatgtcgggcaacgttatctcagcgccagctcccaggcaaccggggattaacagtcgcaggtcgtcaatcaccagggccggcgattcttctgcaatcggccgcccatggttgtagccgtagctcagggccacgcacttgactccggcggcctttgccgccagcacatcgctgcgtgaatcgccgacaaacaacgattgggacgccgggatattggccattttcatcacgaagaacagcgcagccgggtcaggcttcttctgcggcaaggtgtcgccaccgatgatccagcggaaataacgaccgatcttcatctggtccaacaagggtgcgacaaaacgctccggcttgttggtgatcaaggccatttccacaccctgcttgctcaaccatttgagcgtgtcacgcacaccggggtagacaacggtgagctcatggccactttcataggccgcattgaacagctccagggcgtgttcggcctcgacgtcatctacgccttcgccgtcgatatggttggccagggcccggcgcaccagcatctgcaccccgttgcccacccattcacgcaccgattcgacccccgccggcttgcgtcccagcttgagcagcatctcatccaccgccgccgccaggtcgggcaccgaatcgatcaaggtaccgtccagatcgaacatcaccagccgtggcagtttgccggggaacaactgctcaaagccgctcatggacgcgccagcgccagttcggcgcgcattttgtcgatgacggcctggtagtccggggcgttgaagattgctgagccagccacgaaggtatcagcgccagcagcggcgatctcacggatgttgttgacgttaaccccaccgtcgatttccaggcggatatcgcggccggacgcatcgatcagtgcgcgggcttcgcgcagcttgttcagggtgcccgggatgaacttctgcccgccgaagcctgggttgacgctcatcagcaagaccatgtcgaccttgtccatcacgtactcaagcacgctcagtggggtggccggattgaacaccaagccggccttgcagcccccttcgtggatcagttgcagggtacggtcgacatgcaaagacgcctccgggtggaaggtgatgtaggtcgcgccggcctcaacgaagtcgccgatgatgcggtccaccggactgaccatcaggtgcgcgtcgatcggtgcggtgatgccgtacttgcgcagcgcggcgcagaccatcgggccgatggtcaggttgggcacgtagtgattgtccatgacatcgaagtgcacgaagtcggcgccggcggccaacactttgtccacttcttcacccaggcgggcgaagtcggcggagagaatcgatggagcgatgacgaagggctgcatgacgcacctttttgagctaaatcacgatggcgcgcattgtatacctcatgctttgctgcgcgcacggtgacctatctcaatggttaataagccgcccggtagattttctcgatatccgccgcgctgagctgacgcggattattgcgcatcaggcgctcgatacccgccgcctccgtggccatggacgcaatggcatcttcgggcaccccgaaacttcgcagccccgccgggatctccactgcggcacacaagcgtgccatggcctccacggcacggtcggcagcatcgttgacactcaagccggccacgttcacccccatggcctgagcaatatcttgcattcgttcaacacatgccaatttgttccaatgcatgacatagggcagcagcagcgcattgctcacaccatgggcgatattgaagcgcccacccagcggatacgccagcgcatgcacggcgccgaccccagcgttaccaaaggccatgccggccatgaggctggcggtagccatgtcgtcacgagcctgcaggttggccgggttggcgtaagccttgggcagcgcgcgggcaatcaatttgatcgcaccgatggccagggcgtcagtaatcggcgaggcattcagtgacaggtaggattcgatggcgtgcaccagagcgtccacaccactggcggcagtgacgctgcgcgggcaggtcagggtcatttgcgggctgatcagcgccacatccggcagcaggtagtcgctgacgataccttttttcagctgtgcggccttgtcggagaggatcgccacattggtcacttccgagccggtgccggccgtggtggggatggcgatcagcggcgggcccttgcgcggcacctggtcgacgccgaacaagtccgccagcgcgccgtggtagccggcataggctgccacgctcttagcaatatcaatggcactgccgccgcccacgccaataagaccgtcatgcccaccctcgcgatacgcacgcatgcagtcctcgacgatggcgatttccgggtcaggcagcacgcgatcaaaaatttcgtaggcgcgatcacccaagtgctccagggccaacgctacggtgccggacttgaccagcgcggcatcggtgacaatcagcgggttatcgacatccaagcgcgtgagctcagcggccagttgttcaatggcgcccgcgccggtcaggagtttgtgggcgatcttgaatgaggaagtactcatgtgcgcggcctcttattaatgttgggctggcacaagaatagctgcccacaggatgttgtctgccattcattggctgaatggtcagagggctcagacgacgccctatccttcaaggcaaactacaaacagccgataacgagttgaacgcgaaaaccactcctcacgccactgacaaataccgaccaacccattaggctgctggaatcacttctggccgggaattaacgatgctttttcttcaccgctcggcactgtcagcattgtgcctatcgctactattgaccagcgccccgtccgtgcaggccgccgaagcgccagcgcctgcagacgaaaaaccggttgaacgccaccccctgcccgagcgtagccaggcagaagccagcgcgctcgaacggcaggttccgccacaggaacaacaacagttacaggctggcagcgattcgtttttggcactctggaaacccgccaacagtgccgaagctgaaggtgtggtgattattgtgccaggggccggggagaacgctgactggccgcaagccatcgcccccttgcggagcaagttaccggacgctcactggggtaccctgagcctgtcgttgccggacgtgaatgtggacactctgccgccacgcgttatcgagccgcccaaggctgcggtcgataccagcagcaaggagggcagcaccgccgccaaacccgtcgaacaggccgccagcgccgaggccgaaggtactgacccggcggtggtaccgggcgcggatgaacaggacaagaccgacgccaagcgcatcttcgaccgtatcgatgccgccgtcgcctttgcccagacccagagcgcccgcagcgtggtattgctcggccatggcaccggcgcctggtgggcggcacgttacctgagcgagaaacagccctcgcaggtgcagaaattggtcatggtggccgggaagacgcccgctgcgcgtcaaccagacctgcagcaactggcgccgagcttgaaggtgcctacggcggatgtgttctatcaagatggcgcctcggaacgtaaaaacgcccaggagcgtatccaggcggctaagcgggcgaagaatgacggctacaaacaggtgtcgcttacggctttgccaggcaacagcgcagcagagcaggaacagttgtatcggcgggttcgtgggtggctgagcccgcaggccggcgccaactgatcacaaattcgaaatcaatatagaccaatgtgggagggggcttgctcccgatagcggtgtatcagtcaacatattcattggctgacagctcgcaatcgggggcaagccccctcccacattagcttgggttttcaggccaatcgcctcagcgaaaatcccgccgctcgcgaatcaacgcataggcgttatgcagctcccgggtgcgctccgtcgcctcccgtacctgcgcggggctggcaccgctgccagcgatcttgtccggatggtgacggctgagcaggcggcggtaggcgcgcttgatcactgaaggttcggtagttgccgtcacgcctagaatccgcaacgcctcctgataagccccgccacgactcgccaatggcttacgctccggcgcgtaatcgactgccagcgcctggagttgttgcggtgtccagcccagccacttgccccactggtcgatcaggtcgcgctcggcatcatccgcccggccgtccgcccaggccatgcgccaacaagcacgcaagacaccttccgccgcatggggctgggccttgagtacacgcaggtagctgcgtacacggacactgccggatttaccacggttgaatgccatgatggcgcggcgctgggccggctcgctcatgtccaacgaacgcatttcctgacgcgcctgctggatatgcccatcgacaacccgtccattactcttggccagccgccccaacagcacaaacaacaattcgtcgtggcgcaatgccggccgcccgcccaggcgttcgcgcaactgcgcccaactgtgcagctgcaggcgacgatccaatgcctgccccagcaatgcacccaacaatgcccccgggatactggcaatggcaaagccagcccccgcgccaatcagcgtccctggccacaacatcctactgccccgctgtcagcagagtttcgacctgtgccaggcgctccaacgtgccgacatcaatccaacgtcctgtcatgtgttcccccgttaccagccctttagccatggccgcccgcaacagcggggccagcttgaaggcacccgcgctgcaacccgcgaacaattgagggtctagcactgatatgccactgaaggtcaggttatcggcaccgggcgccgcatcatgaagcacaccatgatccagatggaaatcaccacccgaggcgtgatgcgccgggttgtcgaccatcaccaggtgcgccaggcccttgagcggttgcttgagccgggcgaagtcgtagtcggtccagatatcgccattgaccaccaggaacggctcatcccccagtaacggcagggcctggaaaatcccgccgccggtttccagcggttcgccctccggtgaatagcggatgcgcaggccgaactgcgcaccatcgcccaggtaactctcgatctgttgaccgagccaggcgtggttgatcacgatatcggtgaagccggccttcgccagcgcctccaggtgatattcgatcaggcgcttgccaccggcctgcaccagcggcttgggcgtatgcagcgtgagcggacgcatccgctcgcctttgcccgccgccaggatcatggccttcatacgctcgcctcggcgggttggcgaaggctggcaagcagctcgcccagttcgctcaactcaggccggtcggcgagcacggcgtctatataagcgaagaagcgcggcacgtccgccaggtagcgtggcttaccgtcgcggtggcaaatgcgcgaaaagatgccgataaccttgaggtggcgctgcacgcccatcaggtcgctggcacgcaggaaatcttcaaagtcatcctgtacgggaatccccagctgcccggcgcgctgccaatagccacgctgccattctctcacgcgggcctggggccagctgaggaaggcgtccttgaacaggcaggtaatgtcgtaggttaccgggccgtagaccgcgtcctggaaatccagcacgccagggctgggctcgctgatcatcaggttgcgcggcatatagtcgcgatgcaccagcaccttgggctgcgccagggcactgtcgatcaactgctcgctgacacgctgccagagggcctgttgctcggcgtcaaagtcgattcccaagtgtcggcgtacgtaccactccgggaacaattccagctcgcggcgcaacaaggccacgtcatagctgggcagtggttggtccatcggcagttgttgaaacgcgagcagcgcatcgatggcatcggcaaataactgatcggcgttttcaccgtcaatcacgtccagataggtttttctgcccaggtcattgagcaaaagaaagccacggggcaaatcttctgcataaattttcggcacatttattccggatttcgccagcagatgcgcgatatcgacgaaaggtttgcagttttcctggggaggtggcgcgtccatgacaacgaacgtatggtcaccgccctcccagcggaagtaacgcctgaaactcgcgtcactgctggccgcggtcaatgtggccgggggcacgacgccccaatcctgagcgttgaataggattggcaactgctcatccagccagacttccagctgttgtaaacgtagatcttgctcgggcattacagaggtctccgacggcgctagccgtcaagcggggcatgctttattatcacgcatctttttcagaccatcgagaggcgtgcggcccaaaccgcgggcagatggcacgcaggaagcccggactaataagatggcattgaaatcccccgcgtttcgtagaaaatttccgttgctggtaaccggcagtctgctggccatgcaacctttcgccacttcacacgtggtcgccgctgagcagtatgactgctcggtctctgcttcgggtgcctgggattgtgcgccgaagaccgccgccgccccgctgccgccgcgtccggtgcatgacggttccgccgtcagctcggccaacggtacgccgcaaggcgaagccggcggcaaggtcgacgccgagccgaagaccatgctggtcaccgaagccaagggccgtggcctgcgttcgcgcagcgccgactacagccacttggactgggtgcctcgcgagaagctgaccgcagcacagctggccgaaaccggtccttactgcagtggtgcctacatcgagcctgttcgtcctggcatgaacgacaagacgaacaagagcgacgcgccgaccttcatcggtgccaaggcctctcgttacgagcaggagcagcaggttgcgaccctggccggtgacgtggtcatgcgccagggcagcatgcagctggagtcggacgaagccagcctgtaccaggccgagaaccgtggcgagctgaacggcaaggtgcgtttgcgcgacaacggtgcgctgattgtcggcgaccatgcagaagtgcagctggacaccggtgccgcccagatcgacaacgccgaatacgtgatgcacaagtcacgcatccgcggtaacgcgctgtacgccaagcgtgcagagaacgcgatcatccgtctcaaggacggtacgtacaccacctgcgagccagacagcaacgcctggcagctcaagggcaacaacatcacgttgaacccggccaccggtttcggtacagccaccaacgcgacgttgcgggtcaagaacatcccgatcctgtacaccccttacatctacttcccgatcgacgaccgtcgtcaatccggcttcctgccgccgagcttcagcaccggtggcgagacgggcttcaccctggtgacgccgtactacttcaacctggcgccgaactatgacgctacgttgtacccgcaatacatgaccaagcgcggcttgttgatggaaggcgaattccgctacctgaccaagtcgagtgaagggcagtttggtggggcgtatctgaacgacgacaacgacgagcgcaagaaccagaccgattacgaaaaaacccgctatatgctcaactggcagcataagggtgggttggattcacgtctgacttcccaggtggattacaccaggatcagcgacccttactacttccaggatttgaagtcgtatgaggaaggggttgagagccaggacgctctgaaccaacagggctccctgacatatcggggcgactcttatcaggcccgcttgaatgtgcaggcctatcagctggcgacaatcactcagatcaccccatatgaccgcctgccccagctcaccttaaatggccaactgccatttcatccgggcggcctggatttcagctatgaaaccgaagccgtacgttttgatcgggatctggagaacggtaactttaccgacgaaaatggcctggtgtcgcgtcgactcgataccaacgttactggcctgacccgtgcaaacggtacgcgcctgaacctcgcgccagctgtttcgtatccgatgaactggtcctacggctttttgacgccgaagttgaagtacgtttataccaagtacgatttggaccttgacggtacaggcaagagccaaatggctgctggaggtcaaaccttcaatagctcgcaggatcgctcagtacctatcgcaagtatcgacagcggcctgtacttcgaccgcacgaccaattggttcggcaaagactataaccagaccctcgaacctcgcgcgttctacctctacgtgccgaataaagaccaaaccgagatccctgttttcgacacgagcgaaaactcgttcagctactcctcactgttccgagataatcgcttcagcggctccgaccgcatcggcgacgagaacaagctgtcctttggccttaccagccgttggatcgaagagaatggtttcgaacgtcaacgcgcgtccatcggccaagcggtgtacttcaaggaccgtgaagttcaattgccaggcatcgatgccaagacgcgtgatgatgcgcattcgaacgtctcaccagttgctctggaatacgaattccgtttcaaccgcgactggcgcgctacggccgactacaactgggataccgaaagccatagccctcgttccggtagtgcaatgttccactaccagccggaagacaacccgaacaaggtcgtcaacctcggctaccgctatcgtaatgaccaggtcgtctacaaccaactgaccggtaaatggcagttcggcggcgacttcggcagcccaggtcaagagaattacgtgaaggattactacaaaatccagcaacacgacttctcgatgatgtggccgatcgttccgcagtggaacctgatcacccgttggcagtatgactatgcccgcaaccgcacgctggaagccttcggtggcttcgaatacgacaactgctgctggaagcttcgtgtcatcaaccgttactgggtttccaacgacgaatacacgcagatcgccccgcagaacgaaaagggtgaccacgggctcttcctccagatcgtccttaaaggactcggtggcctgaccggcgccaaggtagagagcttcctcgacaaaggcattgaaggttatcgtgaacgtgaagacaaagctttctgagtgtttgcgcccgctagtgctgggcgcgctgttcctgggtactgttacggcacacgccgcggtccaacagctggataaagtagcggccatcgtcgataacgacgtgatcatgcagagccagttggaccaacgggtcaaggaagtacagcaaaccatcgccaagcgtggcggtggcgtgccgccgaccagtgtcctggaaccccaggtactggagcgtctgatcgtcgaaaacctgcaactgcagatcggcgaacgctccggtatccgaatctcggatgaagaactgaaccaggccgtcggcaccatcgctcaacgcaacaacatgagcatcgatcagttccgcgccgccctggctcacgacgggttgtcctatgaggacgcccgtgagcagatcaagcgcgagatgatcatcagccgtgtgcgccagcgccgcgtggccgaacgagtccaggtgtccgaacaggaagtgaagaacttcctggcctcggaccttggcaagatgcagctctccgaagaactgcacctggccaatatcctgatcccgacgccagacagcgccagcgccgagcaactcaacgccgcagccgccaagactcaagcggtatacgaccgcctgaaggccggcgctgactttgcccagaccgcgattgccgtctccggcagcgataacgccctggacggcggtgacatgggctggcgtaaagccgcgcaactgccacctccgttcgaccgtgaactgagcgccatgaacgtgggtgacatcacccagccagcacgtacgccaggcggtttcattatcctcaagctgctgggcaagcgcggcggcgagacctcgctgaaagacgaagtacacgttcgtcatatcctggtcaaaccgagcgagatccgcaccgaggcacaaaccaaggagctggcgcagaagatctacgaccgcatcgaaagcggcgaagacttcgccaccctggccaaaagcttctcggaagacccaggttctgccctcaacggcggcgacttgaactggatcgacccaaaagccctcgtgccggagttccaacaggtcatggccgataccccgcaaggcgtgttgtccaaacctttcaagacccaatacggctggcatgtactggaagtccttggccgtcgcgccacggacaacaccaaccaggcccgcgagcagcaagccctgaccgtactgcgtaaccgcaaatacgacgaagagctgcaaacctggctgcgtcagatccgtgacgaggcttatgtagaaaacaagctgccaggcgccgagcaaacaggcaccgaccaggccacccagtgaaaccccagcgtttcgcggtgacacccggcgagccggccggcattggtccagatctttgcctgctgcttgcctcgcaactccagccacaccccctgattgccatcaccagtcgcgacctgctcctcgagcgggccgcgcaactgggtgtggctgtcaacctgttgggcgtggcgccgggcaactggcctgacctgccggcgcccgcaggcagcctgtatgtgtgggataccccgctgcacgccaaggttgttgccgggcaactggacaaggccaatgcggcgtttgtgctggaaaccctgacccgtgcgggccaaggctgtatcgacggtgacttcgccggcatgatcaccgctccggtacacaaaggcgtgattaacgaatccggcatcgccttctccggccataccgaattcctcgccgagctgacccacaccgctcaagtagtcatgatgctcgccacccacggcctgcgcgtcgccttggtgacgactcatctgccgctgcgtgaaatcgccgacgccataaccgccgagcgcctcgagcgtgtcacgcgcatcctgcacgccgacctgcaacagaaattcggcattgcccaaccgcgtatcctggtctgcgggctcaacccccacgccggtgaaggcggtcacttgggccatgaagaaatcgacatcattgaaccgacattagagcgcctgcgccaagaaggcatggacctgcgcggtccattgcccgcagacactctgtttacccccaaatatctggagcactgcgacgcagtgctggcgatgtaccatgaccaggggctgcccgtgctgaaatacaaaggcttcggcgccgcagtcaacgtgacgctgggcctgccgatcatccgcacctccgtcgaccatggcaccgccctggacctggcgggcagcggcaaaatcgataccggcagcctgcacgtggccctggaaaccgcctatcagatggccgagacccgtatatgactgagcattaccaacaccgggcgcgcaagcgcttcgggcagaacttcctgcacgacgctggcgtgatcgaccgcatcctgcgctccatccatgccaaacccgaggaccgcctgctggaaatcggcccgggccagggcgcgctgacccagggcctgctggccagtggtgggcaattggacgtggtagagctggacaaggacctgatcccgatcctcaaccagcaatttgccggcaagcccaacttcaacctgcaccagggcgacgcactgaagttcgacttcaacagcctcaacgccgcgcccaatagcctgcgggtagtgggtaacctgccgtacaacatctccacaccgctgattttccacctgctgaacaacgccgggatcatccgcgacatgcacttcatgctgcaaaaagaagtggtggaacgtctggctgccgggcctggcggcggcgattggggccggttgtcgatcatggtccagtaccattgccgtgtggagcacctgttcaatgtgggccctggcgcgttcaacccgccgccgaaggtcgattcggccatcgtgcgcctggtgcctcacgccgtgctgccgcacccggccaaggaccataaattgctggaacgcgtggtacgcgaagcgttcaaccaacgtcgcaagaccctacgcaataccctcaaggctctgctgagcaccgctgaaatcgaggccgccggcgtcgatggcagcctgcgccccgagcagttggacctggccgcatttgtacgcctggccgaccagctggctatccagcctgctccgacggcggaataagacaaaaggacaacatgatccaaatgtgggagggggcttgctcccgatagaggagtatcagtggatacattttcaactgacacaccgctatcgggagcaagccccctcccacattctggatcacgtcatcccagacggcatgtctggcctagtgcccacctgatggcctagactgagccgcatctgctgtcctccgcttttaaggcctcttgcatgtccgatcctcgctaccagatcgacgtcagcgtcgtcacccgcttcctggcggaccaatcgcaacctgaacataaccgtttcgcctttgcctacaccgtcacagtgaaaaacaacgggctggtaccggccaagctgctgtcacggcactgggtgatcactgacggtgatggccaggtcgaggaagtgcgcggcgccggcgtggtgggccagcaacccttgatcgacagcggtgccagccatacctatagcagtggcacggtgatgacctccaaagtcggcaccatgcaaggctcgtatcaaatgaaggccaccgacggccacttgttcgacgccaccatcaagcccttccgcctcgcggtgcccggagccctgcactgatggcgacgtacgcggtgggtgatctgcaagggtgcctggagccactcaagtgcctgctggagcgcgtagccttcgacccggctgaggatcgcctgtggctggtgggggatttagtcaaccgtggccctcagtccctggaaaccctgcgctatctctataacctgcgtgattccctggtgtgcgtactgggcaaccacgacctgcacctgctggccgctggcaataatatcgagcgtctgaaaaagggcgataccttgcgggaaatccttgatgcgtccgatcgcgtcgagctgctcgactggctgcgtcgccaaaaaatcatgcattacgacgaaggccgcaacatcgccctggtccatgcgggtataccgccccaatggacgttgaagaaagccctcaagtgcgccgccgaagtcgaaagcgcactggctgacgacaacctgtatacggcgtacctcgacggcatgtacggcaatgacccggtgaagtgggacaacgacctcaccggcgtgacccgcctgcgtgtgatcaccaactacttcacgcgcatgcgtttctgcaccgccgagggtaagctggatctcaagagcaaggaaggcgccgacactgcgctgccgggttataagccctggtttgcccacccggaacgcaagacccgtgacactcggatcatcttcggtcactgggccgccctggaaggcaagtgcgacgagcccggcgtgttcgcccttgacaccggttgtgtgtggggcggcgccatgaccctgatgaacatcgacaccggcgagcgtcatgactgccagtgccaagccccccttcccattacccagccggccaccgccaagccttaggagcccgccatgagcgaattcaaacgtatccctcccgaacaagcccaggccttgcgcgagcaaggtgcagtggtggttgatatccgtgaccagccgacttacgcagccgcccacatcagcggcgcccggcacctggataacgtcaatatcgccgacttcatccgcgccgccgaccttgatgcgcccctgatcgtagcctgctaccacggcaattccagccaaagcgcggccgcctacctggtcagccagggcttctccgacgtctacagcctggacggcggctttgagctgtggcgtgcgacttacccttcggaaatttcctcaggcgattcgcaataatttttttcacaccccgctaccccgcgtgacgcttgggcttgcgccgtttctgacgaacggcgcagccaaactaattgcgcatcccccctttacctcccggattccgaactatccttaagcgcaggccatccgaatcaggggagagccggtacaccggcgtacgggtcatcggtagcgtttcagggtgttctggggggaaaacagccattggcgtccgtcaatgactgccagcatcgactgattgatccgacgtcggctccacgtatcgagcgaggtgacgacgtcatgagtattttcagccacttccaacaacgcttcgcgtccacgcagcaggaggaactcacccttcaagagtatctcgagctgtgcaagcaggaccgcagcacctacgcatctgcggccgagcgcctgctactggcgatcggtgagccggagttggtggaaaccgccaacaattcgcggctgtcgcgaatattctccaacaaggtgatccgccgctatccggcctttgaagacttccatggcatggaggaatgcatcgatcagatcgtttcctacttccgccatgctgcccaagggcttgaggagaagaagcagatcctctatctgctcggccccgtcggtggcggtaagtcgtccttggccgaaaaactcaagcaattgatcgagaaggtgcctttctacgcgatcaagggctcgccggtcttcgagtcgcccctgggcctgttcaacgccacggaagatggcgcgatccttgaagaagacttcggtatccctcgacgctatctcaataccatcatgtcgccgtgggctaccaagcgcctggccgagtttggtggagatatcagccagttccgcgtagtaaaactctacccgtcgatcctcaaccagatcggggtcgccaagaccgaaccgggcgacgagaacaaccaggatatttcggcgctggtgggcaaggtcgatatccgcaagcttgaagaattcccgcagaacgacgccgacgcctacagctactcaggcgcgctgtgccgggccaaccaaggcctgatggagtttgtggagatgttcaaggcaccgatcaaggtgctccacccactgctcaccgcgacccaggaaggcaattacaacagtaccgaaggcctgggggccattcccttcaccgggattctgctggcccactccaacgaatcggaatggcacactttccgcaacaacaagaacaacgaggccttcatcgaccggatctacatcgtcaaggtgccgtattgcctgcgggtcagcgatgaaatcaagatctacgacaaactactgttcaacagctccctggccaaggcccattgcgcgcccgataccctgaagatgctcgcccagttcaccgtgctgtcgcgcctcaaggagccggagaactcgaatatctattcgaagatgcgcgtatacgacggcgaaaacctcaaggacaccgatcccaaggccaagtcgatccaggagtaccgcgataccgccggcgtggacgagggtatgaacggcctgtcgacccgctttgcgttcaagatcctgtccaaggtcttcaacttcgacccgcatgagattgccgccaacccggtgcacctgctctatgtactggaacagcagattgaacaggaacagttccaggccgaaacccgcgaacgctatctccgattcctcaaggaatacctggcaccgcgctacatcgagtttatcggcaaggaaatccagaccgcgtacctggagtcctacagcgagtacggccagaacatcttcgaccgctacgtgctgtacgcagatttctggattcaggaccaggagtaccgcgatccggaaaccggcgaaatcctcaatcgcgtggccctcaacgaggagctggaaaaaatcgagaaaccagccggcatcagcaatccgaaggatttccgcaacgaaatcgtcaacttcgtactgcgcgcccgggccaataacaacggcaagaaccccacctggctcagctacgagaagctgcgggtggttatcgagaagaaaatgttctccaacaccgaagacctactgccggtcatcagcttcaacgccaaggccagcaaggaggaccaacaaaaacacaacgacttcgttactcgaatggtcgagcgaggctacaccgacaaacaggtacggctgctctccgagtggtatctgcgggtgcgcaaatcgcagtaaggcagcgacaagtgtgcactgccaggccgttggcctggcagccgaccgcttgtcccgaagcttccagctagcagcttgaagcttgtaacgtgaagctgcccggagggctccctatgagctatgtgatcgaccgacgcctcaatggcaagaacaagagcacggtaaaccgccagcgtttcctgcggcgctaccgtgaccacatcaaaaaggccgtcgaagaagccgtcagccgccgctccatcactgacatggagcacggcgaacaaatcagtatcccggggcgggacattgacgagccggtgcttcaccacggccgcggcggcaaacagaccgtcgtgcaccccggcaacaaggaattcaccaccggcgaacacatccagcgcccacaaggtggcggtggcggtaaaggtccgggcaaggccggcaactccggggaaggcatggatgaattcgtattccagatcacccaggaagaattcctcgagttcatgttcgaggatctggaactgccaaacctggtcaagcgcaacctgaccgggaccgacaccttcaagaccgtgcgcgccgggatcagcaacgagggtaatccatcgcgcatcaatatcatccgcaccttgcgttcagcccatgcacggcgcatcgccttgtccggcagcagccgcgccaaactgaaacaggccaaggaggagttggcgcgcttgaagcgtgaagaaccggataacttcggcgatatccaggaaatcgaggcagaaatagagaaactcagcgcacgcatccaccgcgtaccgttcctcgatacctttgatttgaaatacaacctgttggtcaaacaacccaacccaagctccaaagcggtgatgttctgcctgatggacgtgtccggctccatgacccaggcgaccaaggatattgccaagcgcttctttatcctgctgtacctgttcctgaaacgaaattacgacaaaatcgacgttgtgttcattcgccatcacaccagcgcccgggaagtggatgaagaagagttcttttactcgcgggaaaccggcggcaccatcgtttccagtgcactgaagctgatgcaggagatcatggccgagcgctaccctgccaacgactggaacatttatgccgcccaagcttccgacggcgacaactggaacgacgactcgccgatctgccgtgacatcctgatcaaccagatcatgccgtttgtgcagtactacacctatgtcgaaatcaccccccgtgagcaccaggccctgtggttcgagtacgagcgcatcggcgaagcctttgccgatacgttcgcccagcagcaactggtctcggccggcgatatctacccggtcttccgtgaactcttccagcgcaggttagtgacatgaccgccaaaaaagagaacaagcgtcaacccatttccaccggttccgagtggacctttgaattgatccaggcctatgaccgggaaatcagccgtattgcggcgggttatgccctggatacttaccccaaccagattgaggtcatcaccgccgagcaaatgatggatgcctatgcctccgtgggcatgccgttgggttaccaccattggtcctatggcaaacacttcctcagtaccgagaagtcgtacacgcgaggacagatgggcctggcctacgagatcgtgatcaattccgacccgtgcatcgcctatctgatggaagaaaacactatctgcatgcaggcgctggtggtggctcatgcctgctatggacacaacagttttttcaagggcaactatctgtttcgcacctggaccgacgccagctcgatcatcgattacctggtgtttgccaagcagtacatcatgcagtgtgaggaacgccacggtatcgatgcggtggaagaccttctggactcctgccatgccctgatgaattacggggtcgaccgctacaaacgcccctaccccatttccgccgaagaggaacgcctgcgccaaaaggagcgtgaggagcacctgcagaaacagatcaacgacctatggcgcacaatccccaaacgtgccggcaaaaacaacgacaaggacaatgcgcgcttccccgtcgaaccccaggaaaacatcctctatttcctggaaaaacatgctccgctgctagagccttggcaacgggaaattgtgcgcatcgtacgcaagattgcccagtacttttatccacagcgccagacccaggtgatgaacgaaggctgggcgactttctggcattacacgctgatgaacgatctgtacgacgaaggcttggtcactgacggcttcatgatggagtttcttacctcccacaccagcgtggtgttccaacccggcttcgacagcccgtattacaacggtatcaacccctatgccctgggctttgccatgtaccgcgacatccgccgcatgtgcgaacaccccacggaagaagatcgccgctggttcccggagatcgctggcagcgactggttgtcgaccatcaagttcgccatgagcagtttcaaggatgagagttttatcctgcaatacctgtcacctcaggtgattcgcgacctcaagctgttcagcatcctcgatgacgacctcaaggacgacctggtggtcccagccatccacgacgaaccggggtaccgcatcattcgcgaaaccctggccgcccagtacaacctgggcaatcgcgagcctaacgtgcagatctatagcatcgatgtgcgcggcgaccgttcgctgaccctgcgtcaccagcagcatgatcgcaagcctttgggcgaatccaccgaggaagtgctcaagcacctgcatcgactgtgggggttcgacatccacctggaaacgctacagggcgatcaggtcatgaaaacccatcatgtaccgccacgcagcgatcacaacgacaatgactacggccgcctggacatggccgtcgttcatctctgaagcagcaaagcctccactggccaggcacaggcgttatcctgtggcgctaatggaggctttttcatgaaaatctacaaagtcggcggcgccgtgcgtgatcgccttctgggcatcaaggtcaccgatatcgaccgcgtcgtcgtcggcacaaccaccgaggaaatgctcgccaaaggctataagccggtgggcgccgacttcccggtatttctcgatccgaaaaatggtgatgaatacgcccttgcccgcaccgaacgcaagagcggcaggggttacggtggctttgtgtttcacgcaagccccgaggtcaccctggaagaagacttgatccgtcgtgacctgaccatcaacgccatggcggaagatgacgatggcaatctgaccgacccttatcacggccaacgcgatcttgaagcgcgtattttgcgtcatgtttcccccgcgttcgccgaagatccgctccgcgtgctgcgcgttgcccgctttgccgcgcgttatgcacaccttggcttcaaggtcgcacccgagacactcgagctgatgcgtcaactcagtgattgcggcgaactcgaggcccttacccccgaacgcagctggaaagaaatctcacgggcgctgatggaggatcaccctcaggtatttatccagatactgcgcgactgcgacgcactgaaaaccctgatgccggaggtaaacgcgctgttcggtgtgccccaacccgaggctcatcatccggaaatcgataccggcattcacactttgagcgtgctggaacaagccgctttgcacagacaaccgctgacagtgcgctgggcctgcctgctgcacgatttgggcaaaggcctgacgcctgtggataagttgccgcagcatattgcccacgaacaccgcggcttaaggctgatcaaggcggtgaatgagcgcttcaaggtgcccagggattgccaggaactggcattgctggtgggcgaatttcatacccacggccatcgcgcactggaactcaaagcctcgacattgctggaattactgcagagttttgacctgtaccggcggccgcaacgcttcgaagagtttctagtagcctgcgaaatggatgcccggggccgcaaaggctttgaacaacgcagttatccacaggcagattatttgcgcggcgcggcaaaggccgcacgcgaagtaccggttgcaccattgctggaaaaaggtttcaaaggcccagagctgggagcggcactcaagcgcgaacggctgaacgcgctgaaagcctacaaggaacaacacaagcctttgtaggaacgagcttgctcgcgaaaaacgtcaatgataaggcagcgccctcaggttttttgcgagcaagctcggctcctacaagagagcttgcggcgtcagttgtcggccttgccactcaaagccgacaggcgccagcacctggtcgatctgcgcatcgcgccacagctcggccattgtcttgcctgcctcagggtgcatacgatccggcgccatcatcgacagcggccacaatacaaaagcgtttttcaggatttctgcccgtggcaggatcaatccatcgaaattacccaccaaatcgccatacagcaacacgtcgatatccagcggcaggcccttgcggttgggcgcataacggccattatcggcctcgatgagtttcagtcggcgatccaaccccaacaacggcaggtcggtataggccgataccaccaagttgaaaaatggcccgctcttgatccccaccggctggctttcgaacaccgctgaacagcgcatatccgtcaagaaccccgccagcgcatccaggccggcgcatagacggctttcgcgctcaacattgctgccaagcccaaggtaaatctgagtcaacgacatccgcgctcgatctccacgcccacgcccttggcagccggcacggcgcctggcttggtcaatttgaggtgcagccagggaatctggaattcgctcatcagcacctcggccaagcgctcggcgaaggtttccaccaactgatactgggactgctcggcaaaagcctggatacgcgcggacacgctggcgtaatccagcgccagcgccaggtcatcacctgcagcggccgggcgattatcccaggcgaagctcaggtccaggcgcaagcactgccggatcccgcgctcccagtcgtaggccccaatcacggtgtcgacttccaggccttcgataaacactctgtccaagtactcttctccgcagcacgacaagggcgcgatgccccgttagaatcagggcatcctcgcccggaatagttagcatgttttggtcactggcgattctcgcctacctgctcggctcgctgtccttcgccattttgctcagccgcctgacgggaaaccccgacccgcgaatgagtggctcaggcaatgccggcgccaccaatatgttgcgcctggccggcaagaaacttgccgtcctgacgttgctgggcgacgtgtgcaagggcttgctgcccgtgctgatcgccagcctcctcggccttaccttgcaacagcaagcctgggtgggcgtgtgcgccgtcctgggccacctgttcccgctgtacttccgttttcgcggcggtaaaggcgttgccacagcggccggtatgctgctgggcatctacccaccggccgcgttactggccatgctcgcctggctgctgacgttctacctgacccgaaccagctcgctggccgcgctgatcgccaccccgctgaccctgccgctgttggcctggcaggaaccgcaggccttgctgccgatgagcatgctgaccctgctgatcgtctggcgtcaccgcggcaatctacgcgacctgtttgccgggcgcgaacggcatttttaaatccgcccttgcgtcggctcttacaacggcggcaactgttccattggccaacgtgcctgcacgctgatcgccaggctttcgtgctgtccggcctgcaagcgctggcaaccggcataggcgatcatcgcgccgttatcagtgcagaactcagggcgtgcgtagaacacatgaccattcatgtcgccgagcattttctccaaggacaggcgcagtgccttgttggcactgacgccgccagcaatcaccagccgcttcatacccgcctgcttcagggcgcgcttgcacttgatggtcaaagtctccaccacggcctgctggaacgccagagcgatgtcgcaacgggcttgttgaccgtcgtccccggcactgacgctctgctgccaggtgttcaaggcggaggttttcaaaccgctgaaactgaacatcaggccagggcgatcacacatcggacgcgggaaggtgtagcgcccggccacgcctttctcggcaagacgggcgatttccgggccacctggataattgagccccatcatcttcgcagttttatcgaaagcttcgccggcggcgtcgtccagggactcacccagcaaggtgtattggccgataccatcgacctgaaccagctgcgtatggccgcccgaaaccaacaaagcgacgaacgggaactgcggtggtgtttcttccagcatgggcgccagtaaatggccttccatatggtgcacgccaagagccggaatgccccaggcaaaagccagcgcctgggcgcaagaggccccaaccagcagggctccaaccaatccagggcccgcagtgtaggcgatggcatcgatctcggtcgccacacaatcggcctcgtccagcacctggcgaatcaacggcagcatgcgcttgacgtgatcacggctggcaagctccggcaccacgccaccataggcgcggtgcaggtcgatctgactgaacagcgcgtcggccaaaagcccgcgttcactgtcgtatagggcgacgccggtttcgtcgcaggaggtttcaagtcccagtactagcatgggtttgcgccttgtagaggctgaattcgaaggcgcgcatgatagtccccgctccccctcccgactagcggttttcgatcagaggctttgcattccgggcaatgaggggttaacatccgcaacccttaaaaaccgacgacctcagccgcgaattttttgcgacgagaacgttgattcccggtaatgaaagaaggtagctctggatgccagccgtcaaagtaaaagagaacgaacccttcgacgtagctctgcgtcgtttcaagcgctcctgcgaaaaagccggtgttctggctgaagttcgtagccgcgaattttatgagaagccaacttctgagcgtaagcgtaaagcagcagccgctgttaagcgtcacgccaagaaagttcagcgcgaacagcgccgcgccgttcgtctgtactaatacacagacgttcgtagcaagcttctgccaagcccggccctcagccgggctgttggcatttgcggatatcgcttgatgcttcaccgtcgacgccgcacatgcgaccgagacactgcttcaaacgtcagggctggctcttttgccagcggtgcacgtctcttctgacgagcctaacaaggctactgacgagcacacctattcttcaagcaggcgatcaactgtgtcggctgtgcccatcgatgcgcttccgaggccttcatcggccaagaccggacgcccgggcaacatttccatgccgaagactgatcagaaactaccgtcagtgaatgctcggcagatacactttcctgacaacccaagcagacgatgatgatcgagcactcgatacgtgcgcttgaacacttcacgggccctcatttacacgcagtgatgacgagaacgccatggccgggctgattccccagagctttattgacgaccttctgaaccgcaccgacatcgtcgatgttgtcagctcacgcgtacaactgaaaaaagccggcaagaactacaccgcctgctgcccgttccataaagaaaaaaccccatcgttcagcgtcagccccgacaagcagttctattactgcttcggttgcggcgccggtggcaatgccctcggcttcctgatggaccacgacaacctggacttcccccaggccgtcgaggatctggccaaagccgccggcatggaaatcccccgcgaagaaagcggccgcccgcacaaacccaggcagcccaccgactcgccgctctatccgctgttgacggccgctgctgatttttatcgtcaagcgctcaagagccatccgcagcgcaaggccgccgtcgattacctcaagagccgtggccttaccggtgaaatcgcccgcgacttcggcctcgggttcgccccgccgggctgggacaatctatacaagcacctgagcagcgataccctccagcaaaaagccatgatcgatgccggcttgttggtggagaacgccgagaccggcaagcgctacgatcgttttcgcgaccgagtgatgtttccgatccgcgacagccgtggccgtatcatcgcctttggtggccgtgtactcggggacgacaagcccaagtacctgaactccccggagactccggtgttccacaagggccaggaactctacggcctgttcgaagcgcgcaagaacaaccgcaacctcgacgagatcatcgtggttgaaggctacatggacgtaatcgccctggcccagcaaggcctgcgcaatgcagtggcaaccctcggcaccgccaccagcgaagaacacttgaagcgcctgtttcgcgtggtgcccagcgtgctgttctgcttcgacggcgaccaggccggccgcaacgctgcctggcgagcactagaggccacgctgtcgagcctgcaggacgggcgccgtgcacgcttcctgttcctgcccgaaggcgaggacccggacacactggtgcgctcggaaggcactgacgcgtttcgtgcgcgcatcaatcaacatgcgcagcccctggcagattattttttccagcaactgaccgaagaggctgacccgcgctccctcgagggcaaggcccatatggccaccctcgccgcaccgctgatcgacaaggtcccgggcgccaacttgcgcaccctgatgcgccagcgcctgctggagatcaccggtttgagcggcgaagccgtaagtcagctggtgcacagtgcaccacaggatgcaccgccggcctacgaccccggtatggattacgacgccatgccggactatgccgacttccaccaaccccaggaggcctttgcgccccagcaggagtggacaccaaagaaacccggcgccggcggcaagaaatgggacaagaagccctggagcaagaacggcaagcgcggcgatcgcgatgaagcctacgctccacgcacgccggtggcggtagaagccccgacacttattgcgctgcgtacattgattcaccacccgcaattggccggcaaggttgaaagtgccgaccattttgccaacgagagcaacacctatgcccaggtgctgattgccctgatcgaggcggtgcaaaaaaatcctaagctaaactcaattcagcttatggctcgctggcatggcacggaacagggccgtttattgaaagccctggcggaaaaggagtggctaattgacggcgataaccttgaacaacagtttttagacaccattaataggttatccgcgggtcagcatacgcagaccctcgatgagctcatcaagagagccaggcagccgggattgtcggctgaagagcaaattcagatagcaaaacagatgcgcgacctcttaaaacagaatgtttccgcatcaaacccgacctcagctggcgtgtgaggtcatagctcgggtataatcctcggcttgttttttgcccgccaagaccttcagtggatagggtgttatgtccggaaaagcgcaacagcagtctcgtatcaaagagttgatcacactaggtcgtgagcagggttacctgacttacgcggaggtcaacgaccacctgcctgaggatatttcagatccagagcaggtggaagacatcatccgcatgattaacgacatggggatcaacgtattcgaagtcgcgccagataaggactcccttatgctggccgacgctgataccgacgaggccgccgctgaggaagctgctgccgcgctggctgcagtagagaccgatatcggccgcacgacggaccctgtacgcatgtatatgcgtgaaatgggtacggtcgagctgctgactcgcgaaggcgaaatcgaaatcgccaagcgtatcgaagagggcatccgtgaagtgatgggcgcaatcgcgcacttccctggcacggttgaccacattctctccgagtacacccgcgtcaccaccgaaggtggccgcctgtccgacgtcctgagcggttatatcgacccggacgacggcattgcgccgcctgccgccgaagtgccgccgccggtcgacccgaaagcgccgaaagcggacgacgacaccgacgacgacgaggctgaagccagcagcgacgacgaagatgaagtcgaaagcggcccggaccctgttgtcgcggcccagcgttttggtgcggtttccgatcaaatggaaatcacccgcaaggctttgaagaagcacggtcgcggcaacaagcaggcaattgccgagctggtcgccctggctgagctgttcatgccgatcaagctggtgcccaagcagttcgaaggcctggttgagcgcgttcgcagtgctcttgagcgtttgcgtgcccaagaacgtgcaatcatgcagctctgtgtgcgtgatgcgcgtatgccgcgtaccgacttcctgcgccagttcccgggcaacgaagttgacgaaagctggaccgacgcactggccaagggcaaggcgaaatacgccgaagccatcggtcgcctgcagccggacatcattcgttgccagcagaagctgatcgcgttgcagaccgaaaccggtctgacgattgccgagatcaaggacatcaaccgtcgcatgtcgatcggtgaggccaaggcccgccgcgcgaagaaagagatggttgaagcgaacttgcgcctggtgatctccatcgccaagaagtacaccaaccgtggcctgcagttcctcgacctgatccaggaaggcaacatcggcctgatgaaggcggtggacaagttcgaataccgtcgcggctacaagttctcgacctatgccacctggtggatccgtcaggcgatcactcgctcgatcgccgaccaggcccgcaccatccgtatcccggtgcacatgatcgagaccatcaacaagctcaaccgtatttcccggcagatgttgcaggaaatgggtcgcgaaccgaccccggaagagctgggtgaacgcatggaaatgcctgaggataaaatccgcaaggtattgaagatcgctaaagaaccgatctccatggaaacgccgattggtgatgacgaagactcccacctgggtgacttcatcgaagactcgaccatgcagtcgccaatcgatgtcgccaccgttgagagcctcaaagaagcaacccgcgacgtgctgtccggcctcactgcccgtgaagccaaggtactgcgcatgcgtttcggcatcgacatgaataccgaccacacccttgaggaagtcggtaagcagtttgacgtgacccgcgagcggatccgtcagatcgaagccaaggcgctgcgcaagttgcgccacccgacgcgaagcgagcatctgcgctccttcctcgacgagtgataccagaacccccggcccaggccgggggttttgttttgaatagataaaattcgtcgcaacctccctcccctgaaatgcccgtctacactcgattcattccccgtgccataacgagaccgttatgcccagattgccgaccgtgttactactgtcgctgctgacctggaccgcaacggctggcgcgttgactcttacggatgatgagcgtagctggttggcggaccatcaggagctgcgcctcggtgtagatgcgtcgtggccacctttcgaataccgtgatgaaaacagccgttaccagggcctggccgctgactatgtacgcctgatccaggaccgcctgggtgtgcggatcaagctgatcgagccggccaactggaccgctgcgcttgaacaagcccggagcaaccagctcgacctgctacccggcatcatgtccaccccggagcgccaaggtttcctggccttcacacgaccctacctggactttcccattatcatccttgcccatgaaggcggcgcaaaaccacgcaacctcagggatttgtacggactgaaaattgccgtggtggaaaactacgcgccccatgagttgctgcgtacccaccatccggacctgaacctcgtcgcaatgcccaacgtcagctcgacgctgcaagcgctggccaccgacgaagtggatgcggtagtcggcgacctggcctccagtgtctggagcctgcgccaactcaaactcgatggcttgtacgtcagcggtgaaacgccctaccgctaccaattggcgatgggcgtcccgcgggatgaaaaaatactggtgggtatcctggacaaagtcctcgccgacctcagcccagccgaaaccgaagcgatccagcaacactgggtgggcagcttcacggatcaccgcacgctctgggcggacctgctgatgtacggcctgccagcggtgttgctactgagcaccgtgttggcagtggtcattcgcatcaatcgccggctcagctcggaaatctcccgtcgggtcgcccttgagcaagaactgcgtagcagtgagtaccactatcgtggcctggtggagagcttgtctgccattgcctgggaagcgagcatcagcgacttcacctacagctatgtgtcaccccatgccgaagatctgctcggctatccccgcgcccattggctgattccaggcttctggcgcaatattatccaccccgctgacctgacccacaccgaggcgtattgctaccgggaaacccgtgccaatcgcgatcatagcgtcgactatcgcgtcatcaccgctgatggccgctgcctgtgggtccgcgatatcgtcagcctgatcgaacatggccatgaaccagtgctacgcggcttgatgatcgacatcagcgaagccaagcgcaccgaagaagccctacaactgtccgagcagaagtttgcctcagtgtttcagcaatgcccggacatcctagtgattgcgcggctgtccgatggctgcctgctggaggtcaataaggcattcgaggaccagattggcctgagcgccaacgaggtcataggcaaaaccgccactgagctgaatatatgggacgttcaaggcattggcccggatttgctgcaccgggtgcagaccaccagtatccgcaacctggaaatgcaatttctgcgcagcaacggccaggcatttaccgggctgatctcagctgagcccttccaactcgacaccaccgaagcgctggtggtggtggtgcgcgacatcactcaactcaaggaaacccaacagcggctgcaaacctccgaagagaaattcgccaaggcgttccacgcctcccctgatggcttgctgctgagccgccagagcgatggactgctgattgaggtaaacgaaggtttcagccatctgaccggcttcaccagcgccacctcactggatcaatcagcttcggacctgggcatctgggtcgacctcaacgaacgtaagcacatgctggagttgatgcatcgcgacggctttgtccgcgatttcgtctgccatatccgccgcgctgacggccagattcgtctctgcgaagtgtccagccgcccgctgcccattggcgacgacgattgcatgctgaccatcgcccgggacatcaccgaacgccagttaatgcaggaaaaactgcaacaggccgccacggtgttcgaaagcaccgccgaaggcgtcttgatcaccgacacccgacagaacatcagcgccgtcaatcgcgcctttagtgagattaccggctacagcgagaccgaagccctcggccataccccacgcctgcttgcctccggcctgcatgacagcgcgttctacgcggcgatgtggcaccaactgacggcccacggtcactggcaaggcgaaatttccaaccgccgcaaaaacggcgaagtgtatccaagttggctgaccatcagcgccgtgcgtaaccacgaccagttgatcacacacttcgtggccgtgtttgctgacatctccagcctcaagctggcccaggcacgcctggactaccaggcccaccatgacccgttgaccggcctgcccaaccgcactctgtttgaaaatcgactgcaggccgccctcaacggccagcaggacagcggcaaacagggcgccgtgctgtttctcgacctggaccgcttcaaacacatcaacgacagcctcggccacccggtaggcgacctgctgctcaaagacatcgccgtacgcctcaaggagcaactgcgggacgtggacaccgtggcccgcctgggcggcgatgaattcatcatcctgcttcccggcttgcaacaggccagcgatgcccagcacctggcgaataaactgctcgattgctttacaccgccgttccaggccggagagcatgagttctttatcagcgccagtatcggcaccagcctgtatccacaggacggcaccgacgttgccaccctggtcaaaaacgccgatgccgcgatgtaccgctccaaagccaagggccgcaaccgggtcgaacactacacccgcgacctgacagcccaggccaatgaacgcgtggcgctggaacacgaactgcgtcgcgccatcgaacgtgacgaattgagcctgtgttaccaacccaagcgcagcctggtgacccaggaactgatcggcgccgaagccttgatccgctggcaccacccgaccttgggcgaagtcccgcccgaacacttcattgccctggccgaagagaacggcatgatcctgcagattggcgactgggtactggaacaggcctgccgccagctgcatgtatggcaacaggctttcgacgatttcggtccactgtcggtcaatcttgctggcgctcaactgcggcaccccaagctgctgtcacgcatcgaacagctgctgcgcgattactgcctggaacccggctgcctgcagttggagatcaccgaaaacttcatcatgagccaggccgaagaagccctgggggtgctgcatcaactcaagcgcctgggcgtccaattggctatcgacgatttcggcaccggttattcgtccctcagctacctcaagcgcctgcccctggacttcctcaagatcgatcaatccttcgtccgcggcctgcccgatgacccccacgacgtcgccatcgtgcgcgccatcatcgccctcggccacagcatgcaattcaccatcatcgccgaaggcgtggagaacaccgcacagcaggccttcctcgccgccgaagggtgtgaacagatgcaaggctacatcgtcagcctgcccctgccaccggcgctttttgccgcaaacttccttcgtacaaggcaggaggatttttcggatggcacagtgaagaaaccatcgttataatccgcgacctactgagggcctatagctcagttggttagagcagaggactcataatcctttggtccacggttcaagtccgtgtgggcccaccaactccaaagccgcgcattgcgcggctttcgcgtttctggcggagccatcgcggatacagtcctatggtccaaaggtacaaattaggtacagtgcggcttcgcttgcacgcctttggagtccttcagatggccacaatcgtcaaaacccctgccggcacctggaaggccgtcatccgcaaaaccggatggccgaccaacgccaaaaccttccgcaccaagcgcgacgccgaagactggtcacgacgcaccgaagacgaaatggtgcgcggcgtgtacatccaacgcagcggctccgagcggctgacgctcgaaaaggcgctccagcgatatctccgtgaagtgagccctaccaagaagccgactacacagcgagcagaggccaccaaggcgcagcagttgatacagcatctgggcaagtattccctcgcggcgttatcgtctgaggtgatcgctaactatcgcgacacccgcctgggctcactcaccaaccgcggcaatcccacgagtaacaataccgtgcggctggagctggctttgctaagccatctgttcacggttgcgattcaagagtgggggctcggattgacctttaacccagtgctcaatattcgtaagccgagcccaggcgaaggtcgaaacagacgtctcatggctgatgaggaaaaacgcctattggcagcagtgaacaagcacagcaaccccatgctggggtggatcgtccagattgccttggcaacgggcatgcgcgcctctgagatcgcgagcctacgtcgctcacagattgatatccaaaaacgtatagtgcggctctcagacacgaaaaacgatagcgctcgtaccgtccctctgagcaaattagctaccgaggtatttcgtaccgccctggcgaatccggtacgtcctatcgattgtgatttggtcttcttcggcgaaccaggaaaggaccaaaagcgtcgcccttatgcgttcacgaaaatctggggcacgatcaagaaaaaggctaacgtacccgatttccgcttccacgatcttcgacacgaggctgtcagcaggcttgtcgagggaggactttctgatcaagaggtttccgcgatcagcggtcataaatcgatgcagatgctcaagcgctatacgcatttacgtgccgaggatctggtgcgcaagctcgatcagtttggctgagtgcgtaattgcatggacttgaccacccatttgcatcggatttgaccagcgcactgggtggccttgaccggcaaaaaacggccagaagcggtcagtcttgaacggcagctttccgttagctcgagtccgagtcgcacgaggcagcagcaggattacagaaaaagtaagccagttagcactcggggtatggcgcgacgcgccaagacgtactgatttcgcattcccctgattgagcttttgcgtatacacggagctgcggaaggacaaggtgtactatcctccgggtatgaaacaaagcattactgaacctctgaaacttaattatcactaggcgcatcgacaatccggacattaggaggaacagtatgggatcaatctggttcgacccagaggtgctgggcgatagtttgtccgaaaccgctggatacaagtccggcctagctttgtctatcgaagaaatgtgtgaccatttggtggactctggttattcagaccttctaagggcttctgaaacccaagtagtaagacttcgatctgaagattatgacgaattattttacaagttgctccatagaattggatatacgaaagaagagtttaacggagatatcacaggtattggtctttttcataagtaccgtggtacggatcttgaatacatccatacaggcgtacaagaaattttcattgaagtctggccaaagcttatagaggctgcgattgcaagtggtactaaaacacttgatccaactcttttcattcgaacggctcataaaaaatatggcatgaaaggcgcagaactggctttagagagaatacaagttatagatgaagggatgcgattgaatccgaattcagggctgcgatacactgaatggaaaagcgtcgaagccttggaggcactttttaagggcggctcgggaaaagttgaagctggtaagtttatcgatcaacgatttgtaaattatctaatcacaaatcacgacagactttctgatatgcactggagaaaatttgaagagttgactgctgaatattttcatcagcagggtttttctgtagagcttggcccaggttcaaacgatgatggagtcgacgtccgagtatggaaaagtaaccaggatgaggaaaacgacccacctcacatgataattcaatgcaagcggcaaaaagccaaagttgaaaaagttatcgtaaaaggtttgcatgccgacatgcagcaccttaatgccgagtacggtttagttgttacaacatcggagctaagccctggagcaaaagaaactattattgctcgcgggtacgctatcaatgaagtagacaacacaggtctcaaggggtggcttaaggctttagaaaaacctggctcaggaattgtaagaatttaaaatatacaaccagcaactcagccctcttgagcggcgattatgggtcgactgatgcccttcgcggtaggcagaaatcagccaaaaagcggctactagaagctagtaaaccgcgatttatggacatagatgtcttaacccggctatcttcaaacagttcgcgctccatcctttactggcccaaccactatttggtctgtgtgcatatgcctttgattgttgattttttactgccccgtcggcctgtttcgcaccaagctaaaaactcttcaaacaaagaggcttggcgtgactttgttttcagccgagcttcgcaagaatggcgagcccgaccactggtaggatggccattgaaattcactatggtctatctttcagatgacaccgcaccaggcgacatcaataacttcgtcaagccggtacaggatgctttatgcgcctgcatctatgctgatgactccatgattcgagacgtatccgcacatatgcgctttcttaatgaaccaaatgccatacgcgatctaccgcaaaaacttgcacaagctttcatcagcggtgaagcttgcgtgtacgtggcgattcacgattcagccgagcttgccgaggtgataaaatgagtaccttagacggactgcgctctgaacgattggttgcgaaacgctacgaagagcgcggctataccgtaattattgagccgccgccatcagctataccttttttcttagaaggctatcagccagacatgttagctattaagggttcggaaaatctactcattgaagtaaaaatgcgcggtgcgcgcgttaactccgagctatatttcaaggtagatgaggaggtgcagcgtcatcctggttggcaatttctacttgtaaccattgctgaggaagagttgcaagaactcacgaaagacactacagccaaacttaatctggaaattttgcaagagcgcttacggcaatttgatcctattctggatagtgatttgcctataggatttattattcctacgctctggatggcatatatagcagctattcgacttctcgtgacagaggaaggttgtctttacgacgcagctcacgaaaaacttacagacttaagcctgattaataaagcctattcggacggtgtaacatcttatgaagaataccaatctgctaggcgctttctcaagctaaggaataatgcagtccatagcctagatgtagtagctacaaaacaggagtgtcaagagttacgacggatgattgatgaggtaatgtgcagacttaaatcttattgagtcaacggcgtatgcttttcccggtagcagtcatcaagtccgcttccgaccaattgtgccaccaccgatcgctttgggtcgattttgcccatcgtgacaggcagaagtcggccaagagcagacgttcgaacctaaggtaatgcgatgaagagaaaaacaagaatgactgcgcctctgaccagtaacgcagcaacccagcctgggtctggctggacgtttgaccctgatcgcatgatccgaatagccaattgtcattcgatcatcgaagtacttcgccacatcaaacacagtgggccggaatgggcgcatcgtaatgtccatatttgctttcccggcccatcaaatgcctgggctctggtgtacccgcttcagaatgccagtgccccgtactttgacttcatgtatacccacaaagagcctcctcaggaagcgctgtccgcactgctaaggaagtatccacagtgttccgtcatcgactggtcgcccggacgcttggcctgcatcgaagctcagggggtggatgttgagacgctcgctgaaattatccgggatctagctgaagctgcttgggatgagcacatcacgttcgtcgatgcttcgtacgaggaaatgggtaaagcgtgacccaagagcggacagtcgaccttagcttcccaagcgcgtgcgcaaagaccaggtcttgggcaacaatcgaccagacgggaacggaacgcaggtcaccataatcgaaggaatgtttgttatgagccaccttaacaacgacttgagggccgatttcgttgaggcacttgaggaaatctcgacgctgatgtccattgcatacgaccagctcggccctgtaccggaagaccatgcattagctcaggcaggtttagagaatggtggtgaaatagttctggattatgtcgatcacaacgaagctggagtagcgttcgaacacctgctttacatgattgacgaaccaccgctcgttgtttctgaaaaatgcataaaaattttagctcggatcgcaaagtccttgaagatgccattcacgaggtgacaaaaatttacccatctgaaggtcagctttgggtcgaaaggcgtctctcgttaaagacatcggaacgtcgctacgccccgtgcggaccgggtagcagcgtggagatgggaatcgcctgagtcgttgcgcgtttgataggtcatcgtcattctggaagcgacgatttttgaggagattgaagtggacattgaccgtctgttaaaaaagcggcaactgaacgtgcaagagcaaaatgctcttgtggcccacagactcatggtaaccgccaaagcttggttggcaggagggattcccctcgccttaaaaaactatggcgagtcgaaaggcattagatggtcagaaaccgtcgtactcgaccttgaagtcgactttcccggaatgccaagcctttatggtcttttgctcactcacacagagcggttcatagagtttgaaattgaaaccgatagcactcatagatgcgtggagtcggtgattcaatgggaggatgtttctgctaatcaagactatgcgccccgcaagcgtggcactggaaagggcttcgcagcaattgctctccagatgagacgcgaaattctatgcggcttgtaggtgtgaatcacagaagctgagatcccattgttgatctgaagccgctttgcgccgactgcttccagcaactggtgtcggctttgggtcgacttcagccagtcagggccacccagtgtgctggtcaaacccgatgcaaacgactggtcaagtcgaatgcaaatgtgtggtcaagtggagtgcaattaccagctgagttcccgaccttaaaaagaatgtagcagctatccggctgctgccttctattgttttccttctgttatattttgttttctttagttttcctgtgttttttagttgttaccaatttgtttttcaatacagccacactactgttggcgacaacttcccagcaaacccctatctttactgtcaccaaatttaattgatagctttctccgaacattacaaatgatacgtaaaccaacgtaactgcggagaaatatatgacttccgaacaataccttttggaccggtttggcccgttgatgagcatggctcaagtcgcaaacttgttggaccgttctgcagacggattcagagtagcgatgtacagcgactcagagctctccagaaagctgaagcctgcggttgttcgcgttgggcgtcgagtctatttccgcactctgcaagtcaaccaggcactgtctcttgataccccagctcttcaggcctgaacatgagctacaggactatagactgggtttataaccagcagctacctgcgcaagacaagctcattctcgtttatatcgctaaatgcgaaaacgaacaggagccctgttttgccagcgtaaaactgttagctgctaaatgcggtgtttcggcccgaacagtacaaaggatcttgaagaagctctgtgaagccggacttgtctcctctactccacggtttagaactgacggctcacaaaccagtaacttctacactattaacgttgagcgggatgtcacagctatgtcacccccccatgacattcaactgacagggggggatgtcagccgggtgtcaccgcccgacgccacgcagatgtcaggccttgaactaccaaataaaaccaaatcaaagccaccactaccttcggacacgtcacccaggcatctggtttatccacaagggttgacgaagcattccaaggattcagttggcaggatcctgcaaggaatccccaccgatgccgcccagacgcttctggatgaactggccggagctatggccgcaggtttcatcaaaaagggacctgaatactggctctctggggtagcgatgaaatatcgggccgggcaattcaaaccgaaccttggtttggagatagcaaaaaacagaagacctcaggcgagccttccctcaccaaacaagccgcccgcaagcgacgtgaaagtggaccgaggagtggggaacagattcctcgcccagttacgaccacagcgaacgccatgatgacgttttttaagagctctaggcctctccgcgctccgcttgggcaaccccttcggctgcaccccgcgtcctatccttgccggactggcggcaggggcaggtcctgcggcttcgcctggttcctacccctggcgctaggcttggacgcttgcagctgtatcaagggtaaaggctgcgcccatcatcctcgcccgttcggtgctcgccctgaagggctccgctccgctgcggcctccggtgatgcccttgacatatcttccagctcagacggcgctgtagagcgtacaaaatcactcaaatccagatcaccgtctacaaaagcctgagcgcgagcttcatcttcggtgcttaggctgtaacccgaaagctcggtcgatgctcgagcataatcgaccgcttcttgcctgcgcttccgctcttcgtcggtaatggtattgcgtagcttcatttgatcactccgaaacaccgacagattaataacaagacaaattcagcgcggactcagtggttcaagggcggcaccacaagccgcagcccgcgaagcgggaccgggtgaggatgccggcgaagcgaacccttgacgcgcttttcacgatgaccctattggctgggttgcgggaggcgttatccccgcagccctgccacccggcgaggggcaggaagtccagaggggcagagcccctttgggtaagcccgccagggcgcgcagggcaaacatacatgcagccagaagaagtcgatggaggacgattagccttgtccaatccttccacctttcgcatgtccccaattcttgcctaagttttgcattacgtgttgccggtaagctggattccagagggtattacccgccaccaaatgatttgtacgtccagttgtcaccatcatgccggactccatatcacgccgcgtactcggagcattcatcaaccgagcagcagttcgaataggcgaggcagcgccctgagccatcgcgcgcagcgtgactgccgcactactgatcccaccggcaagctgccctgcgactgagttcgcctcacccagcagccagaacatgacaatggtgaaggtgatcagaaccagagacgtgaacagtggattttgctcgctatccaggtcaacgctgtttatcagcgcatcgaaccctttgaatgccagccctacaacagccgccatgagggcgatacgcaatacataggtcataacctggccaaaccagctatcgaagaaacgagcagtggcaggccacatcaaagcgatgagaaagaaagggcctataccgagcatgatcgttaaccccgccttagcaataacgatcattccgccagccggaatacccagcaagccggttgctaccgcaatgatgccggcattgaaatactcaccaaatgccatgccgatttccgaccaatcacgattggccgcccgctcccaaagatcaccagcgattccccatcctcgacctaaggcgtgatctactacttgatacacggatgtggcctccccgccagaggaacccgtgccggcaaaggtcgaagtgaagcccacctccaaggaccgaatgcccccgacaatccattccatatacatgtcagcattcagcgcaaatgctgcgatcaaaatgagcttggcgcaggttttcagaaaggtggacatcggcgcttcgatatacccccagccgatcatgtaacccatgacagtcaggtaaagcgtggtgcccccaagcgcgaacagcgtaaacatcgtaatgacgttgccggcggtttggctcacgaatgcattcaatgcagtatcgagaaaagccccgatgaattgaaaaatcattggcccttccatgttcactctcccttcttgtcgaggtcgactgcacctggggtgagccatccgcgtcgggcattggctttttcgttgtcggcctgctgcgcattaacgcagttcggcgaagcggccaattcgccaggactggctttacatttggcaaccatcgcctttctttccgagtcgtgctgtttgtaccagtcgacagtttgcacgggggtgttttcgccacatccagccagtcctacggcgatcagcagagttaggaaaaaacctctcatttccgcatctcctgcttttctacatcgatcacaacacctcgactcgacccatgacgagcctcatgttgctgcgcgaaattcaaagcgtaagcaagctcagcagcatcgatgatgcggagcgtcgcgacagttcgcagggcgctttcccgagtgccagcccaatgcccagcgaagcgacttccagaatcgcgtaacgccagcgctgcaccacctaaacacccaactgaaagaaaggcggcaagcaccggtgaaaccggtccttcctggtacggcaatggaatcccgaaccaatcgaccgctgcgattacgaagggcaaaaatgcgagcgatgcaacgaggatgtcagtgtgaaccaacgcaggtgcgcgacggcccacctcccgaaggaagcccatcttgtcgatgcagatccagaaacggcgcatggctagcaagaggaaaaaacagactgccagaatgggaagctgaatgaatgaaatcatgacgcgtccccctcagttcaggttgttcgatgcattcggctgtatccaaccacgtcgggcattggcctgggcgttgagctcccgctgccgttgttgctgcaaacggtcctcagcctgcgccaccatctgaaacatctgaagcttggtttgctcgttctggattttcgcttgttcaatcgcaatccggccttgcaactccgcgatggccttcggatcttgcgtcgcattgatacgcgacatcagcccatcgatttgcgaaagccggcttttagccgcgtcgtaggcatcaagggcaaccgctttgtcttgcgacggtttgaccgcccgcgcttcacacgcccgttgcacgtcgcgggagttgatgaagctgcagctatcaaatgtcttgttggcggcatagacctgtttaccgcgaccagtcagaccggcataaccaccgtccctcacggagtcgtagacctgttgccagtctcgcggcaggtaatcacgcagagttgggttgtccatgatgctgcccattccacgcgatccggtgatcgactggtactgctgcttcatctggtcaatctgcgacgtcatctgctcgacttgctgcgcccagcgcgcagtgttggccgagaactcggccatggtcatcggcgagtcacttgcctgggtggttactgttacaggtatttgcgcgaaggctactgaaggcattgcaatgcctacagccaagaaccaagagggtaagggatttttcatattcgccactccaaaggttgggggcgaacgcaggatcgtactgttccgatctgtcggtctgtttaggaaccgcgcccggcacgctgtgcgttcttggggcgacttaggcggccattctgttcttggcggtcaggcccttcttctcaggccggcacccggtacgcgcgaggcgttcttggggtagagcaacgttcgttagaagaccaaaactattcattctggcgtgcgacattttcccattttggttaggggatgtcgatgacataaaagggctagaactcgattgttcattaatttgttgcagcgtgcctctaggggaaaatttcgtcatgacgaaaaaatgttaggaagcagaggactagtgcaggataggctaaccgccggtaaactaccccggtagtttctgattgccccgccggggcctttactcattgggggcgctagtcacgtatggtgaaagcgaaggtgccgaagtcggcccagtatctggacgtgtacttgggcgcgctcaaggagccgtggaccgattactgcaaggccctcggcaagaagcccggcgcggccatcaaagaagccatcgagcagcagttggcgaaggcctccgcgaacccacagcccaagacgcaccatcaggcagacgaagcgccccccgtcgaacccaaggtgcgctttgaaattcttctgaccgaatccgagaagcgggcaatccgtgagcgctcgaatatcgaacgatgttcgatgcgccgttggattgttgatgcctgccgcgctggtctcacgcatgagccgcagttcggcatgagtgaaatcgacgcccttggcgaatccaattaccaactgcttgctatcgggcgaaatttgaatcaaatcgcaagaaaactaaatgaaggtagccccagccctatccatgcagaattaatagagggggtacgcgagatcatcgatacgcatacgcatgatgtcagcaaagctattcgggcaagccttgaacgttggaatatcgagaaacgctaaaatgttggccagcccgggagcagtggcctgtccgaaatctgtagcttgagtgaatcattcgatcgccgagcctgctaaacgtgatgatcacgtgggacatttgggctgaaaaacagctaccatggaacctggcgggatgccatctcaagccgggctgaggcccgcgagacctatgggcggtcagtgaccggatgtcatcctctgttgtaaggaaaaccagagagccctaccctttgaagcaaatgcaatcattccgttttgtagaccttttctctggtttgggcggctttcacctagctcttgagcgactaggcggggaatgtgtgttcgcagcagagtggaaagagcatctacgggaaatctatgagattaacttcggcattcatcccgcaggagatataactaaagtctcaccaaaagacatccccgatcacgatgtgttaacagcaggattcccgtgtcaacctttttcaaaagctggtgagcaactaggttttgaatgtaccgagcaaggaaatttatttttcaatgtcgctgccatccttgctgaaaagaaacctaagttctttatcctagaaaacgtaccaaacctgctcaagcatgacgaggggaggacgtggaaagagatacaagcaatacttggaactggccaagaaggcctcggctaccacattaaagccgaacgcttttctcctcacaacttcggaatccctcagattcgagagcgcgtctatattgtaggctcccttgagcctttagacgactttacttggccagcgaaaaccgatgcaccaacctgtatcgactctgttcttgatgagcatccagctgatgcaaaaaaactttcaccacaggtgatagattgccttgaagtttgggacaaatttctcaaactttgccccgaaggggtagaacctccatggtttcctttatggtcaatggagtggggagcgacatacccttttgaagacacgaccccttatgcatgtaaacagctgagcggcattgacggcctaaaaggcttcaaaggtagtcacggttgcaaaataggctatctgccaactattgaagaacgatgggcagctctccccagccatgccagaacgaacgctttaaaattcccgaaatggaaaaaggactttattcggttgaatagacaattttattctgacaataaagagtggattgaaccgtggctcccagaaatacttaagttcccctcaagcctgcaaaagttcgaatggaacgttaaaggtggcaataggaatatctgggactacgttttacagtttcgcgcatctggcgttcgagtaaaacgtcgtactactgcccctagcctaattgctatgacagacacgcaagtgccgatcattggctggcaaaaacgctatatgactccacatgaatgcgcaagacttcaaagccttgacatgctcaaaaagctaccagagagcccaactcaagcttttaaagcgctaggcaacgcagttaactctaacgtcgttgagtctgtggctagggcgcttataagaaatacaagcatcactgaaaaagcttcaactctaaagtctattgagtcgttggtggacatactgtgaacacacaacagactccagattcaaaagatactgtaaaagtagagatacgccctgaagtcaccatgctttctgtgctccagcacttaaattacaaagcttggtttgcaatggcggagtttatagacaactcaatacaaagctttgaaacaaacaagactacactagaaaatattcacggaaaaaacctcaagctaaagataaaaataaatatcgaccaatcagaacccggccgaataaccataacggacaacgcagcgggaatcgcggaaaaagactttcctcgagcatttagaacagcgcaggtcccattagaccgtaccggattatccgaattcggaatgggcatgaaaagtgccgcttgctggtttgccaaaacatggtccgtaagaactaaggctgtaggcgaattaattgaaagaacaattaccttcgacattcaaaacatcgtagacaataaaacagaaacacttaatacagaagatcgctctgaaaaagccgaggcacactataccgttgtaaccctccggggactacatcacatacctcaaggacgtaccattggtaaaatcaaggctcatctagcaagcatttatcgggtatacctccgcaaaggtagcctagagttaaaagtcaacgatgagctccttgaatacaagtccccttctatacttaactcgcttccattcacatcatctggaactccagttaaaggccccgaagttaaaactgtgctctggagaaaagacattaactttgactttggcaagggacaacaggttaaaggatttgctgcactgcgcgaaacaggttctactccactggccggctttgcgttatttcggcggaacagattgattgagggcagccatgacgaatcgtataggccaagtcaaatattcaaacaaaccaacagctatccttatcaacggctgtttggagaactacatcttgaagggtttgatgtaagccataccaaagatggttttcgctgggaagagcacgaagacatatttctcgagtttttgaagcaagaattggaagcactcccgctaaatctcctttcgcaggccgagtcctaccgtagtaccccaacaagacacactatcgagacacaggctatagcagcaaccgcctcagttgcacaatatattgaggatcaagtagccccacatattattggcgcaaggttaaaccctaccgaacctgcagcgctccctcatgcactgcctgataatttattagaggcttcagaaaaaactgttgaggttcatgatggccggtacctctggctaataacacttaaaacttcgatcgatcctgcctgtgaagattggttatcggtagcaaagcacgaacaggaagacgacacgtctaatagaattagacggctaacccttgatatttctttggctcatcctttctcgatacagtttctcggaaccagaaacgaaaatgtcgagttatatctcaggttggctaccgccatttgcgtatcacttgtcttatctgaggatattacaggagtcgcgccagaaacctttcttttcaattttaatcaactgatgcgcggcgccttagtgcgtacaggtaccctatgacgacttccgtaaaaattttgtctaccataactcccccgcttcgctgggtacctgagctaaaagagtttacgaacgatttcctgaaggcaaaatctcaggatccgaatggaccaagctacggagatctcaccgagggcaccgactccgtacttcaggaagctcaacgaattcttggacgatgcctaccaccatctgagccgtccggacgcgaaacgggattggttgtaggttatgtacaaagtggcaaaacgatgtctttcgaaacggttatcgctctagcacgtgataatggatatggtttagttatcgttttagcagggaccaagaataacctacgggaccaatctgaagatcgtcttcgaaaagatttgggtatcgatgaaggaggtgacgactggttccatctatccaatccgacaaaagctgcacaaaatcaaattgaaagtaagattagcgcctggacaaaaaaaccgacaaaaaaggctctcttaatcactgtcctaaagcatgggggacacctcgaaaagcttgctgaggttctaaaaaaaataaatcttaagactgtccctactctgatagttgatgatgagagcgaccaagcgagcctaaataccaaagctgcaaaaattcgaggaggccaggtacccgatgtagaaaaaagcgcaacatatgaaaagatactaaatctcagagatgtgctaccacatcactcttacttgcaatatacagcgaccccgcaagccaatcttctaattgcacaaaccgacttattaaacgcctcatttgcagaaatagtcactcctggcacatcctatactggtggcaaggcgttctttctagaaaacaaaaacctcatatgcgatattccttctatcgaagtaccaacaaaaaccaatattcttagcggtccgcccaagagcttactaaaagcccttcgttttttcttactcgtttctgcacaacactctctaactagagagaaggggatgaccggcaaagaccgaaaccggtcaatgatggtacacccagcggtcaaaacatcgtcgcacaaagaatataaggcatgggtcgataaagcaaagactggaatatctgatttcgtagaaagccaatatcctaaaaaccctagcagtgttcttaaaacattttcagaggaatacgactctctagcactctctgagccgaacatgaagccgttgcctgatttgatcgccgcgatgatcgatgatgtttttgatgagctacttgttgtggaagtaaacggcaccccggatgccgaaaaaaatatcagttggaaacaaacgcgctactggatattagtaggaggagcgaaattagatcgtggctacaccgtcgaagggctgtgtattacctatatgccccggccattgggcggcactcctgcggcggatacactgcagcaacgagctcgtttttttggctacaaacgaaaatatcttggattatgcagagtatttattcaaccaagtgtacaggcggctttctccgagtatgttgaacatgaggaattcgttcgttcggcacttgtcgaacacagaggaaaaccattagcagagtggcgtcgagactttgtacttacagaactattaaaaccaactagagccaacgttattggcctaagtacaagacgaatcccggcggatggatggctagttccagatgttcttcaaagggatgaggcagcggcagagcataatcgcaaccttctctccgatgtcgtagaacaatggagttttcgttatggtccagtagttaatgcatcgaccttagccaaatttcactcagcaaagggtgatacccctcatgacgtattcgacggtattccattgcgagttatacttgaggagtttttgctgaaggttgcggtaagagatcctagggacgccgaagaacacagtgctatgctagtagcattagcgatacttttaagaaaaaacagtagcgttgtggttgacgtattccttatgaacaagcttcaaataggatatcgtatgaggaatgcggggcgtggtctaactgctgatcataaatacgcgccgataaatcagtactttagccaaagcgcggactcttttaacgacagagacttttgctctattgatcgtgtcacattgcagcttaggaaatttgacctagggacggtacaacgagatcgaacgactgcggatatccgcgaagtatcttggtttgctttgaacatccccaaaaaactgaagaaaactctgttaattgaggctagggcataagagtgctactctcaaaattctccaatttaccccaagccaagtcaactgacgactttattgcgttgcccctgtcagccagacggagagattttcttactaagggagtcgatggagaacctatttttcttctccacgactcaagtccaataaaatatgtacccggaattcagtaccgctacatcagcgccaagtttcatataacatgtaaaattcaaacaagtggagactcgctacaggatcagtttgctgtcattgcttgcgactcggaagtacctgaactctacgaactttttataaattgtttcagtgcagcgatagaatcccttccatctaaagctgttaccaaacaaattgagtcaagcatccaagacctccttgcattatttaaagacatgtctcgaccgaacaggaaagaagtctctggattatgggcagaactatttattattgaacgatccgaaagtgcctctaagatgctagcctgttggcatgacgacccttatgataggttcgatttctcctggaaaaacgtgtatttagaagttaaagccacgactaaaccaacaagaacccatgatttttcagtggatcaactgtgcgtccccgtgagtgcaagtggttacgtcgcctcattgcttatgcttcctcttagtagtgggataggagtcatggacatagcgcgaaaaattgacaattcggtaatagattatcccttgcttcggaaaaaactatggagcaatgttgccaaagcgctggggagcgatttttcagaaaagatagatcgtcgtttcgacctgggcttttcagaacaaaactttatgctttacagtatggacgatataccgacatttaaagatccaatcgatccacgcatctccagcatcaaatacaaagcaagcttagaggccacttcatcctctctacctcggccaacgcttgatttcatttcggagctactatgcgcatcctcagcgagcgaaagacaagttgactagattacctttgcagggagctgcctctgagaccataaggtgcagctgagccaggtacaatctaggtacactgatcagcttgttcaatcagagttctacttcgctaacctactgttttacaaagattaaatttagcgtacatttactttcctttacgtagatttacatagcttgatgtcttcacatggcaactcataatcctttggtcgtaggttcgagtcctactgggcccaccaaacaagaaagccgcgcattgcgcggcttttgcgtgtctggcgtagcggttctttcagccggaccaagcctgtaccatgcttgctcattgccgtccgcactggagcctccccccttgccccccctagacgaaatcgaccgccagcttatcgccgccctgcagctcaacgctcgcgaaagcgtggccatgctcgcccggcagttgggcattgcgcgtaccacggtgacgtcgcgtctggcgcgcctggagaaaacccaggtgatcaccgggtatggcgtgcgcctgggccaacgcgttgcagatgggggattgcaggcttatgtgggcattaccgtacaaccgcgctccggtaaagaagtgctgcgcaggctgagtgccatggcgcaagtacagcagttgtgcgcggtgagtggcgagttcgattatgtggcctggctgcgcaccgattcgccggagcagttggaccagttgctcgaccagatcggcactgtcgacggtgtagaaaaaaccaccacctcgatcatcctcagcaacaaactggatcgcggccaaccaatctgaccactggattcgtcatattgacaaaaatcagtgcaatccgacgacacattgcgtcttattaacgagcgcaacgctccctaaactggctgccatcttttcctatactcaacgggccatatcccgccgagccgtcagtaaggtcagccatgagcattccgtccagcaccatcagcaagaccaatcgccaccccgcagacggcaagaaacccatcaccatttttggtccggatttcccctttgcctttgatgactggatcgaacaccccgccgggctgggcagtattcccgccgcccaccatggcgccgaggtggcgatcgtgggggccggtatagcgggcctggttgcggcctacgagctgatgaagctgggcctcaagccggtggtgtatgaagcttcgaaaatgggtgggcgtttgcgctcccaggcctttgaaggcgccgagggcatcatcgccgagctgggtggcatgcgttttcccgtgtcgtccaccgcgttctaccattacgtggacaagctgggcctggagaccaaacccttccccaacccgctgaccccggcgtccggcagtaccgtgatcgatctggaaggccagacccactacgcacaaaaactttcggatttgccggcactgttccaggaagtggccgatgcctgggccgatgccctggaagccggctcgcagttcggtgatatccagcaggcgatccgcgatcgcgacgtgccgcgcctcaaggcactgtggaacaagctggtgccgctgtgggatgaccgtaccttctacgatttcgtcgccacctccaaggcctttgccaagttgtcattccatcatcgcgaagtgtttggccaggtcggcttcggcacgggtggctgggactcggacttccccaactccatgctggaaatcttccgtgtggtgatgaccaattgcgatgaccatcaacacctggtcgtcggcggcgtggcgcaagtacccatgggcatctggcgacacgtgccggagcgttgcgcccactggccggccggcaccagcctcagctcgctgcatagaggcgcaccgcgggcaggcgtgaaacgcattgcccacgccgccgacggccgtttcgccgtcaccgacaactacggcgacacccgtgaatatgccgcagtgctgaccacttgccaaagctggctgctgaccacccagatcgaatgcgacgaaaccctgttctcgcaaaaaatgtggatggccctggaccgcacgcgatacatgcagtcatcgaaaacctttgtgatggtcgaccgcccattctggaaagacaaagatccgcagaccggtcgcgacctgatgagcatgaccctcaccgaccgcctgacccgcggtacctatctgttcgataacggtgacgacaagccgggcgtgatctgcctgtcctactcgtggatgagcgatgcgctgaaaatgctgccccagcctatcgataagcgcgtcaagctggccctcgacgcgctgaataagatctacccgaaagtcgatatcaaggcgcgcatcatcggcgacccgattaccgtatcctgggaagccgacccgcatttcctcggcgcgttcaaaggcgccctgcccggtcactatcgctacaaccagcgcatgtatgcgcacttcatgcagaaggacatgcccgccgaacaacgtgggatcttcatcgccggcgatgatgtttcctggaccccggcctgggtggaaggcgcggtgcagacctcgctcaatgcggtctggggcatcatgacccacttcggtggcagcacccacccagagaacccggggccaggtgatgtgttcgatgaaatcgggccaatcgccctcgccgagtaaggagttgaccatgcgtgtcgccctgtaccaatgcccgccgctgccgctggatgtggccgccaacctccagcgtctgcaccagttggcccatgaagcgtgcgacgccgatgtgctggtgctgccggagatgtttctcagcggctataacatcggcaccgaagccgttggcgcgctggctgaggctcaggatggaccgtcggcacaggcaattgccgaactggcgcagagtgccgggctggcgattctgtacggctacccggagcgggccgaagatggccaggtctacaacgccgtgcagttgatcgacgcccagggcaagcgcttgtgcaactaccgcaagacgcacttgtttggcgacctggatcactcgatgttcagtgccggtccggatgatttcccagtggtggaattgaacgggtggaaggtaggcatgctgatctgctatgaccttgagtttccggaaaacacccggcgcctggccatggccggtgccgaactgatcctggtgcccaccgccaacatggtgccgttcgactttgtcgccgacgtcactgtgcgcgcacgagccttcgagaaccaatgtttcgttgcctacgccaattactgcgggcatgaaggcgatattcagtactgcgggcaaagcagcattgccgcgccggatggccagcgactcgcccaggccggcctggatgaagcattgattgtcggcacgctggatcgtcaatcgatcctcgacgcccgcgccgccaatcactacctgcacgaccgtcgccccgaactctacggcgcactgcacaagccctgacccggtgggtttgctagcataggcacttcccatgcctcggaagtgcccatgcctgcgccggttcaccctcaccctattcacctgaccctggccaatggcctgcgggttgccctgcgccatgcaccgcgcctgaaacgttgcgccgcggttttacaggtggctgccggcagtcatgacgtgccattggcctggccggggctggcgcattttcttgagcacctgctgtttctgggtactgagcgttttcctgcgggcgaggggctgatggcctacgtgcagcgccacggtgggcacgtcaacgccagcacccgtgagcgcaccaccgatttcttctttgaactgccggtgtcgacctttgcagatgggctggcacgcttggcggacatgttgacccatccacgcttggcacttgatgatcaacggcgcgaacgcgaagtgctggacgcggagtttatggcctggtcccaggatgccaaggctcaactgcaagtggcgttgatgaagggactggcggcggatcatccgctgcgaggttttcatgccggcaaccgcgacagcctgccggtagaaagcgacgccttccagcaagccctgcgcgacttccacgggcatttctatcaaagtgggcagatgaccttgagccttgccggcccacaatcgctggcagacctgcaagccttggcccagcagttcagtgacgaactgaccccaggccccctgcatccgcaagccgctccccccgccttgatgcagggcccagcacacagctatcaacacgttgccaatcagcacctgcaccagatcatcacctgtaacgccccacgcgaagcgctggagttcctctgcatctggctcaacgcttcggcaccaggcgggttgctcgcactgctgaaagcacgacaattggccaccgcgctgcacgcgtccgtgctgtatcactacgcgggccaagcggtgctggatatccacttcacccttcataccaagagtgaatcggccacgcaggttgaagcgttgctgtacgactggctgagttttttcgcacgcagcgattggacagccttacgcgaagagttcgccttgctcaacgctcgtcaacaacaggtccaaggcgccctggcattggctcgcaacgatagcgaagacctttcggagcaaggcgtcacagccctcaaggccatgctcgacgggctgcacctgcccgccgctgagcacaactggcagctgccaccgaacaaccccctgctgcgtcctccggccaaggaagaacgcgccggcctgatccgtggccaaaccagcgcccaccgtggcttgcgtagctttgcccaggatcgctcaaggggtcgaaaggaattatcggcgttgatattcagccaggcgttggcggatgacaccgacgaaggcgcgttgtacctgcactggcggtttgacgctggcgtccccaccgggctcgaacccgcgctgcagccgttgcgcgaacatgctcgccaggcaggcattgagttgtcttgtgaaaccattgccaatgattggctggtgacaatgcacggtcttcacgaaccgatgccagcggtgctcgaagagctggcacgttgcctgaacaggtgcgatgaacctctatccccgcccgaagcagcgccgtcgatcgccattcgggagctgctcaaggcgttgcctgcttgctgcgccggggtgcaactcaagtccttggaagcacaagcgtcgtggtctggcgcacgctggcaggggctgggctctggcctgtccaccgcaagtcaagcagcgatcaaactcgcagccgcccacttaccagggcagccggcgaacatcccgttcacacctcagccaatcgaaggccaacacctctggcacgagatcaacaccgactccagcgaagccgccttattgctattttgcccaacgccgagtctatccctggccgatgaagccacatggcggttactcgggcatgtgctccaggcgccgttctatcagcgtttgcgagtcgagctgcaaatcggctatgccgtgttcagtggcatccgacaaatcaatggccaaaccggcctgttgtttggcgtgcaatcgcccagcatgtccctggacgggattgtcgagcagctgcaaaccttcctggggcaactgccgtccttgctcgaacgcagtccagacttgggcaaccaggccctggcgcagcagttcacagcccaggcgctgcccatcagccaagccgccgacttgctttggcacgcgcaccgggcgggtcattcgtcgggatacctggatcaacttcgtcagctgattcaaagccgcacacgcgaggacttgcaacacgcagcccaacaactcaataacgctgcaggcggctggcgctgcgtggcgaacgggccgtgcagcaacgatggctggcaagcggcgcggtgatcattgccaaccctgcaacaggctttttccacccagacagcgctaacttgaaaagaattgcgtaatattccctggcaatatctgaacatctccaatgggaggtggactatatgtattacttggtagtgaacgtcccatcccttgataggagtaagaatatgacttggtccaaacctgcttacactgatctgcgtatcggttttgaagtcaccatgtacttcgccagccgttgattggctgagtaagacaacgcctcggtttgcccggggcgtttttgttttgagctttgcctgatggagcgaacatgtttgtccagattctaggttccgccgccggcggtggcttcccgcagtggaactgcaactgcgtgaactgcgcaggttttcgcgatggcagcctgcgggcccatgcgcgcacccagtcgtccatcgcgatctccgacgatggcgtgaattgggtgctgtgcaatgcgtcgccggacatccgtgcgcaactccagggttttgcgcccatgcaacccggccgcgccctgcgcgacaccggcatcagcgcgatcatcctgatggatagccagatcgaccacaccaccggcctgttgagcctgcgcgaaggctgcccacaccaagtgtggtgcaccgacatggttcacgaagacctgagcaccggtttcccgttgttcaccatgctgacccactggaacggcggcctggcctggaaccgcatcgagctggacgccagcttcaccatcccggcctgccccaacctgcgctttaccccgctgccgttgcgcagcgctgcaccgccctactcgccgcaccgcttcgacccacacccaggcgacaatatcggcctgatcgtcgaagacctgcgcaccggtggcaagctcttctacgccccgggtttgggcaaggtcgacgcgccgctgttggaaatcatggccggcagcgattgcctgctggtggacggcacaatgtgggatgacgacgaaatgcagcgccgcggcgtcggcacccgcaccggccgcgagatgggccacctggcccagaacggccccggcggcatgctggaagtgctggagcagttgcccaagcagcgcaaggtgcttattcacatcaacaataccaacccgatcctcgatgaagactcccccgaacgagccgagctggtgcggcgcaatgtcgaagtggcttacgacggcatgagcattgaattgtaggagcgaccgaaatgactgatacagcgttgaccacggctgaattcgaagcagccctgcgggccaagggcgccttctaccatatccatcacccctatcatgtggcgatgtacgaaggccgtgccacccgcgaacagatccagggctgggttgccaaccgcttctactatcaggtgaatatcccgctgaaggacgccgcgatcctggccaactgcccggaccgggagatccgccgcgagtggatccagcgcctgctcgaccacgacggcgccccgggtgaagacggcggtatcgaagcctggctgcgcctgggccaggccgtgggcctcgacccggaccaactgcgctcccaggaactggtgctgcccggcgtacgcttcgcagtggacgcctacgtcaacttcgcccgccgcgccagctggcaggaagccgccagcagttcactgactgagctgtttgcaccgcagatccaccagtcacgcctcgacagctggccgcagcattacccgtggatcgacccggccggctacgaatacttccgcacccgcctgggccaggcccgtcgcgacgtggaacacggcctggcgattaccctgcagcactacactacccgtgaaggccaggagcgcatgctggaaatcctgcagttcaaactggacatcctgtggagcatgctcgatgccatgagcatggcctacgaactcaaacgcccgccctatcacagcgtgaccgagcagcgggtctggcataaagggatcaccctatgagctttgatcgcagcaagaaaccgacctggcgccagggctatcgctaccagtacgaacccgcgcagaaaggccacgtattgctctaccctgaaggcatgatcaagctcaacgacagcgccgcattgatcggtggcctgatcgatggcgagcgcgacgtggcagcgatcatcgccgaactggacaagcaattccccggtgtgcctgagctcggtgaagatatcgagcaattcatggaggtcgcccgtgcagagcactggattacccttgcctgaaaaaccagagatcggcttaccgctgtggttgctggccgagctgacttaccgctgcccattgcagtgcccgtattgctccaacccgctggattttgccgagcagggcaaggagctgagcaccgagcaatggatcaaggtgtttcgcgaagcccgcgagatgggcgccgcgcagttgggtttctccggcggtgagccgctggtgcgacaggacttggccgagctgatcgctgaagctcgcaagctgggcttctacaccaacttgatcacctccggcatcggcttgaccgagcaaaagatcagcgacttcaagagagctggcctggaccacatccagatcagcttccaggccagcgacgaacaggtgaacaacctgctggccggttcgaaaaaagccttcgcgcaaaagctggaaatggcccgcgcagtgaaagcacatggctaccccatggtgctgaacttcgttacccaccggcacaatatcgacaagatcgaccgcatcatcgagctgtgtattgcgctggaggcagattttgtcgagctcgccacttgccagttctatggctgggcgcagctcaatcgcgtgggcttgttgccgacccgggaacaactggtgcgcgccgaacgcatcaccaacgaatatcgcgccaaactggaagccgaagggcacccgtgcaagctgatcttcgtgacgccggactattacgaggaacgcccgaaagcctgcatgaacggctggggcagcatctttctgaccgtgacaccggacggcactgccctaccctgtcacggcgcccgacagatgccggtgcaatttcccaatgtgcgcgaccacagcatgcagcacatctggtacgaatcgtttggcttcaatcgctttcgtggctacgactggatgcccgagccgtgccgttcatgcgatgaaaaggaaaaggacttcggcggctgccgttgccaggcgttcatgcttaccggtgatgccagcaatgccgacccggtgtgcagcaagtccgagcagcacagcatcatccttcaggcgcgggaagaagccgaacacgccaccctgaccatcgagcaactggcctttcgcaatgagcgcaactcacggctcattgcaaaaggctgagggcctcaacgcttggcgatgatgtacaccgcgtgaatgatgccagggaagtaaccgcacagggtcagcaggatattcagccagaaggcgccgccgaaacctacttgcaggaacacacccagtggcggcagcagaatggcgatgatgatacgaatgatgtccatgagtcagctccataaaaatcggctcctgtgagccgtgtagctaatcgaccttgggggttcgtgagggttcagtgggatctggcatcgggccagcttcaggccaggatttccagcccgtgcttttgcacgatgctcagcaacttgagcgccatgccgctgggttgtttctcgcctgactcccactgcttcaccgtggaggcgctggtgttcaggtaacgggcaaatactggctggctgacatggttacgctctcgtagctgcttgatttgctcggccgggatttgcgccgggatatctgcaaggcatgcctcgtcgaactcacgaagggtggttttgctaatggcgcctactgcatatagcgcttcagcagagtgatgaatggactcaaaagcctcacttttgtatttcttggtcatgacgtatctccacaaactccctgatatccagcatctgctgaatctgtgcttcattgaagccttcataagacttagccagcgtccgaaaccaagcaagttcgctttggctgatgttgcttcgatcctgcttggcgaacagcaattgataaacccaatagtgcctacccttggccaatataattgagcgatgccggtttcgattcagtcgcttcttccaaacaccgccgcccaaattatcagcctggcctttaagcatttcattgaacgcctccctcagctctgaatcgcagatccaggccttgctggcagcatcagcaaagtgccgcgttttgaataacctcagccaaacataccactcagtggtatagattagaagtggcgcatctcgcgccccatcggcagtccatgccgacgtccgctaaaaagccagggttttacaggaagctcaagggcccttttcaatccaaaaattacgcagacaaaaaaacgcccccagccaaaagaatcaggctgagggcgccgcgtatgccgcgagacggttctgaaatacagggttaaacggcaatgcccttgcgacattgcacttgggcagtacgcacccgtgaaaaggcgcgggccaggcgctggagcatttcgtcgatgttgcctttgcttatcgtcagtgccggggtgaagcgcaaacagtcgggttgcggcgcgttgaggatcagtccctcctgcaaggcggcctttaccaccgcatccgcagaatcatccgataacgtcagcccccacatcaggccatttccgcgcaatgggccgtggtcgtagcgataggccaggcgggcgagaccttcgcccaggtaacagcccgactcacgtacgtgctctaaaaagccgtgtcccagcaccgtatcggtcacagccaacccagccgcggccatcagcgcattaccatggtgggagccgcccaattcccccacatcaaagcaacaggcttggccccgcgccagcaacgccgccaatggcataccgccgcccaggcctttgcccagggcgatgatgtcggcgcgtacaccgtactgttgttcggcgagcaatgtgccgcaacgaccgataccggtttgcacttcgtcgaggatcagcaggatccccagttcgcgacacagccgctcgacgcccttgaggtagtgctcggtcgcagggatcacgccggcttcgctctggatcggttccagcaggatagccaccgtctgggcatccaccgcggcatgcagggcgggaagatcgttgaaagggacgtggctgaagcctggcagttgtggttcgaaacggttatccgatagacctgccgaagccgccagggcagcgaagctatggccatggcaaccgttgctcgcgctgataatgcgataggcccccccgcgatgcagctgcccccatttgcgcgccagcttgatcgccgcctcgcaggcttccgcgccgctgttgagcaggtaagcctggtcgctgccggtgtgccggcaaagacgctcgacgagattgagttggacgctattgtgcaggccattgccggggttgatcagcgcatgggtttgctcgcccagcgccttgatcagcacctgtgggctatggccgagactattggcagcattgccttggctgaaatccaggtaggcactctcttcgctgtcccacagccacgagccctggccacgcacaaacacctgaggtgggcgcgccacggtgggcatcagagattcagtggaacggttgtcgtgcggtggatccaggatcagatcgtcaaggctcggcaccggccggcgtatgttgaacaggctcacaagtcagctccgatggcaaccagaccttggtcggaatagcctggccaatccacatggaggttttttgccttgcctatgcaaacgctatcaatacaaacgctgttcattgtccgatccggccctgtaagccctgcgaataggcgctagactaggcgtctgcggggccaacggccatttcgattttccagcttttttgataagtaaatcttatggatttcaagcaactgcgttatttcgtcgcggtgtatgaagagggccacgtaggccgcgccgcggagcgcctgtcgatctcccagccagccttgtcgcaacagattcgccaactggagcagaacctcgacgtgagtctgttcgaacgcagcagtaagcgcctgttaccgacgctggcggcgcataccctttacaaccatgcactgccgctcattgatggcatgcagcaagccgtcgaggcgctgcgcaacttcaagggccaggccatgcgcaccctggccatcggcgtgctgcaaaccgtgcacaccagcctggtgccgcagatgctcgagcgcgtgcgtaaggcccagccccatctggtggtgcagatctacgaattgactgggcttgagatcgagcgccggttgctcaacggtgccctcgacattggcatcagctacctgccgccacgtcagccgggcctgcacggcgtgttgctgtacgaagatgagttgaaggtggtgattcccgaggaccatccgctgcgcgaattcaagaaagtctcgttgaaacaggcagccgagttgccgatgttgctgctgggggaagagtttcaagtcaggcagatctggcagggccagttggctaacctggggcggcgtccgcaggtgcaggccgaactcaataccatggtgggcattctcgacagcctgccccacactcggctggcgacggtactgccgggccgctcccaggacgaacacaacagcaaggcgctgctatggaaacccttgagtgaacccagggtggcgctgaaagtaggcttggtgtgccgcgatgtgcagcgccagcaggcgacggtggcgttgctgcgcaccttgctcgaagacgtgatgaatgcccctcgggcaagcgcctgactttttcgcgggcaaaagaaaaccccgccgaagcggggctttgcagactgtttccctgacatccatttcactccgccgtcctggcagaatcctacgtgtccgtgttgttgctttgcgcttcctgcgcgacgtccatgtgaagtagattagccatggatccaatttggcgatagaggacgaatagcagtacgtcatgtaagagaatgcttacacggcctccctgcccttagaacagggcctcatccatcaggaacagcgattcgctaccggcttttaccgacgcactcaatgagtggatacgcggcaacaagcgggcaaagtagaaacgtgcggtacccagtttgctggcgtagaacgcttcctcggtctccttgcccaacgcggccttggccatgcgcgcccacatgtaggcgtaggccatgtagccgaacgcatgcaggtattccaccgacgccgcaccgatttcattcggattgtgcttagcgcgatccagcacccacgccgtcaattcatccaggttatccaccgcagcgctgagcggcttggtgaactcggccaacactggacccgactcagtgacgaattggcggatctcatcggcgaacagggtgtagaaagcaccgccgctgccaacgatcttacggcccatcaaatccagagcctgaatgccgttggtgccttcgtagatctgggtgatgcgcacgtcacgcaccaactgctcctggccccactcgcggatgtagccatggccgccgaatacttgctgtccgagcacggtggtttccaggcccaggtccgtaaggaaggccttggcaacgggggtcagcaacgccaccagattatccgcgcgctcccgagcagctgcatcgtcactgaacttggcgatgtccagctgcgtcgccacgtaggtggagaacgcccggccgccttcgttcgccgccttcatggtcagcagcatgcggcgcacatccggatgcacgatgatcggatctgccactttgtccttggcctgtgcccccagcggggagcggctctgcaggcgatcacgggcatattcaatcgcgttctgataagagcgctcgccggaagccaagccctggatccccacccccaggcgctcatagttcatcatggtgaacatcgccgccaggccacggttaggctcgcccaccaggtaacccacggcctcgtcgaaattcatcacgcaggtcgcggacgcctgaatgcccatcttgtgttcaatcgaaccgcaggtcaccgggttacgcgcacccaggctgccgtcggcattgaccaggaacttcggcaccaggaacagcgagatgcccttgggcccggctggtgcatccggcagcttggccagcaccagatggatgatgttttcggtcagatcgtgttcgccaccggtgatgaagatcttggtgccgctgactttgtaggaaccgtctgcctgaggctcggccttggtgcggatcatccccaggtcagtgccggcatgggcttcggtcaagcacatggaaccggcccactcaccggaatacatcttcggcaggtaggccgccttgagcgcttcactggcgtgagtgttgatcgatacacaggcgccggaagtcagcatggggtacaggccgaatgccaggctcgacgagttgatcatttcttcgacctgcgccgacaccgccttgggcatgcccatgccgccataggtcgggtcgccgcccacgcccacccaaccgccttcggcataagtgctgtaggcctgggggaagccgtccggggtactgactgcgctgtccttccactggcagccttgctcatcgccgccgcggctgaggggcgcgatggatttggcggtgactttgccggcttcttcgaggatcgcctcaacggtttcggcatcaacgctgtctgccaacgccggcaactgggcccaagtctcggcgacctcaaaaacttcgttgaggacgaagcgcatatcacgcaacggcgctttgtaatcagccatggcaaacctcgtgagaacgtgaaaagtgattcgataggatcggttttacaagctccgagtgtacccgaacaacttttaagacacatagggtccacttgtgaccgacaggtatttttaagtcactccagctggaatgccgacccggacagactcatcaggcattcactgcccgcttccacggcggcgcggtgggtggtggtacgcggcagcagacgcttgaagtagaaatcgcaggtggccagcttggcctgggtgaacgcggcatcgtcctgggactgggcggcaatcgccatgcgcaaccacaggtaagccaggatgatatagccgctgtacatcaggtaatccattgctgccgcacccacttcgtcaggattcttcatcgccgccatcccgactttggtggtcaactcaccccactcctgattgagctgattgagctgcgtcacatgagccctgaattgcggatgctcggcctgcgcgccacagaacttatgcacgatcttggtaaacccgcgcagcaatttgccttggctacccagcactttgcgccccagcaaatcgagggcctggataccgttggtgccttcatagatcggcgcaatccgcgcatcgcgcgccagttgctccatgccccactcacgaatatagccatggccgccaaatacctgcatgccatggttggtcacctccagaccggtttcggtcatgaaggccttgcagatcggcgtaaggaaggccaacaagtcttcggcctcctggcgttggccggcgtcgctgcccagatgagcagtatcgagcagttgcgcggtgaagtaggtcagtgcgcggttgccctcgttaaaggctttcatggtcagcagcatgcggcgtacatcggcatgcacgataatcgggtcagcagccttctccggggccttggcgccggtcagcgagcgcatttgcaggcgttcactggcgtatttgatcgcgccctggaagcttgcttcgccattgcacaggccctgcatgccggtgcccaggcgggcgtggttcatcatggtgaacatgcagttgaggcccttgttcgcctcgccgatcaaaaaacccttggcgccatcgaaattcagcacgcacgtggccgaagccttgatgcccatcttgtgttcgatggagccgcagtgcactgcgttgcgctcacccgagtcggcatggaacttgggcacgataaacagcgaaatccccttggtacccgcaggcgcgtccggcaacttggccaacaccaggtggatgatattggcgctcatgtcgtgctcaccggccgaaatgaagatcttgctgccggtgattgcataactgccatcggcctggggcacggcacgggtcttgatcaggcccaggtcggtgccgcagtgggcttcggtcaagcacatggtgccggtccattcgccagcggtgagcttggtcaggtaggtggctttctgttcgtcggtaccgtgggcctggatggccgacattgcgccatgggtcaggcccgggtacatgccccaagaggtattgctggaaccgatcatctcgctcagcaccaggcccagggaatggggcaagccctggccaccgtaggccgggtccgccgccacgccgtgccagccgcctgccacgtattgggcgaaggcttccttgaagcccttgggtgtggtcaccacgccattgtcgaaatggcagccctcttcatcgccactgcggttgagtggcgcgagcacgttttcgcaaaacttcgcgccctcctcaaggatcgcactgaccatgtccgggctggcgtccgttgcgcccagggccgcgtaatggccgtggaaatcgaacacgttgtcgatcagaaagcgcatgtcgcgcaagggagctttgtactcaggcatggcaatgtctccggcagcagatgctttcaagctactgccggcaccgcctgtggacaatcattgtagcgctgctgaatacagcgccattactcaaccggcagcgctttccatacgtaccgcgccacgtcgggtttggccggccgcgaccacacagttacgccccgcgcccttggcggcgtacaacgcctggtcggcggacttgagcacttcctcggggctgcgctgatcggcctggcgctcagccacaccgatgctgaccgtcaccgacacactggatgcaccgctgcccgcacgccgctggcggccttgatggtcgtcatgggggcggtccgcgttgcgcaacttgatagcgtagccggcgatgatctcgcggatctcctccagatgcggcatgcattcatccagggtcttgccggcaaacaccacggcaaactcttcaccgccataccggtaggctcgcccgccgccgctgaccttggacaacttgctcgccaccaggcgcaacacctggtctcccacgtcatgaccatgggtgtcgttgaaacgcttgaagtgatccacgtcgctcatcgccagcacatagctgcgccccagccgctgcatgcgctcgttgagagcccgtcgcccgggcaagccggtcagctcgtcgcgaaatgccatttgataggcctcgtgagccacaccggcggcgatcatcagcatcacctggctgcacatgatgttaagggtgaacggcaggatgaaggtttgcggcaacatccagaacatccccagcaatcccaccagttgcgccgcgtgcagcgggcgcggctggtaccagtactgtgcggccagggtgagaaagccgatcaggaacatggggtatgagagttggatcaggctcatccaggtgccatgcagcgccggccagcgaatctccgccagccagttaagtagcgcctggggaaaactttgctccagagccaatgccacgctgcctaccgccagtaacaccgcggcgcgtgcgatgaagtcacggaacaaatgggtcttctcctgccacagcgcgtaaatgctgaacagcaacggcaacaacaagcaacacaggtgaaacaccaccgcagcgtcttcgcgcacgcggccattgtcgcgatagaaatcggtctgggtatccagcaggtaataggcaacgtacaccgtgatcatcaggaacagttcacgctggcgtcgatacaccgcacagtaggcaccgcccagcagcaagaccagggtgggcagcacgttgaacaacgaggtgaagaagacactgaggtccttgacgtacgcagccgaaagcccagccagcaataacagcagcgagggtaggaagtggcttaaacgtagcgcagacacgcgtgacaagggtaaaactccgacccgcaaaaaataatagcactgtgcctctatgcgatcagttaagcacaaccgaccgaccatgtatcacattgccatcactttaacggcaggcgctcccaatccctgagtgctgtacgcgggttttttaaccggccataaaaaaccgccgactcccaagggaggcggcggttttcagaaggttgccggaaggcttagtaagccaggccgaagtcttcttctttcatgtccatcaggttgctggcgcccgacagcatggttgctacgtgggtgcgggtacgcggcaggatgcgctggaagtagaagcgcgcggtctgcaacttggcagtgtagaacgcttcttcggtggtgccggcagccagcttctcggcagccaggcgtgccatgtcggcccagaagtaagccaggcacgcatacccggaatacatcaggtagtccaccgacgcggcaccgacttcttcacggtctttcatcgcagccatgccgaccttcatggtcaactcgccccattctttgttcaatgccgccagcggtgcaacgaactctttgacagcctcgttaccttcgttggcctggcagaacttgtgcacgatcttggtaaaacccttgagcgcttcgccctgagtcatgagcactttacggccgagcaagtccagtgcctggatgccggtggtgccttcatacagcatcgaaatgcggctgtcgcgaacgttctgctccatgccccactcggcgatgaagccgtggccgccgtagatctgcacgccgtggttggccgattcaaaaccgacttcggtcatgaacgccttggcgatcggagtcatgaaagccagcaagccgtcggcctgtttcttggcttcgtcgtcggtgccgtacttgacgatgtctacttgcttggcagtgaagtacaccatcgcacggttgccttcggcgaaggctttcatggtcagcagcatgcggcgcacgtcagggtgcacgatgatcgggtcggcggctttgtccggtgctttcgggccagtcagggagcgcatctgcaagcgatcacgtgcatatttcaagccgccctggaagccgatctcggcgtgggacaggccctgcagtgcagtccccaggcgagcggtgttcatgaaggtgaacatgcagttcaggcctttgttcgccgggccgatcaggaaaccggtggccgcgtcgaaattcatcacgcaggtggcgttgccgtggatacccatcttgtgttccagggagccacaggtcaccgcattgcgctcgcccaccgaaccatcggcgttgggcaggaacttgggcacgataaacagcgagatgcccttggtgccggccggtgcatccggcaggcgggccagtacgatatggacgatgttgtcggccatgtcgtgttcaccggccgagatgaagatcttggtaccggagactttgtaggaaccgtcggcctgaggctcggccttggtgcgcaacatgccaaggtcggtgccgcagtgcggctcagtcaggcacatggtgccggtccactcgcccgacaccagcttggtcaggtaagcctcttgctgctctggggtgccgtgctcggaaatggtgttcatcgcaccatgggacaggcccgggtacatgccccacgaccagtttgcggcccctaccatttcgctcaccgccaggcccagggattccggcaggccttggccgccgtgctccacatcgtgggccaggcttggccagccgccttcgacgaattgcttgtaggcttctttaaagccagtaggggttttaacgcctgactcactccaggtacacccttcgatgtcgcccacgcggttcaacggtgccagtacttgctcacagaacttggcgccttcttcgaggatggcgtcaaccatgtccggggtagcgtcctggcacgccggcaggctctgatagtgcgcttcataaccgagcagttcgtcacgaacgaagcgaatatcacgcaagggggccttgtagtcaggcatagcgataaacctctgctgatgtatctgggatgaacaaccgcgtggatttgttatggcggtcaaacaggtgtttgaaacatacgtttacgaccaagggttgtcaagcatcggccggatgccgtttgtcttgatgcaggccatcgccaggcacggcaaggcccgcggcaagacgccacgctaaattgagtgcagagagtgatcagggctaggcaagagaaaaagatgggagggggcttgctcccgatagcggaatgtcagtcagtacttttgtaactgacacagcgctatcgggggcaagccccctcccacattttgaactacgtacatgaaagaggatcaggcgtaggtgtcgatcaaggtaccaagcatttcattcgaagccttcgcgactttcgcccccagctccacttgaaacttgccctgggccatttccaccatattgctcgccgaattggatggctgggcacggtcgctggcttgcagacgatcactttgcgccccggatggctgggttgtcgcggcgctggcaatcttgccggccgcctggtcgacacggttctgcccggcctgaatgctgttcaggccggaataaaacgcgctgctgccagagatttccatggcgtaaacctgcctttagagaatcgtgaagttggattgaagcagacatcctggcaaaaggcccgtcaaaaacactaatggcacattgccttagtgatagccaaaatcagtcaagcaggtccaattcaaggtattcggccactgcagccgccccggcgtgcttgagtttcggcactcttcccaggcaaggcgccggcaagcgctcagccagggtggcgaggttttcttccagacgagaggtcttggggtcgatgatgttcgccacccaaccggccagcggcaagccgtcccgtgcgatggcttcggcggtgagcaatgcatggctgatacaacccaggcgcaccccaaccaccaggatcactggcagcttgagcgccatggccaggtccgacaggttggcctggtcagccaagggtacgcgccacccgcctgcgccctcgatcaaggtgaaatccgccccacgggccaggacgtgctgcatcggcttgagcaacgattgcaccgtcaacgcgacacccgcctcgcgtgcggccagatgaggcgcgatagccggctcgaatgctaccgggttgacctcggcatagctcagcggcactgaacattcggccaacagcgccaaggcatcggtgttgcgcaacccttgggcagtcagttggcagcccgacgccaccggctttccggctgcggtacttttacctgccagcctggcggcatgcagcagtccagccgcgatagtggtcttgcccacatcggtgtcggtgccggtgatgaaataagcggcgctcatgcaggtttctccaatacggcatacaccacttggtaggtggcaggcaggccatgggcctggcgcaactgctcgtaagcatcgaccagtgccaccattcgtgcgcgacccgtcaaccctcccgggcggcccgggttgaggttatgggcgcccaacgccttgagctcgtgggtcaggctgcgcacatccgggtaatgcagcacatggggctgtcgctccaggctcatcacccgcaagccactggtcgcacacagttgttgataagcctcgaaggtgcggaagcggttgacgtggaccaggccatccgccgcccgccagctttcgcgcagttcatccagcgtgcctgtgcacaggctcgcgaaggccagcacaccgcccggtcgcagtacgcgatgagcttcactgagtactgcatcgaaatttgcgcaccattgcaccgcaaggctggaaaagagcaattcgatgctgtcagccttaagcggcaagcgttccgcatcaccggcaataaagtgctgcgcaccgcccaaaggccgcgcatggttgagcatgccttcggcgatatccagcgcgatgccttcgcttgcaggcaaacgctcacccagtacccggctgaagtagcccgtgccgcagcccatatccagccagcattgtggcgaaaggttgggcggcaaacggctgagcaattcatgccccaccgcccgctgcaactcggccacgctgtcgtagctggccgctgcacgggaaaacgaggccgcgacctgacgcttgtccggcaaggcgcccggcaggcaaggatgggataaatcagtcatcaacacactcatacaaaaaagcctggatggcccctgctacaccgtgggggtcttccaggagaaacgcgtgaccggcctgttcaatcaggccgacttctacatcggggagcaatgccaacaggtcactggcggcttcggcaggcaccagcccatccaagccggcaaacaaatgcaactgcggcccgcgaaatgcctgcaaggcggctcgggtatccagttgggccagcaattccaggccaggcatcaagacactggggggtgtattcggcgcaccgctgaccagcagccgcgacagtccgcgggggtctgcggcgcccttggcgcacagcaggccgaagcgcttgagggtgacctgggagtcggcatggcagcccgccaggaatgcatcaaaggtctcggccggcatcccgtggggccagctgtcatgggcgacgaaacacggattgctcgccagggtcagcaaaccgcagcaacgctcgccgcgccgcgccgccagctctgaagcgagcatgccgccgagggaccaaccaccgagccagacgttgtccggcagcgtcgcatcgagctcgtcgagccattcacccacatcactggaatccagcaccggcaaaggctcgatctgtacccgcagatgctcattcaggccgtgcagtgcattggccagcggctccagcggtgacacaccaagcccccagccgggcagcaatatcagtcgattacgcatggtcgggctccgaggcgcctaacaagcggaaacactcttccaacccgtttaacaatagctgcacctgcgcctcgctgtgggccgccgttaatgtcacccgtaaacgggcggtaccggcgggcaccgtaggcgggcggatcgcagttaccatcaggccacgctcgcgcagcatttgcgacaggcgcaacgcccgggcgctgtcgccaatcaggatcggctggatcggcgtaaagctgtccatcaacgccaggcccatctgctcggcgccctggcggaactggcggatcaacccgttgaggtgctcgcggcgccaatgttcatggcgcaacagctccaggcttttcagggtggcgcaggccagtgccgggggttggctggtggtgtagatatacgggcgggcaaactggatcaggctttcgatcaactcctcgctgccggccacaaatgccccggcggtgccgaaggctttgcccaaggtgccaaccagcaccggcacgtcctcctggctcaagccgaaatgctcgacgatgccaccgccctgggcgcccaacggaccgaagccatgggcgtcatccaccatcagccaggcacctctggccttggcttcacgggccagtgcggggaggttggccaggtcgccgtccatgctgaacacgccatcagtgaccaccagcgtattgccgctggccttctccaggcgcttggccaggctgtcggcgtcgttatgcaggtagcgattgaaacgcgccccggacagcaagccggcatccagcaatgacgcgtggttgaggcgatcttgcagcaccgtatcgccctgccccaccaatgccgtgaccgcgccgaggttggccatatagccagtagtgaacagcagtgcacgcgggcgcccggtcaaatcagccagggcttcttccaactcatggtgcggcgtggcgtggcccaccaccagatgcgaagcgccaccgcccacgccccaacgggccgctccggcgcgccaggcctcgatcacctgcgggtgattggccaggcccaggtaatcgttattgcagaacgccaacaatggctggccatccaccaccacttctggcccttgagggctctgcagcagcgggcgttgacggtatagatgttcggcacggcgggcagcgaggcgtgcggcgagatcaaaagacatgctggcctcgatttggcgggttcaactggatcaaataatgtgggagcaagccccccacattgggatcccatttcaatcagacgacagcgttgtagaactgctcgctgctcttttgctccaccagcgcctgctcgatcgccgcctgatgcacttcatcggcgtgctcttcgcgagcttcaggcaggatgcccaggcgtgcaaacagttgcatgtccttgtcggcctgcgggttggcggtggtcagcagtttgtcgccgtagaagatcgagttggcgccggcaaagaacgcaagggcctgcatctgctcgttcatggcctcgcggccggcggacaggcgcacgtgggatttcggcatgaggatgcgtgccaccgccagcatgcggatgaaatcaaaggggtcgatgtcgtcggcgttctccaacggcgtgccggcaaccttcaccagcatgttgatcggcaccgactccgggtgctcgggcagattggccaactggatcagcaaattggcgcggtcgtcaagggactcacccatgccgaggatgccgcccgagcagatcttcatccccgaatcacgcacataggccagggtttgcaggcgctcgccgtaggtgcgggtggtgatgatcgagccgtagaactccggcgaggtatcgaggttgtggttgtagtaatccaggccggcctgggccagggcttcggtctggtcctggtcgaggcgcccgagggtcatgcaggtttccaggcccatggccttcacgcctttgaccatctccaacacgtagggcatgtccttggccgacgggtgtttccacgccgcgcccatgcagaaacgcgtcgagccgatggccttggcgcgggcagcctcttcgaggaccttctgcacttccatcagcttttctttttccaggccggtgttgtagtggcccgactgcggacaatatttgcaatcttccgggcaggcgccggtcttgatcgacagcaaggtcgatacctgcacgcggttggcgtcgaaatgcgcgcggtgcacggtctgcgcctggaacaacaggtcattgaatggctgcacgaacagggctttgacttcggctaaggaccaatcgtgacgcagggtggcagaggtgctggcgctcatgggcgattccttgattatgctttggcaagcgctgcgggaagggcaatacccacaggcacgacacggatgccggcatatttaaggaagaatcatgcactgtcaacctgatcacaaacgccaagtttacatctggtcaaaaaacatacagccctgcctgatttgcgatgaaagcactcagtcagccgaacatatatgcaacgtctgcgaaacagacttaccttggctaatggagcagtgtgaacgctgcgccctacccttgccgatggatggcttgatctgcgggcagtgccagaggcattcacccgctttcaatcaggtcgtcgcgccatggacctatagctttcccatcgacaccctcatcagccgcttcaagcaccagggccgttggccgctggggcacatgctggcacgcctgctggggcaacacttgcaacaccgcttcgacaacgctgaactcgaccgacccgacggcctgctgccggtgcccatggcccgcaaacgcctgcgcgagcgcggctttaaccaagcgttgatggtggcccgctggctcagtaaagccctcgagattccctatcatgaacatgcgttattacgcccttatgaaaccgtcgcgcagcaagacctggatgccaaggcccgcaaacgcaacctgctcaacgcttttgccctggcacccgacgcccacgtagcagggcagcatctggcgttggtagacgacgtactcaccaccggcgccacggcccacagcctggcgcggctgttgataggtgccggcgcacgccaagtcgacgtctattgcctggcacgtacaccaaggtccagcgtctgacttgactcccctgcgccaggacggcaacgtccgctcatctcatccagacgtatgcccatgtccctgcccaaccccctcaaccagcacatcatccgtcgcccccagcgcattgccttgctggggcatatcgccgagcagggttccatcacccgtgcggccaaaagcgccgggttgagttacaaggctgcttgggacgccatcgacgaactgaacaacctggcgcaaaaaccgctggttgaacgcagtgtcggcggcaagggtggcggcggcgccaagctgacgcaagaaggtgaacgggtgttgcgcctctatcagcgcctgcaagtgttgcaggccgaagtactcggctcggacgaagcagccagcgacttcaacctgctgggccgcttgatgctgcgcaccagtgcgcgcaaccaattgcacggccaggtcagcgccatcgacagccatgggcgcaatgacatgattggcctgcagttggccggcggcctgcatctggacgcacagatcacccacgacagcacccaacgactggaactgcagatcggcgtggaggtggtcgccctgatcaaggccgggtggctcgagttgctggcgatcgggcaacctgaaacacctggacacaattgcatggtcggtgtgatcgagacgattctcgacgccgaagatggccccagtgaggtgcgtatcgccctgcctaacggccaggtgctatgcgcgctggcaccgcccgctgcactccaggcccttgacgctgccgagggccaaccgatccgcgtgcaattcgcccccagcaatgtgttgcttggcacgccggtatagcgggccaaagtcttcgaactgcaacaatttggtcacaagcgctgcttaaggtgtctgcaaaaaccgcagggagcctgagatgagcctattagaagaaaaccaagccaccgaccttgaacagatggtcggcctcacccgtcgtcgctttatcggcgcaggcgccctgtgcggcgcggcgatgttcctgggtggcaacctgttgagccgcagcgccctggccgtgaatgccgcttccgccagcccgttgctgggcttcaccagcatcgccgccgccaccagcgacaccatcaccctgccccctggctacagcgcttcggtgctgatcagttggggccagccattgcacaagaacgcgccggctttcgacccgtccggcaatggtacggccaaggcgcaggaacaacagttcggcgaccacaacgacggcatgagcctgtttcccttcccgggcgacaacaaccgcgcgctgatggcgatcaacaacgagtacaccaactaccgctacctcttcgcccacggcagtgcaccgcagtcggctgaagacgtacgcaaggccctggccagcgaaggcgtgtcggtcatcgaagtgcgacgcaagggcgacacctggcagttcgttcaggactctcgctacaaccggcgcatccacggcaattcaccgatccgcttgagcggcccggccgccggccatgattggctgaaaacccgcgccgacaaaagcggcaaaaaagtcctcggcacgttccagaactgcgccaacggcaagaccccatggggcacctacctgacctgcgaagaaaacttcaccgactgtttcggcagcagcaacccgcagcaggctttcgacgccgggcagaagcgctacggtgtggtagccgccagcaaagacatcaactggcacccgcacgacccacgtttcgacatggccaagaaccccaatgaactcaatcgtcatggctgggtggtggaaatcgacccattcgatccgcaatccactccggtcaagcgcacggcgctgggtcgcttcaagcacgaaaacgccgccctcgccgagacccgcgacggccgcgccgtggtgtacatgggcgacgatgagcgcggtgagttcatctacaaattcgtcagccgcgatcagatcaaccacgacaatccgaaagccaataaagacctgctcgaccacggcaccttgtacgtggccatcttcgacgcgggcgacggcgatgccgatcatcccaaaggcaaaggtcaatgggttgaactcacccatggcaaaaacggcatcgacgccagcagcggtttcgccaaccaggccgaggtgctgatccatgcgcgcctggccgccagcgtagtgaaagccacgcgcatggaccgcccggaatggatcgtggtcagccccaccgacggccaggtctattgcaccctgaccaacaacgccaaacgcggcgaagacggccagccggtgggcgggcccaacccacgggagaagaacgtctacggccagatcctgcgctggaaggccaacgccgataaccacggtgccacggacttcacctgggacttgttcgtggtagccggcaacccgggcgtgcacgccggtacgccgaagggcggttcatccaatatcagccctcagaacatgttcaatagccccgacggcctgggtttcgacaaagcggggcgcctgtggatcctgaccgatggcgactacagcaacgccggcgactttgccggcatgggcaataaccaaatgctgtgtgccgacccgagcaccggtgaaatccgccgtttcatggttgggccggtggcgtgtgaggtgacaggaatcagctttgcgccggatcagaaaaccttgtttgtggggattcagcatccgggggaaaccggtggttcgacctggccggagcatttgcccaatggcaagccgcgttcgtcggtagtggcgattcggcgggatgatggtggggttgtcggcgcctgacagagcctcatcgtgggcaagccccctcccacaattgcgaattgcgaatacattcaagtgtgggagggggcttgcctccgattgcaatagcacagccaccacctatcccagccccggtgcgttaccatacccggcccgacgcggcgccctgctgcgcgcaggagttcgcatggcccacccgtttgaaaccctcacccctgacctggtcctcgacgccgttgaaagcatcggtttcctcagcgacgcacgcgtattggcactcaacagctacgaaaaccgcgtgtaccaagtgggtatcgaagacgccgagccgctgatcgccaaattctaccggccccagcgctggaccaacgaggcgatcctcgaagaacaccgcttcaccttcgaactggccgaatgcgaagtaccggtagtagcgccactgattcacaacggcgaaagcctgttcgaacacgcaggtttccgcttcaccctgttcccgcgccgtggcggccgggcgcctgagccaggcaatcttgatcagctctatcgcctcgggcaattgctgggccgtttgcacgcagtgggttccacccgcccgttcgaacaccgtgaagctctgggtgtgaagaacttcggtcacgactccctcaacaccttgcttgaaggcaacttcattcccaagagcctgctgccggcctacgagtccgtggcccgtgacctgctcaagcgcgtggaggaggtgtacaagaccacgccgcacaagaacatccgcatgcacggcgattgccacccgggcaacatgatgtgccgcgacgagatgttccatatcgtcgacctcgacgactgccgcatgggcccggcggtgcaagacctgtggatgatgctcgccggcgaccgccaggaatgcctgggccagctgtcggaactgatggatggctaccaggaattccacgacttcgacccgcgcgagctggccctgatcgaacctctgcgcgccctgcgcctgatgcactacagcgcctggctggcacgccgctgggatgacccggcgttcccccacagcttcccgtggttcggcagcgagcggtattggggcgaccaggtgctggcgttgcgtgagcagttgtcggcgctcaacgaagaaccgctgaaactcttctaaccgcttttgcttttaatgtgggagggggcttgctccctcccacataaagcgaagcgggtcccactgctgcacaaatatccttacaatcgcgctttgttagctgcctaagcaaggattctgcaatgcaagccgccaaccctcgcaaagggtacatcctgggcctgagcgcctacgtcatctggggcctgttcccgctttacttcaaagccatcgccagcgtccccgctgccgagatcatcgtgcaccgcgtgttgtggtcggcgctgttcggcggtttgctgctgatggtgtggaaacatcccggctggttccacgagttgcgcgacaaccccaagcgcctggcgatcctggccctcagcggctcgttgattgcggctaactggctgacctacgtatggtcggtgaacagcgggcgtatgctcgaggccagcctgggttactacatcaacccgctggtgaatgtactgctgggcatgctgatccttggtgaacgcctgcggcgcctgcaatggatagcggtgggcctggcagcggtgggcgtggcgcagcaggtctggcaggtcggcagcttgccgtgggtgtcgctggtgctggcgttgaccttcggtttctatggcctgattcgaaagcaagcgccggtcaaggcactgccggggctggtggtggagacctggatgctggtgccaattgccgtggcctggctgctgttcaacccgtcggcccacagtgcgcaactggaattctggagtacctccgaagcctggtggctggtggccgcaggcccggtcacgttgatcccactggtgtgcttcaacgccgccgctcggcatttgccctacaccgcactgggctttttacaatacgtcgcgccgaccctggtgctgctggaagccgtattgctgttcggcgaacacttagcgccggccacactgatggcattcgcctttatctgggccggcctggtggtgtacagcctggatgcctggctgagcgtgcgcaaacgctgatcaaataacgtacaaatctctgcaagccacggttttcgtggcttgcagcgttccaccccaaggttatccacaacctgatccccgccatgtgtgcacaagtcattgaaactgctcgttttttgctcaacttacggagaagcaaggccggcgtgggctggcgccgggtctctacaggttatccacaggcccatgcaagatttccatgcataaccctgtgggtcgttactcctcttgacgcaactccaccatcaagtcatcggccaaggtttccagcgacgcttgcaaggactccaacgacaggctcgctggcacctgcaacaacgcttcggcgttaaacagcggatcaccgctcatgggtgccgggcgcacatcggtactcaggcgttccagattgacgccctgctggctcaacagcgcggtgatctcgcgcacaatgcccgagcggtcattgcccaccagcgtcatcacaatcgacttggacaccgacgcttgcccggtgctgccctcgcccaccagcgcacgtatgccatgcgtggataaatcctccaacgcgcccaccaacgcttgacgctgctcggccggcacgctgacccgcaggatcccggcaaactgccccgccatatgagccatgcggctttccagccagttaccgccgtgggcggcaatggtctgggcgatgcgttccaccagtccgggtttgtcggcagcgataattgtgagtacaagatggtccatggcaacgccctctggaattcaatctacaaggtggacccgggagccctcgaaaacaaatcgtgtaccatttttatatttatctggaacaatccaatagttttttgagaacatctggttctccgctgtgaccgtacgaccaaagtgggtcgctaaacgacgtatttagtctaattttcacaaccgcaagtcatcatgtagtatgcgcaaccgtgcactacataatgaaaatctgaaaaagcgcataagctccgcagagtgaggcaagcaatgactgaacacgttcaagtcggtggcctgcaggtcgccaaagtcctgttcgacttcgtgaacaacgaagccattcccggtaccggcattactgccgaccagttctgggccggtgccgacaaggtcatccacgacctggcaccgaagaacaaagccctactcgccaaacgcgacgatttccaggcgcggatcgatacctggcaccagacccacgcgggccaggcccatgacccagtggcctacaaagccttcctgcaagacatcggatacctgctgccagaagccgcagacttccaggcctcgacccaaaacgtcgacgacgaaatcgcgcacatggccggcccccagctggtagtgccggtgatgaatgcccgcttcgccctgaacgcttcgaatgcgcgctggggttcgctgtacgacgccttgtatggcaccgacgccatcagcgaagccgatggcgcagagaagggcaagagctacaacaaagtgcgtggcgacaaggtcatcgccttcgcccgtgcgttcctcgacgaagccgcgccgctcagcgccggcagccacgttgactccaccggctacaagatcgccgatggcaagctgatcgtcagcctcaagggcggcagtaacagcggcctgcgcgacgatgctcaattgatcggcttccagggcccggcggccgagccgattgcgatcctgctcaagcacaacggcctgcacttcgagatccagatcgacgccagcaccccagtcggccagaccgatgcggccggcgtcaaagacgtgctgatggaagccgcgctgaccaccatcatggactgcgaagactccgtcgccgccgtggatgccgatgacaaggtggtgatctaccgtaactggctcggcctgatgaagggcgacctggccgaagaagtcgccaagggcggcaagaccttcacccgcaccatgaaccctgatcgcgtgtacaccggggtggatggccaggacgtgaccttgcacggccgttcgctgctgttcgtgcgcaacgttggccacctgatgaccatcgacgcgatcctcgacaaagacggcaacgaagtgccggaaggcattctcgacggcctgctcaccagcctggcggcgatccacagcctcaatggcaacaacacgcgcaagaacagccgtaccggctcggtgtacatcgtcaagccgaagatgcacggcccggaagaagccgcgttcaccaacgagctgttcggtcgcatcgaagacgtgctgaacctgccacgcaacaccctcaaagtcgggatcatggacgaggagcgccgcaccacggtcaacctcaaggcctgcatcaaggcggccagcgagcgcgtggtgtttatcaacaccggcttcctcgaccgcactggcgatgaaatccacacctccatggaagccggcgcgatggtgcgcaaggcggccatgaaggcagagaagtggatcggcgcctatgagaactggaacgtcgatatcggcttgagcactggcctgcaaggtcgtgcacagatcggtaaaggcatgtgggcgatgccagacctgatggccgcgatgctcgagcagaaaatcgcccacccactggccggcgccaacaccgcctgggtgccgtcgccaaccgccgcggcgctgcatgcgctgcactatcacaaggtcgatgtgttcgcccgtcaggccgaactggccaagcgcgagcgcgcctcggtggacgacatcctcaccattcccctggccagcaacaccgattggtctgacgacgagatccgcaacgaactggacaacaatgcccagggcatccttggttatgtggtccgttggatcgaccagggcgtcggctgttcgaaagtgccggacatcaacgatatcggcctgatggaagaccgtgccaccctgcgtatctccagccagcacatcgccaactggttgcgtcacggcattgtcaatgaagcccaggtgatggaaagcctcaagcgcatggcgccggtggtggaccgccagaatgccggggacgcgttgtaccgcccactggctccggatttcgacagcaacatcgcgttccaggcggcggtggagttggtgattgaagggaccaagcagcctaatggctataccgagccggtgttgcaccgcaggcgtcgggagttcaaggctaaaaacggcctgtaaatgaaaaagccctgatcgagagatcggggctttttagttgggttgagggtgaccgaactggcgctatcgggggcaagccccctcccacattttgaactgcgcagacttttagactgtgggaggaggcttgctcccggtgacgccatcacagcatcaccaaaatcaggaagccatccccaactcccgcttgaccaacttcgccaacttcacgctatcaatcggcttgagcaagaaatccaccacgctcaaatgcatcgcatcgatcacatccggcgcttccgcgtcccccgacatgataatgatgggcagcgccgcacgcgtcgactcacgcacctggcgaatcaactccaggccattgctgggctgcatgcgcaggtcagtgattagcaaaccgatggagctgctggacttcaacaaatcccacgccttctcaccactgtcggcggtcatgcagcgaataccgtccaggcccaggatctccgccagcagttcacgcgcatccttgtcgtcgtccacgatcaacacgcgttgtggcggtaaatcaggctccagcatcacggcgctcagcgcctcgcgctcggcatcactcaaaatatcgtggtcggtcatacgtttctcagcggttctaatcaatctcccagcactcgtcagacatctgcggaggggcgaacaatgtgcacttcgtcggaaagtttgcctagtgggcgttctacggggttcggacgatagtcatgtaaggtttttccctagttttgcgcggttcttatcaacctagacttacgtccaatgggcacctgccgtgcaggagtcgaccatgcagcacgataacgacaaaaaactgcgatcactgttatgagtaaagctgatgcattcgcacaggcaggaaaaactgccgttttgcagaacatccacggcaccctgcaattcctgcaacgcttcccgccattcaaccagatggagcaggcgcacctggcgtttctggtggaacagtgccaactgcgcttctacggacccggcgacagcatcctcaagccctctagtggcccggtcgagcacttttatatcgtcaagcagggccgcgtcgtcggcgaacgaccggactgcgccgataccaccttcgaaatcaccaccggcgagtgcttccccctcgccgcgttgctgggcgaacgtgctactcgcactgaacataaagccgccgaagacaccttttgcctgcaactgaacaagcccgcgtttatcaagctgttcgccctttccagcgcgtttcgagatttcgccttgcgtggggtcagcagcctgctcgaccaggtcaaccagcaggtaaaacaaaaagccgtggaaaccctcggcacccaatactcgctgaacactcgactgggcgaattggccatgcgccacccggtcacctgcagcccgcacacgccgttgcgtgaagcggtgacgctgatgcacgagcagcaagtcggcagcattgtgattgtcgacgagcacaaggcgcccctgggcattttcaccctgcgcgatctgcgccaggtggtggccgatggcgccagcgatttcagccagggcattgaaggccatatgactcaagcgcccttctccttgagcccggaccacagcgctttcgatgcggccatcgccatgaccgagcggcatatcgcccatgtgtgcctggtcaaggaccagcgcctgtgtggcgtggtatccgagcgtgacctgttctccctgcaacgtgtggacctggtgcacctggcccgtaccatccgcaacgcgccacgagtggaaaacctggtggcaattcgtggtgaaatcggccagttggtggagcgcatgctcgcccatggagcgtcgtccacccagatcacccacatcattacgctgctcaacgaccacaccgtgtgtcgcgtgatcgaattgaccctcgcggaaaaaggcgaccccggtgtgccgttcagttggttgtgtttcggcagcgagggccgccgcgagcaaacgctgtacaccgaccaggacaacggcatcctgttcgaggccaaggacgctgtcgaagccgccgagatccgtggccgcttgctgcccctggcgcagcacatcaaccagagcctggcgctgtgcggtttcagcctgtgcaagggtaatatcatggccggcaaccccgagctgtgtttgtcgcgagtggagtgggcgcggcgcttcggcgcgtttatccgtgaagcaacaccggaaaacctgctgggctcgagcatctattttgatttgcgcgcggtgtggggcgatgagcgcggctgcgagcaactgcgccagggcattctcgatcaggtggcggataaccgcttgttccagcgcatgttggcagaaaacgcgctgcgccagcgcccgccggtagggcgtttgcgcgagttcgtgctgacgcgcaaaggcggcgagaaggctaccctggatctcaaggtgcagggccttacaccattcgtggacggtgcacgcctgctggcactggccaatggtatccacgccaacaataccctggaacgcctgcgccagttggtggccaagcaagtgatcgaaccgctggatggtgccgcctatgaagaggcctaccactttatccagcagacccgtatgcagcagcaccaattgcagacccgtgaaaacctgccctattccaaccgcgtcgaccccgacagcctcaaccatctggaccggcgcatcctgcgtgaagccctgcgccaggcccagcgcctgcaaagcagcctgaccttgcggtatcaactgtgagcctgttcagttggtggcataagaaaaaacctggcctggatgcggcgcagcagcagcgcctggcgcaattgcccaagcctcgcgccttgggcgacggcccgttgcgcagccagcgctgggtggtggtggacctggagaccagcggcctgaaccttaaccgtgaccaggtactgtccatcggcgccgtggtcatcgaggatggtgcagtggatttttcccaactgtttgaacgcaccctgcaacgcaccgacaccaaactcagccccagcgtgttgatccacgggctcggccccagcgcgatcgctgccggcagcgacccggccgaagcgctgctggatttcatgacgtttgttggcgacagcccgctgctggccttccacgcacccttcgatcaacacatgctgggccgggcgctcaaggacagcctggattatcgactggcccatcccgttctggatgtagccgacctggctcctctgttgtgcccggacgtcacgctgcgcgaagccggcctggacgactggctcaaccacttcaagcttcaggcaggcgaacgccatcacgccagcgccgatgcactggctacggcggagctgatgctgatcctgttcagccgtgcccggcagcagcagatcgacacgccccatgccctgcaagagcgtttggcccaatggaaacgccgtcaacaagcgccatccttttaatggcatcccgacagacgccaattgcacccacctcacgcctctgacacaatcgcgaataattctcgttagttaaagccccttatttattcggtgatgccgtgtcgtcggttcagaccccacacagtgagcttgttggcgcgttgtatcgcgaccatcgcggctggctgctggcctggctgcggcgcaatgtggcatgtccaagccgcgccgaagacctgagccaggacaccttcatgcgcctgctgggccgggatgagctgcgcgaaccccgcgaaccccgcgcgttcctggtggcgattgccaagggcttgctgttcgactacttccgccgcgccgccctggaacaggcctacctcaccgaattgatgctgatcccggaaagcgaacacccttcgccgcaagagcagcacctgatcctcgaagacctcaaggccatcgaccgtctgctcggcaggctgtcgagcaaggctcgcgccgctttcctctataaccgcctcgacggcctgggccatgcagaaatcgcccggcgtctcggtgtgtcggtgccccgcgtgcgccagtaccttgcccagggcattcggcagtgctacatcgcgctgtacggcgagccgtcgtgaccgccgtcagtgccaaaccggtgtcagcgcgggtgctggatgccgcgattgcctggcaactgtccctcgactcgggcgacggcagcgcggtggaacaggaagaattcgccaaatggctggccagcgatgaggagcatgcccgcgcctggcgccaactgggcatgctcgaccaacgtttcagcgtggcctcgggcccggcgcgggcggcgttgctgcaatcgcgccaaggcattcgccaacgcgtgcgcaagctgggccgtggcctggcgagcatcgtgctggtgtgcggcctggcgctgtttgccggcgagcggtacgtgccgatccactattggctggccgaccagcgcaccgccaccggcgagcaacgcacactgaaactggcagacggcacgcagatcaacctcaacacccatagcgccattgatgtgcacttcgatgaaaaacgccggttgattgtgttgcaggaaggcgaaatcctcgtcgaaaccggccacgacgatgcacggcctttctatgtgcaaacccgcgacggcagtttgcgagcgctgggcacgcggtttatcgtcaagcgcgaagacgaggctacacgcctgagcgtattgcagtctgcggtggctgcccaacctgaggcgctgcatcaggaacaggtgttcaaggccggccagcaagtgctgatgcgcagcgacggcctgggccagacattggctgtcaccccggcctccgatgcctggacccgcggcatgctggtggtcgacaacgcccgcctgggggatgtggtcaatgaactgagtcgctaccgcgccggctacctgggtgtggataacgacgtggccgagctgcgtatcaccggcagcttcccgttgcacgacaccaccctggcgttgaacgcgctgctgccgaccttgcccgtgcagatcaagcagcacacgccgtggtgggtgaccgtagctgccaagccttagattctgtggtgaccgggcaatcgccatcgggagcaagccccctcccacatcggacggtattcacatatccaaaatgtgggaggggcttgctcccgatgaggccttgaaatacaccgccaaaaaaatagtttcacccggccctatcactttcggcttctcgttcggcacctaggcaattgagaaatatttccattcaggagccgccctatgtcccgcacgctagacaccttgttgcgccccagcctgttagccctggccatcgccctcggcaccccgctgaccagcaccgcactggccgctgctgaacaagcctccagcacgcgagcctacaacctgccggccgcgccattggccgccaccctgaaccagatcgccagccaggccggcctggcactgaccctcaacccgacactcgccgccggcaagacctcggccccggtcaagggccagttcgatgcgcagggcgcgttgcgtgaagcgttgcgcggtactggcttgcagttggaacaaagcagtgcgggcacttacaccttggtgccggttccggaaggcgtcgtcgccttgccgattaccaatatcaccggccagggcagctatgagagcgcttgggggccggtggaaggttatgtcgctactcgcacagcagcgggcacaaagactgatacccctatcgccgagctgccccgttccgtcacggtcattacccgccagcaaatggaagaccgctccgttctcaacctcaacgacgcccttcgctacaccgcaggcgtacagagcagtggctatggctccgactcgcgcagtgactggttgttggtacgcggttttgtcccgacccaattcctcgatggcctgccattgcccaaaggtaactacgcatcgccaaaaatcgacacttggaatctggaacgcatcgcggtgctgcgaggcccggcgtcgtcggtctacgggcaaacgccacccggcggcctgctggatatggtcagccgccgcccccaggccgaaagctcaaacgaaattgaagtgcaggccggcagcaataaccacaagcagttcaacttcgatagcaccggcaaaatcgacgacgaaggccagttcctctaccgaatcagcggcgtggtgcgcgacagtaataccgcggtggaccacatccccgataagcgatacaacgttgcccccagcctcacgtggaatatcaacgacgacaccaagctgacgttactcacccagttcacccgcgatgataccggtatcaccggtcagttcctgccattgcagggcaccaaattgagttcgccagccggcaagatttcccatcataagaacctgggcgatccagactgggaattctatgaccgcacttactacgcactgggctatgcatttgaaacgcgcctgaacgacacttggcagttccaccaaaacctgcgctataccaagaacgacttgtcgttccagggcctgaccgccggtggtgcgttcttccccaatggcccggaaaccgcagttgacgctgacggcaacgtgcgtcgttcagccggcaaggtcgatgaggacatcagtcagttcgcggtcgacaataacttgcaggccgacttcaacactggcgccgtgaaccacacactgctgctaggcctggaccatcagcgctccaccagcaatgcgcgctgggactggggttcgaccggcgtgccaaccatcaatttcaaccgcccggtgtatggacaggacttctccaatgtccagtacttcaccatgtatgactacacccagaagacccaacagaccggcctatatgtccaagaccagatggcactgaacaactggcgactgacgcttggcggacgggaagactgggtacacaccggcacgactttccataacctgagcgacgtcaccaacacacaacgcgacaagcatttcagcgcaaatgccgcgctgagttatgtgttcgataacggcatcacaccgtacctgtcctatgccgaatcgttccaagcgggtaccggtacacaagtggccagcaccggggctttcaagccgactgaaggcaaacagtacgaagcagggatcaagtaccagccaccgggcacaaaggctttgtttacagcggcggtatttgacctgacccaaaagaactccacggtgactgagggcagcatcacgcgccagatcggtgaagtgcgcaatcgcggtctggaattggaagccagcgccgacgtcaccgacagcctcaaactggtaggctcctacacctataacgatagcgagatcaccaagggcgcgaccggggaagaaggcaatcgcatgaaccagttaccacgcaaccaggcgacaggatgggccgattatacgtggcgcagtgggttactggacggcttcggcgtaggtgcaggcgtgcgctacgttggcgatacctacggcaacgccgccaacaccgaactcggccatgtaggttcctacactgtctacgacgcctcggtgcactacgacctaggccgtgtgaacagcgccatgaagggtgtcacagtggccgtggacgccaagaacatcttcaacaaggactacctgtccacctgcgacggtttctattgctactacggtgaccagcgcaacgtggttgccagcgtgaactacaaattctaagacggtgaaaaaccgcttatgaagggccgcctgaactgcggcccttttgccttggagccgtgatgaaaagcaaaaccatccgccgctggtccttcatccacacctggaccagcctgatctgcaccgtattcctgctgctgctcgccctcactggcctgccgctggtgttccaccatgagatcgaccatctgctgggcaacgagcccgagttggcgcagatgcccgccaatacaccgcagctcaaccttgagcagttggtgactaaagcccaggcccatcgccccggcgaggctttgcaatacctggcttgggatgaggacgacaagaacggtgtgatcgcaatcatggccgccacagcgggcactgagccgaacgcatcccataccttcatgctcgacgcccgcaccggcgaggcaatggaaacaccatcggcgaacggcgggctgaccctgttcctgctgcgcctgcatgtggatatgttcgccggcctgccgggcaagttgctgctggcattcatgggtattctgtttgtgctggcgattatttcgggcacggtgttgtacctgccgttcatgcgccgcttgaaattcgccaccgtgcgccagaacaagtccacccgcctgcgctggctcgacctgcacaacctgatcggcgtagtcaccctgacctgggcgctggtcgtgggcgtgacaggcgtgatcagcgcctgcgccgacctgctcatcgccgcctggcgccaggacagcctcagcgccctgatcgaaccgtacaaaaacgccgcgccgctgacccatcgcgcaccagccactgagctgctgagcattgctgccagggccgcgcccggaatggagcccgactttatcgccttccccggcacgcgtttttccagtgaacaccactacgccgtgttcatgaagggcagcacccacctgacttcccatctgctgacaccagtgctgatagacgccagcaccctggccgttaccgccatcgccgaacgaccgtggtacatggacgccatgggtctgtcccaaccgttgcacttcggtgattacggcggcatgccgatgaagatcctgtgggcggtgctggatgtgctgaccatcgtcgtactggtgagcgggatttacttatggatcgtgcggcgcaaggcggccaaggtatgaagccgcggcagtcgaatttctggaaagtgtttggcataccgctggggattggcctgttcagcgccgtcgggttgtttgcggcgctgctgggggatggggtgtgggattcgttgagttgggtggggttgggcgtacctgctgccattggcgcctgggcgttgggcaagcggcgcggctgagggcgctatcgggggcaagccccctcccacatttgatttgtgaacgccgtccactgtgggagggggcttgcccccgatgaggccctcaggatcacaaaaatccccctcgccagccactgcgcaagcatctacgctagccccagtccatttcgaggaatgcccatgtccgcccccagcatgaccttgctccacaaccccgcttcgccgttcgtacgcaaagtccgcgtgctgctgagcgagaccggccagcaggaccgcgtggccctgcacgcttgcctgccgacaccggtcaacccggatgcccaagtgctgcaaggcaaccccgtgggcaagatcccggccctgcgcctggccgacggttcggtgctgcacgacagccgggtgatcctcgattacttcgatcaccagcacgtcggcaacccgctgatcccccgagatggctcggcccgctggcggcgcctgaccctggcctcgatggccgacggcatcatggatgccgccgtgctggtgcgttacgagaccgccatgcgcccggtggaaaagcattgggaccaatggctggatgaacagcgcaacaagatccgtcgtgcccttgccgagctggaacaggacgccattgccgaactggccagccacttcgatatcgccgccatcagcgtagcctgtgccctgggttacctcgacttccgccacccggacctgcaatggcgcacggataaccccaagctcgccgcctggtacgccgaggtcagccagcggccttcaatgctgcagacccagccgcccatctaaaactcaccgccgtccactgtgggagggggcttgctcccgattgcggcgtgtcattgggtacatctgtttctgaaccatcgctatcgggggcaagccccctcccacactgaaaggcggcgtgattgaggaagttgaccatcctgttcttcagttgctgatcttcgcgcaatccgatcattgctccatctccaccttgcgcttgcccaccccataccaatccagtttgcgcgtcagcaccatcaccgtacccagcaggccaaacagcaacagcgagcccatcagcagcgcgtaatcctcggcactcagcagcccgtacagcaagccatacaatgccgccagccccgccgagaaccccaagccatgagcaacgctgcgcagcacatggcacacgtagaaaccaatcagcaatacgcaggcactggcggatatcaggtacgccagggcaaagcccacatgctcggacaacgacaacagcagcagatagaagaacgccagcgcgacacccaccagcgcatactggaccgggtgcacggccaggctcttgagcacttcgaacaggaagaagccggcaaaggtcagggcgataaacagcagcgcatacttgatcgcgcggtcgctcttgaggtactggtccaccgggtcgatgaagttcacgccaaagctgcggttggtgaaatcttcacagccttgcccgtccaggcagttttgcagggcctgctcaaggttggtggagaagaatgaagtctgccagttggcgctgaagccctggtcggtgactgcccgttgagccggcaggaagttgccgataaaactcgggtgcggccagttggacgccagcgaaacctggctggtcttgcccaccggcaccacttgcagttgttcggtgccttgcaggcgcaggtcgaaggcgaactccagtaccgcaggttgcttgccgtcctgctccggcaacgtcacatgcacgccctcgcccagccagtccacttgggagcccggcgaaaattccaggcgttggtcacccagttccagcttcagggcgttttcaatcccgcgaatatcgctgatacccaccgccaggaacgccggttcaaaacggtaatcggcaaagttttcggtgatgcccaactgcgcaggcaactcgaaacgcccgctgatacggttgtcggcgtggaacagccgcgcctggtaaatgccccgtgcccgcagttcggtttgcaccttgccgtcaagttcaaagcggtccggcaggaaatacagacgcccgcgctcttcacgggtttcttcatagcgcttgttgagcttttcattgagcttccattcgcgcacggtcttgcgatacggcaccaccatgaccggcccggccaggcgctgggcgtagctggaactgcgggcaatgtccatcaagacgccgtcgcgcagttgctggcggtcgctgatgatgccgttgatcatcagtagtggaatcaacaacagcagaatcagcagcgcaatcgcgccaagtttgaaaagcaggctgcggttcatgggtctctccctgtttgaatgggagagagtctggggaatacgtgtgggggatttatgtgggtaatgtggagactgtatggagatgcagcaccgcttgcacaccaccaggcacattgccgatctgcaacgagccgccgtgcagcttcatcacttcttcgacaaagttgaggcccagcccagtgcttttgcgcccactggccgggcgtggcagcgagtagaagcgctcgctcaaacgcggcaaggcgtagtcgggaatggcgtcggcctgattgaacaggctgacttgcacatcgttatgccgcacctgcgcactgaaccgcagcgcaccaccgggcggggtgaaatccagagcgttgtccagcagattgcccaaggcctggcgcagcaggaagggttcgccaaacaccttcacgtcggcggcaatcgcctgctcgacgtgcaagccggcgccttcgatccgcgcacactgggccttgagtacgtcctcgaccaaggccgccagcgggatgttcgactgttcttccagcccctggcgttgctccacctgggccaggttgagcaagcgctcgatcaactgctgcaggcgtgcactttcgctgtcgatgttgccgacaaaacgctgctgctgttcacggctcatatcgccctgcaacagctccgccgcgccacgaatcgccgccaacgggcttttcagttcatgggtcagggtgtgcacgtaccgctcgacgtaagccttgccctccagctgcgtgcgcatgtgctccacggcggtggacaactgcttcaactcgccgcctcggtaatggggcaactcggcgcgccgtccttcgctgaccgcctctgcataagccgtcaaccgccgcagcgccacgctcaaccaccatgacaacaaagcccccagcagcaagccgagcaccaccagcccggcgccgtaccacagcaggcggcgttcggtgcggtcgacatagggttgcaatgaactgttgggcttggccacggtgaccacgccgataatctggccgttatcgcgaatcggcgcgcccacgtgcatcaccgatgaggcagcgtcctccgccgcactgcgggtggaacgcgcaccgtattcgccgcgcagagtcaggtacacgtcgttccatttcgaatagtcctggcccaccgcttcacccgaggagtcgagcagcaccgtgcccttggcatcggtgacgtagatgcgatggttgacctggtttttcggcaggccccaaatggtcgcacccggctggcgactgccataggccttgagcagcgccggccaatgactctggtcgagagtgccgttcttcacatcctcgcgcaggatttcagccagcaggttggcggtatccaccagggtttcttcggtggactggcgcacgccggggcggatttccttcatcaccgtattgagcacaaagtaaccagtcagcccgataaacagcgcatacaccaggaagatccgcagccccaggcgcatcagccgttgctcgggctgtagctgtagccgaggccgcggtgagtctggatcggctcggcgtccgccgccacgctgcgcagtttgctgcgcaggcttttgatgtggctgtcgatattgcgttcgtaacccgcatcggccggcacccccaccgcgtccagcaattgttcgcggctgaacacgcgctcgggttgttccagcaggctttgcagcaggcggaattcatggcgtgtgaggctcaaggggtgcccgcgatagttgatctgcatgcgctccaggtcgacctggaacagcgtcggcgccacgcccgggccgacccgcttgaggatcgcccggacccgcgccgccacttcccgtgggctgaagggcttgaccacataatcgtcagcaccgatttccagccctaccactcgatcgatctcggcatcgcgcgcgctgaggaacatcaccggcacttcgctgaagcggcgcaattgcttgcaggtttcaaagccggtgatgtccggcagaccgatgtcgaggatgatcaggtcggcagggctctggcgctgatgctccagcgccgcctggccgagagtcagccaggtggtggtgaagccttcgccttgcagggcaaagatcagcgtgtcggcaatcgccgcttcgtcttcgacaatcaggatgtgcggcatgggttcaatcagcagtccggtttgtcggcagtgtagcgacgtgccgggttcaccgccgcgccaaattcacgcagggccttggcgccgatcagcagcgggtaattgaagctgctgcggtcggtgaggttgacctcgacggtgcgcttgacgttgcccaggcacatttccagatcgaccaccgggcgcttggccaccgagggctcgtccttgtcgtcgtcttcgtcggcacggctcttgatcttgctgatacgcgacaccttgtgctcgtagaccttgttgccggcgtccttgccgccaaggcggaagcgcacccaatcatcgccgtcgcgggtgaaggtctcgatgtcacgagccgacagcgaagcggtcaacgcgccggtgtccatcttggccttgaaggtttcgccgatctccggcaactggatgtattcgtagcgaccgtaaagggtcggttcggcggccatgacaggcagggtgacaagagcgagggaggcaaataacagtttcacgaagtgatttcctcggaaagaagtaggcggattctagaccgcaaaagcggcacttagttagtgacggccaccctacacggcacattgtgaaacattcgtccgttgatttgcgatttggcctctagactcaccttgcttatcatggcccgcccacaagatcccaagagttatttatgcgccgcctgctcaccggctgttttgtcacactgctgctgttgcttaacaccctggtgctgttcgggccgctgatggtgtttgccttgctcaagctggtggccccgggtcgctttcgcgactatatgtcctgggcggtgatgtggatcgccgagacctgggccgagatcgacaagctgatcttttcgctgtgcattccgacccaatgggacatccgcggtggcgatgacctgcgcggtgacacctcctacctcgtcatcagtaaccaccagtcctgggtcgatatcccggcgctgatccaggcactgaaccggcgcacgccgttcttcaagttcttcctgaaaaaagagctgatctgggtgccgttcctcggcctggcctggtgggcgctggattatccgttcatgaagcgctacaccaaggccttcctggccaagcacccggaactggcgggccaggacttgaagatcaccaagcaggcctgcgagctgttcaagcgccagccggtgacggtggtcaattacctggaaggtacgcgcttcaacgcgaccaagcacaagcagcagaattcaccttttacgcgcctgctaaaacccaaggcgggcggcgtggcgtttgtactggcggcgatgggtgaacagctggacgcggtacttgatgtgaccgtggtctatccacagcaaaagattccggggttctgggacttgatcagcggcgcggtgccgaaggtgatcattgacatccgcactcgcgatctggacccggcgttatggcagggggactatgagaatgatccggcgttccgccagaccgtccagaactgggtgaaccagctctggatggagaaagatgcgcgcatcgaccaactgcgcgcggggcgggcctagctgccagtaccccaggcttgagcgagtttgctaagcactgaattgctggcgccctggccgcccaggtattgcaggatcaccggggcaaactggctgaccatcccgctgtccatgcccagcgcactgaacgcggtattcaggtcattggtgttcttcacgtcacccagcaaaccatcaaggccgctggtcttgctgccacccttctggccgagcaggccgctcaaggcgccaaggctgcccaatgcgttgttgcccgacaactgatcaagacccggcacgctgttgcccagttgcgaatagtcgttgccactcagtttgttcttggccaggcccagcatcgcgccggtaccaccgacagcctgttcgggggtgatgttgagttgcgaagtcagggtgctgagcaagccggccgtctcggacgacggtgcagcggctgcggccttgttgttcccgccttgcatgcccgagatggcattggccgcgtcgccaaggctgaagcctgcggcgaacaccgggcctgctgccagggtcatcacacaggaaagggcgaaaccgcgtgaaatcttcatcaagacaacctctgaatgtgggagcaaaagcaggcgttggactgggtatctcgtcggttgttccaaggccaccctggaacccatcgaggataagggggtccatgcactgactacaaaatttgtcaggaagagacttatgactgcgatccaaccccaagtgattgagcaaaagcctccgttctggagccgcccgcgcctgttcatcggcgcctgtgtggtagtggttgccggcatcggcggcgccctctacacccaggacagcgtcaagtccgccgctacgctggtgaccactacccagcagccagcggcacagatcatggcccacaaggattacctggaagtgcagccgattgcctccacggcgccagcaccggaccagagcctggagctgtgggccattcctgaaggtggcacgccggtttcgttagggctgctgccggaagacggcaagggcatcattggcctcaacccgcgccagcaggaatcgatcagcaagccggtggagttgatggtgagctcggagagcaagggcggctcggtgagcaaacagccgacaggcccgaccatttaccagggtgcgctggccacacgctgatccccctcccacatttgatcttcagtgcagccttaagcggcagacgcaaaaaagggcgacccacgggtcgccctttttcatttgcccaacgctttacgctgcactgaacaacttatgcggatcaatcacaaacttcttcggcacacccgcatcgaactcgccatacccacgtggcgcatcgtccaggctgatcacctgtacgccaacgatctcggcaatgttgatccggtcccacatgatcgcctgcatcagctggcggttgtacttcatcaccggcgtctgcccggtgtggaagctgtgggatttggcccagcccaggccaaagcgaatgctcaggctgcccattttcgcggcggcatccaccgcgcctggatcttcagtgacatacaggccgggaataccgattttgcctgccacacgtaccacgcccatcagtgagttgagcacggtggccggagcttcggccttgacgccgtcgtgaccatggccgcgtgcctcaaagcccacgcagtcgacggcgcagtccacttccggctcgcccagcagtgcggcgatttgttcgtgcaacggtgtatcagtggacaggtcgacaatctcaaagccctgggccttggcgtgtgccaggcggatcgagttgacgtcgccgatgatcaccaccgccgcaccgagcaggcgagcagaggcggcagccgccaggccgaccgggccggcaccggcaatgtagacggtgctgcctgggccaacgccggcagtgacagcgccgtgataaccggtgggcaggatgtcggagaggcaggtcaggtcgcggattttctccatggccttgtcgcggtcgggcagtttgagcaggttgaagtcggcatacggcaccagcacgtattcggcctggccgccggtccaatcacccatgtccacataaccgtaggcaccaccggcacgggccgggttgacggtcaggcatacgccggtgtgttgttccttgcaggagcggcagcgcccgcacgccacgttgaacggtacggaaaccaggtcgccgattttcaggttttcgacgtcgctgcccttctcgatcacttcgccagtgatctcgtgaccgagcaccaggccggtctgggcagtggtgcggccgcgcaccatgtgctggtcggagccacagatgttggtggagaccacgcgcaggatgacgccgtgctcgatcttcctgccacgggggtcctgcattttgggatagtcgattttctgtacttcgaccttgccgttgccgagatacacgacaccacgattaccagacatgctttcacctcgctgttgtttttgtggaactgcgttgccgcttgggtgggcagcgcgtttaagtgctcgggtacagatgctgtttttgcgttgtttgtgagggcctcatcgggggcaagccccctcccacattgggaatgcaatctcctgtgggagggggcttgcccccgatggcgccagtcagagcaccaccgtccgattggcgttcaaaaacacccgtcgctcaatgtgatagccaactgcacgcgctaacgtcagcccttcgatatcccgccccttggcaatcaaatcctcgggatagtggctatggtctaccacctccacaccctgggcgatgatcggcccctcatccaaatcgttattgatgtaatgcgccgtcgcgcccaccagcttcacgcccttgttgtacgcctgatggtagggcttggcgcccttgaaacccggcagcaacgagtgatggatattgatggccttgccatccagcttgcggcacagctcgggcgacagcacttgcatatagcgcgcaagaatcaccaactctgcgccagtgtcttccaccacctgccacacctgacgctcctgggacggtttgtcgttggggtcgagcgggaaatggtagtagggaatctggtgccagtcggccaacggcttgagatcgggatggttggagaccaccgcaaccacgtccatcgacagctgaccgatgcgctggcgatagagcaggtcattgaggcagtgatcggccttggagaccatgatcaccactttcggccggtagttcggcgcggtcagctcgaaaatcatgccaaaggcttcaccgcgtgttgccaggccatcgcgaaacgcctgctcgtcgaaaccgtccggctggcggaattcgacgcgaataaaaaaccggcccgagaggcgatcatcgaacgagtggtgttcagtgacatagcagccctgctcgaacagatagcgggtgaccgcgtccaccgtgccgagcacgctggggcagtcggcggtcaaaatccatgtatcgggtgcgcggctcatgggtcactcctcaggcttggacactcaggccaaactcggccgaggcatcctgcaaccacaaccaccagtaatccgagaagctgcgacggatcaccagctcccaggtgtcttcagcggtatggcggatcaccagttgcgacttggcgaacactgtgcccactgccttgcccaccgggaagttgttggggtgcacgtcgtagctggtggacttcatcagcacatcgcgcacattagggccgctgagttcgagaacctgctggccgccgctgacgttgacgatctggatgtgcaaatcacccaaggcggcacgcaggttctgttcggcggcgaattcttcgccgctcggcacgatcagcaaccactcatccgggccgagccactgcaggctggtttcgcctttgacgaccacgctcagtgggccgggaagctcaatgccgacggccttgtgtacgccagcggcgaaggcggcatcatggccatcaccgcggatagtcaggtggccgaggagtttcttttcgcgcacggtcacgccggcgttcttgcggcccttgccgaccaggctggcgaggtcggcatggtgcagcgacgactcggccttggcaccggtggtggggcgttgttggtaaacgttggctgctgtcataaagcacctttcctgaattctgttgtgaggctgatggcctcatcgggagcaagccccctcccacattttgatttgtgaataccttcaaatgtgggagggggcttgctcccgatggccgcgacgcggtctatcagatgttctggcgatctcctttcggatcgaagaacaccgaaggcacaatttccgcctcgatcacgctgccatcggcctgcggtgagaacacccgctcgccgatgcgcttcaagccgcccttcaccactgccatcgcaaacgaatagccgagggagttgtgcgcatagcttgaagtgacatgaccgaccatcttcatcgggatcgtctgcttcggatcgaacaccagttgcgcgccttccggcagccacacgttcggatcaatcggcttcaagcccaccagttgcttgcgctcttcacgcacgcagtcttcgcggttcatgccacgccagccgatccacgagaacggtttggtgcggcccacacaccagcccatgttcaggtcgtccggggtcatcgagccgtcggtgtcttgcccaacgatgatgaagcccttctcggcgcgcaatacgtgcatggtctcggtgccgtacggagtcaggttgtacttcttgcccgcctcgacgatctgttccagcacgcccatggcgtagtcggcctgcacgttgacttcgtacgacagctcaccggtaaacgagatgcggaacacccgcgccggtacgccgccgaccaggccttccttccaggtcatgaacgggaaaccgtccttgtccaggtcgatgtcggtcacttcactcagcagcttgcggctgttggggccggacagggtcatggtcgcccagtggtcggtgaccgaggtgaagtacaccttgaggtccggccattcggtctgttggtaaatttccagccactggagaacgcgcgccgcgccgccggtggtggtggtcatcaggaagtggttgtcggccaggcaggcggtgacaccgtcgtcgaagaccatgccgtcttccttgcacatcaggccataacgcgccttgcccacgtcgagcttggtccaggcattgctgtagatgcggttgaggaactcgcgggcgtccgggccctggatatcgatcttgccgagggtggaggcatccagcaggccgacgctgtcacgcaccgccaggcattcgcgtttcaccgcggcgtgcaggtcttcaccgttgcgcgggaaataccaggggcgcttccactggccgacgtcttcaaattcggcgccattcttcacgtgccaggcgtgcaaggcggtgtagcgtaccggttcgaagatgtgcccacagtgacgccctgctatcgcaccgaaggtcacgggcgtgtagttgggacggaacatggtggtgcccatctgcgggatggtcacgttcagcgaccgtgcggcaatcgccaggccgttgacgttaccgagcttgccctgatcggtgccgaagcccagtgcggtgtagcgcttgacgtgttccaccgactcgaaaccttcgcgcgtggccagttcgatggcagcagcggtgacgtcattttgcaggtcgacaaattgctttggcgcccgtgcggtagctttctcgtggggcacctggaacagcgccagggtcggttcttccagacggctcaaggcctttggcagcgtaccttccaccggcgcaaaaccggcttcgctggcggcgcgcacgccgccttcaaaaccatcggccagggaatcgccaagcccatagacgccgttgatgccgccgacgcatacgcgtttctgtggtgcttcacccggtacaaaaccgaggatgtcttcgcgccaggtcggcttgccgcccaagtgcgaggccaagtgaaccaccgggctgtagccgccggaactggccaccaggtcgcagtccagccattcgccggggctggtgactttatgcgctttgacatcgatggcggcgacgcgcacaccggtcacatgcttgctgccacgggcttcgatcacggcgctgccggtgaggatgcgaatgcctttggcgcgggcctcctcaaccagggcgccgcgggggttgtggcgtgcatcggctacggcgacgacttggagaccggcatcgaaccagtccagtgctacgcggtaggcgtggtcgttgttggtcgacagcaccagctttttacccggtgccacgccgtaacgacgcacgtaggttgaaaccgcaccggcgagcatattgcccggcacgtcgttattgccgtacaccaatggacgctcgcacgcacccgtcgccagtaccacgcgcttggcacgtacgcggtggatacgctggcgtaccacaccaatcggcgcacggtcgccgagatgatcggtaaggcgctcgtggatagtcaggaagttatggtcgtggtaaccgttgacggtggcgcggggcagcagcaccacgtccggcagggctttgagttcagcgatcacgctggcaacccattcggtggccggcttgccgtcgaggctttcgcgggagtcgagcaaagacccgccgaactcttcctgctcatcggcgatgatcacgcgcgcaccgctgcgggcggcagccagtgcagcggcgaggccagcagggcctgcgccgacgatcagcacgtcgcagtgacggttgaagttgtcgtaggtgtccggatcattctcggtcggcgagcggccaagaccggcggctttacgaatgtacttctcgtaggtcatccagaacgattgcgggtacatgaaggttttgtagtagaaacccggcggcatcagcttgccgccgaccttgccgagaatccccatcatgtcgttgttgacgctcggccagccgttggtgctggtggcgaccaaaccctggtacagcgcctgctgggtagcacgcacgttgggaatctgggtagcttcggtggcgccgatctgcagcactgcgttcggctcttcggcgccggcggcgaaaatgccccgtgggcgcgagtacttgaagctgcgaccgatgatgtcgacgccgttggccagcaacgcggcggccagggtatcgccttcaaagcctttgtaagtctggccgttgaaactgaaagtcaggactttattgcggtcgatgcggccaccgttggacaggcgattgatctggctcataccttctctccagaagccttggcggtgaactggggtttttcgccaatcttgtaggtttcaagaatttcgtaggtgacggtgtcgcgggtagcgttgaagtactggcggcaaccggcggcatggatccacagctcgtggtgcaggccgcgagggttgtcgcggaagaacatgtagtcgccccactcttcatcggtgcaggcattcggatccagtgggcgcgggatatgcgcttggccggacgcatggaattcctcttcggagcgcagttcgccacagtgaggacagaagatatgcaacatagggaatttctcctgttagtgggcgacggccgcagcgccgtgttcgtcgatcagcgcaccgttgtggaaacggtcgatggagaaaggcgcagccaatgggtgcatttcacctttggccaggctggcagcaaagacgttgcctgaacccggggtggccttgaagccaccggtgccccaaccgcagttgaagaacatgttcggtaccggggtcttggagatgatcgggcaggcgtccggcgtggtgtcgacgataccgccccactggcggttcatgcgcacccgcgacagcaccgggaacatctcgacgatggcctggatggtgtgttcgattaccgggtacgagccgcgctggccgtagccgttgtagccgtcgataccggcgccgatcaccaggtcgcccttgtcggactggctgatgtagccgtgcacggcgttggacatgatcacgctgtcgataatcggcttgatcggctccgacaccagggcttgcaacgggtgggattcgatcggcaggcggaacccggcaagcgaggccatgtgcccggaattaccggcggtgactacgccgacgcgcttggcgccgataaagcccttgttggtttccacaccgatgcacacgccgttttccttgcggaagccaatcacttcagtctgctggatcaagtccacgcccaaagcatcggcggcacgggcgaagccccaggccacggcatcgtgacgggccacaccgccgcgccgttgcacggtggcgcccaggacggggtagcgggtgtttttcgagcagtccaggtacggaatctcgtcggccacttgcttggcattgagcaattcgccgtccacgccgttgaggcggttggcgctgacgcggcgttcggaatcacggatgtcctgcagggtgtggcacaggttgtagacgccgcgctgggagaacatcacgttgtagttcaagtcctgagacaaaccttcccagagcttcatcgcgtgttcatacaaatgcgccgactcgtcccacaggtagttggaccgcacgatggtggtgttgcgcgccgtgttaccaccgcccagccagcccttctcgaccacggccacgttggtgatgccgtgctccttggccaggtagtaggcggtcgccagaccatgcccgccgccgccgacgatgaccacgtcgtagacttttttcggcgtcggagtgcgccacattttctgccagttttcgtgatggctgagggagtgcttgaagaggccgaagcctgagtagcgttgcatagtcattactccaaaaccgcgctcagcgataaaccgggaaatcagcgcacagggcagacacgtgcttggccacgttggcctcgacatcggcatcgccgaggttgtcgaggatgtcgcagatccagccagccagttcgatgcattgcggcaccttgaaaccacgcgtggtcaccgccggggtgccgatgcgcaggcccgaggtcacgaacggcgattgcgggtcgttcggcaccgcgttcttgttgacggtgatgtgggcgcgaccgagggcggcgtccgcctctttgccggtgaggccctggcggatcaggctgaccaggaacaggtggttgtcggtaccaccggagaccacgtcatacccgcgcttgataaatacgccggccatggcctgggcattgtcgatcacttgctgctggtaggccttgaagcctggctcctgggcttccttgaagcacactgccttgccggcgatcacatgcatcagcgggccgccctgggcaccggggaataccgcggcgttgagtttcttttcgatctcttcgttggccttggccaggatcaggccgccacgcggaccgcgcagggtcttgtgagtggtggtggtgaccacatcggcgtagggcagcgggttcgggtacaggccagcggcgaccagaccagcgacgtgggccatgtcgacaaacagcagagcgccaactttgtcggcgatggcgcgaaagcgtgggaaatccagggtcttggagtaggcagaaaaaccggccaccaccatcttcggcttgtgctccaccgccaggcgctcgacttcgtcgtagtcgatcaggccagtgtcggtgttaatgccgtactgcaccgcgttatacagcttgcccgaggacgacaccttggcgccgtgggtcaggtgaccgccgtgggccaggctcatcccaaggatggtatcaccggcgttcagcagcgccaggtacaccgcactgttggccgaggagcctgagtgcggctgcacgttggcgtaatcggcaccgaacagctgcttggcgcgttcaatggccagggcctcgaccttgtccacatgttcgcagccgccgtagtagcgcttgcccgggtagccctcggcgtatttgttggtcaggccgctgccctgggcttgcatgacgcgcttgctggtgtagttctccgacgcgatcagctcgatatggtcttcctgacgctgctcttcggcattcatcgccgccaacagtgcgtcgtcatatccctggatctggtcttgtttgctgaacatcgcgtctctcccagcctttcgtattgttgaggcccgtgcagggccctttgatgcgatggtagggctggcgcagacaggccaaatgcctgcgcacgccacgcaaaggtgcgtttacgacattgaccaaacaacaccgaacaaatgtggaacagggcttgtgtgggagggggcttgctccctcccacaggggttaggcgatgatctgacggacgaatagcagcaggaggaagtgcagcggatagagggtgtaggcccagcggcgcattgcgggcggtgaggcgctgcgggcgtgtcgcaataaaaccatccccgccaatggcgcaatcagacagatcgccaacccggaaagcgccacaggcgtgccgctattgagcagaatctgccattgattcgcggcgacgcagaccaaacccggcagcacgctgaaataccagggcctgcgaaacaccagcaacatcgccagcggcagcaacacaccaaagaaaccgaacatcaactgagttgaaaatactgccgccattgtaacggcgatcagcgccaatcctcgatcaagcaacgccttctgctgccaacctcggacaaccagcaggcccagcgccagggtcggcaacacattcaatgtatcggcatcatcgataaacatccgatacggcacttcgctgatcacgctaaacagtagcaaccaacccaggtagcgccaatgaccggtcaccggcgcgttccggagccgatgcacattggctgcaatcgccaggcaaaaccacgggaacgccaggcgccccggcacatacaggccatccaggcttaacccgacgtagcgcaggtggtccagcaccatgctcagcaacgccagccacttgagcaagtccaatgcgccatcacggacacgtcctacaggagccgttacagtactgtgcataattccccagtgactttgcatttacagtgcgtgcgcctcctcgacaatcttggttaaagtgcgcaccaacatcgaccacaggaatgggccatgaccgacaagagccaacaattcgccagcgacaactattccggcatctgcccggaagcctgggccgccatggaacaagccaaccacggccatcaacgcgcctacggcgatgatgaatggacccaccgtgccgctgacggtttccgcaatctgttcgagaccgactgcgaggtattctttgccttcaacggtacggcagccaactccctggcgctgtcctcgctgtgccagagctaccatagcgtgatttgctcggaaaccgcccacgtcgaaaccgacgaatgcggcgcgccagagttcttctccaacggttccaagctgctcaccgcccgcaccgaaaacggcaagctgactccagaatcgatccgcgaaatcgcgctcaagcgccaggacatccactaccccaagccgcgcgtggtcaccctgacccaggccaccgaagtcggcagcgtctacaccccggaagaaatccgcgccatcagcgccacctgcaaggaactgggcctgaacctgcacatggacggcgcgcggttctctaacgcctgtgcgttcctcggttgctcaccggctgacctgacctggaaagccggcgtggacgtgctgtgctttggcggtaccaagaacggcatggcggtaggtgaagcgatcctgttcttcaaccataagctggctgaagacttcgattaccgctgcaagcaggctggccagttggcgtcgaaaatgcgctttctgtcggccccctgggtgggcctgctggaaaacgacgcctggctcaagcatgcgcgccacgccaatcactgtgcgcaactgctgagcagcctggtatcagacatccccggtgtggagctgatgttcccggtacaggccaacggcgtgttcctgcagctctcggaaccggccattgcggcgttgacagccaagggctggcgcttctacaccttcatcggcaaaggtggcgcgcggttcatgtgtgcgtgggataccgaggaagaacgtgtaagggaattggctgcggatattcggacagtgatgggggcctgaagctaacgaatactggcggagtgccgagactgttttttgatatttctgacaggcacgaacttggattttattgtctagcctcttgttacccgcaaggaaaagccgctgcagaggccgccttgcggggacaactgcctgccgaataatcggccggaaacggaaatccagcagagagccaaaccatggaatatcaaagcaacgccagcatccttaaaagcgacgacactgccagtaccacggtgattgattgggatgagttcaggacgcacgcaaaggtcggggacactatccgcgagccgtccaggacgttgaggatctacgacaaagtctatgaactgacagcatcaggccaacatttcgtggttcatatatacgcccaataacccttaacgcctaaaggccgcgccggggattcatggcctccgacgcggaaccgaactgacgtaccagcccttacttacaaagccttcggctggagcgccgcccattcatcgatggggcctgggttattgataaaggtacctccaccgaacttcaccgccagtttattaaccgcgttcagggcagtggtcaccgcgccttccccccagccaccggtaaaggacacatcatccccagcaagaatgaacccatcgggactcgggctatgcacatcgttcataaactgggaaaacaacaggcgctggtattcgtactgccctggcaggttcattttgaaggcgcttagaaaaaacggctgctcttcccaattgatttcgacaaatgggtctgtcatgccgaactctgcgccaaggtctagctgatggtgggcatacaccgagtccagcaaggttgaacataccgccacatgggacggcaacggcacggcacggtcacccaggaacttgaggctgtcgtcattccaggcgtaagacaaaaacatcccactgcccttgtacgaacctttactcgcagcgtagtccaacagataggtgccccgggtaattcgatccgacaacgtcacactcatcttgtgttggtgatccgttccgacatcggtccagaaaggtcgcttggtttgcgcaaatatcttggccgactgcatgtagtgggtgtacatcaccgcttcccattctttagtcgacaaaaggtcattcatctgactgaagcgaccggcaccatccatgtaacggaatttgtccagtatccgcttgtggggggtatagaccacggcggggaagacgtatcggctctcagttttctggacatgatcataaatccacacgtcgaactgatcgtcctctgatcgccgtatgatttgccgcacttcttgattcaacatctgcggaatgacttgggcactcagactctcgacagtagttcccgccggccagtggtccatgctgtcgcccatcatgtccgggctacgtgacaacaaccggcgcggcagctcactggagccgtcgtacatcaacttatggttggtatccaggccggtgtacaacacccgcagcacctccagaaaactgttcgggtagtcggtattccatcccccggtaccaaaaccgatctggccgaacaggtcgatatcctcgcgactccattttgcctgctccaccatggccgcaaaaaagctcaggttgtcccaacctgcgtccaaaatggcgttccacagcgtcttgatcttcgcctgatcaatgctttcctcggacattgccgcttccatctcgcggaaattgatcggctgttgttccaggaaaatatcgaacaatttacgttcgatttcgacatatttatcgggcaatttatcgcgttcgtaatagacctgttgctgctggtaatcgaccactgtacttggcgtggaagccgcgcccgggttgggaaagtcagtcgaattggctgacatgccaaccttgtcgaaatagtgcatcagcgccttgccggaaacgggaaaacgcatggcgcccatttcacatataacgctgttgccggggtcctgcggatcacctgtcacatgggaatagaaccgcccaccaatacggtcactggcctccactaccacggggtgcaaccccatgcgcatggcttcataagccgccacagcgccggctactcccgcccccacgataagtacctggcggcaactcgtaccgctggaaacccgccccaacggcctgtcgtcgctgacggcctgattgagaaaacgggagtaatgaaaggggaagtctgggataagcgctgtgacaccttgggccaacaaacgcgcggcaccttgagaacgagaaggaatagcagacatgttgatcatccttggtgtgtcaaaggacgtccgcctacttcttcactgcaaagggcgactacgacgagttcgctctagcgtagacgcttgtaggaaatctctctatatcaactagaaataaaaggtacgtgcgtaaggcaagccctgcttagactggacttgcgcaatcagttcagaaattcctgaagtgattatttgcgaatgccgattcaaatgtacttttgcttacaagactctccgtggtctcactcaataaaaacagaccgtgatatctatgaacacgcccccagaacgatcaactgctgcgtcttccaccacgctgaaagttgaaacccgctccattgactatgtgccgcgccatgaacgccacggcaaggtttggcatcaagcgccgttctggttcacaggcaacttcgtactgaccaccatggtcaccggctttaccggcgcggcgctgggcctgagcctgatgtatgcgatcctggcgattgtcatcggcgtgtgcctgggcacctttgccatggccttccacgccaatcagggcccacgcatgggcttgccgcaaatggtccagtcacgggcacaattcggcttgcgcggggcaatcgtgccctttatcgcagtggtcttcgtgtatatcggtttcaacgtcttcaacgtgattctcgcaacagacgcgatcaacaccgtgctgcccggcgagcgcgccccctggtacgccttgatgatcatcctggcagtgatcattgcagtagtcggccacgacctcctgcacaccgtacaacgctggctgacctacgtgatgatcagtgttttcaccgtactgacggtggctgctttgatgagcctgcaagccgattcggcggtggtgggcgcgcacttttcctggtcagccttcttgattcaactgtccgccgccgcgggctaccagatcagctacgccgtgtacgtgtcggattactcgcgctatctgccgcacaccacgcccacgcgcagcgttgtcacctggacctacctgggcgccgccggctcagcgctgtggctgatgtcattgggggctttcctcgcgtcggccctgccctctccggatgctatcgccagcgtgcaggccgtgggcaaccaagtgatacccggctttggcacctttaccgtattgatcgcggtgcctgcgctggtgggcatcatggcggtcaactgctatggcgccatgctcaccggcatcagtgccatcgacggcttcatctcgatcaagccgcgcctcaagagccgaatcatcggcatcagcttggtggccgcggtcatcttcgtgatcgccctgagcatcccggagagctacctgcacagcttcaataacttcgtcctcttgatgctgtatttcctgtgtgccttggacggcggtaaatctcgcggactactatgctgtacgcaaagggcgctacgcaatcagcgacctgttcaaccctggcggcatctacggtcgctggtcgagcgccggcctcaccgcgtatttcttcggcatcgcagcgatggtcccgttcatgtccctgggtttttaccaaggcccggtcgcactatggctgggcggtgccgacatagcattcgtggttggcctggtggtctcggcggcgacctattgcatcatggcccgacgcctcgatcacgcccgtgaagcccgcgccgtggaggccagtgaacggctattggaaggagaagagtcatgaccgcaataacggtcgtttgccatcaactggccccccgtattagcgatcttgattacaaccgggcgctaagcgaaagcgcaatccgtggcgcaagtggggcacaggtcatcgtcctgcccgaactgatgcaaagtggttacgccttcgataaccgaggggaagcccatgcggcttccgagacagatgacggcccgaccctgagcctatggcgcgccttggccagtgaactggatatcatcatcgtcgccggcttctgtgagcgcctgagtgctggacgggtcgccaatagcctcgcgttgatccaacccgcaggccggctgacggtgtatcgcaaagcccacttatggaaccgggaaaagctgatcttcacgcccggcaccgaaccaccgccggtcgtcgaaaccaaaatcggccgggtcgccgcgatgatctgctacgacctggaactacctgagtgggtgcgcctggccgccttggccggcgccgacctgctgtgcgccccggtgaactggccggacggtccacgcccggccgacgagcggccgggggagattgttcgcgtccaggccaatgctggggtcaatcgcatgttcattgccgcctgtgaccgctatggcgaggagcgcggtataaactgggtgggcggctcgaccattgtcgatgccaacggttacccgttggccggcgcagtctcccatcagagggaacagcggctagtcgctcaactacctctggccgaggccagagacaagttcatcagcgagcataaccacgttcaccaggatcgccgaccgggcttgtactgacctctcaaaactcaatccgcacatcacccttcggcacactgcagcacgacaggatgtagccttcggcttcgtcttcctcagtgatcccaccgttgtgctccatctccacctcgccgcccagcttcatcaccttgcatgtcccgcagatgcccatgccgcaggccttgggaatcagcaggccgagcttggcggccgcggcgtgcaccgtttcacccggtgctacacgaatgctcttgccggaggcaatgaactccacctggtgcagatccgccaagtcgatctccggcgcatccgccgcttgctcggcttgctccactgcatcggcccgcgcttctggcggcgtcgcgccaaaggactcttcgtgatagcgcgccatatcgaaaccagcggcttcgagcaggcgcttcaccgcgctcatgtagggcgtcgggccgcagcagaacacttcgcgctcgaggaagtccggcaccatcagttccagcatcttgtggttcaggtaaccacggtacccggcccaaggctctcccaaaccatgcttttcgcagatcaggtgcagactgaagttgtcgatccgcgacgccatgtgctccagctcgcggtggtagatgatgtccttgggcgagcgggcgctgtgaacaaaggtcatgtcgacattcgcgttggtgtcgtagaaccaacgggccatggacatgactggggtgataccgacgccgccgctgaggtacagcactttcgggctgggaaagtcgatggcattgaacagccccaccgggccgtgcaccgccagctcctgcccttcatgcagcgtgtcgtgcagccagttggagaccttgccgcccggtacgcgcttgatggttaccgaaaagctgtagggcaccgagggcgaactggaaatcgtatacgagcgcatgatcggctggccttcgatctccagctccagggtgacgaattgcccgggcttgaaaaagaacaggatcggctggtcagccatgaagcagaaggtgcgcacgtcccaggtttcctggatgactttgacgcaacggacgatgtgtcgaccattggcccaggtctgggtggttaccggattcaggaaattgctagacatgttgttctccaccgccgacgtcggccttatggtggcgattctgcgtaacgccggggccacccatttacctatctgcgacattcacatacttacggcgaccagcccccaactaccgggggttgcgcgtcgggatcagattgcgccatgtcgcccatggataaggttcgacgcaacgccgggcccacactcgctcccaacaaagacgctttctttacgccttgcaacgcaacaaccgtagccacttatcccggccacacagaatggccacgaggacacatacgatggacgtcaccgcaaccttaagcttgggcgatccgctggaacccgcacgcaaggccaccgcgcaaatgctgcacgagcgcgagcgcaccttttcactgccgcagccgttttactctgatgagcggttgtttgatatcgacatgcaggagatcttccagaaagagtggttgatcgccggcatgacctgcgaaatccctaccaagggcaactacctgaccctgcaagtgggcaagaacccgatcatcgtgatccgtggcgccgaaggcgtggtgcatgcattccacaacgtgtgccgccatcgtggctcacgcttgtgcaccagcgacaagggcaaggtcgccaagctggtctgccactaccaccagtggacctacgagctggacggtcgcctgttgttcgccggcaccgagatgggcgctgatttcgacatgaagcagtacggcctcaagccggtgaacgtgaagaccgccggcggctacatctttatcagcctggccgagaacccgccggccatcgatgacttcctgtcgaccctgaatcactacatggaaccctacgacatggaaaacaccaaggtggcgatccagaccaccttgttcgaaaaggccaactggaaactggtgctggaaaacaaccgcgagtgctaccactgcaacgcgtcgcaccccgaactactcaaaaccctgctggagtgggacgacgtcaccgaccctcgcgccgaccaagctttcaaggaccatgtggccgcttccgccgccgcctgggatgccgagaagattccttacgcccacgccagtttcggcctgcgcaaccgtatcgtgcgcatgccgttgctcaagggcaccgtgtccatgaccctcgacggtaaacagggctgcgccaagctcatgggccgtatcaagaacccggacctgggttcgatgcgcatcctgcacctgccccactcctggaaccactgcatgggcgatcacatcattgtgttcaccgtgtggccgatcagcgcccaggaaaccatggtcactaccaagtggatcgtgcacaaggatgccgtggaaggcgtggactacgacgtggagcgcatgcgccaggtgtgggacgccaccaacgaccaggaccgccgcctggcggaagagaaccaacgcggcatcaactccaccgcttaccagcctggcccatactccaagacctatgagtttggcgtggtgaattttgtggattggtacagcgagcgcatgttgaacaacctgggcgccgctccagcgccgtacctcaaaggtgtggcagcacacgaataactgacaccctatggatcaaaatgttggagggggctttttgtaggagcgagcttgctcgcgaaaaactcacaggcatcgcgtttattcaggaagcacgcgttatcgttgacgtttttcgcgagcaagctcgctcctactggtattagggctggccccttcccacatttgaagcaggcgctgcttactatttgatcagttctcccgcaggccgctaacaccctgccctccagccttcgcccaacaacttatccacaaagtcacccaccgcaattgtgggcaagtgcgccgcgcatgcaaattaaatcaagaaaatccgtgacttattcaaactcccgagtgctacgccgatctgatcattttttaatcaaccttccagaagctttgattgacgtggcttgcagcggtaagcgaacaccttatccacagatacaccaacagactttgggggcaacttcgtcagggctgtggaaaagcgcttcaactctacacaagccgggccatacagcagcctaaagcaaaaaaaatccgaatttgttcaaaattcaaccagaaccctgaaagccacgttttacaaggggtgtggctgatagcgaacatcttatccacagaagcgccaacagactttgggggcaagtttcacattcacctgtaccgaaagcatctaaaaacctctgcaaaaacgcagacttaggctggctacttttcatacaggtatctgcgagccttgctttacgtggcctgtggacaacaacaaacaccttatccacagccacgcgcacagggattgtgggtaactggacgtttatccgacttcggccccccaatcactcgttttccaagatcgactaacctcttttatgcagttatatccaacgacccggaatttgaagcgacatcacgtgccgccagcaacctgactttccgggacgacgcagttaacgctcccataggagaacggctgatccattgagtgccgttgcataacacacattggtcgttccagcagttcggaacttgtctatctgaattgaaggtgagctagttcatgaaaaatctacagcgacatagaggggatctgattaagtgggcgctggcagtggcatttctactgcccgctctgggatggacgcacggcgctgttgacacccccattgcacggcaagtgaagtgccaaaaagatggaggttattggagttcacaagacggctcctccataaaagataaaggctgcaggggcgctgcactggtatttgagacacctgacaaatgggcgtatcaatttcaacaatggaacgaagttgcccacttgatcaaggcaccgggttataacgatcccgagacggtcaagcgggaagttccggatggcaagctgtgttcggcaggtgacgataagaaagacggcctgaaccgtgtttcggcggattggtatcggacagatgtcattcctgaaaacggaaaaatggacgttcggatcatcggtaccgcaccgcacgtccccagctttgccaaagtgtttctcacaaaaccgggcttcgatccgaccaccgcccccttgacctgggataagttgacactgatacacactgagcaactgactgtcgccaggcaggattggggcagcagcccaccggccatttccggcgcctctgggtatttccagttcgaagttcccgtgccttcggaacaatcgggcaaagccaccttgtttgtgcagtggcaacgtatcgatccggcgggggaagggttttataactgtagcgatatcaacatcgtcggggcctcgattccggaggagtggtatgaactgggtcagttcatcgatcccgtcatgggcgatctcaaagccggagacaaggtccatttccgaattctggacaattcgccgcaagccaaggaagtgattgatctgaccctgccaatcaccgcaagcaatctggatgcgaatatttggggcaagcaactcagtgaccggatcaatcccgccgttgccaaagtgggagagaaaaacggcggccgcatcgagttcaacctgactcgacctggtgccaacgctgtttacacgctggaaaaaggctacagccaagcgatggcaattgttcgaggagaggaccctggccctgtggacccggcaccgccagtagcgcgaatatctggcccggcaacactcaaatcagggcaagccttcacattctccggtgtctcctcatcgggcagcaacggccccctggagtatgaatgggctgttccggggatgagacaaccgaaaaacgaaccgaccgtcagcgggaatgccgaatccgtgagtcagacgactaccttcacagcacgcttgagcgttaccgaccagcaaaacggcaaaaccggtgaagcgacattcgactttaccgtcacgccaggaagcggtggggactacccggcgtacgttgagggcaccgactataaggcaggagatattgtgaccaacgagggcaagaactttaagtgcaagcctcacccctacaccggctggtgtgcggggcctgccagggcatatgccccaggcactgggtcggactggacccaagcatgggacctggttcaatgagccgcccgtgaagccgttcaaatcagcgcccggacagccagctgccaagccctgacttcatggcctgaagaggacccgatgtgggagcaagccctctcccacatttgggatgtgcgctggttttaattcagcgcaccacaccctcctccaccaacaacttgagaatcgcctgagcgccctcttcagcgctcaggcccttgagcacctgcccgccacctccgctggccttggccgtcgctgctttcatacgatcagcgccactcttggccttgatcaccttgagccgcttgggtcgcggcttagccggaagcagctgcgctcccgtgaataactcatcctgttcgatctcgacttcatgggctgccagctcaccccgctgcgccgggccataggcgctttggcgaggcttgggcgccgcgttatccacagtggcgagaaacggcaggcgcaccttcaagcgccgccgctggccacggggcaacgcttgcagcacatgcgccacgccagcctcgatggattccacctgggccaaccctacaatcagcggccagcccaattgttcggccaacaggaacggcagcatgcccgagccttcaccggtttcggcctggctgccggtgagtaccacttgggcaccggcatcgcgcagatactcagtgagtaccggcaaggcatccgagcctggcggttgctccagtacctgcagttgcgccaggcccatgcccaggtagctgcgcagggtcggttcagcgatgttgccggcgtgcagcacctgcaacttatccccagccatttgcaggcccagctcgacggcacgcgcatcctgctccgcacggcgcgggcgcccggaagtggggtgggcgccgatggataccaggctgattacattgcttgtcatggtcatgtccctaagctgcatcgcgcttggcgccgttgcggtaggcctcgaccgcatcgatcaaggcttgcagtatcgcggcgctctcgccgattaccgacaggtcggcacgcttgatcatgtcgcaccccggatcgaggttgatcgccaccaccttgtcacaggcaccgatgccttgcaggtgctggatggccccggagatgcccacggccacgtagacccttgcagtgacccaggtgccgctggcaccgacttggcgatcacgcgccataaagccatcgtccaccgccacccgtgaggcgccttccgtggcgcccagggccgcggcggtctggtggaacagcgcccagtccttcacgccgttaccgccggagaaaatgaactcggcctcggccatgggaatcgctgccgggtccaccgccaccgcgccgagatcttcgatgcgtggcaggctgcgtgccaggcctgtggataactctacgggcaacacttcatggcgtgtctcactgaccgggtcggcacattcggcagcagccagaatcaggcgtggcagtggtcgggccaagtcttcctgacctgcgccggcacggccgatgcaggtctgatcattgatttgccacacccgcgtggccgggcgctccccgaggctggcggcaaagcgccggcccaattcgccaccgccactccgactgtccggcagcaaccagtgacgggggttgaactggttatccacagcacgcagaccctgcacacgttgctcgggtgaataaccgtcgaattcatggccctccagcaccagcaggcggtcgacaccggcggtggaaaacccggcctccttgtgttcgccgaataccaccgccagcactgcgccgtcgctgccggccagttgtcgcgccagaccgagcaagtcacggtcgtgactgctcaggcggccaccgaccatgtccggcaccacgttgatgtaaaacgcaggcgctggcacctgatgcagcggcaattgcacttccactgctgccgtgcgcttggctgcgccgccctgctgggcgccgctgcgatcgatacgcttgatgccgttggggccgataaaaccgacgccatgcacattcttgcggatgatcccgttagggcccatccaactgtgttgtaccggctgcatggccgcatgcagcgggtgcaggcggttacgggcgatccattcggcccgtgggtcgcggcggataatgtcgctcatcagtgcacctccgcaggttcacgtttgatcggggtcttgaccggtgccgggtcctcaagcaaagcgtcggccaccagctcagcgatgtctttgatcaatggccgtggttcgaccacgccctcaagcatcgccgtacattgcgggcaacctacagccaccagctcggcgccagtttcgcggatgtcatccatgcgcatatccgggatacgttgcttgccgggaatatcggtgatcggcgcgccgccaccgccaccgcagcagcgcgaacggaagcccgaacgttgcatttccttgacctcgatcccgagcgcccgcagcacttggcgcggtgcctcgtattcgccgttgtagcggcccaggtaacaagggtcgtggtaggtcacgctgttgcctttgtgctggcccaggttcagcgcaccatcgccgatcagctcggccatgaaggtgctgtggtgctgcacgaggtaattgccgttgaacgcaccgtactcgtttttcagcacatggaaactgtgggggtcacaggtgacgatgcgcttgaagctgtacttggccagggtctggatattgcgcgtagccaacagctggaacgtggcttcatcgcccaggcgccgcgcaacgtccccgctgtcgcgctcctccaggccgagtaccgcgaagtcgaccttggcggctttcagcactttgacgaatgcgcgcagggttcgttggttgcgcatgtcgaaggcaccgtcaccgacccagaacagcacttcgcagctgccgttgtcgctgagcagcggcaggttcaagtccgcggcccagttcagacggccgccaggtgcgaagccgcctgggttatcggtggcgatcaggttttccaggacttcggcgcccttgttcggcgtggcgcctttttccagggtcaggtgacggcgcatgtcgacgatggcatccacgtgctcgatcatcatcgggcattcttccacgcaggcgcggcaggtggtgcacgaccacaacgtctcagcgtccaccaggccgttgacgatcggttgatgaggattgccgccatgctcgcctacgggtttgcccggatacgggctgccggcgaacttggcatcggtgccaccggccaggccgaccaccatgtcctggatcagctttttcgggttcagcggctggccggcagcaaaggccgggcacgccgcttcgcatttgccgcactgtacacaggcgtcgaaaccaagcagttggttccaggtgaaatccttgggtttttccacgcccagcggtgcagatttatcgctgaggtccaggggtttcaaccccgtggagcggccaccgccaaagcgctcggcgcgacggtgccaggccaggtgcagggcaccggcgaaggcgtgcttcattggcccgccccaggtcatgccaaaaaacatctcggacacaccccacagcacgcccacgctcaatagcgcagcgagcagccaaccgccgaagtccgctggcaggattccggccaccggcaaggtcaccagaaagaagctcaccgagaaagccatcaggcttttcggcaggcgcatccacgggcccttggataggcgcgccggaggattgcgacgacgcaggtagacgaaggtagcgccaacgaacatcagcaccgaggccagcagcagggcatagccgaggatacggttatgcaggccaaagccatgtacgagaatggccagcaggcccgacagcacaaagcccagcgccgtggcgacgtgggtgttggcgatgtatttgtcgcgggcgaccacgtggtgcaagtcgaccatgtagcgcttgggcatggccagcaggccgccgagcaagtcgactttggatgcacggccacgacgccacatgttcatgcggcgcagggcgccaaggaccgcaaggcccagggcagcaaacaagaggattggcagcaaggtgttcaacatgatgaagctcccacagaccacacaggtctactgtgaaactggccttgaatgtgggagggggcttgctcccgatggcggagtgtcagttgatactgttgtagctgacccatcgctatcgggagcaagccccctcccacatttggacccagtcccacattggttcggtgtcgggtcagaaatccttgcacaggcgcagggcgtcatagatcgcagcgtgggtattacgctgcgccacacagtcaccgatgcggaacagcaagtacccctcgcccgcctcgctcaggcacggctgcggcttgatcgcgaacagggcttcgacgtcgatctggcccttgttgcgcgacccttccttgagtccgtagtagatggcttcgtccggacgtacgccgttctccaccaccacctggtcgaccacccgttcctctttggcgccggtgtattcgttctccagcacagccaccagcttgtcgccctcgcgatagaccttttccagcatcatgtcgccggtcatgatcacttccttggggtacatgctgcggtagtaagtcgggaacgacgtaccgccaactgccacgccgggtttgatgtcatcggtgacgatttccacctggcaacctttatcggccaggaagtcggccaccgacatgccggtgaattcacagatggtgtcgtacaccagcacgttcttgcctggcgcgactttgccgtcgagtacatcccaactgctcaccaccaaaccttcggcggcgccccagtgttcgttctgctcgatgaacggatgcccgccgacagccagcactactacatccggacgcaggtccaggatggtctcggcatccgccgccacgcccaggcgcaggtcgactttcaagcgcgccagctccagttggtaccaacgagtgataccggcgatctggtcgcgttgcggggctttcgaggcagtggtgatctgcccgccgataaattccttcttctccaacagggtcacatcgtggccacgttcggcggcgacccgcgcagcttccatcccggccgggccggcaccgaccaccacgactttgcgtttgggtccggtggatttttcgatgatgtgcggcacgcccatgtattcacgggaggtcgcggcgttctggatgcacaacacatccaggccctggtactggcgatcgatgcaatagttggcgccgacgcactgcttgatctggtcgatctggcccatcttgatcttggcgatcaggtgcgggtcggcgatgtgcgcacgggtcatgccgaccatgtccacatagccgccttccagaatgcgcgtggcctggtttgggtccttgatgttctgcgcgtgcagcaccggaaccttgaccacttccttgataccggcggccaggtgcaggaatggctccggtggataactcatgttggggatcacgttggccaaggtgttgtgggtgtcgcaacccgagcccactacgccgatgaaatcgagcatgccggtgtcgtcgtaatacttggcgatctgcttcatgtcctcatgggaaaggccgtccggatggaactcgtcaccgcacagacgcatgcccacgcagaagtcatcaccgacttctgcacgcacggctttcaagacttccaggccgaacttcatgcgcccttcgaagctaccgccccattcatcggtacgcttgttgacccgcgggctccagaattggtcgatcatgtgctggtgcaccgcagacaattccacaccgtccaggccaccggccttggcacgccgcgcagcctgggcgtagttgccgatcacgcgccagatttcttccggttcgatggtcttgcaggtggcacggtgcaccggctcacgtacgccggatggcgacatcagggtcggccagttgaagccgtcccaacgcgagcgacggcccatgtgggtaatctggatcatgatcttggcgccatgcttgtgcatggcgtcggccaggttctgaaagtgcgggatgatgcggtcggtggacaggttcaccgagctccaccactcctgggggctgtcgatggccaccaccgaggaaccgccgcagatcgccaggccgataccgcccttggctttttcctcgtagtacttcacatagcggtcggtggtcatgccaccgtcggtggcatacacctcggcgtgggcggtactgagcacgcggttgcggatggtcagtttgccgatctggatcggcgcgaacattgcttcgaaagccatggcagggttcctcgacttacaacggcttgacggtgaacagcccgtcgtcatggccctcttcggagcctccatagacttgttcggccacagtgcggatgttgctgccgcgcgcttgcagaatctggtccatggcgccggcaaaccagccggtgaacatgtagtccactttgcgcccgaccttgccgtacacatagacaaacgccgagtgctccagcttgacgctggcggtgcctttagccaggtcgatgtcctggatcttgaacaatccccagccgcgctgcgacaggcgcttcatgtagtgctcgaacaccgcgacaccttccaggccgtggcattcggcttctttttcacaccagtgccaggcggatttgtagccggccttataaaggatttcggcataggcgtcggcgcccagtacttcttcgatacccatgtggttattgacgaagaaatgccgcggcacgtacagcattggcagggcgtcggaggtccagacaccggtttcgctgtcgacttcaataggtaattgcggggcgatcttggccatggaaacttaactccagaaaatttgttttgatgcccccgccgtcggatggtcgggggaaaagaagtgtcagcggtggcttattcgccccagacgtccttgagcacgttgacccagttctcgcccatgatcttgcgcactacgcgctcgctgtggccgcgcttgagcagggtttcggtgagattggggaactcgcccacggtgcggatgcccagcgggttgatgatcttgccgaagctggtcaggcggcgggcgtagcccttgtcatgggtgagcatttcgaagaaatcctggccatggccctgggtgaagtcggtgccgatgccgatagcgtcttcgccgacgatattcatggtgtattcgatggcttcggcgtagtcgtcgatggtcgaatcgatgcccttggccaggaacggcgcgaacatggtcacaccaacgaaaccgccatgatcagcgatgaacttgagctcttcatcggatttgttgcgcgggtgctctttaagacccgacggcaggcagtgggagtagcacaccggttttttcgattcgaggatcacctcttctgaggttttggacccgacgtgtgagaggtcgcacatgatgcctacgcggttcatctcgccgacgatttcgcgaccgaaacccgacaagccgccatcgcgctcatagcagccggtgcccaccaggttctgggtgttgtagcacatctgcaccacccccacgccgagctgcttgaagatctccacgtagccgagctggtcttcaaacgcatgggcattctggaagccgaagatgatgccggtcttgccttgttccttggcgcggcggatgtcggcggtggtttttaccgggatcaccaggtcgctgttctcacggatcagggtctggctggcaacaatgttattaatcgtggcctggaacccttcccacaccgacacggtgcagttggcggcggtcaggccccccttgcgcatgtcctcgaacaggtcgcgattccacttggcaatgatcagcccgtcgataacgatgctgtcggcgtgcaattcggctgggctcatcaggcgtccccttattggcgattcatgcgccgaatcgtgtgccggcgctttggggccagcatatgcccagggatcgacggagccgggtgcaaaaacgacaggggaattgccgaaagcgtcaatccgcgacaaaggctatgtagacatgcctgctgggcggctgttctttgtcttacgcttgagccagaattgcgcatcacctgatatgagacggcgcaatgaaatcgattttcctggctttggcactcatcgcaaccaccgcccacgcagccgaagacaccgacagcacaccgtgcgacggcatcgaaaacgacaaacagaccctggcctgcgccgcctacaacaaaaccactgccgagcaactgctcaaggataactaccagggcctgctggaacgcatgggttcgttctatggcagcgacaagaccaagctggccgacattaccgcacgtctgaaggacgcccagcagaaatgggaaaaattgcgtgacgccgattgcgcggtggacaccttcccggcggtgaacggcagcaaggaatacgcgattgcgcagaatgattgcctggcacggatgagtgatgagcggtcggagtttttggagtcgattgggcaggagtaaacgctatttgcgcggcaaggccgcgcaaatagcgtcgttacattcaagccatgaagggtgacttgaacgggcgcttgctcaggggtggggatggctcgtaggcataatccaaactattgatttccatcacctgcgaaatactgcgcgtccaaggcacgatcacgtcgtggtaattatgccctgacggcccaccttgcattggacagtagtgaggcgccaagctgggtttatccagcctcatctgcgcttgccaatcggcccagatcttgtcgacgaagcagtgatgcagaaaaaacaccgggtcttcgggtgaagtcatcgccaacatgttgccgccaatccacaggtggactcggttgtgcaattgcgagccaggcgtggtgacttgggggtcgcccctctgggtaatccacccttcgagacggtttctgaaaccccgattgaacgggcttgccgtataattcggctcgtcatacagcccttcgttcatcgccattttcaagtcggcgcccgtgggcagcgaatcgaccagctgcgaaaactgtcgcttcaggcccgggcccggcagaccgtcttccggatactcaggaacgtcccaattcccggtttcgtatgcaaatggcccatcctgcaccctgaactgatcggcagggtcaccatcaccgcccatatgtttccataccggcgcattccagggatctgccgcgtccaatgtccaatcccagtaaggaatcgttacttcggggctgataccccttagctcgttttccaactgcatcaacatctcacggtgccaaggcaaaaaggccgggcccaaatgggcgccattgcgatagtcggggtcctggggctcattggggtaaaccgtaggcaccatgaccgcgtggtgccaatgcacgtacttgtcatatttgccctgcttcctgagagccaacatcgccttgataaagtcgtctaattcatcatcgttcaatgttcgaatttccttgcgaatcctcatggcgcaactcctttgtcggaaagatctggagccacgtaaggctccgtcccgaatctaggtgaggcgccaaacgggatctactgtcaaacatgacagtgcagccactatttcagacaaacggccaacgcctctccatcacgtcgaccctgttaacattcacgctctctttacctgctcaaggcaacgtccatgaccctctgcggcatcgaaatcaaaggcagcgaagccatcatcgccctcgccgccctggacaaccaggcgctgacccacgtcgccctggccaccaagaaaatcgccctggatgacgacgacgaggcagctaacgtcaaagccttcgccgcccaggtaaaggctttcgtactggacaacggcatccagcgcatcgcgatcaagaagcgcagcaagaagggtgaattcgccggcggcccgacgacgttcaagattgaaggggtgtttcaattgctggaaggggttgaggtaacgctgctgtcgccgcagaccatcaatgcgcaaaacaagaagcacacctttgacctgccggcgacgctcaacaagtatcagcacgaggcgtataagaccgcgtgctcatgcctgatgaagaaataaacgcgatcagcttttgacgcagtgctccaggccgtgcccgccgccttcgtattcaggaccgtaatagtatttaacgaaggagactttgccttccggggtcggtgtcacttgtgccacgcccacaccaaagtctttcaaggccggatcggtgtgggcaaagtagatgcccagcgtatccgaggtgccggcggccatgccttcatagcgggacttgtcctccagggtcagggtgaaggtgtaggcggcgtacttgccagtgctttgcttggcatcgagcttcatctcgaccacgcccttgaagttgccgatatgtttatcctggccgttacattcataacgcccgctgtaatcggcgccggtaaaaggtgcgggcgcctgggcagcccacagcggggtggaaacgagggccatcacagcaacgagttttttcagcatgccaacctcttggggttacgtagtggcgctcctgacgtaggcgctttgattttcaaagcacttggccagaagcaacatggagacccttggacgttagcaggctctttctatagatcgtagttaacggcaaaaaacaagaaacttccgacagcttttgtgacgacccttacaagatacgtctgacgctgtcttagtgtgatgtacgacttttatgccgtagccaatcaccgaacgacttgtcctccaaggcatagcccccccggctcgacttccacaccagctccttgtcgcgcaaggcatcgatacacgcctggatggtctgggtgcccggcaccacgtcactgcccatagcctccagtttcttgctgaccgccgtaagggtgctgtcagtgaatggcgcaaatggctcattggcgtgtgaacgctccaccatcacttccaacacggcacgttgcgggacggtcagggcgttccaggcgctttcgaattcggtccacaccccggcgcgtagcagttcggcgcgactgtgcaacagttggcccaggttgctcgcctcccccagttccagcgccacttcaccaatgatggtgcgcagcatctcgggacgacggcctaccaactcaaacgcttcgtcgatatccgccgctttgaactggttggtcttggccagatgggcgttgaggtgagtcgtgtaagcctgggtgaattccttgcccagcaaggggaacggcgtgatgctggagccgaaaaacggttggcttttacccagcaccaaatgcgcgagcttgtcgcgattagagccggtgaacaccaggtgcaagccactgccctcgccttcacggccctgattgagctgatcccgcgcggccttgagcgcgaacatggagttaaggccagcctcagtggtcagcgcgtgttgcgcctcatcgatcaccagcaccacggttttttcggcggcgctgtggagtaattccagcgcttgcgtaagcgtcgccccggccggtaattgcggcgtggtgaaatcccaggacaacgtgcgtagaaaactgagtttttcgataccgatatttttcgccagcttgcgtacacccttttcaaagggcaccaaggcaccggcgatagcactggcgatcaggtctgcaggatctttttccttgtcggcccacaggtcgacatacacaaccaaccagccacgggcctggcattgcgggacgagatcttcacgcagaaacgtacttttgcccgtacggcgcggagccgcgagaaacaggccagaagtgaaatcctgaataccggcccccaccaggccatcggcaatgctgcttgccaaggtggggcggcggaacacaaagccgctgtgcttggacatggttttatactcaattatgaaacggactataaattatagccgagagtataattaactataattgcccgtcaaaccgcctcccgtcgccgatcctctctcgggcacttggcaaacctggctcgatagctacgggtgaaatacgacggcgactcaaacccgcacgcaatgctcacctccagcacactcatgccgctctggcgcagcagtttccgggctttctccaggcgcaggccaaggtagaagttgctcggcgtatcgttcaggtgcagacgaaacagccgttccagctggcgccgggtaaccttgatcgcctcggccagggccagggtgctcaggggcggttcagtgtgttgctccatctcgccaatcacctgcaccaacttcttgttgttgatgccatagcgcgtggcgatctgcatgcgctggtggtctttgcgtgggcggatgcgccccagtacgaattgctccgagacctggatcgccaactccgggccgtgtgcctgggcgatcaggtcgagcatcaggtcgatggacgcggtgccgccggcgcaggtgatgcggcggcggtcgatttcgaagagttcctgggtcacgctcaggtgtggataggactccttgaaagcgtcgatggcttcccagtgcaaggtcaggcggtgaccatcgagcaggccggcctcggccagcacgcaggcaccggtgtcgatggcgccgagggtcacgccgtcatgatcgagacggcgcagccagtgttccagcatgggagtggcgaactgaagaggttcgaagccggccaccaccaataacgtcgcgccttttttcagcggctccagcgcggcgtcagcgttgaccgacatgccattgctcgccagcaccgcgccgccatcggcgctcaatatatgccaacggtacagctcgccgcgaaagcggttggcaacccgcaacggttccagtgcagagataaagccgatggccgaaaaacccggcatcagcaggaagtagaaatcctgggacatggtggcgctctcgtagtacgggcagcgtggtcactgtgatacgccagttcaaccagccattcaagagcacaggtcgctgcagtgcaagagtcggtcgccgccgtgcgttttgttggcactcaagctgcgtaacttgatgtcacggcgcacaaagacgccggaccccacaataacgacctgccgagggatccaccatgaaccgactgatcagccgctgtgcgcttgcactcagcgccagcgctattttgagtacccacgtcatggcagcggacgccgcttcttgccagaacgtgcgcatgggcgtggtgaactggaccgacgtaatcgccaccagcgccatgactcaagtgctgctcgacggcctcggctacaagaccaagcaaaccagcgcctcccagcaaatcatcttcgccgggatccgcgaccagcgcctggacctgttcctcggctactggaacccgctgatgacccggaccatcacgccgttcgtcgatgccaagcaggtcaaggtcctcgacaagcccagcctggaagacgcccgcgccaccctggcggtgcccacctacctggcggacaaggggctgaaaacctttgccgacatcgccaggttcgaaaaagagctgggcggcaagatctacggcatcgagccaggctcaggcgccaacacccagatcaaggcgatgatcgccaagaaccagttcggcctgggcaagttccagttggtggagtccagcgaggccggcatgctcgccgccgtggaccgcgccgtgcggcgcaaggaagccgtggtgttcttcggttgggcgccgcacccgatgaacatcaacgtggcgatgacctacctcagcggcagcgaagatgccctgggcccgaacgaaggcaaggccaccgtctggaccgtaaccgcgccgacctatgcccagcagtgccccaacgtgcacagactgctgaccaacctgaccttcaccgccgccgacgagagccggatgatgcagccgctgctggaacacaaggacgccattgaatccgcccggcagtggctcaaggatcacccgcaggaccagacgcgctggctggaaggcgtgaccaccttcgacggcaagccggctgcgaccaacctgcaattgaccagcaaataacccatttcttctcaccgcttcgcagcccgtaacggctgcgaacggcaccaccacgcccgtaaggaaccaccccatgaaccacgacgtcatcatcacctgcgcactcaccggtgctggcgacacgaccgccagaagcccccacgtgccggtcacgcccaaacaaatcgccgctgctgcagtagaagccgccaaggccggcgccaccgtggtgcattgccatgtacgcgatccgcaaaccggcaagttcagtcgcgacgtggcgctgtaccgcgaagtgatgcagcgcatccgtgaggccgacatcgacatcatcgtcaacctcaccgccggcatgggtggcgacctggaaattggtagcgacgagaacccgatggaattcggccccaacaccgacctggtcggcccgttgacccgcctggcccatgtggaggaactgctgccggagatctgcaccctggactgcggcacgctcaatttcggcgacggcgacaccatttacgtgtccaccccggcgcaattgcgggccggtgccaagcgtatccaggcgctgggcgtaaaggccgaactggaaatcttcgacaccggccacctgtggtttgccaagcagatgatcaaggaaggcctgctcgataacccgctgttccaactgtgcctgggcatcccctggggcgcgccggccgacaccaccaccatgaaagcaatggtcgacaacctgcccgccgacgcggtgtgggccggcttcgggattggccgcatgcagatgccgatggccgctcaagcggtgctgctgggcggcaacgtacgggtcggcctggaagacaacctgtggctggacaaaggcgtactcgccaccaatggtcaattggtggaacgcgccagcgaaatcctcagcaagctgggggcacgggtcatgaccccggccgagggccgaatcaagatgggcctgaccaaacgcggttaagaaatgtgggagggggcttgctcccttccacattgagctgattccaaaacagaaccttgaatacttcaggaaattcgccaatgagctttattactgaaatcaaaaccttcgctgccctgggcagcggtgtaatcggcagcggctgggtatcccgcgccctggcccacggcctggacgtagtggcctgggacccggcgcccggagccgagattgccttgcgcaaacgcgtcgccaacgcctggggagcccttgagcaacaaggattggcgcctggtgcatctcaagaccgtctgcgctttgtgagcaccatcgaagaatgcgtcaaagacgccgatttcatccaggaaagcgctccggaacgcctggagctgaagctgcagttacacagccagatcagcgcggcggccaagcctgatgcactgatcggttcgagcacgtccgggctgttgccgagtgagttctacgaaggttccacacacccggaacgctgcgtcgtcggccacccgttcaacccggtctacctgctgccactggtggaagtggtcggcggcaaaaacaccgcccccgaagcgatccaggctgcaatcaaggtgtatgaagccctcggcatgcgcccgctgcatgtgcgcaaggaggtgcccgggtttattgctgaccgcctgctcgaagcgctgtggcgcgaggcgctgcatctggtcaatgacggcgtggcgaccaccggcgaaatcgatgacgcgattcgctttggtgccggcttgcgctggtcgttcatgggcaccttcctcacctacaccctggcgggcggcgatgccggcatgcgccacttcatggcgcagttcgggccggcgttgcagttgccgtggacttatctaccagcacctgaactgaccgacaaattgatcgatgatgtggtcgatggcacccgtgaccaattgggcagccacagcatttcggcgctggagcgctatcgtgatgattgcctgctggcggtgctggaggcggtgagaaccaccaaggccaagcacggcatgaccttcgccgaataacaggaccctaataaatgcccgcattgaccacctataccacccaagtccttgcagattgggtcgactacaacggccacctgcgcgacgcgttctacctgctgattttcagctacgccaccgacgcgctgatggacaccctgggcctggacagcgacaaccgggacgccagcggccactcgctgttcaccctggagctgcacctgaactacctgcacgaagtgaaactcgacgccgaggtggaggtgcgcacccaactgatcgcccacgacgccaagcgcctgcacctctaccacagcctgtatcgagtgggcgaagaccgcgagctggcaggtaacgaacagatgttgctgcacgttgacctcgccggcccgcaggcgacgccgttcactgcggccacgctggaaaaactcgccgccatcagcaccgaacaggccgagctgccaaaacctgcactcctcggccgcgtcatcggtttgccggtcaggaattgagcaaaaaaaagccccggtccagccgtgactggatcggggcagagtgccttgtgtgagccgtgcatcccgagggtgaccaaaccgtcaagctgcgtgcctgggattgagtgtgccgaatccttctaaaggtgagtgacccgaaaacgacctgttcatagccatccgagccattcgttgattctgcccttgccgaccggccggggccctaccagaatccaagtcagttcccgctccctacaccaggatgaacgtcatgatgcacgcggatttgattgaccaggatgacctgctgagccaactacgctcgctgggttttgaagtgtccagcggtaccaccgccgagcaggcttgcgagtgtgcggtgcgcggtttgagcgaggcgcgagccaaggcgctcaagggcatggttgaaaagatgtacagcggcagtgcgacgattttgccggcggtaaggcaggcgatcgacaagcagttgttgccggctttgatgcagttcaaacagaactcaggcgtctgacagatcgctatcgggggcaagccccctcccacctttggaatgcattcccctgtgggagggggcttgccccgatgcaggcgacccggtttaaagccttacactggcaaacgtcgattcattcctggcctggctcaacgccgacatcggccccgacaacggtgatagcaccaacgcctggggaatcggcatcatcgccacctgctgggtggtattggagccgacgcgctcatcccgcggcggtatgccgaagtattcgcggtagcacttggagaagtgcggcgtggagacaaacccgcacaccgacgccacttcgatgatcgacatcggcgtttgcttgagcaattgccgcgcgcggatcaggcgcagcttgaggtagtagcgcgatggcgaacaatgcaggtatttctggaacagccgctccaactgtcgacgcgacacggcgacatataccgccagttcatccaggtcgatcggctcttccaggttggcttccatcagcgcgacgatttcctgcagcttcggctggttggtgccgagcatgtgcttgagtggcacgcgctggtgatcctgttcgttgcggatgcgctcgtacacaaacatctcggagatagccgccgacaattcacgcccgtggtcgcggctgatcaggtgcagcatcatgtccagcggcgcggtgccaccggagctggtgaagcggttgcggtcgagggtgaacaggcgtgtgctcatggacacccgcgggaaggcttcctgcatcgacgccaggcattcccagtgcacactgcaatcaaaaccgtcgagcaaacccgcgcaagccagcgcccagctgccggtacacaccgcgccgagacgtcgggactggcgcgcctggctttgcagccacgacacatgttcacgagtgacggtgcgttggatacccacgccgccgcacacgatgacaatgtccagggccggcgctttatgcatggaggcatcgggggtgatctgcaggccatcgctggcccatacctggttgccgtcgacgctcagggtcgtccagcgatacagctcgcgcccggacaactggttggccatgcgcagcggttccactgccgaagccagagaaatcagcgtgaaattgtccagcagcaaaaagccgatggattgaggcgcacggttctggggttgggccccggagttgaacgacgtcatcgcggtatctcctcacacaaagcgggtgttggcctcaggcgaggctcttgttatggcggtcgtcctcaggaaggcgacgctttgaattgatagagcaaatgccatgcctaaattggatggctattcaataactcctgaaaacgacctgttgacgcgtctatataagcccgcgcctggagtgcccggcaggtcgcataacgagtgatgttcaaggggtgtgagcagatcggtagcacttgtgggaaggcgctttgcgagcgtaggagaagtctgtcacccaaagcacattgctccggtgatcgtgtaggaatagttcggaagctacttatctatttgcgacgcgctaaaaggtggcgtttttggctcgggtgttcactttatgagcagtgttgaccggaccaccgctatcgggagcaagcccccgatgcaggcgactcggtctcaacactcgacagcactcactgccaacccgccccgcgaagtctctttgtacttgtcatgcatatccgcgccggtatcgcgcatggtgcggatcacccggtccagcgagataaagtgctggccgtcgccacgcagggccatttgcgccgcgttgattgccttgaccgccgcaattgcattgcgctcgatgcacggcacctgcaccagcccacccaccgggtcgcaggtcaggccgaggttgtgttccaggccaatttcagcagcgttgcacacctgctccggcgtggcgccaagaatctcggccaagccggccgcggccatggcgcaggctgaaccgacctcgccctggcagccaacttcagccccggagatcgaggcgttcttcttgcacagaatgcccaccgctgcggcgccgagcatatagtcgaccacgttggcttcggtgacttcctcactgaatttcatgaagtaatgcagcaccgccggaatgatccccgccgcaccattggtcggtgccgtgaccatgcgcccgccggcagcgttctcttcgttgaccgccaaggcgaacaggttcacccattccatggcgctcaaagtcgagccgatcacattgggtttgcccagttcctgcaagctgcggtgcaacttggccgcgcggcggcgcacgttcaagccgccgggcaggatgccttcgtgcttgaggccctgctccacgcaatcctgcatggcgcgccagagcttcatcaggccactgcggatttcctcttcggagcgccaggttttttcatttgccagcatcagctcggcgacgcgcaggttatgggtcttgcacagctgcaacagctccactgcgctggagaaatcgtagggcagttcggtgcgatccatgtccgccactccgctctgggcctgggcctcatccaccacaaaccccccgccgaccgaatagtaggtatcacggtgcagttcgccatcatcgccccataccaccagggtcatggcattgggatgaaacggcaggttttcgtcgagcaggcgcatgtcccgcgcccatacgaaaggcaccggcaggcgaccgtcgagcagcagagtgtcggtttcgcgcagggtgtggatgcgcacgccgatctgtgatgggtcgattgcgtcgggccactcgcccatcaggcccatgatggttgcggtgtcgctgccatggccgatgccggtggccgacagcgagccgtagagctgaacttcgacgcgccgcacctgttccaacacgtcacgttcacgcaacgcctggacgaacaacgccgcggcgcgcatggggccgacggtgtgagaactcgaaggcccgatgccgatcttgaacaggtcgaaaacactgatagccattgcggtagaactcctcgataagcacggccaggcttgaacgaggtgctacgctcagatcgcccagatggcggcatcatcaagcttttgtcgccgctcacggcgtctcacaccgacgcatccatgctcaccagcgtcgctcgcgtgcgaacgcctgtttcggccgttttttgcggtgcagaggggtaaaaacagcggtttcaccttcggaaaaacctgtaagcgacgtcatcggtactggatgcgaccctccctgtactggatacgacgccccctgtaggcgtcagattttcactggtacatgatcagttccgactcgtttgcaaggcaccgtgccagagctgttgtcgcacgctccaaccgcaacacttataaagcgcggcaaatgccgccagaaaaaacacaggagtctagccttatgaaagcttcaccctcgttgttgttggccgccatgttgagtctgccagccctggcaaacgctgcagaaccggaacagtgcaagaccgtcaacttctccgatgtcggctggaccgacatcaccgtcactaccgcgaccaccagcgaaatcctcaagggcctgggctacaagccgcgcaccacgatgatttcggtaccagtgacctacaagtccctggccgacggcaagaacatggatatcttcctcggcaactggatgccgaccatggaaaacgacatcaagcagtatcgtgatgccggcaccgtggaaaccgtacgcgccaacctggagaacgccaagtacaccctggcggtgcccgaggcgctgtacgacaaaggcctgaaagacttcgccgacattgccaaattcaaggacgagctgggcggcaagatctacgggatcgagccgggtaacgacggcaaccgcactatccagacccttatcgacaaagacgccttcggtctcaagaccgcagggttcaaagtggtcgagtccagcgaagccggcatgctctcccaggtcgaacgcgcctccaagcgcaaccaggccatcgtgttcctcggctgggaaccgcacccgatgaacacccgcttcaagatgaagtacctgaccggaggggacgactcgttcggccccaactacggccaggccaccatctacaccaatacccgcaagggctacacccaggaatgcagcaacgtcggccagttgctgaagaacctggtgttcaccctgaacatggaaagcacgctgatgggcaatgtgctggacgacaaaatgaagcccgacgccgccgccaaggcgtggctgaaaaagaacccccaagtgctcgacacctggcttgcaggcgtcaacaccgtcgatggcaaaccagggctggaggccgtcaaagcctacctggacaagtaaccactatcccgggccgttaagccggtccgggatgtttccccccttcgcatgtggacattcactaccatgctgactgaacagaaaatcccactaggccagtacatcgctgccttcgtcgaatggttgacccagaacggtgccaactacttcgatgcaatcgcatcgacactggaaacgatgatccacggcgtgacgtttgcgctgacctggttcaatccgctggcattgatcggtctgattgcgctgctggctcactttatccaacgtaaatggggcctgacggtcttcgtcatcgcctccttcctgctgatcctgaaccttgggtactggcaggaaaccatggaaaccctcgcccaggtgctgttcgccaccctggtctgcgtggtcatcggtgtgccgctgggcattgttgccgcgcacaagccgatgttctacaccatgatgcggccggtactcgatctgatgcagaccgtaccgaccttcgtctacctcatccctaccctgaccctcttcgggctgggtgtggtgcctgggctgatttccacggtggtgttcgcgattgccgcgccgatccgcctgacctacctgggtatccgcgatgtaccgcaagagctgatggacgccggcaaggcctttggctgctcgcgccgccagctgctctcgcgtattgaactgccccacgccatgccgagcatcgccgccggcattacccaatgcatcatgctgtcgttgtcgatggtggtaattgccgcactggtgggtgccgacggcctcggcaagccggtggtcaatgcactcaacacagccgatatcgccctgggctttgaagcgggcctggccatcgtgctgctcgccatcatgctcgaccgtatctgcaaacaacccgacgctaaagtagggggtgatgcatgagcattatccgattcgacaaagtcgacgtgatcttctccaaagacccacgcgaggcgctcaagctgctggaccagggcatgagccgtaacgaaatcctgaaaaagaccgggcagattgtcggtgtcgaaaacgccagcctggatatcgagaaaggcgagatctgtgtgctgatgggcctgtcgggctccggcaagtcgagcctgctgcgctgcatcaacggcctcaacaccgtgagccgtggccaactgtttgtggagcatgagggacgccagatcgacatcgcctcctgcaccccggccgagctgaaaatgatgcgcaccaagcgcatcgccatggtgttccagaagttcgccctgatgccctggctgacggtgcgcgagaacatcagcttcggcctggaaatgcagggtcgcccggaaaaagaacgacgcaccctggtggatgaaaagctcgaactggtgggcttgagccaatggcgcaacaagaagcccgatgagctgtccggcggcatgcagcagcgtgtcggcctggcccgcgcgttggcgatggacgccgatatcctgctgatggacgaacccttctcggccctcgacccactgattcgccagggtctgcaagatgaactgctggaactgcaacgcaagctgagcaagaccattgtgttcgtcagccacgacctcgatgaagcgctcaagctcggcagccggatcgcgatcatgaaagacggcaagatcatccagtacagcgtgccggaagaaatcgtgctgaacccggcggacgactatgtgcgcaccttcgtcgcccacaccaacccgctgaacgtactgtgcgggcgcagcctgatgcgcacgctggataactgcacgcgggtcaatggttcggtgtgcctggatccgggcggcgattcatggctggacctggctgaaggcaacaccatccagggcgcacgccagaacggcgtggtgatgaatttgcagaattgggcaccggggcaagcggtggaagatttgggtcgggtaccgacgctggtggattcgaatatcggcatgcgcgatgcgttgcagatacggtatcagacggggaacaagctggtgctgcatgacaacaacaaggtggtagggatcctgggcgacagtgagctctatcacgccctcctgggcaaaaacctgggctgacaaacactgcaaaacaactgaagaaactgggtcaatgtaggagggggcttgcccccgatagcggtgtatcagtaacagatgtactgactgacacactgcaatcgggggcaagccccctcccacatttggacccagtggtgtcagcaaggacaccactggctttcaactatcagctatagacccggccaaggagctgccgatggctttcgaactgatcgagcacatcccgggtaatctgttcctgggtgaagcccatcaggtcatattcctgcggcccattatgcaggtacacctcggcacggtagtaacgggtgcgttcttcttcaggcaggtcagccggcgccgccgagtaaccatccaggctcacctcgtagacaaacgggttgccctcttgcatctcgatacgcacgccgatgcagcgcttggatttgcccagcaaggtctgcacctccaagccttgctcacgcagcgcaaccgccgcttcttccagcgccggcgttacgtgcttgtccataaagcgctgcacggtggcctggctcggttgcaggtccagggcggtcaagcgctcgctgaaaccacggcggccacgctcagccagttgcgcctgttccagttctgtcgccacatcctggcgcatggccttgtgcaaaccgaacataaacaggatcagcaccaccgaaaacggcagccccgccagcacgaccatggtttgcatagcttcgaagttaccggcaaacagcaggccgatggtcaccagggtgatcaccaccgaccagaagatccgcaaccagtgcggcgcatcttcatccacattgccgcctttgcaggacaggttggccatcatcaccgcgccggaatccgccggggtcaggaacagtacaaagcctacgaagatcgatacgccgatgacgactttcgacgccgggtaatgctcaagcagttggtagatggccatggacggttgctccagcgccgtcttgcccaactccacggcaccatggttcaacaccaggtccagcgccgagttaccgaagatcgacagccatgccagagtaaagcccagcgggatcagcaagacgccggccaccagctcacgcacggtacgaccacgggaaatacgtgcgatgaacatgcccacgaatggcgcccaggaaatccaccaggcccagtagaacagggtccacaggcccatccagcgttcggtcttggcaccgtcgccttcatacacatagaggtcgaaggttttcaggatgatgccgttgaggtaatcgccggtgttctgcaccaagccgttgagcaggtgcagggtcgggccgaacagcagcacgaagatcagcaagccgctgaacagcacgatgttcaggttggacagacggcgaatgccgttttccacacccgacacagcggcgatggtcgccacggtgctcatcacgatgatcacgatcaacaggttggtattgctgtgctccatgccgaacaggttttccagccccgaggacacctgcatcgagccgatccccaggttggtcaccaggcccagcagggtcacgaacataccaaaaccgtctaccgcgtggcccgccgcgcccttcacccaacgctcgcccaccagtgggtacagcgccgaacgcaaggccagcggctgattgtgacggtaggcaaagtacgctacggccaggccgaccagtgcatagatcgcccagccgtgcaggccccagtgcaggaaggtcagttgcagcgcctggcgggccgcaccattactggccgcagcgccctcgggcgggttgaagtaatgatccaacggctcggacgcaccgaaatacaacagcgaaataccgatgcccgacgagaacaacatgcccgcccaggcgccgtaactgaagtccggggtgtcgtctttactacccagtttcaattttccgtaggacgaaaacgccaggccgaccacaaacaccaggtaggcggcgatgaccaccatgtagtaccagccaaagcttttggaaagccaggcctgggcgacgccgagcatgcgcccggcctcctgcggggcgatgatcaggatggcggtcaataacagaatcagcgcggtggaggtgtagaacacccaaccgttgacccggaccttttccggcggggtctttataagagaggcagaactcatggcgcagatgctccaggcagtgcgagagagaaacacaaggcagcggttatcccgggacatcgatttttcggcagtcgacggacgggtgttataaagacaccccgaaaattcttgagccgccgaggcggtgatcaggctctgatatggcctgtttcaagggttttgcaggtgtcagcggttgcggccagcaggtaggaaacatctgtaggtagcgaccatttgtcgcagatcttattctttgttgattgaacgttcaatcaaaacaaaatagactggccctcaagccgacggacgttcttcgcccatcggcaggcctaaggagaggtgctacatgcccaaggtcggtatgcaacccatacgccgccagcagttgatcgaagccacattgacggccatcgatcaggtcgggatgggagatgccagcattgcgctgattgcgcgtctggccggcgtctcgaacggcatcatcagtcactactttcaggacaagaacggcctgatcgcagcgaccatgcgttatctgatgaatgcgctgatcgagaacgtccaggaacgccggcgcgccttgaaggatgacagcccacgggcccaccttcaggtgatcatcgaaggcaacttcgacgccagccaggtcaacggcccggcaatgaaaacctggctggccttctgggccaccagcatgcatcacccgtcattgcacaggttgcagcggatcaacgatcaccgcctgtattccaacctgtgctgccagttccgccgtgcgatgccgttgtccgaggctcgcagcgcagcccgcggcctggcggcgttgatcgacggtttatggttgcgcggcgctctgtcgggagacgctttcgacacggagcaggcgcaacggatcgcttacgaatacatggatttccaattggccaagcaggtgagttagagcccttataaacgctcaacccctgaacgtccgccgctcagtgttgccacaaccccatggcccacttttcggcgggtaacgccaaccacttatgcacttgcgaggactttatggcccgtttcgacctgcaaaaactctacattgacggcggctacagcgacgctggcagcgatgccaccttcgaagccatcaacccggctaacggtgaagttctcgcccaagtgcaacgcgccacgaaagaagacgtcgagcgtgccgtagtcagcgctgaaaaaggccagaaggtctgggctgccatgaccgccatggagcgttcgcgcatcctgcgtcgtgctgtcgacatcctgcgcgagcgcaacgatgagctggccgccctggaaaccctggacaccggtaaagccttctccgaaaccaagtatgtcgacatcgtcaccggcgccgacgtgctggaatactacgccggcctggtgcccgccatcgaaggcgagcagatcccgctgcgcgatacctcgttcgtctacacccgccgcgagcccctgggcgtggtcgccggtatcggcgcatggaactacccgatccagatcgccctgtggaaatccgccccggccctggccgccggtaacgcgatgatcttcaagccaagcgaagtcacttcgctgaccaccctgaaactggccgagatctacaccgaagctggcgttccagcaggcgtgttcaacgtcttgaccggcagcggtcgtgaagtcggcacctggctgaccgagcacccgcgcatcgagaaagtctcgttcaccggcggcaccgacacgggcaagaaggtcatggccagcgcttcgagctcctcgctcaaggaagtgaccatggaactgggcggcaagtcgccgctgatcgtgttcgaagatgccgacctggatcgcgccgccgacatcgcgatgatggccaacttctacagctccggccaggtctgcaccaacggcacccgtgtgttcgtgcctaagcacctgcaggctgcgtttgaagccaagatccttgaacgcgttgcgcgcatccgtgtgggtgacccgcaggacgacaacaccaacttcggcccgctggtcagcttcgcccacatggaaagcgtgctgggctatatcgccaaaggtaaggaagaaggcgcccgcctgctgtgcggcggcgatcgcctgaccgacggcgacttcgccaagggcgccttcgtggccccgaccgtgttcaccgactgcaccgacgagatgaccatcgtccgtgaagaaatcttcggcccggtgatgagcatcctcacctatgaaactgaagaagaagtgatccgccgcgccaacgacaccgacttcggcctggctgcgggccttgtgaccaaggacctgaaccgcgcccaccgcgtgattcatcaactggaagcgggtatctgctggatcaacgcctggggcgagtccgacgccaagatgccggtcggcggctacaagcaatccggtgtgggccgtgagaacggcatcagctcgctgaacaacttcacccgcatcaaatcggtacaggttgagctgggcgactacgcctcggtgttctaacacccgagccttgtattgcctataaggccgccatcgggggcaagccccctccacctttgactgtgtgaacccgatcaaatgtgggagggggctcgcccccgatgaggcctgacctgactagacttcaaagagggtgcatccaatgtcccaagaatacgattacatcattgtgggtgccggctccgccggtaacaccctggcgacccgtctgaccgaagacgaaggcgtcaccgttttgctgctggaggccggtggccccgactaccgcctcgacttccggacccagatgccagctgccctggccttcccgctgcagggccgccgctacaactgggcctacgaaaccgatccagagccacacatggacggtcgtcggatggaatgcggccgcggcaagggcctgggtggttcgtcgctgatcaacggcatgtgctacatccgtggcaacgccatggactacgacaactgggcgaagctgccgggcctggaagactggacctacctcgactgcctgccgtatttccgcaaggccgaaacccgtgacatcgggcccaacgattaccacggtggcgaaggcccggtcagcgtgaccacgccgaaagcgggcaacaacccgctgttccacgccatggtcgaagccggcgtacaagccggctacccgcgtaccgaagacttgaacggttaccagcaagaaggcttcggcccgatggaccgtaccgtcacgccgaacggccgtcgcgccagcaccgcacgcggttacctggacacggctaaaaagcgttcgaccctgaccatcgtcacccacgccctcaccgacaaagtgttgttcgaaggcaagcgagccgtaggcgtgcgctacctgatcggtgccgccgaagagcgcgtcgaagctcgtgcgcgtaaagaagtgctggtgtgcagcggcgcaatcgcttcgccgcaactgctgcaacgctccggcgtcggcccggccaaactgctggaaagcctcgacatcccggtggtccacgacctgccaggcgtcggcgaaaacctgcaggaccaccttgagctgtacctgcaatatgcgtgcacccagccggtgtcgctgtacccatcattgctctggtacaaccagcctgcgattggtgccgagtggctgttcaacggcactggcattggcgccagcaaccagttcgaagccggcggttttatccgttcgcgtccggaattcgaatggccgaacatccagtaccacttcctgccggtcgcgattaactacaacggcagcaacggtgtgaaagagcacggtttccaggcacacatgggctccatgcgttcgccaagccgtggccgcgtgcaactgaagtcgaagaacccacgggactacccgagcatcctcttcaactacatggccaccgagcaggactggcaggagtttcgcgatggcatccgcctgacccgtgaaatcatgcagcagccggcactggatcaataccgtggtcgcgaaatcagcccgggtattgaagtgcaaaccgatgagcagctcgacaagttcatccgcgagcacgccgaaaccgcgttccacccgtcctgctcgtgcaagatgggcaccgacgagatggccgtagtggatggcgaaggccgcgtgcatggcatgcagggtctgcgtgtagtcgatgcgtcgatcatgccgatcatcaccaccggtaacctgaacgcgccgacgatcatgatcgccgaaaaaatcgccgacaagatccgtggccgcaagccactgccgcgcagcaccgccgactactacgtggcaggcgatgcgccggtgcgtggcaagccgatgcgtgaagtaggccctactgcgcagtaactgatacaccgcggcgcctgatatcgcaggcaagccagctcccacatttgactgtgttcacaaatcaaaatgtgggagcgggcttgcccgcgatgaggcccgacccgacaccgcaagccccccgcctacactttccttgatcagctctgcgccccggcctactctgttggcctgccgcgcgccgagccgcccacaaggaaggccccatgttcgaacaccacgccaccctcaaacagcacttcagtgccctgcgcacccgtgccgaattcttctccctgcgctacgtacgcgaatccggtcagtacctgtcggtacgcaagaacgtcgccgaaccaccacatctgagccacgatgaaggcgccatgcttaccgtgcgtctcaatggtgtggaagcctatgccgcgaccaacgacatttcccttgccggcctgcaagcggcccttgagcgcgccgaacagcaagcccggctgatccagccccacgccctgctcgacctgcaccagcagccggtttccaatgaagtcgccgactacctgtctccggaccttgatcagcccttcccgtccctgagcgactgctaccaattgctcggcgatgaatctgccgccgtgcccaaggatgaacgcctggtgacttgggaagtcagcctgggcaccacccatgttgagcagatctacctcaacagcgccggcgcgcaattgcgccaggctcagcgcttcgtctttcctggcctgagtgtcaccgccttcaacggcaacgacagccagacccgcaccctgggcggtaccaacttcggccagcaaggcagtgccggtgtgatccagcgcttcggcctggttggcgctgccagccaggtggccgacgaagccctgcaattgctgctcgcaccgaacacgccccacggcccacgtgacctgctgttgatgcccgaccagatgatcctgcagatccacgaatccatcggccacccgctggagctggaccgtatcctcggggacgagcgcaattacgccggcaccagctttgtgaaggccagcgacttcggccatctgcaatacggctcacctttgctcaacgtgaccttcgacccggacatccccgaacaactggccagctacagccacgacgacgacggcagccgcgccagcaagcaattcctgatccgcgacggcctgctgctcaagcccttgggcggtgcgctgtcgcaatttcgcgccaacctgccaggcgtcgccaacagccgcgcctgcggctggaaccgcccacccatcgaccgcatggccaacctgaatatcgaggccggcgataaaagcctcgcgcaactggtgggcggcatcgaacacggcatcctcatgtcgaccaaccgttcgtggtccatcgacgatgcgcgcaacaagttccagttcggctgcgagtggggccagttgatcgaaaacggcgaactcaagggcgtggtgaagaaccccaactaccgggcgatttccgcacaattctggcgcaagctcagcgccgtcggcgatgccagcactttcaaggtattgggcacgccgaactgtggcaaaggcgagcccaaccaagtgatccgcgttggccatgcatcgccggcctgcgtgttcagtaacgtcgacgtatttgggggagatgcctgatggataacttcaaggcattggtggactggctcaagcaagccatcaccgacaaggaacaatttcacctcggctacgcggatgagtcgtccgaattcgtgcgtttcaatcacgccaaggtacgccaggccggacaggtgcaacaggccagcctcaacctcaagctgatcgacgatggtcgccatgcggaccttggcatcaccttgtccggcgaggcggaactggaccgccagcggctcgccgatggcctggaacaactacgccagaccctgccgctgctgccccaggatccgtacctgctgctcaaccacaacgcctggcaaagccacaacgaacaattgcgaccgctgccggacatggcgcaagtgctgcaagacatcagcctggctgccgaaggcgtagacctggtcggcttctacgcagccgggcccatcagccgtgggttcgccagctccgagggtgcattcggctggcatcgggccaatagcttcaacttcgatttcagcctgttccacgctaatggtgaagcggtaaaagccagctacgccgggcacacctggaacagcgccgaattcaccgcccgcttgcagcaagcgcgcgagcagctggcgtttctcggtcgcccgctgcacaacctggcgcccggccagtaccgggcctacctcgccccggcagcgctggaagaaatcatcagtatcatcacctggggagggttttccgcccaggccatcgccagcaagagcagttcattgcagcgcctgtatgccgctgagcagtcgctgagcccgctggtgacaatcgatgagcagatcagcggctccctgagccaggcgttttccacagagggctacccgcgcgaggacgtcaccctgatcggcgccggcaaggcgctaggccaactggtgaattcgcgcagcgccgccgaatacggcttgagcgccaacggcgcgagcagcgatgaatcgcccagcgccctgcagatggcgccaggcagcctggcccaggccgatatcctcaagcagttgggcaccggcctgtatatcagcaacctgtggtacctgaattattccgacctgccggcggcacgcctgaccggcatgacgcgcttcgccacgttctgggtggaagacggcgagatcaaggcgccggtcagcaccatgcgttttgatgacagcgtcttccagttgctcggttcgcaattggaagcgctgaccgctgatcgggagctgctgctgtcggccagtacctacagccagcgcaatacggcctccagccttctgcctggcgccttggtaaaacgcctgacgctgaccttgtaagcaccggctccctatgggagcgggcttgctcgctcccacattggactgcatctctcctgtgcggcctgttgtcgcctgcaaaaaacctcgatataacggttagtggccacccgccaccccacccacgagagcacgaccttgcctgggaaagggcaagctggagcgttgacatgaaccatggaagttttgtcattgaaaagctggtcaagcactacaacgttcatgttgagcaactaggaaacaatcctgaaaagaaaaccgtactgatggtcaacggcgcgctctccaccacccgctcctttgcccgtaccagcaaatgccttgccgagcatttcaatgtgctgctgttcgacctgcccttctcaggctattcacgcgaacacaacaccgacctcgacctggtcaacaaggatgacgaagtacaaatcctgcgcgccctggtggaacgcttccaggtcaaccatctggtgtcggcctcgtggggcggcatctccacgctgctgaccttggcgcacaacccgccctccatcgaaagctcggtggtgatggccctggcgcccaacctcaaccaggccatgctcgaatacgtggagcgcgtgcgcgtgttgatcgaggccgatgacaagtctgcggtcggtcacctgctcaacgaaacggtcggcaaatatctgtctccccgcctcaagcgcaacaatcaccggcacctgtcgagcatggccaccactgagtaccgccaggcgcgctttcatatccaccaggtactggacttgggcgatggcaactacttgcccacactccagcagattaaaaccccagtgcactttctcaacggcacactggatgaatacactccggccacggacgcccaattgttcaaacagtatgtaggccgcagcagcttcgccgtcgccgcacacactggccatctactggacctggagtcctgcgaggcggcattggcagtgcaccgcgcgttgttggattttctagtgggcgagcatgcagcgttatcggacttagatgaaccgccagtgggaaaaaacttaagggttagcgcataatcgccaacacatagcctgctaatcaaagggtctccatgccgaatcgcgcccctctcgatgccaagaccgcccgctggctaccctgggtggtagcgattgccttcttcatgcagtcgctggatgggacgatcctcaacactgcgctgccggccatggcccgggacctggcggaaaacccgttgcgcatgcagggggtggtgatcgcctacatgcttaccgtcgccttgctgattcctgcgtcgggctggatcgccgaccgcttcggcaccaagaaaatcttctttggcgcgatcatgctgttcagcatcggctcgctgctgtgtgcattgtccagcagcctgaccatgctggtgggcgcacgggtgatccaaggcttgggcggcgcactgatgctgccggtagggcgcttggtggtactgcgggcttatccgcgctccgagctggtacgcatcatgggcttcattaccatccccggcctgctcggcccattgctgggcccgaccatgggcggctggatggtgcagtacctgacctggcactggatcttcctgatcaacctgccggtgggcatgatcggttgctacgccgtgtggaagttcatccccgacctgcgcggcagcgagcgcacgcgcttcgacggcctgggtttcctgctgttcggcgcagccatggtgttgatcaccatcgccatggagggtctgggcgaactgcacctgccgcacctgcgggtgatgttgctgctgttcggtgggctggcgtgcctggcggcgtactggttgcgcgccgggcatatcgatagcccgttgttctccccgatactgttcaagacccgcacctttgccgtgggcattctcggtaacctgtttgcgcggctgggcagcggcgcattgccgttcctggtgccgctgctattgcaggtggcgctgggctactcgccgtcggaagccgggatgagcatgctgccgctggcggcggcggcgatgtttgccaagtccgtggccaggccgctgatcgagcgcctcggctaccgcgtcgtgctgaccggcaacaccttggccctgggcctcatgctggcgagcatgggcctggtcggcgagcacacgccctacccgctgctgttagccatgctggcggtcctgggggcgatcaactccctgcaattcacggcaatgaacaccgtgaccttgatcgacctcgacgacgcccaggccagcagtggcaacagcttgctgtcggtggtggcgcaattgtccctgagcctgggcgtggcctgcgccggtgcattgctcggcggctttaccgccgaggcgggcaacgacggggtggaaagcgtgctcggggccttccagctgaccttcctcaccgtgggtatcatggcgatgctggcggcggcgatcttcctgcaattgtcgccaaaagacggcaaacgagtggtcagccgcgagcacgatatcgagcactgacgggcttctcgtctagaacttgcagggaaaatcccacggggctggtacactacgcgacattttgttttgcagagccagtcccgtgactaccatcgccaccgcttttaatactttgcccctgtccgccgccatgctggctaacctcgactcgctggggtatgtcgagatgacgcagatccaggcgcaaagcttgccggtgatcctcaaggggctggacctgattgcccaggccaagaccggcagcggcaagaccgccgccttcggcatcggcctgttgaacccgatcaacccacgctacttcggttgccaggcactggtgatgtgcccgacccgtgagctggccgaccaggtcgccaaggaaatccgtcgcctggcccgtgccgaagacaatatcaaggtgctgaccctgtgcggcggcgtgtccctcggcccgcagatcgcttccctggagcacggtgcccacgtgatcgtcggcaccccgggccgtatccagcagcacctgcgcaaaggttcgctggtactggatggcttgaacaccctgatcctcgacgaagccgaccgcatgctcgacatgggtttctacgacgccatcgaagacatcatcagcaagaccccgccacgccgccagaccctgttgttctcggccacctacccggtgagcatcaagcaactggcgtccaagttcatgcgcgcgccgcagcaggtgaaggccgaggcgttccactccgatgaccagatcgagcagcgcttctacgagatctccccggaagaacgcatggatgcggtgaccaaggtcctggcgcacttccgcccggcttcctgcgtggcgttctgcttcaccaagcagcaagtgcaggaaaccgtggatcacctgacatccaaaggcatttccgccgtcggcctgcacggtgacctggaacagcgcgaccgtgaccaggtactggccatgttcgccaaccgcagcacctccgtactggtcgccacagacgtcgccgcccgtggcctggacatcgactcgctggacatggtgatcaacgtcgaactggcccgcgactcggaaattcacatccaccgcgtcggccgcaccggtcgtgccggagagaccggtatcgccatcagtctggtggcgccgtccgaagcgcaccgcgcccaggccatcgagcaactgcagaagtcgccactgaactgggaccaactggacaacctcaagccgcaaagcgggggcccgctgctgccgcagatgagcaccctgtgcatcgccgccgggcgcaaggacaaggtccgcccaggcgacattctgggtgcattgaccggtgaagccggcattccgggcgcccaggtcggcaagatcgcaatctttgatttccaggcattcgtggccgtggaacgcgggatcgccaagcaggcgttgcagcgtttgaataatggcaagatcaagggccgatcgttgcgcgtgcggatcttgtaaatatctcgcacaccaatggagattcaaatatgggagggggcttgctcccgatagcggagtctcagtcaatatagatgtgactgaaccaccgccatcgggaacaagccccctcccacatttgactgtatttcaattcagaatttgtatgaggacaccgtcttgcgctcgaccgaagttgtgatcattggcgccggcgccgcaggcttgatgtgcgcactgaccgccgccgggcgcgggcgcaaggtgatgctaatcgaccacgccaacaaagccggcaagaagatcctgatgtccggtggtggccgctgcaatttcaccaatatgtacaccgagccggccaacttcctttcgcacaatgcacacttctgcaagtcggccctggcgcgctatacccagtgggattttatcgcgctggtcgccaagcacggcgtgccctaccacgagaagaaactcggccagctgttctgcgataacaaatccagcgacatcctcggcatgctgctcgatgagtgcatccagaccggcgtgagcctgcacctggacacctgcgtggaggaaatcgccaagttcgacagcggctaccagctgcagacctccctgggcgaactgcgctgcgaatccctagtgattgccactggcggcttgtcgatcccgacactgggcgctaccggttttggctatcaagtcgccaggcaattcggccatgaactgttgccgacccgcgccgggctggtgccgttcaccatcaccgaccagctcaagccattgtgcagcgagttatccggcacttcagtggattgcctggtgagctgtaacggccagagctttcgcgagaacatcctgttcacccatcgcggcctgagcgggccggcgattttgcagatctcttcctactgggaatcgggcgacacggtggaaatcaatctgttgcccgatcatgacgcccatgactggctgcaacagcaacaggccgagcatcccaacagcgagttaaagaccctgctgggggagattttcaccaagaagatggccaacctgctggcccaaagctggttcgaatccaaaccgatgaagcagtacacccacgctgaaattgccgatatcgcgcaaaagcttgggagctggcaactcgtaccggccggcaccgagggctatcgcactgctgaggtaaccttaggtggagtggatacgcgggaggtgtcgtccaagaccatggagtcactgaaaaaccctggcctgtacttcatcggcgaagtgctggatgtgaccggtcacttgggcgggttcaacttccagtgggcctgggcgtccggctacgccgccgcgcaatatgcctgacacaacgcagtaaaaaatgtgggagggggcttgcccccgatagcggagcatcagtcaccttatgagttgactggtccacagctatcgggagcaagccccctcccacattggttttgtattgatcttgaaaaatttgctcctggatgtgatcaccacccttgccgtggcgtccttgatagctcaatttagcgacactgtcccggaagactccagacttcatgtcatcgacctcgttcaagcagtccatgcggcgcctgtgggcgctggataaattcagctacagcgtacgggtgttcatcgccctcaccggcagcatggcgctgtgttggtaccaggatgaaatgacgctgctgatcccgctgttcctggggattatcgccagcgccctggccgagaccgatgacagttggcaaggccgtctcaacgccctggcggtgacgctggtgtgtttcagcatcgctgcactgtcggtggagttgctgttcccctacccgtggatctttgccattgccctggccctggccagtttctgcctgaccatgcttggcgcgttgggtgagcgctatggcgcgattgcctcggccaccttgatcctgtcggtctacaccatgatcggcgttgaccagcgtggcggcgccgtcaccgacttctggcatgaaccgttgctgctggtggccggcgccgcctggtacggggtgctgtcggtgctgtggcaggtactgttttccaaccagccggtgcagcaaagcctggcgcgattgttccgtgagctggggcgttacctcaagctcaagtcatccttattcgaaccgatacgccagctggatgtggaagcacgccgcctcgaactggcccagcaaaatggccgggtggtcgcggcattgaatgcggccaaggaaatcatcctgcaccgcgtcggcaacggtcggccgggctcgaaggtcagccgctacctgaaactctacttcctggcccaggacatccacgagcgcgccagttcctcccactacccctacaacgccctcaccgaagccttcttccacagcgatgtgctgttccgctgccagcgcctgctgcgccagcaaggcaaggcgtgccagaccctggccgagtcgatccaactgcgccagccattcatctatgacgacagcttcgccgaagccctgggcgacctcaacgcctccctggaacacctgcgcatccagagcaacccggcctggcgtggcctgttgcgctcgttgcgcgccttggcggccaacctgtccaccctcgaccgcctgctgggcgatgccagcaaccccgacgccctggccgacgccaccgacagcaacctgctggaccgcgccccgcgcaacctcaaggaaatgtggacgcgcctgcgcacccaactgacccccacctcgctgctgtttcgccatgccctgcgcctgtccctggcgctgaccatcggctacggcaccctacatgcgatccacgcgtcccagggttactggatcatcctcaccaccctgtttgtctgccagcccagctacggtgctacgcggcgcaagctcggccagcgcatcatcggtaccgccatcggcctcaccgtggcctgggcgctattcgacctgtttcccaaccccgtggtgcaatcaatgttcgccatcgccgcgggcctggtgttctttatcaaccgcaccacgcgctacaccctggccacggcggcgatcaccctgatggtgctgttctgcttcaaccaggtgggcgatggctacgggctgttcctgccgcggctgttcgataccttgctcggcagcctgatcgcggggctggcggtattcctgttcctgccggactggcaaggccggcgcctgaacaaagtgctggccaataccctgacctgcaacagcatctacttgcgccagatcatgcagcaatacgccgccggcaaacgcgacgacctggcctaccgcctggcccgccgcaacgcccacaacgccgatgccgcactgtccaccaccctggcgaatatgctgatggagccgggacacttccgtaaggaagccgatgtgggctttcgcttcctggtgctgtcccacaccctgctcagctatttgtcagggctgggtgcgcaccgcgaaacccaactgccggccgatgtgcgcgagcatttgatcgacggcgccgggcacgccctggcattgagcatcgatgaaatcgccagtgggctggcgaataaacaaccgattgcgattcagagtgatgccgaagaagcgttggcggcagagctggagcaaatgcccgatgagatcgacgaagggcaacggttggtgcagacgcagttggcgttgatttgccggcagttggggccgttgcgtaccttggctgcgcatttgatcaaagataccagcgcggcttaggccgctaacgggagcaagaacgctacatcccatgcgccttcatcaaccgcgcataactgccatcagccttcatcctggcaatctcccggtcaaaaccggcgacgatctgcgcatgctcggggttcttcaggctcaccaggatgtgcaggctgttctcactcaatggcttgcctacaaacaccacggcatcgcgcacccgcggcgactcccgcgccaagtaatagcgcgctacgtattcatcctccagcgtcagtcgcacacgctgcgccgccagcatgcgcacggccatggcgaagttgtgcactggcactttctgcaacagggtgtcttgatcgaatgccgccgagtaggcataaccgcgcaccacggcgatggcctcgtcgtgcagtgcgtccaggctgtgatattcgatggcatcgtcgctacgcttgagaaagcgcacacggttaagcaagtactcgccggaaaactgccccaggtgcgtgcggtcctcgttataccaggcgttgatcagcacgtcgtagcgcccatcccccacgcccttcaatgcgcgcgcccagggcacctgttcaaaatcactggcgtaccctgcgcgggccagggccgtacggacgatatcagtagccaggccgccattgaccaaggtggcatcagtaaacggtggccaaccatccgccaccaggcgcaaacgttgtgccagcgccggttgcgccagcagcagcactgcgatcaaagcaacggcacgagtcaatcgcggcatgcttaaagtccttggcgggcaggcgatggcctgataacagtagctcatcaatgagcttgcattgcagattacacaaagaagcccgcggcgcatgcacagaatgatggcaaattgacgccattcacaaaatggccgattttagacagcagcgcccgtcgcgcttactatccctggcaggtctttataagagcgcacatcatgacggttgattgggtctgcaaacatcacgacgacttgggcaaggaacagctgtacgccatcttgcgcctgcgcagcgaggtcttcgtcgtcgaacaaaaatgcgtctaccaggacatagatagccaggacctggcaggggatactcatcacctcatggcctggcaaaatgatgagttggtggcctacctgcggttactcgacccggagtcccagggcggcgatgtggtgattggccgcgttatcgtagcaaaggtggcacggggcagcgggctggggcatcaaatgatggaagaggcgctcaagcgcgttgaggatatctggccgcaaacaccggtttacctgtcggcgcaggcacatttgcagagctattacggacggtatgggtttgtggtggcgggcgaggaatacctggaagacgatattccacatatcggtatgcggcgggcttgagggcctcatcgggggcaagcccctcccacctttgaatgtattcacagatcaaatgtgggagggggcttgcccccgatggcgccagaccagcccccctctgcctcagggataacccagcacttgcttgatcgccgcaagattggcctcgatccaccgccggtcaatcgcgccccaatcacgaattcgataattcccagcgtggttgcgcgctccctcttgctgctcaaactcgcagacgatatccaggtccgccaacgccgcaatcgtgtcttgggccgtacgccgaggcatgccggtggcttcggtaagcgccggcacactgctggccgactggctgtcgatcaggtacgccacgtaaaggcggcggtagaagctgcttttggtcttgctcacatccatggtcagtcgccttatggttagggcttaccctgcaaatcgcgccaggtgaggtacacacgcaggtcgaactccacttgatggtagtctggcatcatgtattggcagagtttgtagaacgccttgttgtggtccgactccttgaagtgggccagctcatgcaccacgatcatgcgcagaaactgcggcgccgcctccttgaacagcgaagcgatgcgaatctcctttttggatttgagattaccgccctgcacccgcgaaatcgtggtgtgcaaacccagggcgcgatgagtcaggtccagccggttgtcgaacagcactttatcaatagcgggtgcgttgcgcaggtgctcctgcttcaaggccagggcataggcgtacagggccttgtcgctctgcacggcgtggcgttcggggtaacgctgttccaggtaggcgcccaactggtctttggcaatcagttggcgcacctgctcctggagcgcagcgggataggcctggaggtatttcaacgcggtcatggggtctgcaacgcaattcggacgggcgccagtgtagccaattcaaggcaaacgcgggtacgaccaaccagcaacgtcctcggccatcaatggcgccgccgcccacggcccctggatatgcgtgcaaccattggctttgagccaatggatttgctcaagggtctgcactccctcggcaatcaccagcacatcaaaatgcccacacaactggatgatgctgcgtgccatcgccgcatcccgtgtcgaaccgggcaggcgcgccaccagttgcgggtcaagcttgagggtatcgaactgcaagtcccgcaaatgggccagcgaacagtgacctgaaccaaagtcatccagggcaatacgcaccccaatccggcgcagtagttgcagctgtttggtcgactcctccaggttactcatcaggcaattctcaccgatttccacctccagttgccgcccctgcagcccatatcgctccaggatctgctgcagttggctggccaagttgggcatattgaactggctgctgctcaggctcacgctcagcaccagctcagggtcgaagacgccctgccaggcttggcgctgggcagcgacttgctggtagatccaggcgctcaactggctgatcaaccgcgcctcttccagcagcggcaaaaacaaacccggcggtacatcgccgacgctaggatgctgccagcgcaacaacgcttcgacaccgcgcaaacgtccatccacaacacaaacctggggttggtacaccagggtgaaatccttgttttgaatggcggtgcgcacgctgtcttcaagcatcagccgcgaacgggcacggccgttcatttcctggtcgtaataacgatactgctgacggccggcccgcttggcttcgtacatcgcaatgtccgccgctcgcaacaggccgttcaggtccgagccacaatccgggaacgtcgcaatcccgatactgaccccgagcattacctccaaaccgtcgacctgctggcacacagagacccgctcgatgagcttttccgcgatctttgccgcctgttcgggaaattccagctcaagcaacgcggtgaactcgtccccgcccatgcgcccgagaatgtcgtaggagcgcagacaggcctgcatctgttccgagacccagcgcagcactcggtcgccagcgtcgtggcccagcgtatcgttgacccgcttgaagccatccaggtccaggtacaacaacaccagcgcctgctcgttgcgttcgttgcgcaacaaggtgttctctaccgcctgatggaatccacgacgattgagcagcccggtcaacggatcggtcacggcctggaattccagttgctgatgaagatggcgcacttcggacatgtccagcaccgtcacgaccatagccttctgctcggcaggcaatggcgcacaggacaatgccaccggcacctgctggccacgcccggtgcgcaaaatggcgtcatgctggcgccacgtctcgcccctgcgatacgcctcgtacatcgggaagcccaaccaggcgggcacatggggtttttgcaggaaactcaggaaactttcgccctgcagctcagccatcgtggcgttcagcaaacgcgagatagccgggttggcatactcgatcacactgccttcgcccaccaccaggatgccctcggcagcgttatccagtatcgaggcattaaaggccctagccagctccaggtcatggctcaggcactgcaaggcacggcggttgcgctgatgttcaagcaaggcttgcaccttaggcttgaggatatgcgggtcaaacggtttgaacagatagtcgatcgccccgctggcatagccttcaagcactgacgcgggggactgggcggtggctgtcagaaagataatcggcgtcatgcgcgtacgttggctgccacgcatcaggcgcgccacctcgaagccgtccataccgggcatgcgtacgtccagcagcaccaggtcgacatcgtgggccagcagcaactccaaggcttccaggccggacgtggcggtaatcacctgccagtcttcacgttgcaacagcgcacgcatgctgacgaggttttccgggtagtcatcgaccaccaggagaaccgaacttgcatcgccgggttgtggagcgccatccatgctacgtctcttccttagggagctgcaccggtcacttctgatacaaaggccggataaacactgagggctcactctagccccggttccaaaaaagcagaagtgacgccgatgccctcattgcaccaaagccaaggaagccgactaacggtaaggccctgtagcccgcgattcatgggcaacatggctttttggcattcctctgacgccaataaattgccagctattgtttaacaatcgtacgagcagcgcctataaagaaccggtaaggcctgcgggccaacgctttcaccctctgtaaaaggccaacaccatgatcgacctttccacctggaacctgagcattccggtcggctccccgcccacgaccatcgacaccccgaggctactgagcggcttcaacgatcaatacttccaggccgaaggcagcgacgtgcagttctggacccccgttaccggcacccgcaccgaaaacgccatctacccgcgcagcgaactgcgcgaaacctacgccgacggccgcctgcgcaactggacctaccccgaggccgacaactttctgcgcgccaccctggcggtcaaccaggtgccctcctccggcaaaatcgtgatcggccagatccacgcctatgacagccaaaagccgctgatcaagctggagtaccagttcaaggaaaaaacccagaccggcaacatcgtcgccaaggtgcgcatgcgcccggatgaagccgaaagccgggtgatcatcgtcgcctccaatgtgcccctggaaaagagcttcacctacgtgatcaacctcaacaaagccgggctgctcagcgtgtttgccgccgacagcgagtggaatgaacgcataggcgcggcctggggcgacaagccgctgtacttcaaggcgggggtgtatgtgcaggacaacagtggggacagccaggagggggcaagggtgacgtttgcgaagttggatattgatcacgagtaagcggattgccctatttcgagtaggtaatgtccgataagcacaaggatcattccccgatagatccagacgattaaatcccctgtgggagggggcttgctcccgatagcggtgtatcagttccaatagctgtgactgacccaccgcaatcgggagcaagccccctcccacacttgccgcgcttggcctgagagtccggtgctagtcctacaggaccgttgcggccagtcaattcgccgcttatagttcgccccgtcgctggctgaacagcgatagggtttcgcagccctacagagttaaaccgcacccgtcaaaacagtcccggtattcttgccgatggccgtctttgttatggcggctgtgcgtgggagaccttcgggtctgccgggtcttaactcctcggtctgcgaacccgcgtacagctgccacctaatttgtttcgcagcaaacggtggtcaatcttctttcgagttaaggattcaccatgacccaacaactaccaccccgccgcttcaccccctgcaccgaaaccgccacagactaccccgtgctcctgatcgacagcgacgccccactgctcgacctccacgcctgcctgcgcgaacgcctcaacgcggcccttgaacatctcaacctgatggcctgttccagcctgccggacttcgctgagcgcgacctgaacaacatcgccaacactgcacgcatactggttcaggacgtgagcgatgtgtttcgagtgattgagcatcgagggttcgatacgcccagcgccgtctaatcaaactccagcaaaaaacccgtattcctgcgggtttttcatagatcggacttatttaaaattatcccatcaggtcagtcctaatcacctgatggcttcgcctatctactgaggaggcaatgtaaatttcgcaggaccctttgagttcatcagctcaaaagtacagtctgtgacattgttacctttacattcctcgtgctcgttccaagcactgcctttagccacgggagataaggtaaaacgcttggacagtcttaaatagtcgttcttgccttttcctacataatcgcagatcacatagttgtaaggtaacttcgtttcactgtctgtttcctgcttgatcgccgcgactgaaaatttaaacccgtcaaccatcgaactatcctcgataagctgctcaccattccactcctgctccccgtctgaaaagtgaatgctcactgccttaatacttgagacgtcgggacaagacagcggagctgtataggcattacccattagcgctaatcctccaacagcagtaaggcattgaagcgtttttaatagatgcaaatgtgacatagcttgtattcccttattggagtaatcatctgcagcatgcgggaattaatttacgaagaacactgtcaacattgacagtgttaaataacaattagaaataagcacagtaacttaatagccagaccattacgatacagggggcacgccaggttgagcttattgaacaaggcgttccgatctcgtagattcaattaatcagcaatgcgccacaaagagggcagctaatcgggaactcagctttcacagataaaattcaaaaaaattacagttcagcggatcattaaccttgggagggaaagcccttgatggatttaaacagatcttcttccttggacctccatagcgaaatcgtataaaaaactgtcaaatttaacagttcctccaaatcgcgctgctagctaacctctcagagcgccacataagtaatcgagattggccgaatacacatgttcaggcctaccttaaacatttccacagaatggtgaaaatcatggccttaaccaacccaaatggaacctatgaaggtgctgtatatgatcccggcgaacgcaatgccgccaccctcataatttcctcctcagacacacaagcaggcagaataacaaaagccgatatgacttattacggacttaattttaatgttaccggaacctttacagctcaatcttttaatttgcgagctcaagccaaaaacggagacagcatactcaatataaccctgaactcgtcgaacgattatcaaaaactggacggcaaggtcactgtggagcgaggaggaccaaatgtaggtagaacctacgacatgacattccagaaacactgatacaagcgcataaccgactgttacttttatttgacattatcatccagcaaatttaaaaaacccgtctgacgacgggttttttaatacagattaaaagtgaaaaatttagttcaccttagcgttcaactcacctttcaaataccgctggtacatcgcttccaacgaaatcggcttgatcttcgaagcattgccggcagtaccaaacgcttcgtaacgcgcgatacacacatcacgcatcgcagtgacggtagcgccgaagaatttacgtgggtcaaattcgctcggattggtcgccatcaggcgacgcattgcacccgtggatgccaaacgcaggtcggtgtcgatgttgaccttgcgcacgccgtacttgatgccttcgacgatttcttcaaccggtacgccgtaggtttctttgatgtcgccgccgtactggttgatgatcgccagccactcttgcggtaccgaggaagaaccgtgcatcaccaggtgggtgttggggatgcgcttgtggatttccttgatgcggtcgatggccagtacgtcgccggtcggtggcttggtgaacttgtaggcgccgtggctggtgccgatggcgatggccagggcgtcaacttgggtcttcttgacgaagtccgcggcttcttccgggtcggtcagcatctggctgtgatccagcacgccctcggcgccgatgccgtcttcttcaccggccatgccggtttccaacgaacccaggcaacccagttcgccttcaaccgatacgccgcaggcgtgggccatggcgacggtttgctgggtgacgcgtacgttgtattcgtagtcggttggggtcttgccgtcttcgtcgagggagccgtccatcattaccgagctgaagcccagctggatggagcgctggcacacgtcagggctggtgccgtggtcctggtgcatgcacaccgggatgtgcgggaattcttcgatggcggcgaggatcaggtggcgcaggaatggggcgccggcgtatttgcgcgcaccggccgaagcctggacgatcactggggagtcggtcttgtcagcggcttccatgatggcgcgcatctgctcaaggttgttgacgttaaaggctgggacgccgtagccgaactcggctgcgtggtccagcatttgacgcatgctgataagtgccattgtgttgtctctcccggtcgagggtcgttaatcgtgcaagcctgccgtagcggcggctgctattcaagttattgcagatcaaggggttaagcttgagctgctgaatcgttattgcagtagccgattctcactttggaaccggatttactgtgggagggggcttgctcccgattgcagtgtgtcagccagcacatgggtgtccggcagaccgctatcgggggcaagccccctcccacatttggatctcattacagtcaaaatttcactgagctttgcagccgcgcccgatcaaatcatcggtggccacccagtaaaccaggccttcctcacctttggtgtgaaacgccaactggccgtcgctgtacaacacgcccgaagcggcaatctcttgcttgagacggtaaacctggtccgaaccacccaggcgtacatccacctggctgcggtcctgattggcaaagcgccaattgacctcggccttgctgtcgcaggtccaggtggtccacttatcggcaggctctgccttgttaaacatgttcatgctgctgcagccagccaacagggccagggctgccagggcgaaaacgcctttcattgccaatcctcgaacggcgaccccggaaggccgcctttgctgtcggttagtggatcagacccgtcatgggcaaccctgttcctgaccgttgggcgcggagtcgtatttctccagccgttcgttgccgatgcgcttgttgatcaccggcatggtctcggcttgccagtcagcctggtaacagctttttttcagcggtgccttggcgttatccgcctcgggcgccgcacttggcgtgctgccgcagccggccagcaggcccgctgcgattaccagtgccaacgacttgatcatgggaacactccttttcctgatcacgcgagctttagcccttggctcgggtttccagcacttctacggctggcagtactttgccctcgacgaactcgaggaaggcgccgccaccggtagaaatgtaggagatctgatcagcaacgccatatttatcaatggccgccagggtgtcgccaccgccggcaatggagaaagccgagctttcagcgatcgccttggccagcactttggtgccgttgccgaactggtcgaactcgaacacgcccaccgggccattccacaggatagtctgggatgccttgagcagttcggcgaagttggccgcagtttgcgggccgatatccaggatcatgtcgtcagcggccacgtcagcgatgagcttgacggtggcttcggcgctttcagcgaactctttggcaacgaccacgtccaccggcaatggcacgctgactttggcggcaatggcgcgggcggtatccagcaggtccggctcgtacagggacttgcccaccggatggccggctgcggccaggaaggtgttggcgatgccgccgccgacgatcaactggttgcagatctggctgaggctattaagtacatccagcttggtggaaaccttagagccggcgacgatggcggccatcggctgggccggagcgcccagggccttgcccaatgcatccaattcagcggccagcaatgggccggcagcggcaaccttggcgaacttggccacaccgtgggtcgaaccttcggcgcggtgcgcagtgccgaaagcgtccatcacaaacacgtcgcacagcgccgcgtattgctgggccagttcgtcgctgttctttttctcgcccttgttgaagcgcacgttttcgaacagcacgatgtcgccaggcttaacgtcaacaccgcccaggtagtcagccaccaacggcacgtcacggcccagggccttgctcaggtattcagctaccggcttgaggctgttttcggcagaaaactcaccttcggtcgggcgacccaagtgggagcagaccatcacggccgcgcctttttccagggccagcttgatggtcggcagcgaggccaggattcgcgcatcgctggtgacaacaccgtccttgactgggacgttgaggtcttcgcggatcagtacgcgtttaccttgcagatcgaggtcggtcatcttcaacacggtcatgggtcgcagttcctgaattactgttgaggttgtttagaggcgatgtgcagataatgttccgcaacatccagcattcggttggcaaaaccccattcgttgtcgaaccaggccaggatattcaccaacctcgggccggaaacgcgggtctggctggcatcgacaatcgccgaatgcgggtcatggttgaaatcgcaactggcatggggcaactcggtgtaggccagcaggcctttgagcgggccgctggtggcggcgtcgcgcaggatccggttgacctccgccgcatcggtgtcgctgacggtttgcatggtgatatccaggcaagacacattcaccgtcggcacccgtacggctttggcctggattcgcccggcaagttccggcaacagtcgctcgatgccgcgagctaagcctgtggacaccggaatcactgactggaacgccgagcgcgtgcggcgcaggtcttcgtggtgataggcgtcaatcaccggctggtcgttcatcgccgagtgaatcgtggtgatcgacacgtaatccaggccgatcgcctgatccagcaagcgcaacagcggcacgctgcagttggtggtgcacgaggcgttggacaccagcagctcatcgccagtcaggcaatcctggttgatgccatagacgatggtggcgtccacatccgcctcgctggccatcggctgggaaaacagcacacgcggtgcgccggcgtcgagaaaacgctgaccatcggcacgggtgtgataggcaccggagcattccaacaccaggtcgacgcccagcgccgcccagtcgatgccctcgggggtggcactgcgcaacactttcacgcagtcgccattgatatgcagacaatcgccgtcgacccgcacttcgccgggaaagcggccgtgggtggagtcaaagcgtgtcaggtattcgatgctggccatgtcggccagatcattgatcgcgacaatttcaaacccggccgccgctcctcgctcgaacagcgcacgcaagacgcaacgaccaatgcggccgtagccgttgagtgcaactttgtaaggacgcggttgaggcatggggttctcgcattgtgggcgacacaaaccactgtaggagcgagcttgctcgcgaagaacttgagagcgccgcgttaaaccagaaacactgcgttatcgttaacgatcttcgcgagcaagctcgctcctacagtagaggcggtgaccagtgggccaccgcgttagcgccttagtcttccagcagctcttcagcctgacccaggatattttccagggtaaaaccaaactcttcgaacaacgctggtgccggcgccgactcaccgtaggtggtcatgccgattacgcggccttccaggcccacgtatttgtaccagtagtcggcgtgggccgcttcgatggcgatacgcgcgctgacctgcaaaggcaacaccgactgcttgtagccggcgtcctgggcttcgaacacgctggtgcacggcatggacacaacgcgcacgttacggccctgggcggtcagcttgtcgtaggcctggacggtcaggcccacttcggaaccggtggagatcaggatcagctccggctcgccgatgcagtccttgagcacataaccaccacgactgatgtcggcgatctgcgcgtcggtacgcacctggtgttgcaggttctggcgcgagaagatcagcgccgatgggccgtccttgcgctcgatggcgtgcttccaggccacggcggattcaaccgcgtcggccgggcgccagcaatccaggttcggcgtggtacgcaggctggtcagttgctcgaccggctggtgcgtcgggccatcttcgcccaggccgatggagtcgtgggtgtacacatggatcacgcgctttttcatcagtgcggccatgcgcacggcgttacgggcgtattccatgaacatcaggaacgtcgcgccgtatggcaccaggccgccgtgcagggacacgccgttcatgatggcgctcatgccgaactcgcgcacgccgtagtacatgtagttgccgctggcatcttctgccgagacacctttgcagcctttccacagggtcaggttggaaccggccaggtcggccgagccgccgagaatctcaggcagcagcgggccaaacgcgttcagggtgttctggctggctttacggctggcgatggtctcgcccttggccgcgacttcggcgatgtaggccgaggcttttgccgagaagtcggcaggcaggtcaccggccagacggcgtaccagttcattggcaagctcagggaattcggcggagtaggccgcgaaacgttggtcccattcggcttcggtggccaggcctttttccttggcatcccattcggcgtagatgtcggccgggatttcaaacgggccgtggttccacttcagcgcttcgcgggtcagggcgatttccgcgtcacccagaggggcgccgtggcagtcttctttaccttgcttgttcggcgagccgaagccgatggtggttttgcagcagatcagggtcggctgtgcactcttgcgcgcggtgtcgatggcgatcttgatctcttcaggatcgtggccatcaacattgcggatcacctgccagttgtaggcctcgaaacgcttgggggtgtcgtcggtaaaccagccttcgacttcgccgtcgatggagatgccgttgtcatcgtagaaggcaatcagcttgcccaggccgagagtgccagccagggaggcgacttcatgggaaatgccttccatcatgcagccatcacccaggaacacgtaggtgtggtggtcgacaatgtcgtggccagggcggttgaactgcgcgcccaggactttttccgccagcgcaaagcctacggcgttggccaggccttggcccaggggaccggtggtggtctccacgcctggggtatagccgaactccgggtggcccggggtgcggctgtgcagttggcggaagctcttgaggtcgtcgatggtgacgtcgtagccagtcaggtgcagcagcgagtagatcagcatcgagccgtggccgttggacagcacgaagcggtcacggtcggcaaacgaagggttgctcgggttgtgtttcaggtagtcacgccaaagtacctcggcgatatccgccatgcccatcggggcaccgggatggccgctgttggctttttgcacggcatccatgctgagggcacgaatggcgttggcacgctcacgacggctgggcatcgctgatctcctggagtttgcttaaaagaaacggaaaaaaggaccggcattttccctcagccaccgcctgcgggcaatgacagatagtcacttgaagggctttttcccaaggtttctacagttatcccttgcagaaccctgccacaggttcgtctaagggttatagcggtggcttataaccgccacttatcgatcaatatcaaaactttttgatattgaccttgcggggatcccaacccgtcactagactgctggccttatgaacctacccgtgccctccctgcgtcctgacgatggcgatgagcttgcagccttgtgcaaggccgctggcgatccgttgcgcttgaacgtattgcgtgcactggccaacgattctttcggggtattggaactggcacagatcttcgccatcggccagtccggcatgagccaccatttgaaggtgctggcccaggccgacctggtagccacccgccgtgaaggcaatgcgattttttaccgccgcgccctgccccacaccgaacaactgggcggcaaactgcacgcggccttgcttgaggaagtggacaacctggggctgccaagcgacgtgcaatcgcggatcggccaggtgcacgggcaacgcgccgccgccagccaggactttttttcccgggttgccgacaagtttcgcgcccagcaggacctgatcgccgggctggcccagtaccgcgaaagcgtgctggcgctattggacaagctgagcttcagtgataaggccacggccctggaagtcggccctggcgacggcggtttcctgccggaattggcgcgccgcttcgtgcaggtcacggcgctggacaacagcccggcgatgctggagctggcgcgccagctctgtgagcgcgaagccttgggcaatgtgcgcctgcagttggccgacgccctgggtgacaccggcctgcgggccgattgcgtggtgctgaacatggtcttgcaccatttcgccgcaccagccgatgccctcaagcaaatggccgggttgctgcaccccggcggtagcctgctggtaacggatttatgcagccacaaccagaattgggccaaggaggcctgcggtgatctctggctgggttttgaacaggacgatctggcccgttgggccaccgctgcgggactcgttcccggggaaagcctctatgtaggtttacgtaatggtttccagattcaggtccgccattttcagcggccggctggcgacactcaccatcggtaaatatcaggaaaacatcgagatgagcgaatactcccttttcacctccgagtccgtgtctgaagggcatccggacaaaatcgccgaccagatctctgacgcggtgctggacgctatcatcgctgaagacaagttcgcccgcgtggcgtgcgagacgctggtgaaaacgggcgtggcgatcatcgccggtgaagtcaccactacggcctgggtcgacctcgagcagatcgttcgtgatgtgatcaccgatattggctacaacagctccgacgtcggcttcgatggcgccacctgcggcgtgatgaacatcatcggcaagcagtcgcccgacatcaaccagggcgttgaccgggccaagcctgaagaccagggcgccggcgaccagggcctgatgttcggctacgccagcaacgagaccgacgtgctgatgccggcaccgatcaccttctcgcaccagttggtgcaacgccaggccgaggcgcgtaaatccggggtattgccatggctgcgcccggacgccaagtcccaggtgacctgccgctacgaaggcggcaaggtcgtggggatcgacgccgttgtattgtcgacccagcacaacccggacgtgtcctatgccgacctgcgcgaaggcgtgatggagctgatcgtcaagcacgtgttgcctgccgagttgctgaccaaggacacccagttccatatcaacccgaccggccagttcatcatcggcggcccggtgggcgactgcggcctgaccgggcgcaagatcatcgtcgacagctacggcggcatggcccgtcacggcggcggcgcgttctccggcaaggatccctccaaggttgaccgttccgcggcttacgccggtcgctatgtggccaagaacatcgtggctgccggcctggccgagcgctgcgaaatccaggtgtcctatgccattggcgtggcccagcccacgtcgatctcgctgaatacgttcggcaccggcaagatcagcgatgacaagatcgtcaagctggtgcgtgagatcttcgacctgcgcccctacgcgatcaccaccatgcttgacctgctgcacccgatgtaccaggaaaccgcagcctacggccacttcggtcgtaccccggcgcagaagactgttggcgacgacaccttcagcaccttcacctgggaaaaaaccgaccgcgccaacgacctgcgcactgccgccggcctgtaagcgttcgcgctgcacacagaaacacctggtaaaaagccccgagcagtcggggcttttttgtgggcacttggatgacttaggctgggcacccttcctcgagcaaggatgctcatgatgcataggttcatggctttttttctcagtgttctacccggctgggcgtgggcagaggcctgccccgatgacgctcacgcgcaactcgacaccttgaccaggcaggtcagccagtgggacgacagctaccaccgcctgggtcagtcccccatcagtgacgaactctacgaccaggcccgccagcgcctggcgcactggcacgaatgcgctcaccagcccctcccgaaggctgataatccgctgaccagttcacgtggcacattacgccatccggtcgcgcacactggcctgggcaagctgctggacgagtcggcagtcagtgactggctcagcacccgtcacgatgtatgggtccagcccaaggtagacggcgtcgcggtgacgctggtgtatcgacaaggtcgcttgcaccagctcatcagccggggcgacggcctgctggggcacgactggtcagcctccgggcgcaggatcccgggcatcgtgcaacagttgccagacgcggtggatgtagtgttgcaaggcgaactttactggcgcctgaaccaccacgtgcaatcgatgaagggtgggctcagtgcacgcagcaaagtggctggcctgatgaaccgtcgacagttgagcgatgccgaggcagcagggatcggcttattcgtctgggcctggcccgatggtccgagcgatttcaacgaacgcctggccgccttggcgcactggggcttcaccgacagccagcgttacagccaccctatcgagaacatcagcaaagctgcgcattggcgcacgcattggtacaacgcgccactgcccttcgccagcgatggcgtggtactgcaccaggccgcgcgggcgcccgccgaacgctgggaggccagtgccccctattgggcggtggcctggaagtttccggtagtaaaggccctggcgctggtgcgcaacgtagagttccaggtcgggcgtaccgggcgcattacccccatcctcgagttggaacccgtgcgcctggatgatcggcagatcagccgggtcagtgccagctcactgaaacgttgggaaactctggatatccgccctggtgaccaggtgtccatcagcctggcgggccaggtgattccccggttggatgaggtggtcctgcgtaacgccacaagggtggacgtgcaggttcccgatacccgggcctttcacgccctgagctgctggcaactggagccgggttgcgaagatcaattgcttgcccgcctgacctggctgagcggcaaacagggtttggccttgccgcatatgggccgtgaaacctggaacatattgatccaggcgggtctaatcgcaggctttctcgattggttaaccctggatgcggcccagcttgctaccattgagggcttcggtgaccgcacccgtgcgcgggtgctcgacaatattcaacgcgcccggcaacgccctttttcacaatggctcaaggccttgggcgtaccacctgcggcgcgcaacaacctggaaggcgactggcagacactggtcgccaaagacacccaagcctggctggcctcagacggcatcggcccgggacgcgcggcgcaactcagcgctttttttcgcgacccgcaggtacaagccttggctgaaacattacgcggggccgggatagatgggttttgaacgccgcccggccacctgattgcgaccttggagctttatatgaaatttctcgccccccttgccttgctgaccctcgcaagtttcacagccacgccactactggccgccgaagacgcgcagccgcttaccggctgcgccgccaagcgccaggctatcagcgcccagattgaccaggccaaggcccatggcaacagcgcccagcaagccggcctggaaaaagccctggccgaagtcaccgcccactgcaccgatgcgtccttgcgtaaagagcgtgaaaacaaggtgctggacgccaagcatgaagtcagccggcgtcaggccgacctcgacaaggccatgaaaaaaggcgacccggacaagatcgacaaacgtaaggacaagctggccgagtcgcgcaaagagttgcaggacgcggtggaagaactcgaccggtaaacccggtcagtggtcgcggaactgcttatgacaggcgctacaggcatcttcgactttttgtaccgcaggctggaggttgctggccttgtagggctgcagttggctggcgatcaccaattcaccggtggcagcctcaaggtcgcgggccagttgctggaattgcgcctgtttttgccagacatcgtccttggcactggtgtggtcttcttcgcgcacactcgggaaatgcttccatggttcatgggacaaggcatccagcttgaccgcgccctcggcgaacctggcaccgtcgaacggaatacgtccgcgcagcatgccgcccaggtcttcgccggtcttgagcatctgcttgaagatcgccttgcgctggcccagaggggagttggggtcgacaccgccacaggcggacaaggccaggaaggccagcagtacaacggtcagtttttttaacatcatgatggcttcaaggtcacggaaaacggcggccagtatcctcgcaccgcccacaaagaccaatagccctattaataataagggttgcccgcctgcagcgacgcacgggcaatcgtttcaggaattgcctagatgaatgtcaccttgaaaccctggagccgccgcctggcgtgggctctgccaatgatcgcgctgctggccggctgtgatgcaggtaaagacaccgacaaagaagtcgccaaagaagaagccaagcctcacgccgtcgccacctatgtgagtgcgccttgggaagccttgccggttgtcgccgatagcgacttgctggccgggtttgaatcctggcgcagcgcctgccagcgcctcaaggccgacccggtgtggggcacgacctgcgcagccgcagccagcgtaccgggcgatgccgtggcggtccgtggcttcctcaaagagcacctggatgtattcggcctgcgttcggctgacaacaccccacatggcttgatcaccggctattacgagccagtctaccctggcagcctgaccaaaaccgccagcgcccacgtgccggtatacggtgtgccggatgacctgatcatcgtcaacctggaaagcatctacccggaactcaagggcaagcgcctgcgcggacgcctagaaggccgcgtcctcaagccctacgacgacgccagcaccctcaacagtcaaggttcgaccgccaagccgattgcctggctgactgacccgatggacctgcaattcctgcagatccaaggttcggggcgcattcaactggcgggcgggcgtcaactgcgtgtcggttatggcgaccagaacggctacccctatcgccctatcggccgttggctggtagagcaaggcgagctgaaaaaagaagaggtgaccatgggcgccatcagtgcctgggccaaggcacacccgcagcgtattccggagctgctggcgagtaaccccagctacgttttcttcagcgcccgccccgacagcaacgaaggcccgcgcggttcactgaacgtgccattgaccgccggctatagcgtggcggtggatcgcaaggtgatcccactgggtagcctgctgtggctgtcgaccaccaaacccgacggctcaccgatcatccgccccgtcgcagcccaggacaccggcggcgcaatcaccggcgaagtgcgggcagacctgttctggggcacgggtgatgcggcaggcgagctggcgggaaatatgaagcagcaggggcagatctggatgttgtggccaaaaggtgcgccactcccccaggtaccagaggcgccagctggtacctgataatgctgaagatcaaatttgggagggggcttgccccctcccgcaagctttctgcgtcaagggttagatcgagacgaagaagaaactcgcaatcaacaccatccccacaaaccacaccagcgaacgcaagatcgcccagtccgccaggtagcagatgatgtacagcaggcggctggtgataaatagcaccgccagcacgttgatcgtcaccagttctgccgtaccggccaggtgcgcgatgatcaccgccgcggcaaacgccggggtcacttcaaagctgttgagttgcgcactgtgggcgcgcttggcaaagccttcgagggtatcgaggaaggcccgcgggtcgtggttctgccgagccccgaacttgccgccgctgaacttggccactcccgtgcacaggtacggcagaaaaattgcaatcaacacacaccagaaagccactgtcataacccattcctttttagttttatccgatagtcaaagttttatcaccagcatgccgaacaataccaccaggccctgctcaattgattcgtgatgtaactgcacctgtttatactaaaccctgcttcggcgcacctcgtgtgcctacatttccccgctccaaggaccccggatgcttgaacttgtcgccgccttcatttgccttaccaccctgctcacctatgtgaacttccgtttcatcggcctgccaccgaccatcggcgtgatggtcaccgcgctgatcttttcgctgatcctgcaaggcctgagcgtgctcggctacccgggcctggaggaacgcgtccagcaactgatcggccagatcgatttcggcgatctgttgatgaactggatgctctcgttcctgctgttcgccggcgccttgcacgtcaacttgaacgacctgcgcagctatcgctggcccatcggcttgctggcaacctttggcgtgctgatcgccaccgtcgtgatcggcagcctggcgtactacattttcgccttgtttggctggcacgtaagtttcctctattgcctactgttcggcgcactgatttcccccactgacccgattgcggtgcttggcgtactgcgtaccgccaatgcgtcgaaaccgttgaaaaccaccatcgtcggcgagtcgctgttcaacgacggcaccgccgtggtggtgtttaccgtgttgctgggcatcgcgcagttgggcgagacgcccaccgtgagcgccactgcgatgttgtttgcccacgaggccattggcggcgtggtctttggcgggctgatcggctacctcgtgtacctgatgatcaagagcatcgaacagcatcagatcgaggtcatgctaaccctcgccctggtgatcggcggctcggccatggcttcggaactgcacgtctcggcaccgattgcgatggtggtcgcggggctgatcatcggcaacctgggtcgcaagctggccatgaacgatatgacccgtcgttacctggatggcttctgggaactgcttgacgacatgctcaacgccctgttgtttgcgctgatcggcatggaattgctgctgttgccgttcaattggctgcatgtgttcgcagccagcctgctggcgctggcgattctgctctcgcgcctgttgaccgtggccccggcaatcctgctgctacgacgctggcgcacggtgccacgcggcactatccgcatcctcacctggggtggcttgcgtggcggtgtctcggtggcactggccttggccctgccgctcggcccggagcgtgacttgctgctcagcatcacctatatcgtggtgctgtcatcgatcctgttgcagggcttgagcatcggcaagctggtcaagcacgtgacccgggatgagcaacaggtcacgtccagccctcactgatccttgtcgatctgctgcggatgccttgggtccgcagccgctttacccggcaggctgctttcactgcggatctgcgcgtgactgatcagggcgaagatgaagctgcccccgatgatgttgccggccagcgtcggcccggcgaagaccagccagaagtccttccacggcagttcgccggcaaacaccaggtacgacacttccgccgagccgacgacgatatgggtgaaatctcccaacgccatcaggtaagtgatcagtacgatgatccacatcttcgcgctttccatcgaagggatcatccagaccatagtggcgatcatccagccggacacgatgcccttggcaaacatctgcgcgggatcgttctccatgatcttgcgcccgatatcgaggaaggccaggtcggtcttggtgtcaaagatcggcaggtgcaacatcacgtaggccaccagcaaagtgccgcacaggttgcccaccagtaccactgaccataaccgcaacaggcgaccggcattgcccagggtaggcttgctcatcaccggcagcactgcggtcagggtgttttcggtgaacagttgctggcgcgccaggatcactgcgagaaaccccgcgcaatagccgaagctggcgatcaccttgaagccttcgccgtccggcagccgcgaattgagcaaccccatcgccatcaatgaaagccccatggtgagcccggccgcgagtgccgaccaccacaaggcggcgacactgcgttccagttcctggtcgccctgggtgcggatgatttcgtgcaaaacagccgcgcgcggcggctggttcttgtcgacgtcctgttgctcttcctgcgacaggttgggggtcttgccgtctgcttgagtggccatgatgtaccagagtccgagaggtgcctgaaactacgacctgccgcaacgatggctgttcaatggctcggcagctaaaccggaataagccaggcctttgcctgttctaccgcaggggaactgaccagtgtgctccagggcttatcgtggggttgatagtatttgatgatgccgttgagcacgctgttgaagtcagccggtgtggttgcgtcgcgcagatctcgcgccgcgcgctgcaacaactcaacattggcgggcggctggccgggaaggtacaacgacgggtaaatgacctccctggtaaaattctcgcccttcactccgacatcccgtctttgcatttcagtaacggcgctgctcaacaccttggacaggctcgaagaattgctcgacgccagtttggcgcccacctgcaacaactgctggaaattacgatgacccggcgcattcaagcgcttgcccagccaatcgatatgctcgggcctgctggccagggcatccaagttgcgtagcgccgaggccaacttcggcgtaatcaccagcgatgtgctggtttgattagcttcgctgatcgcagcgtccagcgcttgcaaagcctgttgtgcctgctggcgaaaccgaagcgcatctgcgccggccggatccttctgcagctcatcctgcacgccggcgagcatttgatcatccatcgccatcacagcatcgtccagggaggcgaactcatgacgttcacgcaccagctcgcgcttttccaggtgccccgacaccgcctggtgagccttggcctgcaaatgcagtttctgctcaggggtcatggtgaagttgacagtgccattaagcaggccgcgaaaatcacctttttccgaattcagcggcaaggttatcgattgatcttcgaacgctttgagccggtcgtcctggtaggcttctgcagcggtatgcggtgcccccgtgaaggtgtcgcccagaaaactgaaaaagctgccgctgttggacgaatcagcggttttttcagactcgaattttacgatcagcgtttcgtccttgcttaggggactctccgggaaagaacgttcgataaccccggaagccggcgtattgagcaacagtccaccatcctgaaaagccgtgatttcagcttcggcctggaacccatggccttgttcggatgggctgctgaacagacccggcagtgcacccgaaatatgcgcagcacgggcaatatccatatccggcgtcaagctggcattgaacaccaccaattgcgggcggccatcgaacatgccagtacccgtgatgttgagctgcttgatcgccgggatatggcgactcaacacctccagatcgcgaaaggtaggccctgctcccgcgctgagccggttggcgatttccgtgacttcagtcggtcgtttggcctcgggtatgtccgcgatatgggcgagtattgattgacgcgactgatcgcggatcaattcctccagtggctgtgcctcgctttgcaggcgcggcaacatggtcagcaacagttgagaaatattacccaccgggccaggcagcttgctggcgagtttgccaagctgggaactgacaccctgcaaccaggccaggacggggtttttgctgttgagcaagctgggcagatcgaggttgttcgacaactcggtgaatgccttggcgtccatgccactggcgagcaccgctgcagagatagcaccggcagatgagccggaaaccaccttgatgtctttcagtttgtcggcctcttcaagggcctgcaccatccccgggaaggcgatgcccttggcaccaccaccactgagcaccagatgtgccgggggcggcggtgacagtgcgacctccacacgcccgtcgccgtggcgaaaaacgcttaccttgctttcgcccacgcctttgaccaacggcgtcttcacctcttgatcgaggttttgaggtaatagtggctgattctgtacaacggaattggagacattcatacacgaggctctctctacagggtgtaggcctgagtgatgagagagtctcgggaagatccatgcggaagaatccggtaacgcaaatcatgccgtgcagttgttactcagagagaccgtcgtccttgaactggtccttcacgtacttgatttcggtacggccgtgaggcgctggcaagccgtcttcgcccaggttgacgaagaccaatttttccacggtcaggatgcttttgcgggtgatcttgttgcgcacctcacaagtcagggtgatcgaggtgcggccaaactcggtagcggtgatgcccagctcgataatgtcgccctggcgcgaggcgctgacaaagttgatttcggagatgtacttggtcaccacgcgctggttgccgagctggacaatcgcgtagatggccgcctcctcatcgatccagcgcagcaggctgccgccgaacagggtgccgttggggttgaggtcttcgggttttacccatttgcgggtgtggaagttcatggtcactccaaagcgtcttgcgaaatgatgggcaacatcatggcagagcgcggacccaagctctatgaaccattgcctatcacccccatgagcgatcttcatgccgccgacggaaaggcttgggaagtgtgtcgtacacggctataatcgctcccgcttcaaaacggtcatcttcgattgataccgttctcccgccacctgtccgaggggcgctgcagcaggttcaacctgtcaggctcggatggggcgttgtccggcctggttgccctggcctgatactaaacgcacaacggcgcccattcgcacactacgaatggaggctcttcatgagcgctgtcatcacgcctgcagatttcaccgactacaaagtcgccgatatgtccctcgctgcttggggccgtcgcgaaacctttatcgccgaatccgaaatgcctgccctgatgggcctgcgtcgcaagtacgccgccgagcaaccgctcaagggcgcgaagatcctcggctgcatccacatgaccatccagaccgccgtactgatcgagaccctggttgccctgggcgccgaagtgcgttggtcgtcctgcaacatcttctcgactcaagaccaggccgctgccgctatcgctgccgccggtatcccggtatttgcctggaagggcgagaccgaagaagagtacgaatggtgcctggagcaaaccatcctcaaggatggcgcgccatgggatgccaacatgatcctcgacgacggcggtgacttgaccgagctgttgcacaagaagtacccgcagatcctcgaccgcgtccacggcgtgaccgaagaaaccaccaccggcgtacaccgcctgctggacatgctggccaagggcgagctgaaaatcccggccatcaacgtcaacgactcggtgaccaagagcaagaacgacaacaagtacggttgccgtcacagcctgaacgatgcgatcaagcgcggcaccgaccacctgctgtcgggcaagcaagccctggtgatcggctacggtgacgtgggcaagggttcgtcccagtccctgcgccaggaaggcatgatcgtcaaggtttccgaagtcgacccgatctgcgccatgcaagcctgcatggatggtttcgaagtggtttcaccgttcatcgacggtatcaacgacggcactgaagcaagcatcgacaaagccctgctgggcaagatcgacctgatcgtcaccaccaccggtaacgtgaacgtgtgcgatgcgaacatgctcaaggccctgaaaaagcgcgccgtagtgtgcaacatcggtcacttcgacaacgagatcgacaccgccttcatgcgcaagaactgggcatgggaagaagtgaagccgcaggttcacaaggttcaccgtaccggtgccggtcagttcgacccgcagaacgatgactacctgatcctgctggccgaaggccgcctggttaacctgggcaacgccactggtcacccaagccgcatcatggacggctcgttcgccaaccaggtactggcgcagatcttcctattccaacagaaatacgccgacctgtcgccagcccagaaagccgagcgcctgaccgtggaagtactgccgaagaaactcgacgaagaagtggccctggaaatggtccgcggcttcggtggcgtggtgactcaactgaccaagacccaggccgactacatcggcgtgacggttgaaggcccgttcaagccgcacgcttaccgctactaagtaatcagcccaatctgctctacctgtaggagcgagcttgctcgcgaaaaactcaaggacaccgcgtacatcctgtttctacgcgttatcgttgacgttcttcgcgagcaagctcgctcctacagtgcagatgggttgcacagtcggcttctgagtttccaagggtattactatgtcccaagaccgtcgctacagcttcgagttcttcccgaccaagaccgatgctgggcatgaaaagctgatggccactgccaaggtgctggccagctacaaccccgacttcttctcctgcacctacggcgccggcggttcgacccgcgaccgcacgatcaacaccgtgctgcagctggaaagccaagtcaaagttcccgccgctccgcacttgtcgtgcgtgggcgacagcaaggacgacttgcgcggcctgctgacccattaccagcaagccggcatccagcgtatcgtcgccctgcgtggcgacctgccttccggtatgggcatggccagtggcgagctgcgctacgccaacgagctggtgagcttcatccgcgaagaaagcggcgatcacttccatatcgaagtggccgcttatccggaaatgcatccccaggcgcgcaatttcgaagacgatttgcagaatttcgtgcgcaaagccaatgccggcgccaacagtgcgattacccagtacttcttcaacgccgacagttatttttacttcgtcgagcgcgtgcaggcgatgggcgtgaatattccgatcgtgccgggcatcatgccaatcaccaattacagcaagctggcgcgcttttccgacgcctgcggcgccgagatcccacgctgggtgcgcaaacaactggaagcttatggcgacgatgtcaaaagcatccaggcgttcggcgagcaggtcatcaccgagatgtgtgagcaattgttgcaaggtggcgcgccagggttgcatttctataccctgaaccaggctgaacccagccttgccatttggaacaacctcaagctgccacgctaaggcttgtgcagttgtgccaaggccctcgtccagacgagggcctttgtcgttttacgttacccacggaaccccgtagtccatgaatacagtgtcctcgccttcccgtccgcagctggtctacctggtcttcggtgccgagacctaccaccaggaggcggtattcagcatcgccagcgcacttgcgttcctgcaggagactacggacgcgaacaacatagacattcaggtattcagcgacaaccccgagccttatcgcctgctgccggtgcgcgtgcgccctctcgacgaggccacccgcaaacgctggagcgagccccacggctatcacttccgcaccaaacacgtggtgctgcgccaagtgttgcaagagtcaccggtggcgctgctgatcgacaccgacaccttcttccaccattcgccaatgacgctgttcgaacgcgtccagcccggcaccctgctgtgcaatgccttctacaccaagtacggcgataatcacgaaagcatcctctacactgctctgcgccagcgcctgctggatatgggcgtggccgacgatgacatgatgaccctcaattccggcgtcatgggcctgacccagcaggatgcgcacatccttgatcgctctatcgaattgatggatgagctgttcccccatgcccagggcgcgtacaccctggaagagttctgcctgtccatcgccgcctatcgcaccgtcaacgtgcgcgagtgcccggacctgatccatcattactggagccgcaagcagttgttccgggccaaggtcaaggcgtggatcgccaagcacgccagcgcccctaccagtgcacaagccctggccgacacgcggcaggtgtcctcgcacctgccgcgcccgccacgcttgcagcgcttgatgtacaagctcatcaccctgttgctgcccaagcaccagcaacagttcatccgcgaaattctttacggttgctacgaacacgaaaacgagttcgaccaggcctgcggtccggtgtggtgggataaggcccgacaaaaccaggaggaacgccagaagcgcccgatcgatgcccaccagctggaacactggttcgccaaccccgtggtgcgcctgattctgggtgagcgccgcgccgcgatccacgaacacctgctggacgctccggcgaaataggaccgtccgccaatacgcgtgccagagcttctctttcgcccatgagcgtcgtaacctgagggcatgcccgtcattttcaagctgttgatcgctgcgctttttgcttgcctgagcctggccgctaatggcgagaaattgcgcattgtcaccgagccctgggccccctacgtctacgacgaccacggccgcatggctggcctggactatgaaactaccgtgatcgtgttccagcgcctgggcgtcgaggtgcaatggcagttcctgccctggaagcgctgcctggcgatgctcgatcagggccacgccgacggcgcgctggatattttccacagccacgaccgtgacgccctgctgctctaccccggcgagccattgtcggacgttgaattcgtactgttctacgccaacgaacgcgcgcatcctgccgaaaccctcgatgacctgcgtggcctgaccgtcggtgtttcccccggctacctctatggcgatgcattcagcgagtccaacgcctttgagcgtgagcccgcacccagccatgaagccaatttcggcaagctcatgctcgggcgcatcgatatggtggttactgaccgacgggtggggcaacacgtgatcaaggcactgggccttgagggcaaggtcagccaggcgtcggtgttggtcagccgccagccgcaatttctcgcggtgcggcgcggcgcgggcatggacctgctggtacaacgctttgccgccgagctcaagcgcttcaagcaagagccggcctatgccgccttgagcgccaaatatggtggaatgcacccacaaacggcgcctatatcagcgtcaagacgtgccgttgagcagcaggaaagcagcgcgccgtgattgctctgttatactccggcctttccgccaggcttacgcccggccgctcgggtcttgaaaaaggcacccaacccagctactgcgcagctttgcagcccgcgcgagccggtggcgtgcccgccagacgcagcaggaccggacgggattgcgctcccctaagcgccattcacgcccggcaagattatccctttgggccaagccctaactaaaacaggattactcatgtcctttgcttccctcggtctctccgaggctttagtccgcgccatcgaggcagcgggctataccgagcctactccggtgcaacagcgggccattcccgccgtgttgcaaggtcgcgacctgatggtcgcggctcagacaggtactggtaaaaccggcggtttcgccctcccgatcctggagcggttgtttcccaacggtcacccggacaaatcccagcgtcatggcccgcgccaaccgcgcgtactggtcctgaccccaacccgcgaactcgccgcccaagtgcatgacagcttcaagctgtatgcccgcgacttgaagttcgtcagcgcctgcatcttcggcggcgtcggcatgaacccccaggttcaggccatgtcccgtggcgtcgacgtgctggtggcctgccccggtcgtttgctcgacctgtgcggccaaggcagcgtcgatttgtcccacgtggaaatcctcgtgctggacgaagccgaccgcatgctcgacatgggctttgtccatgacgtgaagaaggtcctcgcccgcctgccagccaaacgtcaaaacctgctgttctcggcgacgttctcccaggacatcaccgccctggccggcaagctgctgcataacccggaacgcattgaggtcacgccgccgaacaccacggtcgagcgtatcgagcaacgcgtattccgcctggccgccagccacaagcgctcgctgttggcacacctgatcacccacggcgcgtgggaacaggtgctggtcttcacccgcaccaagcacggcgccaaccgtctggccgagtacctggacaaacacgggctcactgccgtagccatccacggtaacaagagccagaacgcacgcaccaaggctctggcagatttcaaggccggctcagtacgtatcctggtcgccaccgatatcgccgcccgcggcctggatatcgaccagttgccacacgtggtcaacttcgagttgcccaacgtcgatgaagactatgtgcaccgtatcggccgtactggccgcgccggtcgttcgggcgaggctatttccctggtcgcgccggacgaagaaaaactgctgaaaagcatcgagcgcatgaccaagcagaaaatcgccgacggcgacctgatgggcttcgatgccagcgccgtggaggccgagaaacctgaagcccgcgagcgtccagatgtgcgtaacccgcgcaacccacgcggtccgaagggcgatggcccgaacggcggcggtggtggcggtggtcgtcgcgacaaaggcaaggacaagggcaaggaaaagtccgccaccagcagccgaggtgaacgcccggcccgtgagcaaaagccacgtgaaggcaccccggcccgcgaacagcgccagccgagccagccgccacgcgccgccgctgaccgtgccccggacgagttcctcgacgacgatgtggataactttggtaaccgcgtcgactacgtgccccaggccaagccggcccagggccgtggccgtcgtccaggtgccccggcacaaggcgccggtgcgggtgctccccgtggcggccagcctcagggcggtcgccagaacggcccgcgcaacagcagcggcggcagcaccggtactccgcctgccaagcgcagcggcccgcgtaatggtgcaccgcgtgacggcaaggcgcgtcgcgaagattcgcgcagcaacaaccgccgcccggcccgtgacgaccagccacgcctgtccgagccagcggtgcaaaacccgcgtggtggcccggcgccgaagatcatccataaggagtcgaaagctgatcgcttcccgacacccgagcagttggaccaactgcccggccgtcctcgtggtgaaaaaccggcactgctgactcgcaaccgcgaggcataaaaaaaacccgtatcgcgagatacgggtttttttgcctataggaacgtgcttgctcgcgaaggtcgtcaacgataaagctggcagcctgaaaaaacgcggtatctctacgtttttcgcgagcaagctcgctcctacatatggagcattacttcgctttcacaccttcaaaggtgatgtacagctgaaccacgtcggactgtggacctacgtccatgcccttcggaacgaactctttacggctgatcgaggtggtgccttcaaagccggcacggtagccgccccatggatccttgccttcgcccaggaacgtagccttgaccacgataggcttggttacgccatggaaggtcaggtcgcccgttacatcagcagtctgcttgccatccgcgttcttgccggttggcttgacactggtggagacgaacttggcgtcagggaatttgcccgaatccaggaagtctgcgctgttgacatgcttgtcgcgctcggcgtggttagagaacacgctggcggtgcggacattcatttcaatcttggcatcttctggcttggcagcgtcgaagctgaacttgccgtccaggtccttgaaggtaccggtgatgtagctgtagcccaggtggctgatcttgaaatcgacgaaggcgtgctggccttccttgtcgatcacgtagtcagcggccatcgccgaaccagcggacaacagagcagaaccgattgccagagcagcgagtgtttttttcaacatgctttctattccttgtgagtcgaggttgaacatcaggctttgcgccccagcattcgtgtcagggtcgcatcacgatcgataaagtggtgtttcaacgcagccacgccatgcaagccggcgaagaccaccaacacccaggccaggtacaggtgcacccaaccggcggtatctgcctggtccggtagaccggaaaccacggcaggaatttcaaacagaccaaacaccggaataccgacgccgtcggcggtggaaatcaggtaaccggcaatcatcacggcaaacagccccagatacaggaacgcatggccaaatgcagcaccgatccgcgtcatacggctatagctggccagcggcggtggcggcgggctgaccagacgccagacgatacgcaccagcatgatggcaaacagcgtgatgccaatgctcttgtgcaagtcaggtgcatctttgcgccaggcgctgtagtagtcgaggccgaccatccacaggcccaatgcgaataaaccaaacaccaccaaggcgacgccccagtgtagaaccatgctgacccagccgtaccgggcgggagaattgcgtagctgcatgtacttaatcccgtaagaactgtgcccaagactagcgttttacctatcgaattaaagcggaaaatttcgctttgaaatatcgagaaatacgatgaagaggctaggtatcataaattaacaagggattaagactattcccaagaaacgcgacagaccgtcctgcatttaccgccaattgccccacaatggcttgtgacaggcgccaccattgcataggcttgcgcgattgtttcgcctgcgccggccgcaggaccgcttcgaggagatcaccgatgggcttgaataaccagtggatgcaacgcgacctcgcggtgctgtggcatccctgcacccagatgaaagaccaccagcaactgccgctgatcccgatcaagcgcggtgaaggcgtatggctggaagatttcgaaggcaagcgctacctcgatgccgtcagttcctggtgggtcaatgtgtttggccacgccaacccgcgcatcaaccagcgcatcaaggaccaggtcgatcagctggagcacgtgatcctcgccggtttcagccaccagccggtgatcgagctgtccgagcgcctggtgcagatgacacctgagggcctgacgcgctgcttctatgctgataacggctcatcctgcatcgaagtcgccttgaagatgagctttcactactggctcaaccgtggcctgccgaacaagaagcgcttcgtcaccctgaccaacagctaccatggcgaaaccatcgccgcgatgtcggtgggcgacgtgccgctgtttaccgaaacctacaaggcgctgctgctcgacaccatcaaggtgccgagcccggactgctacctgcgccccgacggcatgagctgggaagaacattcgcgcaacatgttcctggccatggaacagaccctggccgaccaccacgagaccgtcgccgccgtgatcgtcgagccgttgattcagggtgcaggcggcatgcgcatgtatcacccggtgtatctcaagctgttgcgcgaagcctgcgaccgctacggcgtgcacctgatccacgacgaaatcgccgtgggcttcggtcgcacaggcagcatgttcgcctgtgaacaggccggcatccgccctgacttcctttgcctgtccaaggccctcactggcggttacctgccattggccgccgtggtcaccaccgacgatgtctacgaagcgttctacgacgactaccctaccctgcgcgccttcctgcactcccacagctacaccggcaacccgctggcgtgcgcggcggccttggcgacgctggatatctttgaagaagacaacgtcatcgaaaacaacaaggccctggcccagcgcatggcgaccgccaccgcgcacctggtcgaccatccccatgtcgcggaagtccgccagaccggcatggtgctggccatcgagatggtgcaggacaaagccaccaagactgcctacccatggcaggaacgccgtggcctgaaggttttcgagcatgccctggaacgcggcgcgctgttgcggccgttgggcagcgtggtgtacttcctgccgccctatgtgattacacctgagcagatcgacttcctggccgaggtggccagcgaggggattgatatcgctactaacagcaaagtcagtgtggcagtgccgaaagattttcacccaggcttccgtgatccgggttgattgcctacatacaccttttcagagaacagaaatgagactgtcccgctttttcaccgacgccccgctgagcctcggcgaccatgaactgcccgaagcccaggcgcattacatcagccgtgtgttgcgcatgggtgaaggcgatgccgtgcaattgttcgacggttctggccaggagttccggggcaccttgctggaagtcggtaaaaagcgcgtcaccgtacaactgacggagtgctttgccggccaggccgaatcaccgctgcacgtccacctcggccagggcctatcccggggcgagcgtatggattgggcgatccagaaagccactgaactgggcgtcaacgcgatcacgccgatcttcaccgagcgctgcgaagtgcgcctcaaggacgagcgcgccgacaagcgtctgctgcactggcgccaagtggcaatcagcgcctgcgagcaatgtgggcgttcgacggtgccggtgattcatgcgccggtgctgttggcagactggctcaagcaggtcgaggccgacctgaagctggtgctgcacccggtggccgagccgatgatcagccatgccaagccatcgcggctggctttcctgatcgggccggaaggtggcttgacggatggagaagtcaaaaccgcccagggcgcgggcttccatgccgcgcgattggggccgcgagtattacgtaccgaaaccgcgccggtggtggcgctgggcgttgcgcagcaactctggggcgacttctaaaggtggatgaggtgatcactccaccgggtcgctgaccgggctggcaatgatcgccttcaactcactggtcatcggaaactccaggttcaagccattcggtggaatcggctgttcgaaccagcgctggtaaatcccgttgatcgcccccgagtggtaaaggtcgcccagggcctggttaaccaccgcgagaaactgtgggtcatccttgcgcaccatgcagctgtagatctcccgcgattgctccttgcccacgaccacccaatggtgtgggtccctggccttggcgcgttcgccgtagagcagcgcatcgtccatatagaacgccaccgcacggccggtctccagcatcttgaacgcttcgccgtggtccttggcgctgatcacgaacatattgctctgatgctcggcgttgtagcgtttgaggaagcgttcgttggtggtgccggcggtggtcaccacgttcttgcccttgaggtcggagagtccgtggatgccgctggtcctggccgtcagtaactgccccttcacatagataaacccataggaaaatgccacctgcttctgccgttcggcggtcactccggtggagccacactccaggtcaacggtgccgttctgtaccaatgggatccgggtctgggacgtcaccaggcgataattcacacgcaagtttttcaggccggcctgttcccggacgcgctcgacgatcctgtgggtgaggtccaccgaataccccatcggcttgccgctctgatcgcctatatacgagaacggcactgacgcatcacgatagccaacggaaatttgctggctggcagtgattttcttcaaggttgcgctggattcgctcgctgacgccaggggtagtcccagcgtcagcgaagagaaaatgcagaccttgaaaatgcaacggtttaccgctgttttttgcatagggtagtctcgctggctatagctataggtcgagccggcagccggcctatccaggcatcgctattcatctctttacactccaacaaccaaaggtcaggccgccttgggaagaaacacatgtgcgtcaatcgaagtcgaccgctctgcaatcatttcggccagcaactggccgctggcacacgcgagcgtgaagccaagagcgccatgcccgaggttgagccacagattgcgataggaactggcgccaatcagtggcaggccggtgggcgtcgctggccgcatccctgcccattcaaccgcagcgtcatagttgccgcccatcggaaacgtctggcgggccaagcgttttatcaccgccaggcgcttgggctccggggcgctgttgaaacccaccatgtcgaccatggcggcgacacgtaactgatcgccgatccgggcataaacagccctgcggtcgtaatcggtcacattgaccttcggggcattgtgctgctcgccgatgggcacgctgaggctgtagcccttgagggggtaaagcggtagacgcatacctggcaaacccaggcttgaactgttgtgaccggctgccaggatcaggttctccacagggatgacttcgtcctcaagctctacggctacagccgtattaaacgcctcatggacacgcaatactttgcgcccgtagacaatgcggcagcgtcccgatgcctccaaatgcccgccaagctgctggcaaaatgcatggcaatcggcaacctcttcattggggttgtaaataccgccgacaaaggtcccctccatcagggacggttcaagcttgcggcagtcttcggccgatagcacttgttgctggagggggtcagtcaatctgcgccgcccctgcgcgaagctgtcatcggaacggaaggtcagcagtttcccattgcgcttccagttgaacccttccagatggtcctctacccgccagcggttcaggacgtcctggctcatcgctgccaggcgaagcaaatgtgcggagtttgtacggttgaccgaggagcggcaggcgccgaggaaagaggcgagccagcgccattgtgaaaggtccagccggggcctgagcttcaggggagactccgagcgcagcagaaagccaagcgccttgagtggtacaccagcatcagcaaggggggtgacatagcggtaggacagttggccaccattcgcaaaactggtgacattacccagttttttttgcgcttcgaccaaggtgacttccatgcctgcacgcacacatgcataggcactcgccaacccgatgacaccgccgccgatgatacatactcgccttgccatattgacacctcacatggattgaaacgaattccagagtaggttcaagtgacaaaagttgaacaatgaataaaggtaagccacctataagttaaggttatgaaaacccatgcgtctgcgacatatcgaaatcttccaggccatccgccagaccggctccgtcagcgccgccgcgcagttgctgcacgtctcgcaaccagcggtgaccaaggtgctgcagcacgccgaattgcagctcggctttccgttgtttctaagggtgcgtggcaagttacagcccacaccggaagccctggccttggaaagcgaagtagagaaagtcacaacgagtctgcaaggagtgcaacggctggccaagagcttgcgccatacgtctgaacaaagcgtgcgcatcggcgccatcccggcgctggcacagtcgctgctgccaccgtcaatccttgagtggaagcgcagctacccggacatggtctgtgagctgtccagcgaccatagccgcgagctggtgcagcagttgttgatgcgcgaaatcgacctggcactgaccctcaatttctccggccacccggggctcaccagccagatactggcaaacggggcgctggtagcgttggcctccaaggcttactggcctgaggctgaatcaagcaagccattgcctttggccgaactggcgaacacgtcgctgattggtctttccagcgctgatccgttggcggcaaagctcgacagttacctggaaaatattgacccaccgccacaaataagcatttccgtacaaacctattccctggcccgggccatggttgaatccggtgcgggaataacggtgattgatcccttcacggccctcggtgcgtccacgacgacgatgtgcatccgcacgcttgtcccgcagttgccgatcaccctgtacgccctgacccgcgccaacgaaccgcctccgcatatgttggccgacctgttgcatatcttcggcaaccgggcacgtgagttgctcgagcgccttcagaatgcccccttcattcagagcacgtaatgcatgatcgccacgaaatgcagcaggctgccgccgatgacaaacagatgccagatcccatgggaatggcgcaggcgatcctccagggcaaaaaagataataccgacggtatacaacaccccgcccgacgccaaccagatgaatcccgccgtacccagcgccgccatcagcggcttgactgccacgagtacgatccagcccatcacggcataaatcacaatggacagaatccgcgcctccgagcgcggcttgatctcttgcaggatgccgatcaccgccagcccccacacgatgccgaacagcgtccagccccatggcccgcgcagggtcaccaggcaaaacggcgtatagctgccggcgatcaacaggtagatggaaaaatgatcgaccttctgcatgatcgcttttcgccgcccctgcacgctgtggtacaccgtcgacgcgctgtacagcaccatcagggtaaagccgtagatcgccacgctgacgatcttccaggggctgccgtccaggctcgccaccaccaacatccacacggcgccaatacacgcagcgactgcaccgagcaaatggctccaggcgttgaatcgttccccgtggtacatctgtcaccgacctccccataaccttcaagaacaggctggcaagcgtccagccttgcgcataagagtgcaagcggcttgtgacgttccgaggacggcgcacgcgtttgcgggcacaattgtaggtaatcgaacaagagcccacggccatgctgatcgacgaagagttcaccctcaagaagctggaaatcttcctggcgttcatgcgcaccggcaacctggcccgcgccgccgccgagttgcaaaccagcaacgtcagcgttcatcgcgccatccactccttggaaaatgccctgcgctgcccgctgttcaaacacgaaggtcgcaacctcaccccgctggaaagcgcctatgtgcttgaagaacgcgcacaaaaactggtggccgatgtggtcgacagcgtacgcctgacccgcgaagccgccggcttctccgctgagcgtttcaagctcggctcgctgtattcgctgacggtaaaaaccgtaccgcaactgatcatgggcctgaagatccgccgcagcgaactcaacatcgacctgatcctcggctccaatttcgacctgctctacaaactcaagaacatggaagtcgacgcgatcctcatctccctcgacgaacacgccaacgaccccgactgtgagcagatcgccctgttcagcgatgacatcttcctcgccaccccggccgattcgcctctggatcgcaatctggaaatcgacctggccgacgtgcgcgacgccaccttcatcaccctcacccagggttttgccacgcaccaggacggcaatcgggtgttcaagcaggcggggttcgagccgaaggtggcgatgcaggtgaacgacatcttcactctgctgagcatggtcagttcaggggtgggttatgccctgctgccggggcggattgctgcggtgtatgagaaccgcgtgaagctgataccgctgcaaccccgctatcggttgcagcagcatatcggcgtggtgttcctgaaggccaaggagcgcgacccgaacctgctggcgctgctggcggagtgtcggatgtatgctaatcgccaggcttgagaatgccatcgggggcttgcccccgattgcgcccgaccaaacaccacagtccgcaaacctaaccaaccaacccacgcacaatgaagtacagcagcgaagggccaagcaaacacccaagcccggtatggaacgtcgccgtcagcgcgccatacggtaccagccgccgatccgtcgccgccaggcccgccgtcacgccactcacggtgccggccaacccaccaaacaccatcgccgaacgcgggttatccaggcccatccagcgcgccgccactggcgtgccaaccatcaccagtatcgccttgatcaaccccgttgcgatcgacagcgccatcacatccgaggtcgcgccaatcgccgcgccggtcaccgggccgacgatgtaggttacagcgccagctccgatagtggtcatgctgatcgcatcgcgataaccaaaggcccaggccatgctcgcgccaacaataaacggcaggatcgtgcccagcagcagtgcaatcacgccgatcatcccggccttgcgcgcctcggtggcttgcacttcgaacgccgtagcgacgatggcgaagtcacgcaacatcgcaccgcccatcaggccgatcccggaaaacagcgcaaggtccgccaggcccttttgcccacccgtgagagtgccgccgacccaagccaggaccaggccgataacaatggcaatcgccgagccatgaatgcgcccgaacgtcaggcgcttggacagcaccacggaaatccacatcaccacgccaacgaacgcaaaagcggtaatcaggccgttatgttccaagcctttttcaatgaggtcccacatatcagcgacctcccgcgacgagaatcagcggctcttcgggcggcaagggctcgcccttgtgggtgcggctgatcaaggcgatggtgcaaccacacaccacgaccgaaccaatggccgcgagcactgcaaccgggccgccatgcagcgccgttactacgttttgctgcgccgccatcgccaccaccaccgggatgtacatggcgccccagaagcccacgcccatctcgcagtccttagtcatgccaccgcgcttttgcatccacaaccgcgcgcagatcagcaggatcatcgcgatccccacgccgcctacgttggatttgacgcccagcaacacgccaagcatgtcgcccatgatcacgcctgcaagcgtgcagatcgccagcaatgccacaccgtagataatcattattgttgtcctcaaagtgctcgttcgaaattgttgtttttgtgcttcgaaagccttgggtgctgctttatcggtggcggcgttcctcctcttgcagcagggcctgcaaggtatccaggcgtgcgccttcgcaggcgatcaccgtgccttggtcgaagacccgccgtgacaggccggtgagcaccgcgcccggaggcaattcgatctgcaggcgcacgccgcgctcataggcgctttgcacggtgccgcgccagtcgacgacgcggcacatattgaaagccaggtcatcgcgcagttgctcggggttgtggattggtcgtgcgcgggtgctgctcaggtaggtgatgcgcggcgccttgagcggcacgaaggcttgggccaggacctgggccggctgttccagcaacgcgcaatgggacggcacgctgacggccaggcgcttggcgatgccgctgcctttgatgcgttcggcgacgagcttcatggcttcatcactgccggcgatgacggtctggttatcggcgttgatattggccaggtacaccggggtcagtgggctgtggatatccgccagcagcgcctcgacgcgggataattcagggccaatcagggcggtcatgccatagccctgtggataagcctgctgcatcagctcgccccgcaagctcaccagctttaccgcgtcagcgaagttcagggcaccggcgatgacggcggctgggtaggcgccgatggacaggcccgccacgtaatcaggcgtatgttgcaactgacgggcatgggcgacgccgacgatcagcaggcacagttgcaccgcacgcgtgctcgccaaggcttgcgccgaatcgagctgacgcacatcttcacccaaggcatcactggcttcttccagaacctcggccgatagcgcctggagcatacccgtccgctgggcaccctgccccggaaacaccaggaggctgctcatgccacagcctgccaagggtcgagcacaaggtgtgcgccgctgctggttttgagcagcacacgacgagatacgccggcccattcgcgcaaggcgacagcgccaaacggggtttgcagttgcaggtccacggcgcacggcgcggtgtcgagtttcgccagtaacgcccgcgcctcaaagcgatcaagcggttcgggggtgcgcaaaatcaaatccaggtcactcatgacatgcaacgcttcgacgccgctcgccaattcaaatccggcgctaccgctgacgccccagtggtgctgcgccagcattggccgcagttgatcgagcgcccgcagcgcgggtatatcccgtgatgagagcacctggcgcaagtcttcaggcgccacgcgccgttgcacagcggttatgggcatcaccgccgcaaaccgctgctcacgcaagcgcccacgcacgccaaccgccacttggcccggatcggtgacggcgcgacgcaccaccaccggatgacccgcgctgatcgcatccagcgcccaggctggcgcgtcatcaggcagatgcgccggcgtcatgccccagagcaaatcgtgggcgttcaccattgttcccgcagcagttggcgtacgtggcttgaggcggcgcgattagtcgcaccgagacgtcctttcaaatcgggttgcacgacatctttgatcgcctgcaccaggcaatcggtgacccgcgccacatcgtccgttgtcggctgttcaatctggctcaccgacaaggtctcccagagcaaacccaggctggcataactgtcgatgtcataggccatcggcggcacactggcggccaaggcttccagctcttcaacactgcgcaaggtcacccgcgccgccgaggccttgcccatggcgtgcaccattaccccagggtcgcgcagggcgatcaagcggttggcctggtaaccgtgggccagaaacgcaccggacatggccttgcccaccagcaacgcaatcaccgggtgcccggccaggcgtgcgcgggcgtagctgtcggcggcggcggccagggcctggtggatgccgagggcttcttcacggcgaccataggcttggctgggcacatcgacgatggcgatgatggggcgtttgtcacccgtcacgatggcttcatcgacggccttggccagcccccaaccttccagcaacccgacttcgccattgcgtgcacgcgggaagcggttattggggtcggtgaccacggcgataaagcgcaccgcctgttcacccaatacgccgtctgcgactttcaatgagtccggcaagccgtctacgagtgtcgcgccgacgctcaatgcgttgaaccattgcagccctctcatgaaccttctccctgatacagagcgcgaaccgttgcgggttcgatttgcgcggtcgcgtcgagttcggccagccgcgccaggtagaaatcagcgcgccggctgcggggttgttcgggcgccccgtgttgcaacagcgcactcacggtctgctggatctgcgccacatcgtccgccacgtaacggtcggccaagccactgttaaaacgttgttcgccgcccgtaaggctccagatgaaaggccggtcgcgggagtcgtattcttccaggccggcctcctgctcgatcacttgcgggccattcaaacccaggcgcgcttcgcgggtgaccaccaggtaactgcacagtccggccgcgatggacataccaccaaaacaaccgacactgcccgccaccacaccgaccaccggctggtactggcgcaggtcgacaatcgcagcatggatatcagcaatcgcggccagccccagattggcttcctgcaagcgcaccccaccggtctccagcagcagcacggcacgggtcggtatggcgttgcggttgtcttcggcggccagttccagtgcccccgcgatttttgcgccaccgacttcaccgaggctgccgccttggaaattgccctcgatagcggcgaccactaccggcaaaccgccgatgctgcccttggcaatcaccacaccgtcatcggcctggggcaccacgccctggcggctgagccacggcgacatgacccgttggaacgggtcgatcagttcacgataagtgccagcatccaacagcgccttggcgcgctgccgcgcaccgagttcgacgaagctgtgtttgttgagcaaatcagtcatggccgacctcctcgaaaccttgctccaggcgcaaacgcaccacgccgggggtggcgccgaaatcgtggatatcgatgttcaaggcaggtggcgtctgctcctggaagatgcgttcgaacaggtgctgccaacgttgctcggcgccgttgaccgaggtctgcacttggatggtcagcgtgccgggagtgcccggctccagcagcacttcgaggtcgcccgaaccgacgcaacccacaagcgcgcggccttttggcggctggcccgcggggaattcaaaggataaggtttccatcacaacgctccgtcgaggcggtcgataaacaggcaggcggcgagcaagtcggcagcgccgccaggggaggcattcagggccaggagttgctggtcaagtgcgtgcagctggcgacggcccgcgagggttgcgctaccgccagcgtcgagcacggcctgggcgccttgctgcatggcttggaggccttcaatgccggcgcggtagagcacgcaggtatcggccagctcggtcatgatcgcgagcaaagcgtccaggcgggcattctgttcaccggcgttttgctggcgacttctgtgcagttgcggcagaccgcgttgcatcacagcggggaagcccagttgcgcttcttcacgggcaccgcgtgccccgtagcgctgggcgacctgtgcgccgtggctcagcggttgcggcgcgaagcggtcttcgagcagagctagtttggccgcggtcagggttacggcgcgtggttgcagggccgctgctgcggtgagcaaaccaagagcccagattgcgccgcgatgggtatttacgccgttggtagtgatgagcatcgcttgctcgccttcgcggccaagacggccgagtgcttcacgcaagggcacaccgacttcaccgaattcaagggcagcctcggccatttccttgaacatcggccacagcgacagcgctgaggcgtgcatcaggcccaagtgcaaatcactgtgggcgccgttgccgcgccggtctaccaaggcgggtttgggcgacaaatccgcttcatcaatcagcgcgtcgacggccatatccgccaggcgatcagccaggctcagttcatgctgtttgagagcgtgcatttaccagctcctgaatttggcaggcgggttgtacaagccgccggaccattccaccaggtcggctacgctcttggcagccagcaactcgcgggtggcgtcggtgcggcggatacccaggtcttcgggcaaggcaatcaagccttcgcggcgcatacggacggtgtccttggggttatgccgcataccgatggccgtcaccccggcgactgcagcgatcattgcctggcgttcttccagggagcgcgccttgtagaggtaagcgatgccctcttcggtgagcaagtgggtaacgtcgtcgccgtagatcatgatcggcgccaggggcatgccgcttttgcgggccacttctactgcgtcgagggtgtcgacaaaggtcggtttgccgccttcctggaaggtctcgaccatttgcaccacgagttttttgccgcgctcaagcagcgcttccggcgcatcgtcatggcgcatatccagccaggccggtgtgccgtgccgacgaccacgtgggtcgtggcccatgttcggcgcaccaccgaaaccggcaaggcggccacgggtcacggtgctggaatgcccgtcgccatccacctgcagggtggcgccgataaacaggtccaccgcgtactggccggccagttggcagaacatgcgattggagcgcatcgagccatcgcgaccggtgaagaacacatccgggcgggcggcgatgtaattctccatgcccagttcggtgccgaagcaatgcacgctctcgacccaaccgctttcaatcgccgggatcaacgtggggtgtgggttgagggtccagttgcggcagatcttgcccttgagccccagggattcgccgtaggtgggcaggatcaattcgatggcggcggtgttgaagccgatgccatggttgagtgactgcacattgtgtttttcatagatgccacggatcgccatcatcgccatcaacacatgcaccggcttgatatggcgcgggtcgcgggtgaacagcggttcgatgtagaaaggcttgtcggccaccaccacgaaatccacccagcttgcggggatgtccacacggggcaagtcggtgacgtcgtccaccaactggttgacctgcacaatgacgatgccatcgctgaacgcggcgggttcgatcagcgccggggtgtcttcggtgctggcgccggtgtagatattgccggcgcggtcggccatgaaaccggcggaaagcaccacgttggggatcaggtccaccaccagacgcgcatagagttcgatgtaggtatggatcgcgccgatttccagcaggccatcttccagcagctggctgatgcgcagggattgagtgccggcgaaggaaaagtcgagcttgcgggcgatgcctttttcgaacaggtccaggtgctcggcgcgcccgacactgggcatgatcatgtgcaaatcgtggagcttggccgggttggccttagccagggagcgcgagaggaagtcggcctgcttctggttgttgccttccagtaccacgcggtcgccggggaggatcagcgcttcaagcgcctcgacgatcttgtcactgggcagcaccgccccgtctgcaatttttttgaccagcccgagccgccgctgcttctcgtcgcgccgccgcgtccagcgcgagtcgggggtgatggttgttgtcatggtcgctccacggggtttgctgtcgtggggctgtaccttaggagtgaatttgggggctatcaatcaagctcagcggcagactgttacgcctggagtaatgaagatcaaaatgagggaggggcttgctcccgattccgctgggtcagctattaaattttggctgatacaccgctatcggcggcaagtcgaatcgtcgcaccgtccctcccgcatttgctcagtagcgcctgtcagatagcagtccctgtgtgggaccgaactaaccgcgctatctctgatcaaggctagccaacaaatcttgcactttgagcatcaataccgtcgcgctatcgatcaactggcttagcagggcctcatcctcatccatatacccttcgtattccgccaggttgcgacgctcatgacacaacgccaacaaccgcacctgcaccttgctcgcgtcgagggtgtgaaccagacattgaaagaccagatagcgtttgtcagaacgatagccttgcaagcgcaaagccgtgagggcgatagcatgggcggcgttgtaagccagatcgaaacggctggcgaatgatagctgtggggttgcggcgtccttcaatcgatcacgagctgaacgcatcagcccgtcacactccttgcgatccggcggctcagccttcaagccaccactacgttgcagattctccaggtttgccttgctgtccatccgtggattccagagggttgccccctaacagattgatcttgtcctgctgcactacccgctgcacgaaactgttcccggcattccatttaccgatccagtcttcaggggtgtacagcgtcgggttgatggtgcgacccagttgctcttccagcggcatgagttgctccatgacttcactgtagttgaggctttgaccgatcagcatcagatctatgtcactggatgagtgcgcctcacccttggcgatggaaccgtagataaacgcccaggtgatctgctcggcaaacggtgccagtgcattgcgcaatggctcgtccaggctcagcgtcttgcgcacgatagccaacagttccgagtaaatcgggcactgagggttggcttggtagtgagtctggttgccttggcgcgtcatgttcaagatgcccgccaactgcaaacgctccaactctcgggtgaggctacccttacccacctgggcccaccgggcaatttcattggtgaaaaagctttggtcgggcttgccgaaaagcaggcccagcactttttgctgggtgaccgtgaagagcgcagtactgagcggcaagatgtgcatggcagcggccaatgagtcccaaaaagggaacgataggtccctttttgggaacgatcaagttttaagccgctgaggagggggatatctgttccagtgcttgatccaccaatagctgtcctatctctgccatttgctgaatcccgagcatgacggcgcgctgggaagtgtccaagtcgaaagccaggttgcaggtgagtgcgttgagggaggacagggtttcgctggcgttgaccaacagggtttcggtgttttggtgggggtttacggtgaagaggggtggattgggggtaggtttgatcatgatgaaactcctaaacagtcagtaaggagcgccaccgttcgcttgcacgcgaatgagggtggcgaccgtgcgcaggtgtgcaagaccgggcctgtttaggacacccagcaggtccgaagacctcctgcgcgcagccgccataaagcagcgagcacaaaaaacgcccgttggatggctgggcgttcatacgcctaaacagtttcgtcggacttgcacgtccgtgtcaccgttttttgcgatgacgggacgaagactaggcgtgcggacctctcaccacaagttcatgcacggctcaaaatcttgcaggaaaaatccgaagccttttatgtcgaagtgcgtgcaggaagtttcatacagcgttttggggttgttgcttggaactggtccttttagccttcgcggttgaatgcccatagtcgaaggacgtaccaacatgccgatgcacaacccacctcacccaggtgaaatcttgctcgaagatgtgatccctgccctgggtatcaccattaccgaaatggcgcgacgtcttggcttcgcccgcgagactttttcaaggatcctgcatggccacgccccggtcagcccggaccgtgccgtccggttagagcgggccggtgtaagtactgcacagctgtggttgtcgatgcaaagtgcctacgacctgtggcaggccgagcatcgggagcagccggtaattgaacgcttggcgcggattgattgaggaatggagaaagtgggaggcgcaagtcgaatcgtcgcaccgcccctcccacatttgctcagtagcgcctgttagatagcagtccacgagaagttcatgcacggcccaaatctgccccaatcaatcttcgccactccccacctctcgctcttcaaatgccgatcgcacggcttccacaacacgctctgcacggcccgtatcgtccaactgcggataggctttcttcagtttccctgatacctgccagccattttccttgagcgagcgaatgatgcggttcgcgtcgtgatccggcatttccagcacttccttgagccgctcctgggcaagctggaaaatgatgagtacccgcgcttcatcagccatctcggtacggacggtatgcgccacgacctgcgccgtgtacagcacgtgctcggtcagatcgggatagcgccatgcaaagtgcgcgtcgtcgtagtcatcgaagaccaggttgcttgaggtgccgtcttcgtagacggcgacttttccaaaacgataggacgctgcatagcgttgcataaatggccgcgaaaacactttcaacgtactgtcataacgcgcccgaaaatcaatcgaacgggtgatggtggccgatacaggcaggatcacgccctccggcaccgccttatcacgaatcaagatatcgttgatcaagaaacgatgaatccgaccattaccatcgcgcatcggatggatatacacaaaggcaaaggcaattgccgccgcccgggccaacggctcggcgccgcgtgtggctagttcgaatgcctttaggccaccgagcaagtgtggcagcccctcaaaagccggcgcgatgtagtgcacgatatcctcgcgcatcgtcgcctgccccacgaagaccggtgagcgtcgcaagcccagcccgaacgcgtcgtgccccaaaattccggcttgcaacgtgtgcaggctgtcgttgctcaacggatcctcgatacggccgcaatacttggcaatcacgtgggcaaaccgctgaatcctgtcggctttgtctgactcttgctcgatcagaaagctggcccgcgactccttgagcgtcaaccagctggccgtgcgcatcaggatgtcagtgccaaaggtttggttcagctcgcgaagggcttcgcccaggtcaaattgcagcacttcttgaaccgattcggtacggcggaccaaggggcagaacgctggcacaccgggaagattattgtttatccgccagcgtcgtacccgcagaagctcaacacgcgtcaggtaatgctgcgctgatacggcgtcgacataaccgccattggtgacatccggcacatcaaggtgctgtcccgtcagccactcgtacaagaatccagcgcggcgagcatattgaccaaagggcgcttgccggcaccagtcttcgattggtttcgggccaactgtggcaaacagacgggcaaaaaactcaaggtgaatctcttcgtacttgagcccaaattcgaaatgccccgcgaaatcgtccgacggttggtagctggcgggatacttgcgctcgacatgtccatcgctctcgcggctcatccgtgtcttaccgattaccgattcgacgcgtaggggttgtgcaagtgcgataccgtattgctcggcgagtgccttgaaacctacttgcatcatcaaatcccctaacgagccattaaaaatactaactatggggggatagtaggcgaaaacaataatctcgcgctcatgaaaatgctaacgctcactttaatttgataacaaatcagcttttctcgtctaaaacgataatttcagctgcaacggctcgacacgcgtgtttacgccaacccggactcgaccaacagcgcctccaaccccatcaaatccggcaccttcgccacctgttcccccacttgcaccgccgccagttccaacgggcacaacggcacatccacgtagctcaactcgctgtcgagtttgtacgagcggggaatgccctggatcaccagcgcaataaacttcaaggtcggccgcccgcccagtgcgttcaacaccacgatccgcgaacgttcgccggtcacgctggcttcaccgcacacggcttcaaagctgatcaaggggatttgccgatcgcgccaggtcacctggcgcagataccacggcggtgcatcgctggccggttcgccgcgctgaaagtcgatcagctcggcgatggcgacgttgggcagcaccaggtggcggtcggccaggggcagcagcaggccggtgagttggctggcgcggtagtcaagcatgggacttgctccagtaggcgatgctttccagcagcaccgactcctggtacggcttgccgaggtagtcgttgacgccgatggccatggcgcggtcgcggtgtttctggccggtgcgcgaggtgatcatgatgatcggcaggcgcatcaggcgggggtcgttgcgcacctggatggccacttcgaagccgtccatgcgcggcatttcgatgtcgagcagcatcaggtccggggtgtgttcttcgagcacggcgatggcgtcgatgccgtccttggcggtgagcacgttcatgccgttgcgctccagcaggcggctggtgactttgcgcacggtgaccgagtcgtccaccaccagcaccagcagcgggcgctttttcagcgggtcggtgaggatcagcggggcgtcgaccgactgggccggcaaggccggttggcgagcacggatatgcgcaagcaggtcgatgatcaagaccacgcggccatcgccgagaatggtcgccccggacaagccctgcaccccggcaaactgcgggcccagccccttgaccacgatctcccgagttccggccatggcgtccacatgcaccgccacgcgccgttcattgcagtgcaccagcagcaccggcaccggctgatactggcccagcagtttcaggcggctgacggtgtgcagcaggtcgcccaggtagaacaactcgtagcgctggccggcatattcatagtgcggcgggtcttgctggtagtgccccgccagctcgtggggcagcacgcgcaccaaaccttcgatggtgttgaggggaatcgcgtattggtcgtctgcgcattgcaccatcagcgcccgattgaccgacaccgtaaacggcaagcgaatgcgaaaatgcacgcccgcccccggcgtcgaatcgatcaccatcgaaccgccgagttggcgcacttcttcatgcaccacgtccatgccgacgccgcgcccggaaatctgcgtgattttttccgcggtggagaagcccggttgcaggatgaattgcagcacgtcgcgatcactgatctcttgatcagggccaagcaggccgcgcttgatcgccttgcgccgcacggcttcaaggggcacgccggcaccgtcgtcgcgcatgtcgaagacgatatcgccgccttcgtgggtcaggtccagggtaatgcgacctttctccggcttgcccgtctgcaaccgtacctcgcgggattccaggccgtggtcgacggcgttgcgaagcatatgttccagcggcgccgccatgcgttcgagtacgttacggtccatctcgccttcggcgttgccgacgatgaactccacgtccttgcccagctcctgcgccacttggcgcacgatacgcttgaggcgcggcagcatgcgttcgaaaggcaccatgcgcgtgcgcatcaggccctcctgcaactcggtgttgatgcgcgcttgttgctgcaacaggtcgtgggcgtcctggttgcggcgctcgagggtgtccttaagatcgagcaggtcggaggccgattcagacagcgcacgggccaactgctgcagttgcgaatggcggtccatttccagcgggtcgaactcttcgtagcccaagcgttcggcttcggcctgctggcggctgaggagacggccctgggtttcgctgtcgagtcggcgcaattggtcgcgcatgcgctcgatggtagtttgcacttcattcaaggcgatgcgcgcatcgttgacttgctgttcgatgcgaccacggaagatcgaggtttccccagccaggttgaccaggtcgtcgagcaggtcggcagagattttcaccatgtcggcagcaggatctatcactgcctcacccttgcccgccggcaacgccaccggcatgactggctcatcactggggtgcaccaggctcttgatgcgttcgatcagcttgtccaccgagccgacgggcaatccatccgctacggcgtcgatcatctgcgccaggcggtcatggcaaccttgcagcagcgcaaacagctcaggggtcggcgcgagcaagccggcggacaagccttcgtagagaaattcgagctcatgggccaaatcgccaatcggcccgatctcgaccatacgtgcgccgcccttgagggtatgcaggtcacgcagcagggtttcgacttcctggcgattgcccggctcggcctgccagcgcagcagcgcgctacctgaactgtcgaggatatcggcggcttcttcgaggaagatatccagcagctcagggtcggcacccgaggccggctccgccgcaaccggagttgttggtgtgctgctctggcgcagctcccgcagtttggcgaccagctcggcgccatcgctcaagggctgctggtgttgcagctcttcgagttgcaaggccaaccgttcgtggctggccatcaataccagggacagctcggtggagtaactgtagcggcggtccaccaggccctcatacaggcactccagctcatgggcaaggtcgcctaccgggtcgatttcggccatgcgcgcaccgcccttgagggtgtgcaggtcgcgttgcaacgaggacaacggcgtcccattgtcgggctccagcagccagcgcttgagggactgcccggcgctgtcgaggatatccacggcttcttcaaggaagatgtcgacaatctcgtcgtccatcgccgtctgctggcccagctgcgcagtggcggcgcccagctcggaaatactcagcgcacggctgccgtcgcttttgaccaggccggtagccgaggggtccagcgcgtcatccagtaactcgcgcagggcctgcacccgtgccggcaccgggctgatttcctggccggcggccaactggtcgagcatgttgatcaaggcttcatgggcctgctcggcttccaggaaaaaccgctcgctgaccgccaggctgctttcttccacggcgccatacaggtcgagcaaggcttcgcacagcgcatcgatggggtgcaggtcggcgatgtgcgcgccctcccccaaggtcgtcagttcatccagcagtgcggtgagctcctggcgctcgccggggtgttgctgccagcgacgcagcaggctttcagcatcgagcaggatgtccatgccctgggccaggaaattggtgatcagctgcgggtcgcgcttgatgcgcaggccagtgcctgggccgtcgagcagtgctgcaagctgctggtccagcaggctttgggtacggttgatcaggtctgccgcccctttgatcggtgccaggggatcgctgcccaggtcgcgcagcccgcgctgaaaaagcccttgggcctcgagcagcaactccacttcatccaggtccagcggcaggcggtgggccttgtattcgcgggtcaggtgatcgagcggccgcgccagttcggcgatgggtagcacgccggccatgtaggcactgcccttgagggtgtgcagggcgcgttgcagttcatcactgacctgcagcggcacatgctctgcagcctgttgcaggaagtggtcgaggctgtccagatggctctgggcttcgttgcggaagatctccagcagcatcgggtcatggggttcggcaatcgacacgggtgcgctgctggccaaggcgtgggcacgggcggccagggcgtcgacttcgtcgcgctgacgctgggcatcggtagcaaaatcggcgatcaattccggcagcagggccaccgcttcatccagcacctgctgcacctcagggccgagggtgacgctgcgctccagtacacgattgagcaggttttccacagcccaggccaactcggccagcaccagggcgcgcaccatgcggccgctgcctttgagggtgtggaaggcccggcgcatttcaccctgggcgagtttgtccgcggtgttgggcaggttgcgatgcagcacctcaaggacttcctcggtttcctcaaggaagacttcgcgcaactcatcgtcaatcggcgcttcatcagccggcggcggtaacaggctgcccggacgccgcaaggctggaggattgaggcgtgaggtggggctggccaacgcatcgaattgggactggctcggtgcggtctcggtagacaatgcgccgtcgggcgcggccagggcctggcgccagggtttttctgttggcaggtaacccagtgcgctcaagccctgagtcgccagttccagcactttttcgccggccgcgtcaggatcttggagcatgcgttcgaggtaatactccaggctgctgatcacctcggcgaaatgcgccagttgcgcctcgcaaggcgcagcgtcactgaccatcaactgctcatcgacgtagtcggtgcaaccgcgcatcaggctcgccgcccgcggcaagggaatcatcgccagggcgccgcgcacttggctcaacagctgcggcagggattccaggcgctggcggtcccagtgggcctcgatgcagtcgatcaccagttccttggcctgcttcaagcactggcaggactcacgaatcaccagttgatgaatctgagtcaggtcggtggtgggcagccgattctcttcgcggctttccggctcgacggtgccgatcatcccggccaacgtcgcttcgacgtagagcaaggcgccggccacatccatcaataccgcatcactgggttcgcgctggccctggaccaggctcaacaccacggcgagttggtcaatgatcactttgcgcggctgaccgaaccccagtacggcaagggtatcggcgatctgccgcagcggcgccagcagcgcgtcgaggtcgttggtgtgttgtcggtcactgcgtacgaacaggtcgaggcgctccttgacccgcaccagttcctcgcacaaggcgccaagcaccgagcccatggcattgcgatccggcccggccaaccgcgcacgctcggcatccaccacggcactgtcgggcaaggcttcgtccaggccatagcgttctttcaggctttgcatgcgcggcgtcggacgggtgactttggcgacgtagaacaacaggctcttgagcaactcatccggcgccggctggttgataccgccgatgccctgggccagcaggcgcttgagttgtttgtcactggccttgagcaggctgcgcagcgccgggctgttggcgatcacgccagtgagcatgccttcgaccaacgccgaggcgacctgccacaacggcaacaacggcgcgccctggcacagcgcctcaaggcgcgcgaacacccgcgccatatcttccaggttgctcgggccgtggtcttcgcgcagcaacccggcgagggcttgttgcagcagttggtgccactggcgcaattgttcatgcaaatccgatgtcgcacgcagggccagtgcttcatcaggcagcggcgtgatcgacagcagttgcgggctgaacaggctggtttccgacaacaggctttcaccccgggcgctgcgcaggtcgttgagcaacggcagcaccaccagtggcaaatcgcggcgggcgctgtgcacgcggtcgaggtacagcggcaattggccgagggcttgttgcagcaggcggatgctttcatcgcgctggccgacacgaccggcctggagggccagggccagcgcctcgatctcttcggccagcaacgccgcgccatagaactcgaccatttgcagcgcgccatgcacctggtgaacaccggccaggcactcgtcgatggcgtcgccggtttcagcgtacaggtccagcgccgaacgggcctgcttcagggtttcggcaatgtcgcccttgacccattcgagggccacgtagtcgtgccgatcaaccataactgctccgctttgaattcgtgggttgctggtgttcttgaaaccaatggagatcaaatgtgggagggggcttgccccctcccacatatggagcgcatttcaatcatcagtctgcttgggcggtgggagcgtgaaacccgacaccgacctgcgcaactgactggccatcttcgccaggttaccaatgctttcggcggtggcggtggaacccgaagacgtctgggtggtgatctgctggatcacattcatggtcagggagatctgccccgccgacgaagtctgctgctgcgccgcgttggagatgctctggatcagcgccgccagggttttcgacacgccttcgatctcttccagcgccacccccgcgtcctgggccagacgggcgccacgcaccacttcggtggtggtctgctccatggaaatcaccgcctcgttggtgtcggcctggatcgcccgcaccagggtttcgatctgccgcgtggccgccgacgagcgctcggccaaccgttgcacttcatcggccaccacagcaaaaccgcgtccggcgtccccggccatgctcgcctggatcgccgcgttaagggcgaggatattggtctggtcggcgatgtcgtcgatcaggctgacgatgtcaccgatttcctgggaggactcgcccaggcgcttgatgcgcttggcggtgtcctggatctgttcgcgaatgttgtccatgccgtggatggtgttgtgcaccacctcgttgcctttgttggcgatttccaccgaacgctctgccaccgccgaggattcggcggcgttggccgatacctggtcgatggactgggccatctgctcaatcgccgtcgaagcctcggcaatctgctgggcctggtgctccgacgcctgggccaggtgcatggcggtggcctgggtgtcctgcaccgccccggcgacttgcccggcggtgaggttgatggtggcgaccaggtcgcgcagctggtctacggagtagttgatggagtcagcgatggtgccggtgaaatcttcggtgaccgaggccgtgacggtgaggtcgccgtcggccaggtcttcgatttcatccagcaggcgcatgatcgcgttctggttgcgctcgttcttctcggcggtttcatgcaattggcggttggtctcgcgcaccatgaccaggccgatcaggatgatcgaggccagcgccagcaggcccagtacgtaaccaccgatggtgtcgaaactgcgcccactggcaaggttttcaaaaccggtggccaggtgcgaggcttcatcgagcagggtttgcgacagattgaaaatatggctcgccgatgcccgcacctggaacagctgcggcgaagtctcgaggatttcatccacggagccggagacgaactcgaacagctcggcgatttccgtcagtcgcgcacgggcgtcctggtcttcgacctgggtgatgcgcagccccgggttgccgttgagcataccgttgagcaccacgccgaaacggttggcgtcacgaccaaaggcatcggcggcctgcaccgcggtttcgtcccctgcgagcacagtgttgaccgcccccaggatacgttcggccagcagtgattggcgctgggccaaagccacctgactggccggggcgccgcgttgcaggaggatatcgacgactttttccgactccatctgcaattgcgggacggtttcggccagggtcgcggccacttgatgcagggacagtacggtctgctcgctggcaaggatcgcgtcggtgtttttcagcaacgcctcccaatcggtctgcaccgcacgcatttcggcgcgtaccgcactgggcgcagccggcaagccggtttgcgggtcgccttttttcagatagccccagcgctgggcaaaatcattgcgtgcatcgcccagcagtttgaacgcggcggccttgccggcggccgcttcggtagcgttcttggcgatgcgctgggacagcacgcgcagctcaccggcatggccgatgtactgtttatcgtaggtggactgggtgttgaggtacgcgaagttggcgaacaacagcatgatgaacacgatcaaggcgataaacagcacgatgatctgtgaacggctgcgcgaagcggcctggggtttgggcgtggtagcggtactcatgcggcgacatccatgaagcctggggcctgggccagggcgaagggactgatgacttgccactgcgtgtcgccgtcgaagtggccctggataaacggcgcaccagaggcggtgctggccatccaggcatccaatgggaaatgctgcatacccgccacctcgtctaccagcagcccgacaaacaggtcgttgaactccaccaccaatacgcgccgttgcttgcgcgccttggacaactcaagaccaaggaaaccacccaggtccattaccggcaacaagcgcccgcgcaggttggccacgcccttgacccagggcttgaccccgggtatcagggtgcaacgcggctcatgcaacacttcggcgacttcgcccatgggcgccacgtacccgtttgcccctacacgaaaagcaatcccgctccagcgttgcaggcgggtttcctgggacggcaggtcggcggccagcaggcggcagcggcggtcgatgtccagcagcagttcgaaggcggtttgcgactcggtcatgatcgcgagccttagccggccagtaccttgttcagggtggcgatcagggtttcttcgtccaccggtttggtcaggtagtccttggcgccctggcgtgcgccccagatcttgtcggtttcctggtccttggtggtgatgatgatgatcgggatgccgttggtttccggctccttggacaattggcgcgtggcctggaagccgttgagacccggcatcacgatgtccatcagcaccgcgtcaggtttttcctggcgggccagggccacgccgtccgcgccgttttcggctttcaggacctggtggccgtgcttttccagcatgccggtaagtttgtacatttcggtcggcgaatcgtcgacgatcagaacacgtgccatggttttccccactacattggtcggcgccggcccttgtggggtggcgtcagtgtgcttgttctactgcggcgaaggcaggcacataggcctttatcacgcccagcagttcttccttgctgaaaggtttggtcaaaaactgatcgacacccacgatgcgccccttggccttgtcgaacaggccatccttggaggacagcatgatcaccgggatcgctttgaatgccgggttgttcttcaccagggcgcaggtctggtagccatccaggcgcggcatcatgatgtcgacaaagataatgtgcgggtgatgatccacaatccgcgccagggcatcaaaaccgtcgatggccgtgatgacctcgcaccccatgttcttcaacagggtctcggcggtgcggcggatcgttttcgaatcgtcgatcaccatcaccctcaaggcgttggaatgctgttccatatctgctctaccatcgccacagcgaatcggttttcggtgtgtactgcctgatgttgcacaggatgagcgccgcaagccttggaattcaagggccgctgcgccgtggcagtctttttagcacagtctcggggagcaatctatcgaggcacctgcccagtggtttttccttgacccacaacagccgcagcgccactctgacgccacttttatgcgccctaatttgctagaggaaatcccccatgagcgttcgcgtcggcattgtcatggaccctatcgccagcatctcctataaaaaggacagttcgctggccatgctcctggccgcccaggcccgcggctggacgttgttctatatggaacagcgcgacctgtaccagggtgacggccaggcccgcgcgcgcatgcggccgttgcaggtgttcgccaaccctgagaagtggttcgagctttcagacgaaatcgacagccccctgagcgatctggatgtgatcctgatgcgcaaggacccgccgttcgacatggaattcgtatattccacctacctgctggagcaggccgaacgcgccggcgtgttgatcgtcaacaagccgcagagcctgcgcgactgcaatgaaaagctgttcgccaccctgttcccacagtgcacgccaccgaccgtggtcagccgccgcgccgacgtactacgtgaattcgccgccaagcatggcgatgtgattctcaaaccgctggacggcatgggcggcacctcgatcttccgccaccgcgccggcgacccgaacctgtcggtgatcctcgagaccctgactgtgctgggcacccagcagatcatgggccaggcctacctgccggcgatcaaggacggcgacaagcgcatcctgatgatcgacggcgagccggtggattactgcctggcgcgtatcccggcagcaggcgagacccgtggcaacctggcggccggtggtcgcggtgaagcgcgaccgttgtcggacaaggaccgctggatcgccgcccaagtcggcccgaccctgcgggaaaaaggtctgctgtttgtcggactcgacgtaattggagagcacctgactgaaatcaacgtcaccagccctacctgtattcgcgagatcgacaatgcatttggcacgaacatcggcgaaatgctgatggccgccattgagcgcaagctacaagccaagtgacatagaacagccggacacacaccaacattgcgttatcatgcgccacctgtgaaacgcgcgatgttggttttcttgtcatgacactcccgtccgatctgcccccagaactcacccacagaggcgtgcgcccggctgatcggctcggatttaccctgtttctcgccgccttgattcacctcgccttgctgctgggcgtgggcttcaccatggtcgagcccaagcagatcaccaagaccctggaaatcaccctcgccacgttcaagagcgaaaagaagcccgaaaaagccgattttctcgcccaggacaaccagcaaggcagcggcaccctcgacaagaaagcggtgcccaagaccaccgaagtcgcgcccttccacgacaacaaagtcaataaggtcaccccaccgccggcgcccaagcccgaggtcaagcaggctgcgcccaaggccgccgtaacgaccgtcgcacccaagccgcaaaaagccccgacccagcgcgaaaagaccaagaccgaacccaagcccgaaccggtgaaacccgcgccaaccttcgacagttcgacgctgtccgacgaaatttccagcctggaagccgaactggcccatgaacaacagctgtacgccaagcgtccgcgcatctatcgcctgaacgccgcctcgaccatgcgcgacaaaggcgcctggtataaggacgagtggcgcaagaaggtcgagcgcatcggtaacctcaactatccggaagaagcccggcgccaacagatctatggcaatttgcgcttgctggtgtcgatcaaccgtgacggttcgctctatgaggtgcaggtactggaatcctccggccaaccgttgctggaccaggccgcccagcgcatcgtgcgcctggccgcgccctttgcgccgttcagcggcgacttgaacgacgtggaccgcctggaaatcatccgcacctggaaatttgccaagggtgaccggctgtccagcaactgatgcgccccgcctactgtaggagcgagcttgctcgcgaaaaaccccaggacgacacgttcattcaggcagcacgcataatcgttgacgagcttcgcgagcaagctcgctcctacacttgtcagttcgcccctccaacgccacactagcggacatgaaaaacgtcagcccgacctacctcaagcaccaattcctgatcgccatgccccatatggccgacccgaactttgcgcagaccttgacctacattgtcgagcacacggccaatggtgccatggggctggtggtcaatcgcccgcaggagctgaacctggccgatatccttgaacaattgcgcccggagatcgacccgccggcccgttgccagggcgtgccgatctacatcggcgggccggtgcagactgatcgcggctttgtgctgcaccccaccgggccgaagttccaggccacggtcgaccttgaaggcgtgtcactgtccacttcccaggatgtgctgttcgccatcgccgatggcgttggccctgagcaaagcgtgattaccctaggctacgccggttgggaagccgggcaactggaggccgaactggccagcaatgcctggctgacctgcccgttcgacgccgacatcctgttcaacaccgccagcgaactgcgcctggaagcggccgccgccaagctgcgggtcaacctcaacctgttgaccagccaggcgggacacgcctgatggccttgcgtctgatcctcggttttgactacggcaccaagcagatcggcgtagcggtcggccaggtcatcaccggccaggcccgtgaactgtgcaccctcaaggcccagaacggcgtgccggactggaaccaggttgaagccctcattaaagagtggaagccagatgcggtggtggtcggcctacccttgaacatggacggcacccccagcgacatgtgcctgcgcgccgagaagttcgcccgccgcctcaatggccgctacaacctgcccttctatacccacgacgagcgcctgaccacctttgaagccaaaggcgagcgccgcgaccgtggcgggcagaagggcagctaccgcgacaaccccgtggacgccatcgccgccgccttgctgttgcagggttggctggatgaaaacaccgctttatttgaatcctgacccgccgcgatcctgtgggagcgggcttgcccgcgaagaacgttaacgataccgcgtgaaggctggatgaacgcggtgcccatgagtttttcgcgagcaagctcgcccctacacacttaataaggagccccccgtgagcctgcccaaccccgccgaactgatcagccagatggcaatacgcctcaaggcgcacctggaacaccgcgccatcagcgagccgcgttttatcggcattcgtaccggtggtgtgtgggtggcccaggcactgctggaagagctgggcagcgactcgcccctgggcaccctggatgtgtccttctaccgtgatgacttcagccagaatggcctgcacccgcaagtgcgcccttcggccctgccgttcgagattgaaggccagcacttggtattgatcgacgatgtactgatgagcggccgcaccatccgcgccgccctgaacgagctattcgactacggccgcccggccagcgtgaccctggtgtgcctgctggacctggacgccggcgaattgccgatcagcccggacgtggtcggcgctaccctgtcgctttccgcacagcagcgggtaaaattgtccggtcccacgccgctcgaactcgaactgcaagaccttgccctttaaaccgccttgtacagagtccccgcgatgacgcctctagatgccaagcgcccgctgcagctcaatgctcagggccagttgcaacatttcttgtccctcgacggtttgccccgcgaactgctcaccgaaatcctcgataccgctgactcgttcctcgaggtcggtggccgggcggtgaagaaggtcccgctgctgcgcggcaaaaccatctgcaacgtgttcttcgagaactctacccgtacccgtaccacctttgaactggcggcccagcggctgtcggccgacgtgatcacgctgaacgtgtcgacctcgtcggcgagcaagggcgagaccctgctcgacaccctgcgcaacctggaagccatggccgccgacatgttcgtggtacgccatggtgactccggcgccgcgcacttcattgccgagcacgtgtgcccgaacgtcgcgatcatcaacggcggcgacggccgccacgcccacccgacccagggcatgctcgacatgctcaccatccgtcggcacaagggcagctttgaaaacctctcggtggccatcgtcggcgacatcctgcattcgcgggtggcgcgctcgaacatgctggccctgaaggccctgggttgcccggatatccgcgtgatcgcacccaagaccctgttgcccatcggtatcgagcaatacggcgtgacggtctactccgacatgaccacaggcctcaaggatgtggacgtggtgatcatgctgcgcctgcaacgcgagcgcatggccggtggcctgttgccgagcgaaggcgagttctaccgtctgttcggcctgaccactgcacgcctggcgggcgccaagccggacgccatcgtgatgcacccggggccgatcaaccgcggtgtggaaatcgagtcggcggtggccgacggcccgcagtcggtgatcttgaaccaagtgacctacggtatcgccgtgcgcatggccgtgctgtccatggccatgagcgggcaaaccgcgcaacgtcaattcgagcaggagcaggcccagtgaagctcagcattctcggtgcccgagtcatcgatccagccagtggcctggatcaagttaccgatctacatctggatgccggcaagatcatcgccatcggcgcagcgcccgctggcttcggcgccgtcgagagcatcgacgcgaagggcctggtggccgcgccagggctggtggacctgaacgtcgccctgcgcgagccgggctacagccgcaaaggcaatatcaacagcgaaacccaggccgcggcggccggtggtgtgaccagcctgtgctgcccgcccaataccaagccggtgctggatacttcggcggtgaccgaactgatcctcgaccgcgcccgcgaagccggcaattgcaaggtgttccctatcggcgccctgagtaaaggcctggatggtgaacaactggccgaactgatcgccctgcgcgatgccggatgcgtggctttcggcaatggcctggacaatttccgcagcacgcgcaccctgtgccgcgccctggaatacgcggccactttcgacctgacggtgatattccactcccaggaccgcgacctggccgaaggcggcctggcccatgaaggcgctgtcgccagcttcctcggcttgccgggcattccggagaccgccgaaaccgtggccctggcccgtgacctgctgctggtggagcaaagcggtgtgcgtgcgcatttcagccagctgaccagcgcccggggcgcggccctgattgcccaggcccaggcccgaggtttgccggtgacggcagatgtcgccttgtaccagctgatcctgacggatgaagcgctgatcgacttttccagcctgtatcacgtgcagccgcccttgcgcaccaaggccgaccgtgatggtttgcgggcggcggtgaagtcgggcgtgatatcggcgatctccagccatcaccagccccatgagcgcgacgccaagctggcaccgtttggcgcgaccgagccgggcatcagcagcgtggagttgttgctgccgttggcgatgacgttggtggaggacggcttgctcgacctgccaacgctgctggcacgcttgagcgccggcccggctcaggccctgcgcctgccggcgggcaagcttgaagtcggttcgccagcggacctggtgctgtttgacctgggcagctcgacggtggcaggggagcattggttgtccaagggtgaaaactgcccgttcattggccacagcctgccggcgacggtgcggtacaccttgatggatgggcggatcagctaccaggcctgatgctggcaaaactgtaggagcgagcttgctcgcgaaaaacgtataggcgacgagggcagcctgtcagcactgcgtcatcgttgacgttcttcgcgagcaagctcgctcctacaggttattcagcggccgttattgcgctcggcattgcggatcgaaatctgcgtattcaacgtccagaagtcatacagcacccccagcaggaacaaaccgccggtcagcaggtagatcaggccggtgatccatttgccttggtacatacggtgcacaccgaacacacccaggaatgccaacagaatccacgcgacgttgtattcgatcggcccggcggtaaaacgcaggtcggcttcacggtccatggccgggatcagaaacaagtcgatcagccagccaatgcccagcaggccgaaggtgaaaaaccagatcgtaccggtcacgggtttgccgtaataaaagcgatgcgccccggtaaaaccgaaaatccacagcaggtaaccgatcaccttgctgtgggtgtcttgctgctgaccaacctgttgataggtgttcatgaagtacctcttttgcttcgatagataaattttttcattttctttgtgacttttttacgagcgcccgacgtacggcaaatggtatcttcctgccctcaaagccttatgccacctgacttgtgtaggacaattgcggcaattcgtcgcgtttttcctgaatttgaccccaaggttcagtcgacaaacggcctgaggacgacacaaaaagctgttataaagttgcgcgcaaacccataagagccacgcctaatgcgaccatttttcaagacatggctgaccatctgcctattaatgccactggccgcccacgccaccaatcgtgagcaacgacttccgaacgtcaatggtttcactcctaaagtccacagcacaaccagtacggccaaatcggcaaagctgaccgtcaaccgcccaactcaactgagcaaggcccacggtaaagcaactcccggcctgatggcggtgaacaccaagcaaagcagcaacgtgctcagccgcgccgtcaacgtgctcggtactccttatcgttggggcggcagcagcccaagtaaagggttcgactgcagcggcttggtgaaatatgcctttaacgatgtaaaagcggtggatttgccacgcacttccaacgccatggcggccggtcacggcttgaaggttgatcgcaaagaccttaagccaggcgatctgctgttcttcaagttgaagagccgccaggtcaaccacgttgccatctacctgggcaacgaccgctttatccacgcgccacgccgtggcaagtcggtaagcatcgacacgctgaaaaagccgttctgggacaagaactacgtgattgccaagcgggtgctgccgaaagagcagaacagcaacctgcggatcgtgcagcgctgatattcagctggaatacagtaaacaatgcgggagggggcaagccccctcccgcatgtggtttcattgtttgaaaaatttcatatgtctgcaggcaccctcgccttctctcgcgcatcgtctcgactgaccacgcctcgcgcaaccaacgccttcaaactcatatccagcgtcttcatccccaacgccccaccggtctgaatcgccgagaccacctgcgccaccttgtcctcgcggatcaggttccggatcgccggcgtgcccagcatgagttcatgagccgccacgcgcccgccgccgaccttcttcaccagcacttgggacaccaccgcctgcaacgactccgacagcattgagcgaaccatggccttttccccggccgggaagacgtctatcagcctgtccacggtctttgctgccgatgaagtgtgcagggtgccaaataccaggtgcccggtctcagcggccgtcagcgccaggcgaatggtttccaggtcgcgtagctcacccaccagtatcacatccgggtcttcccgcagggccgagcgcagggcgaccgaaaagctgtgggtatcgcggtgcacttggcgctgggtgatcagggactttttcggcctgtggataaattcaataggatcttccagggtgaggatatgctggcgtcgatgctggttaaggtggtcgatcatcgcggccaaggtggtggacttacccgagccggtgggcccagtgaccaataccaggccgcgtggaagctgggcgatacgctggaaaacctcgcccagccccaggtcttccaggctctggacctcggtcgggatagtgcgaaataccgcacccacgccgcggtcctggcggaacacgttggctcgaaaacgcgccaccccgggcaactcgaaggcaaaatccgtttcaagagatgtttcgaaatccttttgttggtgtttattaagcaacgggcacaccaggtcgaccatttgcgatgcctcaagcaccggccaatccatgggccagacctcgccatcgatgcgcagcattggcaccaggccggccgagagatgcaggtcggaggcgcctcggcttacgctggccgtcagcaattgcgtgatatccatagggctttccatttccagtagaatgccgcggactccatatccacgggtgcaacttgaatgtcgacgatagcagacaacatcggcctggttagccagcgcatccgcgccgcagccgaggccgcgcaacgtgacgcaagcagcatccacctgctggccgtgagcaagaccaagcctgcccaggcggtgcgcgaagcctatgccgccggtatgcacgactttggcgagaattacctgcaggaagccctgggcaaacaggccgaattgaccgacctgcccttgagttggcacttcatcggccccattcaatcgaacaagactcgcgccatcgccgagaacttcgcctgggtgcattccgtggaccgcctgaaaatcgcacaacgcctgtccgaacaacgcccggccgacctgccgccgctgaatatctgcatccaggtcaatgttagcggtgaagccagcaagtccggctgcacgcctgccgacctgccggccctggccaatgccatcagcgcgttaccgcgcctgaagctgcgtggcctgatggcgatccccgagccaactgaagacagggccgcgcaggatgcagcgttcgccagggtgcgcgacctgcaagccagcctggacctggcgctcgacacactttccatgggcatgagccatgaccttgagtcggccatcgcccaaggcgccacctgggtgcgcatcggtaccgccctgtttggcgcccgcgattacggccaggcgtgaaatggctgacttccctcgaaaataaggacctgtcatgagcaacacgcgtattgcctttatcggcgccggtaacatggcggccagcctgataggcggcctgcgggccaagggcctggacgccgagcagatccgcgccagcgacccgggcgccgaaacccgcgagcgcgtcagcgccgagcacggtatcgaaacgtttgccgacaacgccgaggccatccatggcgtcgacgtgatcgtactggcggtcaagccccaggccatgaaggccgtgtgcgagagcctgcgcccgagcctgcaacctcatcagctggtagtgtccattgccgccggtatcacctgcgccagcatgatcagctggctcggtgcccagcccatcgtgcgctgcatgcctaacaccccggcgctgctgcgccaaggcgtcagcggcttgtatgccacccacgaagtcacagcgcagcaacgcgaccaggccgaggagttgctgtctgccgtgggcatcgccgtgtggctggagcaggaacaacagctggatgcagtcaccgctgtttccggcagcggcccggcctacttcttcctgatgatcgaagccatgaccgcagccggcgtcaagctgggcctgccccatgatgtcgccgagcaactggccgaacaaacagccctgggcgccgcgaaaatggccgtcggcagcgatgtggatgccgccgagctgcgccgtcgtgtaacgtctccgggcggcactacgcaagccgccatcgaatcgtttcaagccgggggctttgaggccctggtggaaacagcactgggtgccgcggcacatcgttcagccgagatggctgagcaactgggcaaatagtcgtcccttaccaaggtaatcaaacatgctcggaatcaatgacgctgccattttcatcatccagaccctgggcagcctgtacctgctgatcgtgctgatgcgctttatcctgcaactggtgcgggccaacttctacaaccccctgtgccagttcgtggtcaaggccacgcagccactgctcaagccgctgcgccgggtgatcccgagcctgttcggcctggacatgtcctcgctggtgctggcgttgctgctgcaaatcctgctgttcgtggtgatcctgatgctcaacggctaccaggcgttcaccgtgctgttgttgccatgggggctgatcggtattttctcgctgttcctgaagatcatcttctggtcgatgatcatcagcgtgatcctttcgtgggtcgcaccgggcagccgtagcccgggcgccgaattggtggcccagatcaccgaaccggtgctggcgccgttccgtcgcctgatcccgaacctgggtggcctggatatctcgccgatcttcgcgtttatcgtgattcagctgattcagagctgggtgattccacgcctggcgtactttgcgtacatgcccaaagagctgttcggcctgatctgaaatatgcaaaaaattgtgggagggagcttgccccctcccacatttgtatctttgtattgaattgaatccgtgcaggcctttgcttgccgctgggggccccgctctttagacttacgcctcatttaaacgagagcagggtcgatgccagctgccttcccccccgattccgttggactggtcgtgccccaagtggcgcacttcagcgaaccgctggccctggcctgcggccgttcattgcccgcctacgacctgatctatgaaacctacggcgaactgaacgccacggcgagcaacgccgtgctaatctgccacgccttgtccggccatcatcacgctgccggcttccactctgtggacgagcgcaaacccggctggtgggacagctgcatcggccccggcaaacccatcgacactaacaagttcttcgtggtcagcctcaacaacctcggcggttgcaacggttccaccggccccagcagcctcaacccggaaaccggcaagccgttcggcgcggacttcccggtgctgaccgtggaagactgggtgcacagccaggcacgcctggccgacctgctgggcatcggccagtgggccgcagtaattggcggcagcctgggcggcatgcaggcgctgcaatggaccatcagctacccggaccgcgtccgccattgcctggccatcgcctcagcgcccaagctgtcggcgcagaacatcgccttcaacgaagtggcgcgccaggccatcctcaccgaccccgagttccacggcggttcgttccaggaagccggcgtgatccccaagcgtggcctgatgctggcgcggatggtggggcatatcacctacctgtccgacgattccatgggcgaaaaattcggccgtggcctcaagagcgagaagctcaactacgacttccacagcgtcgagttccaggtagaaagctacctgcgttatcagggcgaagagttttccgggcgtttcgacgccaacacctacctgctgatgaccaaggccttggactatttcgacccggccgccaaccacggcgacgacctggcgaaaaccttcgagaacgtcacggccaagttctgtgtgatgtcattcaccactgactggcgtttctcgccggcccgctcccgtgagctggtggacgccctgatggccgccaagaaagacgtttgctacctggaaatcgatgctccacaaggccacgatgccttcctgatcccgatcccgcgttacctgcaggcgtttcgcaactacatgaaccgaatcacgcttatatgaattgcttacgctttgggagaacgccatgagagccgacctggaaatcatccaagactggatccccgccggcagccgcgtgctcgacctgggttgcggcgatggcgagttgctgagctggctgcgcgacaacaagcaagtcaccggctacggcctggaaaacgacccggacaacatcgcccagtgcgtggccaagggcatcaacgtgatcgagcaggacctggacaagggcctgggcaactttgccagcaacagcttcgacatcgtggtgatgacccaggccctacaagcggtgcactatccggaccgcatccttgacgaaatgctgcgcgtcggccgccaatgcatcatcaccttccccaatttcggtcactggcgctgccgctggtacctggccaccaagggccgcatgccggtctcggatttcctcccgtatacctggtacaacacgccgaacatccacttctgcaccttcgaagacttcgaagccctgtgtggcgagcgtgaagccaaggtgatcaaccgccttgccgtcgatcaacagcaccgccacggctgggcgagtaagctatggcccaatctgttgggcgaaatcggtatttaccgggtcagcagccctggcctgtccgaccacaaagttgccgtctaatcatcttcaagaggaacgttcatgagtcgtttggctatttttctattgaccgcatgcctgggcgccagcgccatggccgccgacgctatcgacgctaatcgcaagaaggattttggcgatatcaccgtccactacaacaccttcacctccagcttcctgccacccgagaccgctcagaaagtcggcgtggtgcgcagcaaggagaagggtctgatcaatgtgactgtgatcaagggcgtggccccggtcgcggcgcaggtgaccggcaccatcaaggatctgggtggcaagagcgagatcctgacgttcaagcaaatcgaagaaaaaggcgggatcagctatctcgcgccctattcggtgacccagcgcgaatacaagacgtttaccatcaacgttgaaaccggcggcaaagcccatggtttccaattcaatcaagaactgtttccggccgaccgatgaatctctcccaactggtattggccagccataacgctggcaaactcaaagaactgcaggccatgctcggcgaatcagtgcaactacgctcgattggcgagttcagccagatcgagccggaagagaccggcctgtcgttcgttgaaaacgccatcctcaaggcacgcaatgccgcgcgcatctccggcctgccggcgttggcggacgactcgggcctggcagtggactttctcggcggcgcccccggcatctattcggcccgttatgccgatggcaagggcgatgcggccaacaatgccaaactgctcgacgccctcaaggacgtgccggatgccgaacgcggcgcacagttcgtctgcgttctggccctggtgcggcacgccgatgacccgttgccgatcctatgcgaaggcttgtggcaggggcgcatcctgcacgccgccagcggcgaacatggctttggctacgacccattgttctgggtgccggagcgcaatgtttccagcgccgaactgagcccggccgacaagaaccagatcagccaccgcgcccgcgccatggccttgctgcgccagcgcctgggtttgaaatgacccagaacacctctgcgcagccgctgatccatggtggcgcgcaaacaccacgggcggctctgccccacctgccgcccttggcgctgtacatccacatcccttggtgcgtgcgcaaatgcccgtattgcgacttcaactcccacaccgccagcaaggtgctgccggaagaagagtatgtagatgcattgctggcggatctggatcaagacctgcacgccgtttatgaccgggaactgagctcgattttcttcggtggcggcacccctagcctgttcagcgccgccgcgttggggcgcttgctcaggggtgtgcaagcgcgcatcccgtttgccacggatatcgagatcaccctggaagccaaccccgggaccttcgagcaagagaagttcgtggcctaccgcaagttggggatcaatcgcctgtccatcggcatccagagtttccagcaggaaaaacttgaggccctgggtcgcatccacaatggcgatgaagccgtgcgcgctgccggtatggcccgccaggcagggttcgataacttcaacctggacttgatgcatggcctgcccaaccagtccctggacgacgccctcggcgacctgcgccaggccattgcgcttaatccgacgcacctgtcttggtaccaactgaccctggaacccaacaccgtcttctggaaccagccgcccgcgctgccggaagacgacacattgtgggatatccaggaagccggccaggccctgctcgccgagcacggttacgcgcaatacgaggtgtcggcctacgcccaaccggggcggccggcgcgacataacctgaattactggagctttggcgactttatcggcattggcgctggcgcccacggcaagctcagccacccggacgggcgcatcgtgcgcacctggaaaacccgtgcgcccaaggactatctcaatccggccaaaagcttccaggccggggcgaaagaactgaccaacgacgagctgccgttcgagttcctgatgaacgctttgcgcctgaccgagggcgtcgatgccaggctctacgccgaacgcaccgggctcgagctggccagcctcgacgaaggccgccgcgaggcagaacaaagtggcttgatgcaggtcgaaccgtcacgcttggcggcaaccgaccgcgggcaactctttctcaatgacctgttgcagaagtttttgagctgatagctcttttaaggaaatcgaatggatctggtactcgacctgctcgccaccgtatcccgctggagccgtagcaacctgtcggaaatctccctggcactcgtgggctgcttgctggtgctgttcggcgccgatatcaagggctgggtcgaagcgcgcctgggcagcatcgctggcgccttgcgcgtgcccttgatggccctgctgtgcatgatcggcagcggtgcggcgttgatctacgcaacgccgtggattgtgcgggggttgagccagttcaataattacagcctggcgccggtgttggtggtggtgctggtgttgattggggtggtggcagaccgccgctgatccgatacacactgcaaaaacaaatgtgggagggggcttgcccccgatagcggtggatcagtcagcttatctgtagctgacccactgctatcgggagcaagccccctcccacatttgattgcatttcaagtcagggggcgagttatgccaacttctcaaacttcaaatcccacaccccatgccccaaccgctcaccacggcgctcaaacttggtgatcggccgctcggccgggcgcggcacgcacttgccatcttccgccaggttgcggtagccaggggcgacgttcatcacctccagcatgtattccgcgtacggttcccagtcggtggccatgtgcaggataccgcccactttcagcttgctgcgcaccaactccgcaaaggacgcctggacgatacgacgcttgtggtgacgggctttgtgccacgggtcggggaagaacagcatcaggcggtcgaggctgttgtcggcgatgcagcggttgagcacttcaatcgcatcgcagtcgtagactcgcaggttggtcaggccctgggtgagcacgccgttaagtaacgcaccaacgcctggacggtgcacttccacaccgatgaaatcctgctccggtgcggccgcggccatttccagcagggagtggcccatgccgaagccgatttccagggaacgtggggccgaacggccaaagacctggtcgtaatcaaccggcgcatcggccagaggcaacacgaacagcggcgtaccttgttccaggcccttctgctggccttcggtcatgcgaccggcgcgcatcacaaaactcttgatgcggcggtgcttggactcgtcgcctgcttccacggtgttcggcgtttcgtttgattcagtcatcaatagctcttacttgatcagaccatccagcggcgaagaggcgctggcatagagttttttcggcatgcgcccggcgaggtaggccaggcggcccgcgacgatcgcgtgtttcatggcttcggccatcatgatcggttgctgggcgtgggcgatggccgagttcatcagcaccgcatcgcagcccagttccatggcgatggttgcatcggaggctgtgcccacgcccgcatccaccagcaccgggatcttggcttcttcaaggatgatctgcaggttgtacgggttgcagatgcccaggccggaaccgatcaacccagccagcggcataacggcgatacagccgatttcggccagttggcgggcaatgatcgggtcatcgctggtgtagaccatcacgtcgaagccttccttgaccagggtttcagcggccttgagggtttcgatcacgttggggaacagggttttctggtcggccagcacttccagcttcaccaggttgtggccgtcgagcagctcacgagccaggcgacaggtgcgcacggcttcgatggcgtcatagcagccagcggtgttcggcaagaaggtgtagcgatccggcgacagcacttcgagcaggttcggttcgccttcgatctggccaaggttggtgcggcgcacggcgaaggtgacgatctcggcacccgaggcttcgatggccagacgggtttcttccatgtcgcggtacttgccggtgccgaccagcaggcgggactggtaggtacgaccggccaggacgaaaggcttgtcgctacgaacgatgctcatgggaaatcctctgtttggatgaggttctgcagaatgcgggttgacgcacttgggcgccgggcggctagccgccgccgatggcgtggaccacttcgacctggtcaccttcgacgagcgcggtctcggcgtgctggctacgcggaacgatatccaggttgagctccactgcgacgcgtcgcccggtcaggtccaggcgggtcagcagggccgcgacggtttcgccatcgggcagttcaaaggattcgccgttcaactgaatgcgcatgccacgggccgccatcgtttttaggggccagtattctagctcgattggaacctaaaggtcagctccaagcgtcaagcggtcagctgcaagcgccaggccgcaaggccgaggaagaaccagccgagcaggaatgccagcccgccgaagggcgtgatgatccccagtttgctgatgccggtcagggtcagcgcatacaggctgccggaaaacagcagaataccgacggtaaacgagatgcccgcccagctgaccaaccgcccaggaatatgtgccgccagtaaggccacgccgaacagcgccagggcgtgcaccaactggtaggtcacaccggtgtgaaagatcgccaggtactcggcgctcaggcggtttttcaggccgtgggcggcaaacgcccccagggcgacaccggtaaagccgaaaaaggcagccagcatcagaaagctacgcagcatggggaactccagtcagactcatcgggcagggtctgtataatggcccgctcaacgggttcggccaagccatctctatgctgcgtgtcctcttcaaacgctttctcaacgtcgtgaaatggtttgccatcggcagtgtgttgctggtgctgctgttcagggttgtcccgccaccgttcactgcattgatggtggagcgcaaggtcgaatcctggatcgacggtgagcccattgacctgcaacgcacctgggtgccgtgggatgagatttccaacgacctgaaagtggcagtgatggccggtgaagaccagcgcttcccgcaacattggggttttgattttggtgcgatccaggcggcgatccagcacaacgagcgcggcggttcgattcgcggcgccagcacgttgagccagcaggtgtcgaagaacctgttcctgtgggccggtcgcagttatctgcgcaagggcctggaggcgtggtttaccgggttgatcgaggtgctgtggcccaaggagcggattcttgaggtgtacctcaacagcgtggagtgggatgaaggtgtgtttggtgcagaggcggcggcgcggcaccattttggcgtgagtgccaaaggcctttcacggcaacaggccagttacctggcggctgtattgcctaatccgcgggtgtggagtgccagccacccgacagcttacgtggcgcgacgggcggcgtggattcgtcagcagatgagtcagttgggtggggatggctacctgactgagctgaacaactctcgaaaagccccctggtccaactgacacaatacaaaataactgtgggagggggcttgctcccgatagcagagtgtcagtcaacatcaaagtgactgatctatcgctatcgggagcaagccccctcccacattttcaaaccagcattgccagctggattaagcggcgatcgacagcttcaacttgttcatcgcgcttttctcaagctgacgaatccgctcggccgacacgttgtacttctgcgccaggtcgtgcagcgtggctttctcttccgccagccagcgctggtagaggatgtcgcggctgcggtcgtccaacacttccagcgcttcatgcaggttgtggttggagttgtcgctccagtcggcgtcttccaattgacgagccgggtcgtaccggtggtcttccaggtagttggccggcgattggaaggcgctgtcgtcatccgcttcggcggctgggtcgaaggccatgtcatggccggtcaggcggctttccatctcgcgcacttcacgaggctccacaccgaggctttcggccacgcggtggacttcctcattgttcagccatgccaggcgtttcttctggctacgcaggttgaagaacagcttgcgctgggccttggtggtcgccactttcacgatgcgccagttgcgcaggatgaactcgtggatttccgccttgatccagtgcacggcaaacgacaccaggcgcacacccatttcagggttgaagcgctttacagccttcatcaggccgacgttgccttcctggatcaggtcagcctgggccaggccgtagccgctatagctacgggcgatatgtacgacaaaacgcaggtgggcgagcaccatctgccgagccgcccccaaatcctgctcatagtagagactctcggccagttcacgctcctgctcgggcgtcagcaatggaatgctgttgaccgtgtgcacataggcctccaggttcgcacccgggaccaaggcataagcaggttgcaaagaagtggtcatacgaaaaaacctccgactcacataactcgtgcagttcagcactgcgaaaattgaccgggaaccgtaggacaagttccctaaaccactgatacggtcaatacaaacgaaaccacattaccctggcattaactacttcggcgccagctcacgtaaatgccgtgctaccgcaatccaggcaccgatataccccaacaggaccgcgccaagcaagagactcagaccatcggcaaccggcaccccggccaaggcaaaatcactgccatacaaaccggccagcccaactaccgcgtcgttcagccaatcaaggccaaacgccagcacgccccaggacaaaaccccggcacccaagccataaagcgcgcccatgtatagaaaaggacgacgcacatagctgtccgtgccgccgaccagtttaatcacttctatctcggtgcgacggttttcaatatgaagacgaatggtattacctatcaccaaaagtaatgcagacaccaacagcaccgtcaaaccgaacacaaagcggtcgcccagcttgaggatcgcggccagacgctctacccagactagatcaagttgcgcctgttgcaccttcggcatctctgcgagtttttgtcgcagggcctccagggcaggcttatcgacttcgttcggcgtcaccagcaccacaccaggcaatgggttctgcggcagctccttgagcgcctcacccaggccggattgctgctggaactcttcaagggcctggtcgcggctgatgtactcggcctcggcaacgcccgggatgttcttgatgtcgtcgcgcagcgcttcgccgtccttgctgctggcgtccaggttcaggtacagcgaaatctgcgccgcacgctgccaggagccacccaggcgctcgacattattaagcagcagcgacaagcccatcggcaggctcagcgccacggccatcaccaggcaggtgaagaagctgccgatcggctgcttgcccaggcggcgcaggctgtcgaccaggctggcccgatggctttcgatccaggcatgcagcaaggtgccgaagtcaggaccgtcgtcttcgtcgcgctttttcttcggtggttgcgggtcggccggtttcggcgccacgcgttcggacactttaggactgcgagtggcactcatacgccggcctccccatcaccaatcaggcgaccgcgttgcagggtcaacatccgatgacgcatgcgggcgatcagggccaggtcgtggctggcgatcagtacgctggtgcccaggcggttgatgtcttcgaacacgcccataatctcggccgccaggcgcgggtcgaggttgccggtaggttcgtccgccagcaacaaggccggacggtggacgatggcgcgagcaataccgacgcgttgttgctggccggtggacaggtcgccagggaagagatcggtcttgtccgacaaggctacgcgctccagggccgagtccacgcgcttgacgatctcggccttggacaacccgaggatctgcaacggcaaggccacattgttgaagaccgtgcggtcgaacagcaactggtggttctggaacaccacgccgatctgacggcgtaggaacggaatctgtgcattgctgatggtcgccaggtcctggcctgccagcagcaacttaccggtggtcgggcgttccatggccagcaacagacgcaacagcgtacttttgcccgcacccgaatgcccggtaacaaacaggaattcgccgcgccgcacccgaaagctcagctcatgcaagcccacatgcccgttggcatagcgtttaccgacctgttcgaatcgaatcatgaacgctcccgctcggcaaacagcgcctgtacaaagggttcggcttcaaaagtgcgtaagtcatcgatgccttcaccgacaccgatataacgaatcggcaacccgaactgtttagccagggcgaaaatcacaccgcccttggccgtgccgtcgagcttagtcaatgccaggccggtcagttgcaccgtctggttgaattgcttggcctggctgatggcgttctggccagtgccggcgtcgagcaccagcaagacttcgtgcggcgcgtcggcatcgagcttgctgatgacacggcggacttttttcagctcttccatcaggttgtctttggtgtgcaggcgcccggcggtatcggcgatcaacacgtcgatattacgagccttggccgcttgcacggcatcgaagatcaccgaagcggaatcggcaccggtgtgctgggcgatcaccggaatcttgttgcgctcaccccacacctgcaattgctcgacggcggcggcacggaaggtgtcaccggcggcgagcatgactttcttgccctcaccctgcagcttcttggccagcttgccgatggtggtggtcttgccggcgccgttaacgccgaccaccaggatcacgaacggcttgttcggcgtgatcaccagcggcgcctccaccggcttgagcatcgccgccagttcggcctgcaaggatttgtacagggcatcggcgtcggtcaactgcttgcgtgcgaccttctgggtcaggctctggatgatcacggcggtggcttcgacgcccacgtcggcagtgagcaggcgggtctcgatgtcttccagcagctcatcatcaatgaccttcttgcccagaaacaggctggccatgccttcaccaatgctggcgctggtcttgctcaagccctgcttgaggcgggcgaagaacccggtcttgctggtttcggcagggacggttggctcttcgatcacagcgggagcggcaatctgcacgggcgcaggctcgaccggtgcttcgacaaccaccggctgcggctctataaccaccgggatcggcggagccacatgctcggcctgcacatcttcaaccagtgctacaggctcttcggccaccggcaattgcggccacggtttgtgctcgggttcaggctcgggctctgcctcgaccacgggctgcaataccggctcggccatcggcaacaccaccggcgccggggtatcggcaaccggttcggcttctactaaaggctcaggaacgggctcgggttgaacctgcggctgttcgacgacggtttcctgcggctttttgcgcagccatccgaacaggccttttttctcgccagccgcagctgggctcttcttgtcgtcattggaaccaaacatggaggacggctatctcaaagtagcgatgcgccagggcgcctcggtaaataaattcgatgcagaacagactgctttaacgcccgcttgttcatgcgcaacattttgtaaggcgtaaataaaggccttggcaaatcgtttcaatataggactgaagcgataaaatcggcgaaaagttgaagatcgtcggggaaaaacaccctttattccaacattcctacgactggatccaggactagatgacaaccgcagtggccgtctctaaatcggatcagtatcctagcacctcctcgcccgccgacgctaagaccaagcgggcagcccaacaggtttaaaaacgaatgaatgctctagcccgccgcgccgcaggcctgctgctcagcacagtttgtctgcccctctcagccttggctgccgacccacaacccacccatgaattcaccctggataacggccttaaagtggtcgtgcgcgaagatcatcgtgcgcccgtggtggtttcccaggtctggtacaaggttggctcaagctacgaaaccccgggccagaccggtttgtcccacgccctggaacacatgatgttcaagggcagcgccaaggttggcccaggcgaagcctcgctgatcctgcgtgacctgggcgccgaagaaaacgcgttcaccagcgatgactacaccgcctattaccaggtgctggcccgcgaccgcctgggcgtggccttcgaactggaagccgaccgcatggccagcctgcgcctgccggccgacgagttcagccgcgaaatcgaggtcatcaaggaagaacgccgcctgcgcaccgacgacaacccgatgtccaaggcctacgagcgtttcaaggccatggccttcccggccagcggctaccacacgccgaccatcggctggatggctgacctggaccgcatgaaggtcgaggagctgcgccactggtaccaatcctggtatgtgcccaacaacgccaccctggtggtggtcggcgacgtgaccccggacgaggtgaaaaacctggcccagcgttacttcggcccgatccccaagcgtgacgtgccaccggcgaagatcccaatggagctgcccgagcctggcgagcgcctgctgaccctgcacgtgcagacccaactgccgagcgtattcctgggcttcaacgtccctggccttgccactgccgaagacaagcgctcggtacaagccctgcgcctgatctcggccctgctggacggcggctacagcgcacgtatctccgaacaactggagcgtggcgaggagctggtgtctgccgcttccaccaactacgacgcctatacccgtggcgatacgctgttcatgctgtcggccacacccaaccagcagaagaaaaagaccgtagcccaagccgaagccggtctgtggcgcctgcttgatgagttgaaagccaagccgccgactgccgaagaactggaacggatccgtgcccaggtgattgccggcctggtgtaccagcgcgactccattaccagccaggccacggccatcggctccctggaaaccgtcggcctttcctggaaactgatggacagcgagttggccgatctgcaaagcgtcacgccggaagatatccagaaagctgcccgcacctatttcacccgcgaacgtctgagcgtcgcccatgttttgcctgaggagagcgctcatgaataatcgtaaaagcagccgcctgatcctgcccggcctgatcgctgtcaccctggtcgcggccagtgccgtgtatttcctgcgcccgagcgagtcggtcgccagccaggccctggacaaggcccaatcggccagcaccctgcaatccctggcagaactggacggcaaggcaccgaccaaccgcaagctcgatgtgcagacctggaccacagccgaaggcgccaaggtgctgttcgtcgaagcccatgaactgccgatgttcgatatgcgcatcctgttcgctgccggcagcagccaggatggcgatacgccgggcctggcactgatgaccaatgccatgctcaacgaaggcgtgccgggcaagaatgtcagccagatcgccagtggttttgagggcctgggtgccgacttcggcaatggtgcctaccgcgacatggcgctggtctccctgcgcagcctgagcgacagcgataagcgcgaagcagccctgacactgtttgaccaagtgatcggccagccgacgttcccggcggactccctggcacggatcaagaatcagatcctggccggtttcgagtaccagaagcagaaccccggcaagctggcgagcattgagctgttcaagcgcctgtacggcgaccacccttatgcgcacccaagcgaaggcacctccgagagcgtgccgaagatcaccttggcgcagttgcaggcgtttcacgccaaagcctatgcggccggtaatgcggtgattgcggtggtgggcgatctgacccgcgccgaagccgaggccatgacggccaaggtctctgcgtcgctgcccaaaggcccggccatggccaagattgcccagccgaccgagccaaaacccggcctgagccgcatcgagttcccatccaagcaaacccacttgctgttcgcgcaactggggatcgaccgcgctgatccggactacgccgctttatccctgggcaaccagatcctcggcggcggcggcttcggcacccgcttgatgagtgaagtgcgtgagaagcgcggcctgacctacggtgtgtactccggtttctcaccgatgcaggtgcgtggcccgttcatgatcaacctgcagacccgcgccgaaatgagcggtggcaccctgcgcctggttgaagacgtgctggctgactatctcaagaccggcccgacgcaaaaagaactggatgacgccaagcgcgaactggctggcagcttcccgctgtccaccgcgagcaatgccgatatcgtcgggcagttgggcgccatgggtttctacaacctgccgctgaactatctggaagatttcatgaaacaatcccaggccctgaccgtagagcaggtcaaggcagccatgaacaaacacttgagcgccgacaagatggtcatcgtgaccgccggcccgacgattgcgcaaaagccactaccgccccccactgataaacctgccgagcagccgctcggggttccggagcattaatggccagttcatctcgcccgaaaaaacctgtccacaacgtacataacggtgtgggccaactgcgcatcattggcggtgaatggggcagccgcaagctgagcttccccgacgtcgtcggcctgcgcccgacgccggaccgcgtgcgtgaaaccctgttcaactggctcgcgccgtatatcggcggggccaaggtgcttgatccgttcgccggcagtggcgcgttgttcctggaggcgctgtcccgtggtgccgcccagggccaggcgctggatgccagtaatgtggcagtgtccagcctcaaggagcacctgggcacgctgcgctgcaataccggccaggtgcagacggctgacgcgctgcgctatctggaaacccaggcggccacggaatatgacgtggtgtttctcgacccgccgttcaaccagaacctgctgccgaccgtgtgcgcattgctggaagaacgtcagtggttggcaccggatgcctgggtctacactgaaagcgagaccgcgccgtccacactcggcctgccgggcagctggcgcctgcaccgggagcagaaatccgggcgggtgtattacgcactgtggcaccggttggtcgaaaacgccgcttaacctgtggcgagggagcttgccacggcgagctcactggctaccgagagtttcatgaccccctcttccgacttgttcaaacccgccttcggcctcggcaacccccacctgcaaacattgtgggggccgctgtggcgcccgacgacccacatcgagcgccagcgcgaacgcctgtggctggaagacggcgacttcctcgacctcgactggcacggcccccacgatgcacaggtaccattggtgctggtgttgcatggcctcaccggttcgtccaactcaccttacgtggccggcctgcaaaaagcccttgccgcccaaggctgggccagcgtcgcattgaactggcggggctgctccggcgagccgaacctgcttgcccgcagctatcactccggcgccagcgacgacttggcggcggcgattgcccatctgcgcaccaagcggcctctggctcccttatatgccgtagggtattcactgggcggcaatgtgttgctcaagcacctgggggaaaccggcatggcttcgcagctgcaaggcgcggcggcggtgtcggtgccgtttcgcctggaccagtgtgctgaccgcatcggcttggggttttcgcggatctatcagaaacatttcatgcgcgagatgctggcgtatatccgcgtcaaacagcgccagtttttgcaggatggccgtgaggaagggctcaaaaccctgaacgcattgggctccctggaaaagatgcgaacgttctgggacttcgacgggcgggtgacggcgccgttgcatggttttatgagtgctgaggattactatcgccgcgcttccagtcgctactacctgggcgatatccgcacgccaacgctgatcatccaggcggccgatgatccctttgtgtttgctcatagcctgcccgaggcgagtgaactctcggagtgcaccgagtttgaattgctggcaaagggtgggcacgtggggttcgtggagggctcgctgaaacgcccaggctattacctggaacgccgcatcccacaatggctactggcacaacatggataaaaatgtgggagggggcttgctcccgattgcagtgggtcagctaaagataagctgactgttacaccgctatcgggagcaagccccctcccacattttgattgggtttacaggggcgattgctcagtcgcctgttgcaatttcccgcgccggctccgtaatccactcactccacgaccccgcatacaacttgcccaacggatatcccgccaacgccagcgcaaacaggttatggcacgccgtcacccccgaaccgcagtacgccaccaactcctccggcggacgcccctttaactgcgcagcaaagcgctgcttgagctgctcggccggcagaaagcgcccgtcactgcccaggttttcagtaaacgctgcgcactgcgcgcctgggatgtgcccggcaatcggatcgatgggctcaacctctccacgaaagcgcggctgggcgcgggcatcgatcagggtcaagccaggtcggcccaggcgtttgtgcaagtgttcggcatccagcaccaaccggtgatccggcgctccggcaaaggtgcccggttcgatcactggtgcatccaggctcaaggggaaaccagcgacatgccaggccttgaggccaccgtcgagaataaacacgccctcccgcttgcccagccaggccagcagccaccaggcacgggcggcataggcgcctgggccatcgtcatatagcaccacatcggtgtcggcactgatgccccaggcccgtagctgcttggcgaacgtgtctgctgctggcaaaggatgacgacccgtcacgcccttggttaccgggccgctgaggtggcgctccaggtcggcgtattgagccccctcgatatgcccttcggcgtaactgcacagcccgtagtccgggtcttccagggcaaagcggcaatccaggatcaccagcccggccgacttctggcgctcggccaattgctgggggctgatcagttgggcaagcggcatgacggactcctgtgaatacaaagggggaaaggtcctacttcacttcttccagtgcctggttcaacggcacgtaaaactctttgaacaaggcgtccaccgcctctttggcctggggcgtgacaaaacccgcctccagtaccagcacctgatacaccccgcgcttgatcgcctcggcgctcaagtgggtggatttctcattggtggtgcacaggaatcgcacccacgaggtcaggattatccaggcgttcagggtcagggcttcggtttgcaccgggtccatattgagaatgcctgcgtcgacaaacccctggtagatggcaccaccctggatcaggcaacgctgggaaaaccgccggtagccggtggccagctccgggtcgctttcgagtaaatgttcaagatcgcggtgcaggaaacgataacgccacatgcccgccagcacggcctgcagataaaagcgcttgtcttccaccaccatagtgcgcccctggggcgggcgcaggaaactgtccaccaacgcttcatattcgcgaaacagcacggcgatgatcgcctgcttgttggggaagtggtagtacaggttacccggggaaatttccatgtgggcggcaatgtggttggtgctgacactgcgctcgccctgctggttaaaaagctccaggctggtttgcacaatgcgctcgctggtctttactcgtggtgccatgggggatcagcttctatacacgggatgggccatcttacggcctatgccggccaggataaatccggatgttactgcaatcttatttgacaatttagagcaatgactctaaaaatccaggcagaccaataacaaccgggaccgcgccatgtctgccaacgttgcctacctgcaagattcccaggcgctggatcacctccaggacctgttcgacgcccaacgtcgcgcctacgccgccaacccgatgccaccggcggcgcaacgccagcaatggctcaaggccttgcgggacatgctcagcgatgaacgccaggcgctgatcacggcgatcagccaggacttcagccatcgcagcgcggacgaaaccctgttcgccgaactgatgcccagcctgcacggcattcactatgccagcaaacacctcaagggctggatgaaaccctcccgccgcgctgtaggcattgccttccagcccgcctcggccaaggttatttaccaacccttgggcgtggtcggcgtcatcgtgccgtggaactacccgttgtacctggccatcggtccgctggtcggggcgttggcagccggcaaccgggtgatgctcaagctcagcgaatccacgcccgccaccggcgaactgctcaagacgctgctcgccaggatcttccccgaggacctggtttgcgtggtactgggcgaagccgaagtgggcatggcgttttccaaattgcgcttcgatcacttgctgttcaccggcgccaccagcattggcaagcacgtgatgcgcgcagccgccgaacacctcacgccggtcaccctggagctgggcggcaagtcgccggccattgtctcggccgatgtaccgctcaaagacgccgccgagcgtatcgccttcggcaaagccttgaacgccgggcaaacctgcgtggcgccggactatgtgttggttccggaagaccgcgtggaggggtttgtcgaggcttactccaaggccattcgcgggttctatccgaccctggctgacaacccggactacaccgccatcatcaacgagcgacaactggcccggctcaatgcctacgccaaggacgccaccgacaagggcgccaccctgatcccgctgtacgagcaaggccaggcgcgacggatggcccacagcctgctattgaatgtcagcgacgacatgaccgtgatgcaggacgaaatcttcggcccgcttttgcccatcgtgccttatcgcggccttgaccaagcctttgcctacatcaaccagcgtccgcgcccactggccctgtattacttcggctacaacaagggcgagcaggagcgcgtgctccacgaaacccactccggtggcgtatgcctgaatgacaccttgctgcacgtcgcccaggatgacatgccgttcggtggcatcggcccgtcgggcatgggccattaccacggccatgagggtttcctgacgttcagcaaggccaagggcgtgctggtcaaacaacgcctcaacgcagcaaagctgatctacccgccctatggcaaatcgatccagaaactgatccagaagctgtttatccgctgataaccgccaccttcgggacgataaaaataatgaaccccagcctgactgactcacccgcgctgtcgcggcgcggcgtcttgaaaatcggcctgtgcgccagcgcgtttctcgccactgccgggcttggcgccagcctcagcggctgttccagcagtacaccggccagtggctttgccatgctgcgcgccagtgacttgccgtttttgcgtgcggtgatcccggtgctgctggaaggcgcggccagcgccgaggcggtggtcgctggcattgacgacactctgaaaaagctcgactacagcctgcagcatttgtcgccagaaatgttcaagctcacccagcagttatttgacgtgctgagcatgggtatcacccgcggcccgttgaccggtatctggggcagttgggaaaacgccagcagcgagcaaatccgcaacttcctgcaccgttgggagaacagctacctgaacctgctgcgcatgggccagggctcgttgctcaagctggtaatcatggcctggtacttccggcccgcgtcctgggcccattgcggctaccccggcccgccgaagatctgattcgcatcccccacaataaaaaccagagacgaacctgatgcccgtacccgatctgttccgcgacggcctggcccgaggctggaaaacccacaacggcgccgccctcgacaacgacctgaccctggaagccgatgtagccattatcggcagcggtgccggaggcggcaccaccgccgaaatcctcagcgccgccggctacaaagtgttgttgatcgaagaaggcccgctcaagaccagcagtgacttcaagctgctggaggacgaagcctatgccagcctttaccaggaaggcatcgggcgtatgagcaaggacggcgccattactatcctgcaaggccgggcggtgggtggcaccaccttgatcaactggacctccagttttcgcacacccgacgccaccctcgcccactgggccagcgaatacgcggtgaaaggccacagcagcgccgagatggcaccctggttcgaaaaaatggagcagcgcctgggcatcgcgccgtgggcgttgccaccgaatgccaacaacgatgtgatccgcaaaggctgcgaaaaactcggctacagctggcatgtgatcccacgcaatgtgcgcggctgcttcaacctgggttattgcggcatgggctgcccggtcaatgccaagcagtcgatgctggtgacgactatcccctccaccctggaaaacggcggcgagctgctgtatctggcccgcgccgagcagctcaaatacagtggcgacactatcagcagcctggagtgcgtggccatggacgaacgctgcgtggcccccaccggacgcaagatcagcgtgaaggccaggcactacgtgctgtcgggcggaggcatcaacagcccggccctgctgatgcgctcggacgcacccgacccgcattcgcggctgggcaagcgcactttcctgcatctggtcaatttctccgccgggttgttcgacgaagtgatcaacccgttctacggtgcaccgcagtcgatctattccgaccatttccaatggcaggacggcaccaccggtaaaatgtcctacaagcttgaagcaccgcctttgcatccagggttggccagcaccctgttcggcggctatggcacgcagaacgcactggacatgaatcgactgccccacacccacgccatgctcgcactgctgcgcgacggttttcaccccgacagcctgggcggcactgtgggtctgcggggtgacggcacgccggtgctcgactatcaggtctcgccctacgcctgggatggcctgcgccgggccttccacagcatggccgagatccagttcgccgcaggagccaaatcggtcaagcccctgcatcacgatgcaaggttcgtgaacaccttggccgaagcacgcaacgtgattgacggcttgagcctggaactacaccgcacaactctgggcagcgcccatgtgatgggcggttgtgccatgggcgaagatccgaaaaacgccgtggccgacagccttggccgacatcatcagttgcgcaacctgtcgattcacgatggctcgttgttccccaccagcattggcgccaacccacaattgtcggtgtacggattgaccgcgcaactggcgacagcgttggccgaacgtctgaaaacggcatgaaaaagcctgggattgacgacctctatctacataagtcgacttggccgaccgggatggctgcgataccatccggttccccaacggactccgccaggacgacgcgatgaaccgagtgttgtacccaggtaccttcgacccgattaccaaaggccatggcgatctggtcgaacgcgcctctcgcctgttcgaccatgtgatcatcgcggtcgcggccagccccaagaaaaacccgctgtttcccctggaacagcgcgtggagctggcgcgcgaggtcaccaagcacctgcctaatgtggaagtagtgggcttttcgacgctgctggcgcatttcgccaaggagcagaacgccaatgtgttcctgcgtggcctgcgcgcggtgtcggacttcgaatacgaattccagctggccaacatgaaccgccagctggcgccggatgtggaaagtctgttcctcacgccgtcggaacgttattcattcatttcctcgacgttagtccgtgaaatcgcggctttgggcggagatatcaccaagttcgtccatcctgcggtggcagatgcactgaccctgcgcttcaagaagtaagaccgctcaagcggcgcctgctcgcactgcgggcgccaatgcggcacaattgcgcgcattagttttcagatgccttggccgcgtgccctggcaggagtttccatgtccctgatcatcaccgacgattgcatcaactgcgacgtctgcgaacccgagtgcccgaacgctgcgatctcccaaggcgaagagatctatgtgatcgaccctaacctgtgcacccagtgcgttggccattacgacgaacctcagtgccagcaggtttgcccggtggattgcattccgctggatgaggcacaccctgagactgaagagcagttgatggagaagtaccgcaagattaccggtaaggcttaagttttttagtgcctgtgagggcctcatcggggcggtgcgacggttcgacttgcccccgatgacaatctcagccatcacaaagctatcagctctggcacttggggcaaaacacactcgcccgctgccccagcaccacattgcgcaactcggtcccacagaccttgcatgcctcgccgccacggccatacacgtacagttcctgctggaaataccccggctgcccatcgccgccgataaagtcccgcagcgtagtaccgccccgctcgatagcagcggccagcacccgcttgatctcaatcgccagcttcaaatagcgcccgcgtgaaatgccaccggcggcacgccgcgggtcaatacccgccgcaaacagtgcttccgtcgcatagatattgcccacccccaccactaccgcgttgtccatgatgaacggcttcaccgccatcgatttgccgcgcgacagctggaacaaacgttcgccgtcaaacagctcggtcaacggctccggccccaggcgaatcagcagttcgtggttgtgcgggtcctggctccagagcattgcaccgaaacgtcgaggatcggtgtagcgcaaggccaggccggattcgagttcgatgtcgacatgctcatgcttgagcgcaggcatgccgacctccaccaggcgcaggttgcccgacatgcccaagtgactgatcaaggtgcccacttcggcattgatcaacaggtacttggcccgccgttccaccagcacgatgcgctgcccggacaggcgcacatccaggtcttccgggatcggccagcgcaggcgccgctcacgcaccaccacgcggctgacacgctggccttccaggtgcggggcgatcccgcgccgggtggtttcgacttctggtaactcgggcatgtgtacctcttgaataacgggtcagtgcgcgcccagttcgcggatcgacaacttcaggctctcgaagtcgtagtccgacaggcccacgtaatccagcaccagatggccaatcgcgttccactcatggtccacggcctggttacccagcacgcgacaggacgaacagatatgctcggccatcttcaaaatcgccagcaggttcttgagttgcggattgcgcgacgtctcatcgctgaaaatcgccagggcgttgtggtgattggcgatggcatcggtcacatgttccggcaggcgccaggacttggcggtgtagtagccgaccaccgcatggttggtgttgaacgcgttgttctcggtgtcgaccacgcggcgctcggggccggcgctggcataagcctgctccagcactgccatgtagttggggaaacgcttgagcatcagcggcacgccgcaatcgtggaacaggcccaatgcatacgcttcatcgacggcctgggaaccggtgcgcttggccagggtgaggcaggtcatggccacatcctgggcggtgtcccagaagcggttgagggtgacgatggtgtcgtcgctcatctcgcccttgatcgacaaggcattgatcaggttgatgaccgaccggctgcccagcaggttaactgcacgctggatcgaggcgatcttgttgctcaagccgtaatacgacgagttgacgatcttgagcaacgcgccagacaagcccgggtcctgggcgatcaaccgtgcgatcacttccaggtccgggtcgggcatgtactgctccatctgcaaatccaccatgatctgcggttggggcggcacgctgatgccttgcaggacctgttggatctgctcggcggaaagctcttgggacataagtacacactctgggctagacgcgaattctaacccttatgaagacgtgaccgacacccacaacccaaactgaaaccctcccacatgtccggtgccgccgccaaataatgcgcaacacgctatactcccgctcttttttccggagcgacgtcatgtccctgccaagcctgcgtctcaaagccaacgctgatcgtcgtttgcgcaacggccacctgtgggtctacagcaacgaaatcgacgtggccgccacacctcttcacggcttccaggcaggcgaccaggcgatcctggaagcggccggcggcaagaccctgggcatcgtggccatgagccccaacaacctgatctgcgcccgcctgctgtcgcgcgacatcaagttgccgctggacaagtcactgctggtgcaccgcctcaacgtcgcgctgtccctgcgtgatcgcctgttcgacaagccgttctaccgtctggtctacggtgattccgacctgctgccgggcctggtggtcgaccgtttcggcgacatcctggtggtacagatcgcctcggcgaccatggaaacccataaagaagacgtgatcgccgcgctgacccaagtgctcaagccgagcggcatcctgttcaagaacgattccgccgcacgtgacgccgagggcctcaaccgctacgtcgaaaccgttttcggcctggtgccggagtgggtggcgctggaagagaacggcgtgaaattcgaagccccggtgatccagggccaaaagaccggctggttctacgaccaccgcatgaaccgcgcccgcctggccccgtacgccaaaggcaagcgcgtgctcgacctgtacagttacatcggcggctggggcgtgcaggccgccgcctttggcgccagtgaagtgttctgcgtcgatgcgtcggccttcgccctcgacggcgtcgagcgcaacgccgcgctgaacggtgttgccgagaagatgacctgcatcgaaggcgacgtattcgaagccctgaaagaactgaaagccagcgaagaacgcttcgacgtgatcgtcgccgacccgccagccttcatcaagcgcaagaaagacatgaaaaacggcgaaggcgcctaccgccgccttaacgagcaagccatgcgcctgctcagcaaggacggcatcctcgtcagcgcctcgtgttccatgcacctgccggaagatgatctgcagaacatcctgctgaccagcgcccgccacctggaccgcaatatccagatgctcgaacgcggcggccagggtccggatcatccggtgcacccggcgattgtcgaaacgcgctacatcaagagcattacgtgccggttgctacccaatagctaattgaaaccgagtcatctgtaggagcgagcttgctcgcgaagaacgaatagacgccacgggctacctgatagcgctgcgttatggttgacgattttcgcgagcaagctcgctcctacaggtaacggtgcgtcatagccagatggcatcccatagtgggtattggccaatgtgctcgaccaaacccgcgcgcaatgggtttgcgacgatgtagcgagccattgccttcaagtcctcctcacggcgcaacgctcggtcgaaatagcctttttgccaaagcactcagaaggactgtcttgccttattgactgcacgggcacttcgcgatttggttcgctgcatgagcctggacaaatcgccgttgtgcaactccaccagccagtggaaatggtcgggcatgaccacccaggctagtgaccttgcatctccttcttcctgagcctttctgaattcgcggaccagcaagcgaccgatatgccagtcttgaaaaatgcgttgccgttgatgggtgacagccgttagcaagtagatacggcccgattctgagtaacgccctttacgcagccgatgagcattttgctgagtggacattccttcgtcctcttctgtgattggaagataaacggtaggagccaacgcgccaacgagccgttaaacagtggttctggatatgtcttgccgttgtaggagcgagcttgctcgcgaaaaacgcataggcaccacggtccacttcatagcgctgcgttatcgttgacgattttcgcgagcaagctcgctcctacaggtagacggccattccctccagccgccagcggtgtagaatcggccctattcatcgccagtcatcccccggcgggtttatgagctcgaggcccaagcacgcggcgatcccgcgacgcgagtggcaacttccggacacacggccatttttcgggtgttccagtcgtcaattagaagctcactcccctttagtacttgattagccgcccggagtgctccaatgcctgattaccgctcgaaaacatccacccacggccgcaacatggccggcgcgcgcgcactgtggcgtgccacggggatgaaagatgacgacttcaagaagccgatcatcgcgattgccaactcctttacccagttcgtaccgggccatgtccacctcaaggacctgggccaactggtcgcccgcgagatcgaacgggccggcggcgtggccaaggaattcaacaccattgccgtggacgacggcatcgccatgggccatgacggcatgctgtattccctgccgagccgcgagatcatcgccgactccgtggagtacatggtcaacgcccactgcgccgacgccatcgtgtgcatctccaactgcgacaagatcacccccggcatgttgatggctgccttgcgcctgaacattccggtgatcttcgtctccggcggcccgatggaagccggcaagaccaagctcgcgtcccacggactcgacctggttgacgccatggtgatcgccgccgattccagcgcttctgacgagaaggtcgcggaatacgagcgcagcgcctgcccgacctgcggttcgtgctccggcatgttcaccgccaactcgatgaactgcctggtagaagccttaggtctcgccttgccgggtaacggttccacactggccacccacagcgaccgcgagcaactgttcctgcaggccggccgcaccatcgtcgagctgtgcaaacgctattacaccgagaacgatgagtcggtgctgccgcgcaacatcgccaacttcaaggcgttcgagaacgccatgaccctggacatcgccatgggcggttccaccaataccatcctgcacttgctggccgccgcccaggaagccgagatcgacttcgacctgcgcgacattgaccgcctgtcccgccatgtgccgcaactgtgcaaggtcgcgccgaacatccagaagtaccacatggaagacgtgcaccgcgccggcgggatcttctcgatcctaggttccctggcccgtggcggcctgctgcacactgacctgccgaccgtgcacagcaagtccatcgccgaaggcatcgccaaatgggacatcacccagaccgacgacgaagccgtgcacaccttcttcaaggccggcccggcgggcatcccgacccagaccgcattcagccagtcgacccgttgggacagcctggacaccgaccgtgaaaacggctgcatccgcagtgtcgagcacgcctactcgcaagagggcggcttggccgtgctgtacggcaacatcgccctcgatggctgcgtggtgaaaaccgcgggtgtggatgagtccatccatgtcttcgaaggccgcgccaagatctacgaaagccaggacagctcggttcgcggcatcctcgctgacgaggtcaaggaaggcgacatcgtgatcatccgctacgaaggcccgaaaggcggcccgggtatgcaggagatgctctaccccacctcctacctgaaatccaagggcctgggcaaagcctgtgcgctgctgaccgacgggcgcttctccggcggcacctcgggcctgtccatcggccacgcttcgccggaagccgctgccgggggcgcgattggcctggtgcaggatggtgacaaggtgctgatcgacattccgaaccgctcgatcaacctgttgatcagcgatgaagaactggctgcacgccgggttgagcaggacaagaaaggctggaagccggtggagaagcgtccgcgtaaagtcaccactgcgttgaaggcctacgccctgctggccaccagcgccgacaagggtgctgtgcgtaacaaagcgatgctcgacggtctgtaagactcgcgcaaaaaaaatgcccgccaagtgcggggcagttttttgcctggagataaccccaagcacaatgatgatcaaaatgtgggagggggcttaagctaatgccagtgtaggagcgagcttgctcgcgaaaaactcaaaggcaccgcgtttattcaggaaacacgcgttatcgttgacgtttttcgcgagcaagctcgctcctacagaagtgatgcgtcaggctttagaactgtggggtgtaggtcatgctgaacatcacattacgcgggtcgccatagtagttgctgccccacgtcgcgttatacgcagggatgtagtacttcttgtcgaacatattgttcaagttcgccgccacggtgaattcctggttgatcttataggccaaccgcgaatcccacagtgcattgccgggtacgctgaagttgcggtcgtaggcttcggtgctgctttgtgcggttacgccggctccgacactgaactgctgccaatcgcccggcaactggtagtcaccccagaccttgagcaggtgcttgggcgtccaggtgctgaagatcttgccttcgtaagtgtcgtctttgaggaatttggtggtgttgtaggtgtagctggagaccagttgcaaacccggcagcacttcgccgctcaaagtggcttcgaagccttggctgcgaaccttgcccgaggcgagcgagcagtaccagccgccgcagactttgccgccttgcaggtcttgagccgcacggttttcctggtcataacggaagatggcgaacgaagtattcagacgaccgtccgccagttcacccttcaggcccagttcgtagttctggccttcgatgggcttgagcacggtcaaagaagtggtcaggttggtctgcggttcgaacgcgtccgcgtagctggcgtaggccgaccattggtcattgagggcgtagaccaggccagcatacggggtaacgtgaccattgctctgcgtggtgctgcgggttgggtcgccatacacaccccgggaaccgctctcgtcggtgtagccatagtcataccaactggtacgtgcaccgacaatcaaggtcagtgggtccacaaccttaacgcgccaagtgccataaacccctttctggcgaatgtcataccaacttttcgtagcattgcccgcctggaacagctggtttttatcgcgctgtggacggttgtgatcaatgttgaaaatgtccgcgccggccgtcgctgctcgcgcccactggtcgttggtggtgagtttggaatagttggcgcccagtaccatctcctgttgcaagcccaaaccttcaaacttgccgttcacatacacatctacgccgcggctcttggtattgaagtcggtgacccaatccacataacgcacattgccggcggtgccggggttgggaatctcatcccaggtcgcctggtaggtcgcgtcgttgtgttcatccatggccacaagggcggctttcaccttccagtcatcgttgaagcgatgctcgatatcggcgaacacctgggtctggttattgacgttgcggttccagctggcgccgacaaaagtcgagcgcggcaggccgatatcgctgccattggcgtaacggggcagtgacatgaagttggggcgcgagtggcctttttggttgctgacccccacaccgacggtggtgtctggcgtgaagtcgtagtccacggcggcatacaccgtctgattccagccaccggcatagtcaacgaacgagtccgtcgtgtcgtaatccgccacaaaccggccgcgcagagtgccttcgtcattaagcgggccaccagcatcgacctgggtgccgtagtggtcccaggagccggcttttgcggtgatcgtcacggtcgggtcctgctggccacgcttgcgcaccaggttcatggtgccgcccggactgttagcgccttgcaacaaggcggccgggccgcgcagggtttctacacggtcatagatcgccatgttttcagtgaggtagctgcccaacgcataggtgttacgcgggatgcccacgccatcgtattgcagggtgccgatttcgaaaccacgggagaagatgaacatacccggcccgggggatttggtcgccgtcagacccggggtacgcttgaccacctcggaaagcttggtggtgttctggtcatccatctgtttacgggtcatgacgctgaccgattgcgggatgtccttgagcttctgctcgcccttgcccagggtcaccgcaccggtggtgtaggagccactgccttcggtcgtggcgcccagtcgttcagcgctgatggtagtggcgccgacttcgatagcgccgccggtggctacgcgcttctccagggtcacggtgtcggcgttgataaacgccgcactcaagcccgtaccgccaagcaattgcgccaaggcttcgcgctggccgagatggccactcacaccgggcgacaccaccccttgggtcaactcaccggacaccagcacctgcacgcgcgtcaccgctgaaaatgccgccagcgcgccatcgaggccttgcccgggaatatcgaaacggtaagcctgggcctgggtgacctcggcagcttgcagggatagcgacgcagtgccggtcaagcaaatgaccagcgcgagcaagggcgatgcggcgaaacggtgtgccatggatggagctccccggtgcaaaaagtctgtgatcggcgcggcactacttgagagtgcttactatttacgcctcagtgatcaaggacgaatgctcaccgggaaaccctgaaagtattttcaaaaagttgcgactacgacgccttgccctcgcgaagcaccagcaaatacggggtgtaatgctcggcacgcaggttgagggtgtattccagcgccttgatcaccgcgtcgggtttatcgatttcaaacacgccggagaccacgcgattgcgcaatgcgtcgcccagtatcagggtcttgcccggccaataacggttcagctcgctgaccacgtccgacagcggttgctggcgaaacaccagttgccgctggcgccaggcaaacccgcttgccgcgtcgaagccatggacttcagccaggcgttggtcctggtactccaccgcccttcccggctccagatacaccggtgcgccaatgccggaactgacctgcaccttgccctgcgccacctgcacgagggtttgcgcatcgcgtcgcgccacactgaaccgggtgccgaccaccttcacccagccgtcgccggactgcactacaaacggtcgcgccggatccttggccacctcgaagaaaccttcgcctcgcaacaagcgcacctggcgctcgcctgcactcatacgcacctgtatggcactgtcggtattgagctgcaggcgggagccatcggccagttcgatgctgcgtgactcgccggtgccggtggcatagtccgcacgcatacggtcaagccaaggtgtgttttgcacagtcaggcctaccgccagcagcaaggccgcggcgcaggcccagcgccgtgcgggcttgcgccaggcagcctgttcggcgcggcgaaccacccgcgccggttcatgcaaaccaccgagcatcgcctgcacttcctgccaggcggcatcctgggcatcgccctgctccagccagagggcaaaagcctgcagttcgccaggtgtgacatcctcggcctgcaggcggaaataccaggcggatgcttcgtcgaacagttcgtcggctgtgggggtagcggtcatgaccgacgtccttgttcatcgcaggcaagccgctttttgataaagccacggcattcaatcaaggcgcgacgcaattggtattccacactgcgcgggctgatcgacaggcgttcgccgatctcgcgataggagagttcgtcgacatgatagagcaggaagatctgtcgagtcgcttcaggcaacgccaaaatcgcgtcctgcatcaactgttgctgttgataggcagccaattgctcatcgatacccgggttgctgcacggcaattcttcgctgggctcgccggcatccaggcgttcgcggcgaatggcctggcgctggtgatcgcgcaccaggttgctggcgatggtgaagaggaacgccgggagattgtcgattttatcgccacagtccatgcgagccaggcgcagaaacgactcttgggtcagatcggcagccacttgggcactgccggtgcggcgagtgacgaaggcttcgagggctttcttctgctccgcgaacaggcgcgcgatctgcgaattccaggagagcacggcactaccttgagaagaacatggggttcaggaggtgtgcacgctagcagaggatgagattggttcgcaattgatatctatttttgcatagatactgctgtgtacttgaggctgccttcacgagcaagcccgctcccacatttgaccgtattctcaggttgaaactcggtcgaatgtgggagggggcttgcccccgatggcaggcgacgcggtcctactgaatctcctccggcttgacgatcacccagttcttgtccgccgtcactggcagtccttctttggcttgcgccgccgcgtgcttggcgatcatgccgttaagctgggtcatatatttgtccttgcggttgatccataaatggatgcctcccttggccacgtccacatcgtggaacagcatatagccatcgctggtcggggtatccccgccaacgatcaccggctttttccattcgtcgatgtaggtgaggatcgccgcgtgcttgccggccatccaggttgccggggtccacaggtagggggtcagttccaggccgaggttggcgttctggtcatacttgccggcggcgatctgcttgcgtgcggtggtcagctcgccggtcttgcgatccttgagcagggtgctcacgccgatgacattctcgggcttgacgttgtagccgtacttcggatcggcggcgaccatgcgcaccagctcctcggaagcagcggtcatcacgtacacctcgatgccgttttccatcagtttgttgtatagctcggcctggccagtgaagactttcggcggctgcacttcggactgcttcaccgcgtcgccttcgaagtaactgaccggcaccggcttgccggatgccatcagctcatcgacctggaccttgagctccttgagggtgaagccggaaaacacctgggcaacccacggatagcagaccatgtcgtcgacttcacaaagacgatagtagtaactgaacaggctttccttatgttcggcggtgtccttgaacggcatcagcttgagcgaaggatcgaggctgtcgcgggtgatcaggcctttgttttccatgtacggcagcagcgactcttcaagatcgtagcggtagctggtgttgtccatgtcgaacaccgcgtagttacccttgttggcgttggcggcgatcatttcgttcaactgcttggcagccggcaccggccagtgtttcaactcggtggcggcgaacgcctggctggcgagcccgaggaggaaagcggcggataccagtagtttcggcgcaagcttcataggcgttgtctccctgagtgaaagacatcgacgctaacaaatccgtatgacagttatcgcccgggcgcgaccgcttgcgtcttgatcacgccaaggccatacgcatgcgcgccagcgccttattccaaaaacgacagtcaccattccatatcggtattaaatcattatatttcaagctgttaggcttcccggttcgcaatcgcaggctcacgcgattggctgccctctcaacggagcttcaatgaatctgcccctgattctcaatttattggtgttcgcggcccttttgctgggcctggcacaaacccgtcggactaactggagcctggccaagaaggttctgtttgccctggttcttggcgtgctgttcggtgcggccttgcacacgatctacggcgacggcaacccggtgctcaaagcctccatcggctggtttgacctggtcggcaacggctatgtgcaactgctgcaaatgatcgtgatcccactggtgttcgcctcgatcctcagtgccgtggcgcgtctgcataacgcttcgtccctgggtaagatcagcttcctgaccatcggcacgctgctgttcactaccgccatcgcggcgttgatcggcatcggtctgaccaatctgttcggtctcactgccgaaggtttggtggccggcactcaggaaatggcgcgcctgcaagtgatccagagtgattacgccggcaaggttgccgacctgaatatcccgcaattgctgctgtcattcgtgccggccaacccgttcgccgacctggcccgggccaagccgacatcgatcatcagcgtggtgattttcgccgctttcctgggggttgctgcgctgcagttgctcaaggatgacgtggaaaaaggccagaaggtcatcaatgccatcgacactctgcaagcctgggtgatgcgcctggtgcgcctggtgatgaagctgaccccgtacggtgtattggcgctgatgaccaaggtggtcgccggttccaacctgcaagacatcatcaagctcggcagtttcgtggtggtgtcgtacctggccctggggctgatgttcgtggtgcacggcctgctgctgtcgttggccgggatcaacccgctgcgcttcttccgcaaggtctggccggtgctgacctttgcctttaccagccgctccagcgcagcgagcattccgctgagcatcgaggcacaaacccgtcgcctgggtatcccgcaatccatcgccggtttcgccgcctcgtttggcgcgaccatcggccagaacggttgcgccggtctttacccggcgatgttggcggtgatggtcgcgccgaccgtaggcatcaaccccctggacccgctgtggatcgcgaccctggtagcgattgtgaccttgagttcggcgggcgtcgccggtgtgggcggtggtgcgacctttgccgcgctgatcgtactgccggccatgggcttgccggtgtcactggtggcgctgctgatttccgtagagccgctgatcgacatgggccgcacggcgttgaacgtcaatggttcgatgacggcgggtgctattaccagccagatcatggcgcagacggataaagcgctgttaaatgccgatgagcatgccgaactggcgcaggcataaaggcttataacctgtaggagcgagcttgctcgcgaagaacctgagggcgccgcgttcgttcagaatgcccgcgtcatcgttgacgatcttcgcgagcaagctcgctcctacactagttgcgctcccagacttcgaagttgtaagccggcttatcgccttcagctggattctccagattcgacaccagcttccactggttcgcatcaaactctggaaaccacgcatccccttccgggctcaacgccacccgcgtcagatacaggcgatcggcctgttccagcccctgcgcgtaaagctgcgcgccgccgatcagcatcagctcgtccgcgccctgcgccttggcccattcctcagcccgttctaccgccgcttccagtgacggaaaaacttgcgcaccttcaagcgccagatcggtctgacgactgaccaccaggttcaagcgccccggcagcggtcggcccagggaatcccaggtcttgcgccccatgatgatcggcttgccgagcgtggtggccttgaaatatttgaaatcccccggcaaatgccagggcatgctgttgtcgacgccgatcacgcggttttcaccgagggctgcgatcaggcttaaagggagagtttttttcatggcgacgagaataccagaggcgcgagccagcggttatgctccaacctcactgaaacaacaggatggcgcgtgactgcactgaaccccctgcacacactctggctgacagaaaccgtgcgcctgcgtgaagaacacgctggccccctggaagatttggaagccaaccgcctggctcgcacagccgggggcgacctgtcgacgcggattacccagcgtgccttgcacctggccgaacgcgatggcctgaccggcgccctcacgcgctggctgcaaggcgcacgcctggcgctggtgttgctggcagtggtggccgtgatcagcggcgccggcttggcgtttgccgcactgggtaacggtttgacctcagtaaacgtgttctgggccttgggcagcgtgctcggtttgaacctgatcttgctgatcagctgggccctgggcctgctgtttgccggcgagcacagcgccagcctcgggcgactatggttgtggctcagcgaaaagctcgcccgcgatgccaagagcgcgcaattggcaccggcgttgttgctgttgctgcaacggcaaaaactcaatcgctgggcggtgggtgtgctggtcaacggcctgtggctgctggcattgctcagcgccctggtgattttgttgatcctgttggccacacggcgctacggctttgtatgggaaaccaccattctcggtgccgacacctttgtcgccgtaacccaagccctcggcaccctgcccgcgctgctgggcttcaacgtgccgagcgtcgacatgattcgcgccagcggcgattccgcgctgaatatcgaaagcgcccgccaagcctgggccgcctggctggtgggcgtgttactggtctacggcctgctgccccggctgatcctcgcgctgctctgcctgtggcgctggaaggtcgggcgtgccgcattgcgcctggacctcaacctgcccggctacagccagttgcgcgaacgcctgatgcccagcagcgaacgcctgggggtcaacgatgtggcgcccgagcaactgcaccacgtcagcggtggcgtcagcgatctggacagcgacggcgctttgctggtcgccatcgagctggacgatcaacacccttggccacccaagctcccggccagcgtaaagaacgcaggcattctcgacagccgcgaatcgcgtaacaaactgctggagcaactcagccggttcccgcccgcgcgcctggccatcgcctgcgacccgcgccgctcgcccgaccgaggcagcctggcgttgatcgccgaactggcacgcagcgccaccgctacccgcgtatggctgctgcaagcgccgccgggacaggccctggacgccgagcgcctgggtgattggcactccgcgctgcaacagcttgatcttaagtttgccgattgcgcgccgctgaactggctggagaccggtcatgactaaaccgctgaaactcgccgtggtcggccacaccaacgtcggcaagacctcgctgctgcgcaccctcacccgtgacgtgggcttcggtgaagtctcccatcggcccagcaccacgcggcatgtcgaaggcgcacgcttgtcggtagatggtgaagccttgctggaactgtacgacacgcccggactggaagacgccatcgccctgctcgactacctggagcgcttggatcgcccgggcgaacgcctggacggcccggcccgccttgcgcgcttcctggaaggcagcgaagcccgccagcgtttcgaacaggaagccaaggtgttgcgccaactgctggcctcggacgccggcctgtatgtaatcgacgcccgcgaaccggtgctggccaagtaccgtgacgagctgcaggtgctggccagttgcggcaagccgttgctgccggtgctcaacttcgtcagcagcagcgagcatcgcgagccggactggcgcgaagccctggcccgcctcggcctgcatgcgctgttgcgtttcgacagcgtggcgccgccggaagacggcgagcgccgcctgtatgaaagcctggccctgctgctggaaacctcacggccgcagttgcagcgcctgatcctcgatcaagaagctcagcgccaggcccgccagcaaagcgctgcgcggttgatcgccgagctgctgatcgactgcgccgcctgccgtcgcagcgtggtgaccgaagatgaacagcaagccatcggtgatctgcgcaaagccgtgcgccaacgcgaacagaagtgcgtcgaagccttgctcaaattgttcggcttccgcccccaggatgccgccgccagtgacctgccgctgctcgatggacgctggggcgatgacttgttcaacccggagaccctcaaacaccttggtgtgcgggtcggtggtggaattgccgccggcgctgcggctggcgcgggcgtggacctcttagtcggcggcctgacgcttggcgccgcagccctggccggcgctatcgccgggggcgccctgcaaaccgcacgcagctacggcagtcgcctgctcggcaaaatcaagggccaacgcgagctgaccgtcgacgacagcgtgctgcgcctgctcgccctgcgtcagcgccagttgctcaaggccctcaacctgcgcggccatgcagcggtgcacagcatcaaggtcgacacgccccaggacaaaacctggcgtgagggcaagctgcccgacgccttgggcaaggcccgtgcctacccgcaatggtcgagcctcaacccccacgccaagctgagccaggctgagcgccaggagcagatcctggccctggcgcagcaactcactgcgaattgaccactagtgccagttgaacttgaggaacagttggctcaaggcgtgaatggtttgatggtccaaggtatcgaacagctcgaaagaagcatcctgaccggaaggctccaaactgccattgccgtcctgatcacaggcagtggtgctatacatcagcttgtccctgcccccggtgctgctgcgctggtaaaagtcggatcgaacttccactgcctggccgtttttcgtaacgactcacatacaagtcaattgagcgccccgcagtctcaccggcattgaaccaactcagtttcaaagcttggttggcgaacgcttgtagcagccgacggtcatggagcgacgatgccccgctgaaatcaacatccccggttttctgatagtccaccgcgccatcggcagtggcatcgaacgccaaggcttcatgcaccaactcatcgggcagccccgggtctctctgaaaaaagtacagcttcgccgtgtctgccagttcgttgtcactgcgatcttgcacgatcaccttcaagtaacgcattggtattgcctcagtaaagaaccaggcgccaacatagtttcgcctcaggttcatgcctaggtaacaccggcgccacgaccagtcagaaaccacgacgctcgtgtattcgcgcttcactcttccaggcgaggcttctcataccacttgaaggcgagaaagctattgcacagatgacgaaccagttcctgatcactctggttgaccacgccatttcggtcgacatcgatacgcgaaaaggcctccaccacaccattgccgtcgacatcgtaaccggcagcctgataaatcagcgagggtttgcgcagagggctacgtcgattcaggaagttcagctgcacacgattgggcgggccctgggggtagtcgtataaccccaccattacgagagtgcgctgccaactctcgcccgggttaaaccaattcaacttcagaaaggtattggcaaatgccttgagcaataagctatcgacggtatcgcaggtaccgtcatggttgatatcaccggcgaacttgaagtccacctttctatcggcatcgatatccacggcgacggtctcatggatcaactcgtcgatgccttcggaacagcgttgatagaaatgcagaatgaccgtatcggcctgcccgttgccgctgcgatcctgggcggtaacttttaaatagcgcatggaatgtctcatataaagaacaggcccatacgctagttcaagccacctttacccactagagtctggcgtccgccatagcagtaggaagcagcgacttgacagtgcgtcaatcagtgcgcaggaacatcgataaccttgacgtcaaaggcttcgggcgtgtgccaattgaatttcaagtagagttcagccaattgctggaccaggtgcttgtccacatcattaattacaccatcccgattgatgtcggaatgaatgttccactcaagctcaccgttgttatcaaaatcataggcggcactccatgacacctgcgtatccgggcttaggaaccctggccctttatgcaaatgcaggcgcacggtgtcgggtgtgccgtctttatagaaatcttcggaaaaaatcttcatatagcgctttgtaccagccccgcgattaacccaattgattttcagatagatatcggcaaacctgtccagcagcaccctgtccaagctgttttcctgaccgttatttgtaacgtcgccccggctgtagtccactttcccatctgaggtgaaatcataggcaacgacctcattgaccaagcggttctgatcgcattgcgtacgttggtagaattggagtcgcaccgtatttgcccggccatccccagtctgatcctgtgcaataacctttaaataacgcacttttttactccttgtgtgcataccacttgaactcgagaaagaacttgcataacactctgatcaacgccttatccagctcatccactttgccacttcgattgacatcggtgttggtaaacgagtccatcacggcatccccatcaccgtcataagcgctggctttataaacaagggtttcctgctctcccgagcgctcaataaaattcaattgaatcgcattgggcttgccgttggcactgtagtgtttcacatgcatggttaaacaatgtgaatgaccagcgcaaaaatcaaaccaaccgagcaacatgaatacattcacgaacgaattgaaaatacgttgatcaaggaagtcttccttgccatctccgttaatatccccactgagatgcaaatcataaagaccatgttcatattccccctcgcgatccaagttgaaggcaatctcttcgtgcatcaactgatcagcaccgcaattatccctctgataaaacctggcaacaattttatctgtgtggtcgcgccctccacgcccctgagcaaaaactttcaaataacgcatcaattaaatcctatgatgaatgattgattacgctatcagtctcttcaaacttcaaactagtcgacatggcagctttggccgcgagaggcaacttcaggctacgtaggaagaacccgccaacagcacgatagtcggccatgccatgttgctcgtacagccaaacacctaggcaatcgccggctccggtttcatcgcgcctctccccacaccgtgctgatatttcgctcagccagcgccgggcccacactcatgcccacgccggtgtgcatcaatgcggcgctgacaccgggtgccgcctgcacaaacgaaaacggccccggcccgcgagcaccgtagacaccttgccagcgctcgaccacctggatcttgcccccaagggtctgctcggccagctcgatcatccagtcgtccacctgttcggcgttgaagggtgacggatcgctgtcgtagtggtgggagtcaccgatgatcaattcgccatggggtgtggggctaatcagcaagtggataccgtgctcatgcaggtgcggcgtttcgcgcaggatctgcgcctgcaccgcgcaggcttccggcaggtcggcgaaggcgccgtagtgcacgcagctcaggccggtgagcagggcgtgttgcagctccaggttaaacatcggtcgggcgcgcagcatttgcaggcgacaggtttgcgggttgagctgggcgatgggttcggccaacagggtctgatagtcatggccggagcagacaatgatctgctcgccgcgaaagctgcctgcggtgctgtgcaaccggccgggctcaacgtcgcgcaccagggtggagaaatgaaactccacgtttagcgcctggctgaggtactggaccagcgccgggatcgcttcacgggaatacagttgctggtcgtccttgccgtgcagcgcagcgcgatgatggcggaactggccggagtagagacccttcatcgcagcgccttgcagcagctccacgttatagccgtgctcccgggcacgcccggcgcaaaaggcttcgagcaactgttcttcggcctcggtgcgggcgaacaggtaggagccattgcgcttgagtgcaaggcccgctgtttgtgcccattggccccagatttcgcggctttcccgcgccaggtcgagcatcggccccggtggctggccggtgaccagcgcttggccgaagttgcgtaccgaggcgcccagaggcgtggcgctgcgctcgaacaccttgaccttgaggccgcgtttggcggcggcataggcgtgtgagaggccaaggatgccggcgccgacaatcagtaaatctgccatggaatatgcagccctctgtaggagcgagcttgctcgcgaaaatcgccaacgatgacgcaatgcgtctgatgacccgcgtcgtctgtccgtttttcgcgagcaagctcgctcctacaggttgaagtaaaagttattgtttttccgacttgccgtcatagcgcttgcgccattcggccaaaatgctgtcacggttcttcgacgcccaggcaaaatcgttcttgatcaggcgctgctcgtaatcggccggcaactcggtctgcggcttggcgatacctggttgggcaaggatggcgaagttggccttgtatagctccatcgccgctgggctggcggagaagtcagcgagttttttcgcggcgtcgccgtgggcgctgcctttgatcacagcggtagcttcaatctcccagcccaggccctctttcggcaggatgatgtccaacggggcaccctggcgtttgagttgaatcgccgggtactcgaaggaaatcccaatcgggaactcaccggacgccgccagcttgcatggcttggagccggagtgaacgtactggccgatgttctggtgcaggtcgtccatgtattgccagccttgcttctcgccgaaggtctgcaaccaggcgctgacgtccaggaagccggtgccggaggacgccgggttaggcatcacgattttgcccttgtactcaggcttggtcaggtcctgccagctcaccggcttggccaggccctgcttttgggcttcgatggtgttgaagcagatggtcgcggcccacacatccatgccgacccaggatggcgggttggcagcgtcgcggtagtttttgccgattttgtccagatctttgggcgcgtagttgtcgagcatgccttgctggtcgaggatcgccaggctggaggcagccaggccccataccacgtcagcctgcgggcggtctttctcggccagaagcttagcggtgatgatgccggtggagtcgcgtacccacttgatctcgatatcggggttggcctgctcgaaggcttttttgtaggtcttcaattgctcggcttcgagggccgtgtacacggtcagctcggtcttggccaaagcattcaggctgaatgccgtgaggaccgcagcgaccagcgccaggggcttgaacatgtagcacctccttcagtttgttattggccaggcgcggtctggcgccaggcttgagagcgacgcagcgcgccacgtgaggcccacgccagcagcagcgagacgccggccgaagtgaacaggatcaaggtcgacatggccgcggcgccgcccacattgccggcgtcgtccatgttcaacacggcgacggcggcgaggatggtgtcggggctgtagaggaaaatggcggcggacacggtggtcatcgccgacacaaacaggtagcgcaggatatccagcagcgccggcaggcaaatcggcaccgtgacacgcaggtagtgacgatacagcggcgccttgagtgacaacgccgcggcttcgaactcggcgtccaactggcgcagggcggtggtggcggtcatctgcgcagtggtcaggtaatgcgcaatagtgcacaccaccagcaatgccatgctgccgtagaacacatgcagcgggttgccgttgaggttgaaaaagaacacgtagcccaggcccagcaccagacctggtacggccatcggcacgaagctgagcatgcgcagcgccaggttcaggcccttctggcccttggtcttttccatcaggtaggcgccagtgaagatcagtacgctgccgatcaacgccgtgcacagcgccatggtcaggctgttgcgataggccagccagccgccgccggcggtgtcttcgaactggtagtggttgagcgatagcgacaggttgtacggccagaacttcaccagcgacgaatacaccgccatgccgaacaccagcagcaacaccgcgcaaatcagcaatacgatggccaggtagcaaccgtcgcgcagccgcgatggcgcgggcagaaacacctgggcgcgaccgctcatcgagtcgccatgccgacggcgcaaccaggcatccacgccgaagctgaacagtgccggcagcagcaacaccatgccgatcaacgcgccgcgcccgaactgttgctgaccgaccaccgccttgtaggcttccagcgccagcacctggtaatcaccgcccaccaccaccggcacaccgaagtcggtgatggtcagggtaaacaccaggcagaacgcggcgaacaccgcctggcgcgtggctggccaggtaatgctgcggaacgcccgcgccgggctcgcgcccatgctcgaagcggcgtcgaacaaacgcgcgtctgccagggacaaggccgacagcaggatcatcaatgcatggggaaaggtgtagatcacttcgccgagcacaatgccccagaagccgtagatattctccgagagcaagccacgcaacaggccctggttgccgaacaggtagaccagcgcaatacccggcagcatcgatggcgccatcaacggcagcaacgacaagccacgccagacagatttgcagggaatcaacgtgcgttgcagggcgtaggcaaacagataggccagcggtacgacgatggctgccacgctgagggacactttcaggctattgcccagcaaccagtggaagttggcgctggtcagcagttcgcccgcggccaccagaccaccgccctgcccggattcgctgctgaagccgcgccagaagatagccaatagtggcagcaacaccgccaccaccaaaaggcccagccagagccatttgccgccgaccacgaagatacggtcgccccactcggcgcgggacacctgacgcgctaccggcagtgtcatgacagcagccatctcaggcaaacacctgcaggctgcgcggcggcaaggccacccagatatcctgggcgcccaggcgcggcatggcttcgggcgccagctcggccagcaacggatggcccggcaactgctccagttcaaagctcatgcggcagcggttgccgaggaaagtgatctcgcggaccttggccgggaacaggttttcctcatgcaccggcgggttgacgctaatggcttccgggcggcagaacagacggccggacttggccacgccggcatcgtcggccaggcgcatcttcatgccgccaacctgggcatggctggcgctgttgcggctgaacggcagccaattgccctgccccacaaactcggccacgaacggcgtggccggacggtcgtagatttcctgcggcgtggcgtactgctcgaccttgccgttgttcatcacggcaatgcggtcggccatcaacatggcttcatcctggttgtgggtcaccatcaaggtggtgatgcccaggcgccgttgcagttggcgcagctcagtgcacagatgctcgcgcacacgggcatcgagggctgacatcggttcatccagcagcaatagcgacggggccggcgccagtgcacgggccagggccacccgctgttgttggccgccggagagttgaccggggtatttcttttcgctgccgagcaggccgaccagctcgagcatctgcccgacgcgcttgcgtacttcatcacggccgctgccggtgaggccatagccgatgttcgcttccacgctgagattggggaacagcgcataggactgaaacaggatgccgtagtcccgcgcctggggtggcagcagggaaacgtcacgctcgcccaggtaaagctcgccgctgtcctggcgttccaggccggcgatgcagcgcagcagcgtggtcttgccacagccggaggggccgagcaggcacaccagctcgccggcggcgacgtccagggacacgttgtccaacgcggtgaaggcgccaaagcgtttctggatcccgcgcaccttcatgggcgtgccgggttgggtcagggctgtgttcattaggggcacctcatcaactgatgaaggccatgctaggtgggcaatgcgtagctggtgtggcagaaaggcaaaaggaggtgatagtggtattggtggatttgtgtaggactcatggagatgagttgcctgtcctaccgctatcgggagcaagccccctcccacagttgaccgggttccaacatgagaatgcggtcaaaatgtgggagggggcttgctcccgattggccctcaagccagccacagaacttaaattggcgacatttcctgagccaggccaaggaatgccgcaggcaaccgcgcacctttgcgctccttgaggcaatacagatactccggaatctgcggcgcattctcgatggtcagcacccgcaactgcgggtcatggggcacttcctggcgggcaatgatgctgatgccgatattgcgcagcaccgcctcacggatcgactcacggctgccaatctccagcaaaggcccataacccacgccggagccctgcaacatctcttcggtcagccgacgggtggtggagcctgcctcgcgcatcagcagcgtatgcccagccagcgcgctcaacggcacatgatcgagcttggccagcgggtgattgcgatgcaccgccagcaccagcgggtcagtgcccagcacgcggcggatcaggcgcgggtcttccagcaattgcgaagacgcggcgacatcgacgcggtaatcatccaacgcttcaagcacttgctgggagttgccgatttctaccgacacgtccacttggggcaggcgctcgcggaaggctttgaccagatcgaggatgtaatacggcgccgtcgcggcaatccgcagcgcgccctggacctggccgttgttgcgcaggaaaaactcgatatccgcttcctgctgcaacagcgtcttgaccattggcagcagccgcgcaccttcgtcactgacggtgaggcgacggcccccgcgatagaacagctcaacgccatactggctttccaggttgcgaatctgggtagttaccgtgggctggctcaggccgagttttttcgccgcctgggtgatgctgcccaggcgggcgaccatgaaaaacgcctttaactcagcactcagcacaccaccctctcatcctctatttgcgcaacaggcgcaggccgttgaataccaccagcaggcttacgcccatatcggcgaagaccgccatccacatggtcgccatgcccatgaatgtgaccgccaggaagatcgccttgataaccagcgcaagggcgatgttctgcttgaggatactcgacgtttgccgcgacaatcgaatgaaagccggaatcttgcgcaaatcgtcgtccatcagcgctacgtcagcggtctcgatggctgtgtcagtgcctgccgcggccatggcaaagccgatctcggcgcgcgccagggccggggcgtcgttgataccatcgccgaccatgcccacccgatggccttgaccgtaaagggtttcgatagcttgcagcttgtcggtgggcagcaagtcgccctgggcctggtcgatgccgacctgactggcaatcgcctgagcggtgtgagtgttgtccccggtgagcatcagggtcttgatgcccaggtcgtgcaattgctcaatagcttcgcggctgctgtccttgacggtgtcggccacggcaaacagcgccagcgggccggatttgtccagcagcagcaccacggacttgccttgtttttccagggcgaagagcttttcttccagcgccggggagcacaggccgaggtcttccaccagacggtggttacccaggtgataggtctggccgttgatatctccgcgcacgccgcgcccgggcagggcttcgaagttatccacaacatgaatcgtcaggtttttatccaccgccgcattggcaatcgccagtgacaccgggtggtcggagcgcccggccaagcttgcggccagggccggggcgctgtcttcgagattggggaacagcggcaggtaatcggtttgcaccggtttgccgtgggtgatggtgccggtcttgtcgagggccaggtagtcgagcttgtaacccccctccaggtacacaccgcccttgatcaggatgcctttacgcgccgctgcggccaggccactgacgatggtcaccggggtggaaatcaccaaggcgcaggggcaagccaccaccagcagcaccagggcgcgataaatccagtcgaaccacacgccagccatgaacaacggcggaatcaccgccacgcccagggcaaacaggaagactgccggggtgtagaccttcgagaaactatcaacaaaccgctgggttggcgcccgtgcgccttgggcctgctccacggcgtggatgatccgcgccagggtcgagttgttggccgccgcagtgactttgtattccagggacccggcctggttgatggtgccggcgaagactttatcgccgatggtcttttcaatcggcaggctttccccggtgatcggtgcctgatcgatggtggattgaccggcagtgacctcaccgtccaagccgatacgctcgccgggctttacccgaacgatcgcaccaagctcaatacttttaacctcttgttccatccacgagccgtcggcctgttttaccgtggcctgttccggcgtcatctgcatcaggccgctgatggcattgcgcgcccggtccagggacttggcctcgatcaactcggccacggtgaacaggaacatcaccatcgccgcttccggccactggccaatcaaaatggcgccggtcaccgcgatgctcatcagcgcgttgatgttcaggttgaggtttttcagggcaatccagccctttttgtaggtggtgaggccgccgctgaggatcgacaccagcgctaccagcgcgatcacccaggtcggtgccacgccggtaaaatgcagcacttccgcgcccagggcacccacgccagataccgccaatggccaccaatgtttcttggcgggcggtgcggcggcagggctgccttcttcgatagggtcggcctgcatgccgatggacttgatcgcatcaatgatcggcgctgtgctcggcaggtcatgggtgacgccgaggatgcggttgatcaggttgaattccagctgctgcacaccggcgagcttgcccagtttgttctggatcagcgtctgctcggtggggcagtccatggcttcgatgcggaaggtgctcagccgcgagccggcggtgggcgcttcgctcagggtcaccacggcaggcccggcagcgccggaacagcatgagcccgcgtggccgtggttatccacaggcgtcagctttgcggggccatgatcatggttgtgatcgtggtcgtgcttatggtcatgagcatggtcgtgatcgtgatcgtgcttgtgcggggtgtgaatggagtggctcatcaggttgcgtccgtaaaggtgcctgttgccaagtaaagaccctgtagccactatagggtcaagcacccatgtggagattgctgcgatgaagatcggcgaactggccaaacttaccgactgcccggtggaaaccatccgttattacgagaaggaaaacctgctgccaccgcctgcgcgcaccgatggcaactaccgggtctatacccaggcacacaccgagcggctgacctttatccgcaattgccgcagcctcgacatgaccctcgaggaaatccgcagcctgctggggctgcgcgacagcccccaggaccagtgcgaaagcgtgaatgcgctgatcgacgagcatatccaccacgtgaaagcgcggatcgatgggttgctggccttgcaggagcaattgctggacctgcgccaacgttgcggcggtggggaacagtgcgggattttgcagcgattggaagtcagcggagggattgcggccagcgaggccgagccttcgcacgtgggcagaagccacggccattgaacctaagtgaacacgattaaaatgtgggagggggcttgctcccgatagcagtggatcagtcataacctctgtaactgatacaccgccatcgggagcaagccccctcccacagttctgaccgaggcaggctttaaatagccacgtctgccttgatgcttgggtccgcgtcatagcccacgatctcgaagtcttcgaacttgtagtcgtagatcgaggcaggtttacgcttgatcaccagttccggcagttttttcggtgtgcgcgccaactgggtgcggatctgttccatgtggttgctgtaggcgtgggtgtcgccggtggtgacgatgatctcgtgggggatcaggtcgcactgctgggccagcatgtgggtcagcaacgccagcgcggcggtgttgtacggcaggcccaggaacacgtcggagctgcggatatacagctgcatcgacagatgaccgtcatgcacgaacgcctggtacagcaggtggcacggcggcagggcttgcttgccgttgcgcgcgttttcctgggggctcttggtttcgtccggcaggtattcgacgttccagccgtggaacaggatgcggcggctgttggggttggtcttgagcgtgtgcaccatgtagtcgatctggttgatcgtgccgccatccttggtcggccaggcggtccactgctcgccatacaccgggcccaaatcaccgtcttcggtggcccactcgtcccagattttcacaccgttttcgttgagccacttgatgttggtgttgccgctcaacatccagatcagttcattggcgatgcttttgaagtgcagcttcttggtggtcagcagcgggaagccgtcggccaggttatgccgatactgacgggcaaacacggccctggtgccggtgccggtgcggtcgcccttggtcaggccattggtcacgacgtcgtgcagcagttcgagatattgcttcatgtggttacccgtagcgttgaagccgcggcccttcaagcaagggccacggcattcggatttaaagcgcggcgttcttcagcggctgcgggcgattgtacgcccaccagagcatgcccaggcccgcgaggatcatcggcaggctgagaacctggcccatggtcagccagccccacgccaggtagcccagctgcgcgtccggcacccttacaaattcgacgataaagcggaagatcccatagaacagcgcgaacatgcccgacacagccatggtcgggcgtggcttgcgcgagaaaatgtaaaggataaggaacagtgcaacaccttccagcgcgaactggtagagctgcgacgggtggcgcggcagttgcgccgggtcgctgaacggcgggaacaccatggcccacggtacatcggtcggcttgccccacaactcggcgttgatgaagttaccgatgcgcccggcacccaggccgatcggcacgaatggcgcgacgaagtccatcagttggaagaacgacttgccgttgcgcctgccgaaccaccaggcggcgatcatcacgccgataaacccgccgtggaaggccatgccacctttccacacttcgaagatcagcgtcggattggcgatataggccgacaagtcgtagaacagcacataccccaggcgtccgccgacgatcacccccatcgacatccagaacaccatgtcggagagcttctccttggtccaggtcgggtcgaaccggttcaggcgccgggaagccagcagccaggcaccgccgatgccgatcaggtacatcaacccgtaccagtggattttcagcggaccgatggccagggccaccgggtcgatctgcgggtaaggcagcattgcgactcctcgttaaaacatttagtcatgacgcaccggaccatgccgaggtgcgattaagcctgcgttacagcgccgatatcaaattaagaagttcacatacacaccaaacagcccggcatgttaacggatggaaggcgcgcggcccaacttcgttgcgatggaacgcctgcgcgtctgtgggtagagtggcaaaaacacaaaaggggtcgcccgatgtgcctgattgttttcgcctggcggccgggccatgcccgaccgctgatcgttgcggccaaccgcgatgagttctacgcccgccccagcctgccgctggcccagtggtcggatgcgccacaggtctatgccggccgagatcaggaggccggcggtacctggctgggcgtcagcgccggagggcgttttgccgccctgaccaatatccgcgacccgcaccaaccaccagcacgcaagtcccggggggaactggttgcgcggtttctcagtggttcgctgccgattgaagactatttagccgacgttaacggacgctcgattgaatatgccgggtttaacctactggtgggcacgcgggatgagctgtggcattacaacgccaatgataccgagccgacgcggttgaaggctggggtgtacgggttatccaatgctgggctggatacaccatggccgaagctggtgaaagccaaggcagcgttcagtgcggtgctggagaaccccgagcctgaggtactgctggggattctgagcgacccgcagactgccccgtttgctgaactgccggacaccggcgtaggcctggcgaccgaaagcctgttgtcgagtgtgtttatcgccagccccagttacgggacacgggcgagcacggcgctgattgtgaatgccgatgggacgcgcaggatgctggagcgtagttttggaccccacggcgggcgactaggtgaggtcgaactcaatttttaaccacaccccaaaaccaatgtgggagggggcttgctcccgatagcggtgggtcagtaccagatattctggctgacaccctgcaatcgggagcaagccccctcccacattttgttcagtgccagcctttagagggttttcgccgaagccgggttgatcatccgggtcagccccagattcttcagcgccaactgcagcgagctgtggataacttgcgggttgtcgatggtcatcagctcggccagcaaatccttggccatgcccaattcaacctggcgcagcatccacttcaccttcggcaggttggtggcgttcatcgacaggctgtcaaagcccattgccatcaacagcaccgccgccgccgggtcgccggccatctcgccgcagatgctcaccggcttgccctcggcatgggcgtcgcgcaccacgtgttgcagggcttgcagcaccgccgggtgcaggtagtcgtagaggtcggccacccgtgggttgttacggtctacggccagcaggtactgggtcaggtcgttggaccccaccgagaggaagtccacctgccgcgccagttccttggcctggtacaccgccgcggggatctcgatcatcacgccaatcggcggcatcggcacgtcggcaccttcatcgcgcacttcgccccaggcccggtggatcaggtgcagggcttcttccagctcatgggtgccggagatcatcggcagcaggatgcgcaggttgttcaacccctcgctggccttgagcatggcgcgggtctggacgaggaagatttcaggatggtcgagggtaacgcgaatgccacgccagccaaggaaggggttgtcttccttgatcgggaaatacgacagtgacttgtcgccgccaatgtccaggctgcgcatcgtcaccggtagcgggtggaaggcctgaagttgctcgcgataaatcgccagctgctccttctcactcgggaaacgctggttgatcatgaacggcacttcggtgcggtacagccccaccccttcggcgccacgttgctgggcgcgtgctacatcggccagcaggccggtgttgaccagcagcggtacccggtggccgtcgagggtgacgcacggcagctcgcgcaacgagtcgaggccctgtgccagttgcttctcttcttccaccacttcggcgtattgcttgcgcagcacgtcgctggggttggtaaacacctcaccgcgatgcccgtcgacgatcatgtcgatgccgtcgaccttggaatacggcaggtccaccaggcccatcaccgtcgggatgcccatggcccgggccaggatcgcgacgtgggagttacccgagcccagtaccgagaccaggcccaccagcttgccctcaggcacttcaccgagctgggtggccgtcaattcttcactgaccaggatggtgttgtcggggaagaccatgttggtgctgcggtcttcctgcaggtacgccagcaggcggcggccgaggtcgcgcacatcagaggcccgctcgcgcaggtaggcgtcgtccatcatttcgaagcggttgacgtgatcggtgaccacctggcgcaacgcgccctgggcccactggccggtcttgatcacggtcttgacttcgttacccagggacgcgtcgtcgagcatcatctggtacacgtcgaacagcgcacgctcttcggggcgcagctgggtggccagcttgttcgacaggttgcgcatgtcggcgcgcacgccttcgagggcggtcttgaacagtttgatttcagcgtcgatgtcatcgacgctcttgtccggcaccacgtccaggtcggccggcggcagcatgaccaccgccttgcccaccgcagccccaggcgagcccggtacgccgacgaacttggcttcctggatgcccttgccctggcgccccaggccgcgaatcgaaccggtggcctcggcgtgagcgataaccccggcgagttgcgcgctcatggtcacgaggaaggcttcttcaccttcgtcgaactggcggcgttctttttgctgaatgaccaacaccccgactacgcggcggtggtggatgatcggcgcgccgaggaacgaggcgtagcgctcttcgccggtttcggcaaagtagcgataacgcgggtggtcggccgcatgttcgaggttcaggggttcttcacgcgtccccaccaggcccaccagaccttcattgggcgccatgctgaccttgccgatggagcgcttgttcaagccctccgtggccatcagcacaaaacggttggtctctgggtccagcaggtaaaccgagcagacctggctgcccatggcttccttgacgcgcaacacaataatccccaacgccgccttgagatccttggcggagttaacttcctggacgatcttgcgcagcgtattgagcatggctcggggtcgaactccgtcgtcagtcgcgcgctaaaaggcgcggggcaagctctttgagagcgcgacgataaacctcgcgcttgaatgtcaccacctggcccaacgggtaccaataactgacccagcgccagccatcgaactccggtttaccggtcaaatccatccgcacccgctgctcattggagatcaggcgcagaagaaaccatttctgcttctggccgatgcacagcggttggctgtgggtacgcaccaggcgttgcggcaaacgataacgcaaccagccacgggtacaggccagaatctgcacatcttcacgctcaaggccgacttcttcgttcaactcacggtacaaggcgtcttcaggggtttcgtcggggttgattccaccttgaggaaactgccaggcatcttggttgattcggcgagcccatagcacctgtccggcatcattcgtaagaataatcccgacattaggacggaaaccatcggggtcgatcacggcaacaacctcgcaaacgcatgtcgccgcattgttccacaaaggttgttccagcggcaacgaggcttcttaccttatgtgcactcttgtgaaaagaccgtattctggacgcctttttacagacttttcagcgagtaattgcaatgcgcctggctttattcgacttggacaacacgctcctgggtggtgacagcgatcacgcctggggtgattacctgtgtgagcgcgggtttctcgaccccatcgcctacaaggcccgcaacgatgcgttctaccaggattacctggccggcacgctggataatgccgcctacctgaacttttgcctggaaatcctcggccgcaccgaaatggcccagttggacgagtggcataacgactatatgcgcgactgcatcgagccgatcatgctgcccaaggcggtggaactgctggccaaacaccgcgccgcgggcgacaagctggtaatcatcaccgccaccaaccgtttcgtcactgcgccaattgccgcacggctgggcgtcgagaccctgatcgccacagaatgcgaaatgctggacggccgctataccgggcgcagcaccgatgtgccgtgctttcgcgaaggcaaggtgacgcgcctgaaccgttggctggaggagaccgggtatagcctggaagacagctatttctatagcgactcgatgaatgacttaccgttgctggagcaggtgacgcatccggtggcggtggatccggatccgaatctgcgcgctgaagcccagaagcgcggttggccggtgattacgctgcgtagctgatggccctatcgggggcaagccccctcccacacttgaccgagttcgaacatgagaatgtggtcgaaaatgtgggagggggattgcccccgatgcagtcgacgcgatctgaagccctaaaccggcttggcgcccatgagcccggcaatcgccacaaaccccaccagactgaccaccgccagcaccagggtgaaattcaggctaccgccctcgcctttgcgcaggcgattaagccgcgccaccagccagaaccaggccagcgccgccacggtgtagaggatgctggaacccaggatccaggtttgccccaatggccagccgagcaggtgtaccagccaccagccggtgaacggcatgctgaccaggcaaatgcccatcagcaaccagacaaacgcccacgggcgttgcacagttacagcagggcctgcgctgcgcttacgccaggccagtacggccagaccgaggccactgagcagcagcaacacggtggcggtgatgtggataaccttgagggtggtcagcgtttccatggtctcgattcctttaaaggccgctcagtcagcgtagtcgctcaaccgaggaacaactggtaggccgggttttcgctctcatcccagtacgggtaaccgatttcagccagggccgtcggcaccaggtgacgctcatccgccggcacttgcagcccggcaaccacacggccgtcggccgcgccgtggttgcggtaatggaacatcgagatgttccagcgcccgcccaacttgttgagaaagttgaacaatgcccccggccgctccggaaattcgaagcgaaacaccaactcgtcgctgactttggccgcgtgcccgccgaccatatggcgaatgtgcagcttggccagttcgttctcggtcaggtccagcaccgggaagccctggctggtcaggctggcgatcagcgcactgcgtggatcgttttccgggtgggtctgcacgccgacgaagatgtgcgcctcgctgccggtgtggtaacggtagttgaattcggtgatctggcgcttgcccacagcctcgcagaacgccttgaaactgcccggttgctcggggatggtcacggcgataatcgcttcgcggccttcacccagttcggcgcgctcggccacgtggcgcaggcggtcgaagttgacgttggcgccagaatcgatggcaacaaaggtctggccgctgacgcctcgggtctcgacgtactttttgattccggccacgcccaacgcgcctgccggctcagtgatagagcgagtgtcgtcgtagatatccttgatcgccgcgcagatttcatcggtgctgacagtgatcacttcatcgacatagtccttgcagatgtcgaaggtgtgctggccgatctgcgccaccgccacgccatcggcgaagatcccgacggtgggcaacaccacgcgctcgcccgcggccatggcggcttgcaggcagttggagtcgtccggctcgacgccaatgatcttgatctccgggcgcaggtatttcacgtacgcggcgatgccggcgatcagcccgccgccgcccaccggtacgaaaatcgcgtccaggggccccgggtgctggcgcaggatttccatcgccacggtgccctgcccggcaatagtgtgcggatcatcgtaggggtgaatgtagacgtagcccttttcatcgaccagcttgagcgagtaggccagcgcttccgggaaggaatcgccgtgcaacactactttaccgccacgggagcgcacgccttcgaccttgatctccggggtagtcttgggcatcacgatggtggccttgacccccagcaccttggccgccagggccaggccctgggcatggttgcccgccgaagccgtgaccacgccgcgggcacgttcctcgctgctcaactgggtcagcttgttataagcgccgcgaatcttgaacgagaacaccggctgcaagtcttcgcgcttgagccaaatcttgttgcccagccgctcggagagctggcgggcagtctgcaagggggtttccacggcaacgtcataaacgcgcgaggtgaggatctttttgacgtagtgttcaagcatcggcaggcatctacttcacgggttgggcagggccagggagtctaacccggcttttggccgggcgaccacacgaatcccgaggttttgttgggttatactcgccgccctcgataattccccgcccgttccggagcccgcatgacccaggatcaactcaaacaggcagtggcccaggccgctgtcgatttaatccttcctaagctcgacgacaagagcatcgtcggtgtcggcaccggttccaccgccaactgctttatcgacgcactggcccaacacaagggcgcgttcgacggcgcagtcgccagctccgaagccaccgctgcacgtcttaaaggccatggcattccggtgtacgagctcaacaccgtgagcgacctggagttctacgtcgacggcgccgatgaaagcgacgaacacctgaacctgatcaagggcggcggcgcagccctgacccgcgaaaagatcgtcgcagccgtagccaagaccttcatctgcatcgccgatgccagcaagctggtgccggtgctcggcgccttcccgttgccggtggaagtcatccccatggcccgcagccacgtggcccgcgagctagtgaagttgggcggcgacccggtgtaccgcgaaggtgtgttgaccgacaacggcaacatcatcatcgatgtgttcaatatgcagatcaccaaccccgttgagctggagacgcagatcaacgccatcgtgggcgtggtcaccaacggcctgttcgcagcgcgcccggccgatgtgttgctgctgggcaccccggaaggcgtgaaaaccctcaaggcttaacaactgcgggagggggcttgctcccgatggctgtgtgtcaggcaactaatctgtagctgacactccgctatcgggagcaagccccctcccacatttgagagccctcgctgtaacaaaaacgctacctttcgcagcactcccctccaaaaccgtgcgctcggtcacggcatgccaagtcccgcctggtatccaatccgttacaaattacagccacgcgacccacgcgtttaacaatgcgccaatttgcagccgcccacggaatgaggcgcgcattgtgcaaagggtctgggctttgaacattcccatcacctcaaggaagaccttgtgataaagcccctagccctcgccatcagcgttgccggtgccctgctgtccgcgcaagcccaagcctacgattacggccagcacgccaacaccaccctggaaaaactgatcaatgactaccccggtcgttatcgcggtacggccaattttgccggcgctgcggattggatgcagagccagatgggcacggcctattccatcagccgccaggacttcacttggaacaacagcagccgcgcttcgcaaaacgtagtggcctacgccgccggcaccaagccgcagtacgtggtgattggcgcgcatttcgacacctattttggtcgcccagccctgcaaggccttgacgacaatggctccggtgccagcgtgctgaccgaggtagccaagaacctcggcggcctgcaactggaaaatggcctgcaaatagtcggcttcggcgccgaagaagagggcttacgcggctcccgcgcctttgtcgactcgctcagcgccagccagcgcgccaatatgctcgcgatgatcaacctcgacagcttgatcaccggcgacatgatgtacgcccacgccggccagaacagcaccgccaacccggccttggcgtctttgcgcgagcacacgttccagatcgccaaggagttgaacatcccgctgttcaccaaccccggcctggatccgcaatacccccagggtaccggctgttgcagcgatggcgaggcctttgaaccgctgaacatcccgatcctttatgtcgaggccaccaactgggaactgggtgacctggacggctacacccagaccgataacccgaaaatccccggtggctcgacctggcacgacccgaacgaagacaacaaggccgtgctcaccgatgccttcggtcaggcgcgcatcgagcagcgcctgcgcgactattcacgcctgctcagccgcctggtgctggagttgaccaacgccgacctgatggcctcaacggcgtccggtggcgcggtcgcacgcaatatgcaagacaacctgcagcgccagcatcaggccatggtgcgcttgcatgatcgccgctggctgaccctgcaggctgccagccgggaggtgggcagctttgatggcgaaatcggcgtggatggcgaatacaacccggacagtggcttcgacagcgcccccaaccccgaagcccggcgcctgggcttgcatgccctcggcgactaccaactgacctcgagcctgaatatcggcgccagtctgagctacctcaatggccgcgacaaactcgagcatcgcggcaaactggacagtgacacctggcaggcagccgtctatgcgctgctcaacgatggcggaccaagctggctggccggtgacctgagcgtcggccgcacgcgcttcgaatccaagcgcaacctggtgatccaggccagtggcgggccgatcctgctcgatcagcaactgagcggcgagaccgacgctctggcattgggcgcacgggtccttggcggctatgactttgatttcggtgccttaaagagcgggccgttcgccggcctggactacagccattaccgcatcgacaaattccacgaaaaacagaacctgcgcacggccctggaatacgaagaacagtctttcgactccctggaagccagcctcggctggcgcgtgcgtggcgcggtcgccctgccctacggcctgagcctgctaccttatggcgacatcgcctgggtcaaggagttggccgacggtcgcctcgacgacctgcaactgagcgctcgcgccgatggccaggcgcgcaccgccaggctcggttcagtggacaagagcttcggccgggcgcagatcggcagccaattggcgatcaccccggaattgggcgtgtatgccgaggtcaatagccgactggggcatgccgaaggcagccagaccggctattcactgggcgtgcaatggatgttctgatcagggtttcttgaacacgtagaacaagttcggctcgctgaccatgtacaaggtgccatcgtcgtccatggcgatcccttcggcctggggcacgcgcttgctcaggccatggcgccctttaagcagcgacagactgcttaacgggcgaccgtcgatatccagctccaacaccaggaacgactcatccgacagcgccagcagatgcccgctgcgctcgtcgtattgcaggctcgacaggtcgcgtacaaacaacccggcatcgcgcttggggttgttgatcacgtgcaccgagtaggttttttccggcttgaaatggggaaatccgtggacctcgtagatcagcatcgggtcacgctccttggccacgaacaggcgcttgcctaccgagtcgtaggccaatccttcaaaacccttgttgccgccaatatgcacgccgagggtcatttgctcggcgtcggcggcatcgagaaattgcgtgtcatcgtccacgtgcaccttgatcagccgctgctggcgctcatcgctgatgacatagatgttgtcgctgataaattccaccgcctcggcatcgccaaagcccaccaggggaatgcgccgcaggatcttgccgtccagggacagctccaccagctcggcgtttttattagtgacggtaaacaggcttttgcgcaccgggtcgtaggtgagggccgagacgtcgtcgtcgagcccttcgatcacctggccttcgacgatgacgcgatagtccgccaggccaatcgcgcgctcatcggcgggctggcgccacacctgccaattgaaccaggcacgctcgaacaggcggaactgctgcgcaaccaccccggcggcaaccagggcaagcaacagcaggatgaagaaagcaggtttgggacgggcaagtcgacgcattggggcgggctcagagaaaaaactggcgaatagatatcaaggtcgcctgaatttaaacttaaacgcaccggactgtctggcgaatgccgtttataaagaaaagtctgacgttattcgtcagttatttctgcttttcaaaacgatagaacaggtttggctcactgaccatgtacaggttgccgctctcgtccatggtcaccccttcggcgcgtgggatggtgtctttcaggccattgaagccaccgagcaaggtcatgaagctgacttgctcgcctttctcgtccagttccagcaacaaatgggagtcggctgacagtgccaataagtgcccggtacgggaatcgatttccagcgccgagaggttgcgcatgtccagttcgctactggccagcttggccttgctgccagccaggcgctggctgccatcgcttttccaggtgaacagcgccggcgggcgctcttcgcccagtatgagttgctggttgcgcttgtcccaggtaatggcctcaaaggccttgttctggtctgcggatgggccaaggtcataactggggaagtcagccttgttcaacgcggtggtagcggcgtcgaccctgacaatggtcaggctgtgctgacgctcatcgaccaccgccatcaggccgttttccagcaccgtcaagccttccggattgttccagccattgagcggcatcttgcgcaacacatcgccttgcaggctcagttcgaccaggaacgggttcttgcccatgacggaaaacaaggttttggtctgggggttgtaggacaggtccgaagcctcatccttctccataccgggcagcaacttggcatcgatgaccgcgtgataatccgggagccatacgctctcctggcgttcggccgggctctcaaagcgctccagcacccacaacacaccgcgatcgtcccaatgcatggcccaggcaaccccatacagaatcgcaccggccaaaaacacccaggaataccaacgcatggacaagcgggagcgaagcgagggttttgaagtgggcagaggcacggccattgagcgcttttccggaaagtcagctgtaggggatagcacaggattcaaaggcccgcgcgcaagtggctggaattatccggatggtgtgtgaaaaaaatgcaaaagcccatacttgggatatacacaaaaccaatgtgggaggggcggtgcgacgattcgacttgctcccgatagcagtgtgtcagtcagaatatctgctactgatacaccgcaatcggtaccaagtcgaatcgtcgcaccgcccctcccacatttttcaccgcatttcttcaggcagtcagcgaacgacgctttcgaaacggttcacacccgccagctccaataccagttcatcgcccacattcagcggcccgacgccagccggggtgccggtcaggattacgtcacccgcctgcagggagaagcacccagccatatgctggatcatcggcacaatcgggttgagcatctgcgcgctgttaccgtcctggcgcacttcaccgttgatgctcaggcgaatgccgatatcggtcagatcctcaaaggtactgctgaccacaaagggtgcaatcaccgccgcgccatcgaaggacttggcgatttcccatggcaagcccttggctttgagctcggcctgcttgtcgcgcaaggtcaggtccagggccggggcaaagccggagatggcgtcgagcacttcttcacggctgggtctggtcgacaatggcttgccgatcaacacggcgatttccgcttcgtaatgcaccgaaccgcgctcggttggaatgctgaaaccgccttccagcggtaccacgcaactgcccggcttgatgaacagcaggggctcggtcggcaccgggttgtccagttccttggcgtgttcggcgtagttacgcccaatgcagaccactttacccacggggaagtggatattggtgccgtcgacatacttgtgctggtagctcatggaacgactcctcaaggtgcggttaaacagcgaagatcttgccggggttcatgatcccgttcgggtcgaacacggctttcaccgccttcatgtactcgatttcaaccggcgagcggctgtaggtcaggtaatcgcgcttggtcatgcccaccccgtgctcggcggagatcgagccgttgtacttctcgacggtttcgaacacccacttgttcacagtggcgcacttggcgaagaactcatccttgctcaggttttccggcttgaggatgttcaggtgcaggttgccgtcgccgatatggccaaaccagacgatttcgaagtccgggtagtgttcaccgacaatcgcgtcaatctcactcaggaacgccggcactttggagacggtcaccgagatgtcgttcttgtacggcgtccagtgggaaatggtctcggagatgtactcgcgcagcttccacaggttgtgcagttgggtttcgctctggctcatcacgccgtccagtacccagccctgctcgacgcaatgctcaaaggtttccagggcatggttggcgacttcttcggtggtggcttcgaattccagcagcgcgtagaacgggcactcggtttcgaacggcgccggcacatcgccacggccgaggactttggccagggccttgtcggaaaagaactcgaaggccgtcaggtccagcttgctctggaacgcgtgcagcaccggcatgatcgagtcgaagtcggtggtgccgagtaccatggcggtgaggtttttcggggcacggtccaggcgcatggtggcttcgaccacaaaccccagggtgccctcagcgccgataaacagctggcgcatgtcgtagccggtggcgttcttgatcaggtcgcggttcagctccagcacatcgcccttgccggtgaccaccttcatgccagccacccaattgcgggtcatgccgtagcgaatcaccttgatcccgccggcattggtgccgatattgccgccaatctggctggaaccggacgaggcgaagtccaccgggtagtacaggccgttttcttcggcgacgttctgcagttgcttggtgaccacccccggttggcacaccgcagtgcggtcggtgaggttcacattgaggatctgattcatgtagtcgaacgacaccaccacttcgccattggccgccaccgccgctgccgacaggccggtacgcccgccggacggcaccagcgctaccttgtgcgtattggcccaacgcacgatggcctgcacctgctcggtggtcttggggaacacgatggcgctgggcgcgggtgcgaagtgcttggtccaatccttgccgtaagcctccagggagtctgcatcggtcagcactttgccgggctcaaccagggtctttagctcatcaatcagggcaggatgggtcatcgacagaactctcgaacaattcatggtcatcctgagaacgcttcacgtcgcaggaataggtgtttagcggggtgcgtatgctagcataccgcccccgcaggacagacccaaagggcgtttctgcggtgacggctttcctgccgtccgggtcagcttgcgctgctcgactccctgccaattttctccgggatacaggtttacgcagatgagcaagacttctctcgataagagcaagatcaagttccttcttctggaaggcgtccacccatcggctgtcgacgttctgaaagccgccgggtacaccagcattgagtacatcaccagttctctgccggaagcccagctcaaggaaaagatcgccgacgcgcactttatcggcattcgctcccgcactcagctgaccgaagagatcttcgaccacgccaagaaactcgtggctgtcggctgtttctgcatcggcaccaaccaggtcgacctcaacgcagcgcgcgagcgcggcatcgcggtgttcaacgcgccgtactccaacacccgttccgtggcggagctggtgttggccgaggctatcctgctgctgcgcggtatccccgagaagaacgcctcctgccaccgtggcggctggatcaagagcgcggccaactccttcgagatccgcggcaagaagctgggtatcgtcggttacggctcgatcggtacgcaactgtcggtcctggccgaaggcttggggatgcaggtgttcttctacgacaccctgaccaagctgccactgggcaatgccacccaggtgtcgagcctgaccgagctgttgggcatgtccgacatcgtcaccctgcacgtcccggaaaccgctgaaacccagtggatgatcggcgagaaggaaatccgcgcgatcaagaaaggcggcatcctgatcaacgctgcacgtggcaccgtggtcgagctggacgccctggccgaggcgatcaaggacaagcacctgatcggcgccgccatcgacgtgttcccggtggagccgcgctccaacgacgacatcttcgaaagcccgctgcgtgggctggacaacgtcatcctgactccgcacatcggtggttccaccgctgaagcccaagccaacatcggcctggaagtctcggaaaaactggtcaagtacagcgacaacggtacctcggtatcgtcggtcaacttcccggaagtggccctgccggctcacccgggcaagcaccgcctgctgcacatccaccagaacattccgggcgtgatgatggagatcaacaaggtctttgcggaaaacggcatcaacatctccggtcagttcctgcagaccaacgagaaggttggctacgtggtcatcgacgtcgacgccgagtactcggacctggcgcaagagaagctgcagcacatcaacggcactatccgtagccgcgtgttgttctaaggtttcaactgcaccacgaaaaagggagccccatggggctcccttttttttcatctgaacaaatcttacttaacgttaaccgtgatcactttagaggctacagtcgggttgaactgcatgtgcagtttgtcgccggccaccagctgcaaggtgtgcttgcctggggtgagggtcacttcagtctcggtctgggccttgccgtaatggatcacagtgtcggtggccgggatcggcagtttcgcatccggcagttctttctggtcgatcagcagatggtggtggccggtgcctggcgcctgttcggtggccggggccagtttcaggccttccatgccaaatttcacggtgaaggttttatcgacggtggcgccatccttcggcgagacgataaacaccttggcaccttccggtggagcgctgcgcggaataccgtcggcggctgtggccaacatcgaagcacccagcaacaggctggccagggtggcgcgggataaaagggctttcattcgcttctccagtttttcggtgaaatctgtggggttatgacaacttcgcgacaaattgctgtccaaggcactcgacaccatagcaaagcgatgctgaacggcgtctcgcccgtacgaattctttaggagtgaccatgcgcttttcgcctggcctgttacttttgcttcccctgctgagcccgttggctcacgccgaactgatcgacgacgtcaatgatcgcgctgaactgcgcatcgccctggaagccaataccgcgccctacaacttcaaggacggcgacaaactcaccggctttgaggtcgagctgggcgagcagctggccaaggaaatggacgtacgcccttcttttatcaccaccgacgacagcgacctgttgccaggtgtggaaaccggcaagtacgacgtggcaataaaccatatcgctatgactgccgaactcaaggatcggttcgattacagcacggcttatcgcgagaagccggaccttgtgatcccattccagaaaggtaacccagcgttcaagagcagcctggacatggccttggagcgggtgaaggcggatggcagattgaaggcgatggcgcagaagtggttcgacagcgacacaccggcagccaaggcacagtagatcaaatgtgggagggggcttgctcccgatagcagcggatcagttgataaatgtgtagctgacactccgctatcgggagcaagccccctcccacattttgttcaaggcaagactttagaatcctttgccggcttaaaacggctcgttgccccgtcggcgaaaccaaccggtcaaggacagccgctctcgggtggcaggcagtacctcgtggggcacctcgcccgacaaaaacaccaccaggcaacccccggtcggcaccacgtcgtattcaacgccgcccttgaggtacatgcgcaactggccgccgtgttcgggtaaccaggcgtcgttcaagtagaccaccgccgagaccatgcgccggtcatcatcgcgaaaacggtccacatgcttaaggtaaaaggccccgggcgggtacatcgcgaagtggctttcgaaatcttccaggcccaggaacaggctgcggttcatcgccaggcgcaggctgtccatcaccgccatataggtatcgcagaccgccgcgtcaccttcctccagccactggatatggtcaccgcgaatgccctcgcgaatctcctgagccggcccgcgccccaccgctgccggtgccagttcaccttcagccgcacgtttatggcactcagcaacgagttccagggtcagagcctggggcaggaagccattctgctgcgaccagcctttttcggccaggtcgtcgacgatgcgttgcagcagcgggtgatcgaggggtatttgcatggcgcgcatagtatccatacgcctgtgaatccgacagagccgctgagcgtctgaatacactttagtcaggtgactgataggacttctcgacaaatcctacgcccgacacggacaatagtggccgactgacaggagtccatatgcgtcgtttgttattttccgtgttgatgctctgcgttttgcccgcctgggcagacggctatgaccagttatacaaggtcgccggctgggccgaacaacgtgcgcatttcaatgacgccctcagtgccgcccagcaacgctatcgcaatagtctgccgccagcggtgtaccaggcgctggtggacaacagcaataagcgctttgccgcccaggccatggaccagcgtgccgaggagcaactgcgcaagcacctgccagacccgaaaccggccctggcatttttccaatcgcccctggggcgcaagattgtcgctgccgaattgctggctacccgccgcgaccagttggcgaagaacgcccagggcctgccgaaaatccaggccgaagccacccgcagcctgatcatcggccacctggcccaggcgctgcctgctcgtgaagccggtgcggaagtcagcctggcgattgccggcgtggcggccgacagcttgagccagatgatccccggcctgcttggcggcggtcaggcccaaggcatgttgaatggacagcgtgaacggctgatggcgcagattgataaggatctgaacaatacgctgctgtatgtctaccgggatttgtccgacccggagctggaggagttcgccacgtttgccgagtcgccccagggtaaggcgtattaccaggccgccctggcagccattcgcgcagggctggcagtcggccaaagcacctcaagcctggcgcagtaacaaaatgtgggagggggcttgctcccgatagcagtgtgtcagtcaacttatgtgtagctgacccagcgctatcgggagcaagccccctcccacatttggaccgtatcagttcagatggtccgtcaaataccggaagtattcttcgcgaatctctggaatctcattggccaggtgatgccggccgcgctttagcatcaacacctcaggttgatcgaacttattgctcagcacgcgcaagttgtgctgccagtccaccgtcatatcctcctcaccctgcacgatcaccggccgccgtgggctgcgtggcgcggcttcgatgcgcttgatccagcgcgccagcgcccccacccaggcggtgggtaattggcggggctggagcgggtcggcttcaaggaacggcttgaattcaggatcgttggagttatcgctgaaacgccgggcgatgcctttgacgaacgggcgcagcaggtaatagctgacctgggaccaaccccaggcccgcggccgtaccagtggcgataacaaaaaggtcttgccctgggccgggctgtcggcaccgtggttgagcaggtgatccacgacaatggcgcccccggtgctctgcccgaacaggtgccagggttgcggcaattgcagcgccttggcctcggcgaatagcccctgcaccacccgctggtacaccgcaaactcatcgatgctggcgcgcgggccgctggacaaaccgtgacccggcaggtcgcaggcaatcaccacgaagccttggtccaatgcccagtccaccacgtggcggtacagtcccatgtgatcgtagaagccgtggaacatgaacatcgtcgccaccggcgcaggcggccaccacacctgggccaccacttcgaacccgtccacctcgaaacgccccaggcgactcacggccggcaccttgcgggcggccaggtcgagcccatagaaacgttggtagacccgcgcttcggcgctgagcggttgcgcgtccaccaacggccgcaagctttcgcgcagatgatcagggtcaaaggtgacgggcataaaggcttccagactggcggtgaagatgaatatcgagctgcgatattcatctgtcaggacaagcatggcaagctacgcgacctgcgaggatacctctgaatgcgaccgccctaccgtaatgccctgttcgccagtctgatcctggttatctgcgccggcgtgctgtgggccgcatatgactggttccagggccgctacctgcgcgccttcagcgagcacacggcggtgttctccggcgatgcgctgcaactgcctgccgccctcagtggccctggcccgattcgcctggtgcacttctgggacccggcctgcccgtgcaatgttggtaaccagcaacacctgggcgagctgatcgagcagtacgcgccccaaggagtggagttctatgccctgcaaaaacccggcagccacggccagctgcccgacaacctgcgccacatgaaagtcatcgacgccctgcccggcgccgaccgaatacccgccagcccagcagtgggcatttgggaccgcacaggcaagctggcctatttcggcccctacagcgaggggctgacctgcaacgccagcaacagttttatcgagccgattctcaaggcccttggaaccggacgcgaagtgaatgccactcacaccctcgcggtaggctgctattgttcgtggcctaaggatctgtagcccgtccattttggtaaggaatgttcatgaagcgcgtcttgcaggttttcgcggtgctgattgtgctggtcgccctgggcgccggctggtacctctacagcaagcaacccacgcgccagggcacggtaaccctggcccacctgcaaggctcggtcacggtgcgctacgacgatcgtggcgtgccgcatatccgcgccgagaacgaaaccgatctgtaccgcgccctgggctatgtgcatgcccaggaccgcctgttccagatggagatcatgcggcgcctggcccggggcgagctggccgaagtgctggggccgaagctgctcgagaccgataagctgttccgcagcctgcgtattcgcgaacgcgcctcgagctacgccgagcacatggcccctgactcagcctcctcgaaagccctgcaggcctatctggacgggatcaaccaatatcagaccagccatcccagccccattgagttcgacgtgctgggcatccccaagcgcccgttcaccgccgaagacagcatcagcgttgccgggtacatggcctacagctttgccgcggcctttcgtaccgagccggtgctgacctacgtgcgcgaccgcttgggcagcgactacttgaaagtcttcgacctcgactggcaacccaaaggcgccctcaacctggcgaacgacgactggaacaccctcggcgctattgccgccctgagcgaacaggccctggctgacaacggcctgccacaatccgagggcagcaatgcctgggccgtcagcggcagccacacccgtagcggcaaaccactgctggcaggtgacccccatatccgcttctcggtgccatcggtgtggtacgaggcgcaactgtcagcgcccggttttgagttgtatggctatcacaacgcgctggtgccagtggcgttcctggggcacaacatggattttggctggagcctgaccatgttccagaacgacgacctcgacctggtcgccgagaaggtcaacccggacaaccccaaccaggtctggtatcacgaccaatgggtcgacatgaccagcagcgagcagcagatccaggtcaagggccaggtgccggtgaccctcatcctgcgccgctcgccccacggtccgatcatcaatgaagtgctcggcgagaacgccggcagcacgccgattgccatgtggtgggcgttcctcgacagcgagaacccgatcctggaaggcttctaccagctcaaccgtgccgataccctggtcaaggcacgtgctgctgcggccaaggtctcggcgccaggcctcaacatcatatgggccaatgccaagggtgatatcggctggtgggcggcggcgcagttgccgatgcgcccggcaggggtcaacccggcgttcatcctcgatggcagtaccgcccaggccgacaagctgggcttctaccccttcagtgccaacccccaggaagaaaacccgtcgcgtggttatgtggtgtcggccaacgcgcagccggcctcccctaccggcatggaaattcccggctattacaacctggccgaccgtggccagcagttgaacgcacagttgagcgataagagcgtgaagtgggatgtgaccaacagccaggcgctgcaactgggcaccactaccgcctatggcccgcggctgctggcgccactgttgccggtgctgcgggaagtggtcaaggacccggcgcagttaaagctggtggaacaactggccaactggaaaggcgattacccgctggactccaccagcgcaacgctgttcaaccagttgctgttcaacctcgccgacgcaaccttccacccgaaactgggcgacgcgttgttcaagaccctgatcagcacccgtgtgatcgacgccgcattgccacgcctggccgcctcggcggattcaccctggtggaatggcaagcgtaccgacaccgtcaaactcgcctgggacaatagcctcgcgcacctcaagagcaccttcggcgatgacccggcgcagtggcaatggggcaaggcgcacaccctgacccacggccacccgctgggcatgcaaaagccattggataagctcttcaacgtcggcccgttcccggcacccggcagccacgaagtgccgaacaaccagaccgccccgatcggcccggcaccgtggccggtgacttatgggccgtcaacgcgacgcctgatcgacttcgccgacccgacccatgccctgaccatcaaccccgtggggcaaagcggcgtgccgtttgatacgcactatggcgatcaggcgcaaagctatatcgagggcgggtatgagcaggcgcatttcagtgaagaggaagtcacggccaatacccgcggaaccctcaagctgctgcctgccagatagtcatgatcgctacaccggtgccgcaaagttaagcctgaactgttgcggcgtaacgcccagccggcggttaaacacactgcgcatgtgctgggcgtcgcgaaacccgcattgataggccacggtcttgagcggcgcgtggctgctttcaagcatcacccgcgccgcatccacccgcgcacgctcgacaaattcggctggcgtgattcgcgcttctcgggcgaacacccgggagaaattgcgcgcactcatattggcggccctggccaagtcggcgatagtcaaatcgccggtcaggttggccagcacgtacaactgcaccagcgccaccgccgaggtggtttcggcatggggcgtgaggaacgggctgaactgcgactgcccgcccgaacgctgggtaaacaccaccaagcgcttggccacgctcaacgcgacttccggaccgtggtcctgggccagcaggtacagtgacaagtcgatacccgccgtgaccccggccgaggtgtagaggttgccgtcctgcacgtagagacggtcggcttcgacccgggccgaggggcacacacgcgccaggtccgcggcatcgccccaatgggtggtgacggttttaccctccagcaggccggcgcgggccagcatgaaggcaccgttgcagatcgagccgaagcgttgtgcccttgcggtggcagcacgcagccagtcatcaaactggggaccgaagttttcgaagggcagttgcgggccgccggcgaccagcagcagatcgtagggttgcagggcttcgctgtagtgtttgtgggcctgcaaggacaggccgttggaggcggccatagaaccgtgaccgaagccgatgacctccagttggtagtgatcttcgggagccaggaagcggttggcctcgcagaacacgtccatcggcccggtcacatccagtgactggacgccggggaaaatcaggagcgcgacggttttgtgcatgggaaacctttatctctgggctgacgcaaaaccctgtggaagctggctcgcctgcgatgcagacacctcggttcatcaggtataccgaggtgatgctatcgcaggcaagccagctcccacatttgaccgagtacacccttggcacgatgtgtatccacattggccgagaacgctccctcgtcgcgatagctgcgtcacgcacgcgcgaccagactaggtgctttccagaggagaaccaccatgagcaccaccatcgccggcatccagatccccgacagcaccttggccaaggccaccaccgaatatatccgcgacgtcgagtccgacctgctctaccaccactcgcgccgggtatttctgttcggcgccttgagcggtgagcgcaagcaactggcctacaacccggagttgctgtacgtaggcgcgatgttccacgacctcggcctggtggaaggccatcgcagtgacaacgagcgcttcgaagtggacggcgccaatgccgccgccgcgttcctcaagccctatgggctgagcgatgacgacatcgaacaagtgtggctgtcgatcgccctgcacaccacgcctggcgtgcctaagcacttgcgccccaccgtggcgctggtgaccgccggtgttgagatggacgtgctgggcatggactacgccgcgttcagcagcgtgcagcgcgaagcagtggtgcatgcgcatccacggggtgaagggttcaaggagtgcatcatctgcgcgtttgccgacggcttgcgccaccgcccgcagaccacgtttggcaacgtgaagaccgatgtgctggtggatcaggagccggggttcaagccgatgaattttgtcgaggtgattcgtaagtcgccatgggcagcataaccaaattggaatgccatcaatgtgggagggggcttgctcccgattgctgagtgtcagtcactgcatctgttactgacccactgctatcgggggcaagccccctcccacattttgagcccagttccggcagtcagaccggcgctggcgcgcggcgcttgtccggttgttgccagccatccgctgcggcttcttcgatggcttgctggatggctttcttgcgatgctcttcggcccggcggctgaagaaccacaccaggaaggtcaccagcgacaccgccaacagaatcaggctcgccacggcgttgatctcaggcttgacccccaggcgcaccgccgagaacacttccatcggcaaggtggtcgagcccgggcccgacacgaagctggccagtaccaggtcatccagggacagcgcaaaggacatcatgccgcccgccgccagcgacggcgcgatcatcgggatggtgatcaggaagaacaccttccacggccgtgcgcccaggtccatagccgcctcttcgatcgacaggtccagctcacgcaggcgcgccgacaccaccaccgccacatacgccgcacagaacgtcgtgtgcgcgatccagatggtgacgatgccacgctcctggggccagccgatcatctgtgccatggccacgaacagcagcaacagcgacaggccggtgatcacttccggcatcaccagcggtgccgtcaccaggccgccgaacagcgtgcggcccttgaactggctgatgcgcgtcagcacaaaggccgccaaggtgcccagcgccactgcggccaccgccgtgtagcaggcgatttccagggagcgtgccaccgagcccatcaactgggtgttgtccagcaggcccacgtaccacttgatcgaccaaccgccccacaccgtcaccagcttggattcgttgaacgaatagatcaccaggatcaacatcggcaggtagataaacaacaagcctgcgaccagcatgaagctggagaaacgaaagcgcttcatatcttgccctccagctctttggcctggctgcggttgaacaggatgatcggcacgatcaggatcgccagcatcaccacggccaaggcagaagccaccggccagtcacggttgttgaagaattcctgccacaacactttaccgatcatcagggtttccgggccgccgagcagttcaggaatcacgaactcgcccaccaccgggataaacaccaacatgcagccggcgatgatgccgttcttggacagcggcacggtgattttccagaagctgttgaaggtgctcgaaccgaggtcggaggcggcttccagcaggctttggtcgtgtttgaccaggttggcgtacagcggcaggatcatgaacggcaggtatgagtagaccacgccgatatacaccgcgatgttggtgttgaggatctgcaacggttcgctgatcagccccatggacatcaggaagccattgagcaagccgttgttgctgaggatgcccatccacgcatacacgcggatcaggatcgcggtccaggtcggcatcatgatcagcagcaccagcacggtttgcatctctttgcgtgcggtagcgatggcgtaggccatcgggtagccgatcagcaggcacagcagcgtgctgaaaaacgccatcttcagcgagcccaggtacgcggcgatgtagagctcgtcgccggccaagaggctgtagttggccaggttcagcaccacttgcagcttttgctcaacgtaggtgtagatctcggtgtagggcgggatcgccacgtcggcttcagcaaagctgattttcaatacgatgaaaaacggcagtgcgaaaaacagaaacagccacaggaagggaatcccgatgaccacctgcttgccattggggacgatgcgatccaagcgccgcttgaatttcttcatattcatgagcgaagtaccacgccgctatcgtcttcccaccatacgtacacctggtcaccccaggtcggacgctggccacggcgttcggcgttggctacgaaggactgcaccagcttgccgctcggcagctccacgtagaacaccgagtgcccgcccaggtaggcgatgtcgtgcaccttgccgctggaccagttgtgctcgcaggtcggcatttgggtagtgaccagcagtttttccgggcggatggcgtaggtcaccgatttgtcttccaccgcggtggcgatgccgtagcccacgtagatatcgcggtccagatcagcgcacttgagcactgcgtggccttcggcgtcgtccaccacctgggtgtcgaagatgttgacgttgccgatgaactcgcacaccaggcggctggtgggggtttcgtagatgtcgatggggctgccgatctgggcgatccagcccaggtgcatgatcgcgatacgctcggccatggtcatggcctcttcctggtcgtgggtcaccatcacgcaggtcacaccgacgcgctcgatgatttccaccagctccagttgcatctgcgaacgcagcttcttgtccaatgcgcccatgggctcatcgagcagcagcagtttcgggcgcttggccagggagcgggccagggccacacgctggcgctggccaccggacaactggtggggcttgcgcttggcgtactggctcatctgcaccagcttgagcatctcggccacgcgggcgtcgacttcggccttggggatcttgtcctgctgcaggccgaacgcgatgttctgcgccacggtcatgtgcgggaacaaggcgtaggactgaaacatcatattgatcggccgctcgtagggcggcatgtcggtgatgtccaccccgtcgaggtagatgcgaccttcggtggggcgctcgaaacctgcgagcatgcgcagcaaggtggatttgcccgaacccgaaccgccgagcaaggcgaagatctcgcctttcttgatttccagggacacatcgtccacggcaatcgtctcgtcgaacttcttcgtgacccggtcgattttgaccagcacctttttcggtgtctggtcgccctcgagggctttcttataggcgccggaggcaactgccatttacgaaactcccaaaaaaaacggtgcggttcgccttaggcgggcgaacccaggatagtttgagccttacttgcccgtcttgaccttggtccagctacgggtcattaaacgctgcactttcgggggtagctcgaagttgacgaaagtccgctcgagaaccgcctgcggtgggtaaaccgctgcgtcagtgcgtatcgattgctccatcagcttgtccgcccctgggttagggttggcataaccgacctgatcactgacctgagcgatcacctcaggctgcagcaaatagttgatgaaggcgtgggcttccttgacgttgctggcatccttggggatcgccaacacgtcaaaccacaggttgccgccttctttcgggatcgcgtaggcgatattcacgcctttgcctgcctcagccgcacgggccttggcctggaacacatcgccggagaagccggccgccacgcagatattgccgttggccaagtccgagatgtatttggaggagtggaagtaggtcacgtagggccgcactttcagcagtttttcctcggctttcttgtagtcggccgggttggtgctgttagggtccaggcccatgtagttgagcaccgcaggcagcatttcgtctgccgaatccatgaaggacacgccgcaggtggcgagcttcttcatgttttccggctcgaacaacaccgcccaggagtcgatatggtcgacgcccagcacttccttcactttatcgacgttgtaaccgatgccattggtaccccacaggtacggcactgcgtactggttacccgggtcgttcttttccagacgcttgagcagtaccgggtcgaggttggcgtagttcgtcagcagtgacttgtcgagcttctggaacgccccggccttgatctgcttgccgagaaaatggttggacggcaccaccacatcgtagccggtacgcccggcgagcaacttgccttccagggtttcgttggagtcaaacacgtcatacacgggcttgatgccactgaccttttcgaagttggccagggtgtcggggccgatgtagtccgaccagttataaatatgcaccgtcggtgcggcctgcacgctggcagccagcgtgatacctgcacccaccagcatggctttgcgaaataaagaaattggcaagtggaggtcctcttaaatagttgggccttagagttgttgcccggcaacaaaaccggcgcgcaacttaccctcgataaaccgatccggcaaaactttctttgatctaatttgtgggaggggggaaattgccccctcccacaactaacaggacttacttgcccgacttgatcttggtccagctgcgtgtcatttcccgctgggttgcagccggcaggtcagcaatcgcgtagagcttggcctgcacgtccgccgacgggtagatgcccgggtcgctggtgatgtctttgtccaccaatgcggtggccttctcgttaccgttcgggaagcgcacgctgttggtgatcgacgccatgacttcgggcttgagcaggtagttcatgaaggtgtaagccgcttcgacgttttcggcatccttggggatggcaaccatgtcgaagaagctgccagcgccttctttcggaatgtcgtacgccactttcactttgccaccggcttcagccgcacgggacttggcctgctgaatgtcacccgagtaacccacggctacgcagatattgccgttggcaaggtcggagatgtacttggacgagtggaaatagccgatcgaaggacggatcttcaagaacaggtcttcggcctgcttgagatcggctttcttctggctgtcggtcggcaggcccaggtaatgcagcgcaatcggcagcatttcggttggcgagtcgaggaagctcacgccgcagcttttcagcttggcgatattttccggcttcatcagcacatcccatgaatcgatcttgtctacgcccagcgcagccttgaccttctccgggttgtagccaatgccgatcgagccccacatgtacgggaacgcgtgcttgttgtccgggtcgctgaccgacacggccttaagcagggatttgttcaggttgctgtagttaggcagcttggacgtgtccagttcctggtacacaccggccttgatctgcttggccaggaagttgttggacggcacgacaatgtcgtagccggacttgcctgccagcaacttggcctccagggtctcgttgctgtcgaaaacgtcatacaccaccttgatgcccgattctttttcaaagttggcaatggtgtccggtgcaatatagtcggaccagttatagacgtgcagcactttactgtctgcctgggccgcgcccgccattgcgcccatcagcgacaaggcgaggagggtcttgccagcgtttttcaaacctaatgccttcattgggtgatgctccgattttttcttttttgggccacaagctttatatgttttacggcccagccaaagggcaacaaaacagggcgacagtctggcaagttccgaggccggctttcaaccaaagcctcacatataactgcccggtgcgcagcgcccgaacgccgctgcgcactgagcctagcacttagccctgcaatgccgccaaggtcaggtccaggcactggcgagccttgctgaccagctcgtcaatttcagccttgctgatcaccaatggcggcgaaatgatcatggtgtcgcccacggcacgcatgatcaggccattctcgaagcagaaggttcggcagatcatgccgacgcccttgccttcataacgcttgcgcgtggccttgtcctggaccagctcaatcgcaccgagcatgcccacgccgcgcacttcgcccaccagtgggtgatctgccagttcccgcagacgtttctgcaaatacggtgccgtttcatcctgaacacggttaacgattttttcgtcgcgcatgatgcggatgttttccagggccaccgccgccgctaccgggtgaccggaataggtgaatccgtggttgaaatcgccgccctcattcagcacctcgaccacttcatcacgcacgatcaggccacccatggggatgtagcccgaggtcaggcccttggcgatggtcatcatgtgtggcttgaggtcgtagaaatcgctaccaaaccactcaccggtacggccaaaaccgcagatcacttcgtcggcaacaaacaggatgtcgtacttggcgaggatttccttgatgcgcggccagtaggtggctggcggcacgatcacgccaccggcgccctggatcggctcggcaataaaggcaccgacgttgtccacgcccagttccaggatcttctcttccaactggttggccgcccacacaccgaactcatcggggctcatgtcgccgccttcgccaaaccaatatggctgggcgatatgggtgatgcccggaatcggcaagtcgccctgttcatgcatataggtcatgccgcccaggctggcgccagccacggtggagccgtggtagccattcttgcgggcaatgatggttttcttgttcggctggcccttgatcgcccaatagtggcggaccatgcgcaacatggtgtcgttgccttcggagccggagccggtgaagaacacatggttcatgccagccggtgcgatgtcggaaatcgccttggccagttccagcaccggcgggtgtgcggtctggaagaacaggttgtagtacggcagctctttcatctgcttggcggcggcatcggccagttcatcgcgaccgtaaccgatcgccacgcaccataggccggccatgccgtcgaggatcttgttgccttcgctgtcccacaggtaaacgccgtgggctttggtgatgatccgtgggcctttctctttcaattgcttgaagtcgctgaacggcgccaagtggtgatcattgctcaaggcttgccattcacgggtttgcgggttgttgctggacataccaatctcctagacttttcaggtgaaggcgcgccaattcctacgacgcgcccggcgcatcagacggcgaagagcaggaattcccgctcccacgaactgatcacacgcttgaagttttcatgctcggcccgcttgaccgcgacgtagcctgtgatgaatttttgccccaggtatttctcgatggtcttgctgttttccatacgctccagggcgtcttcgatggtcaacggcaggcgcaggttgcggcgttcgtaaccacggccgactactggagcgctcgggttgtggccttcgaccataccgatgtagccgcacaacaggctggcggcaatcgccaggtaggggttggcatcggcgcccggcaggcggttctccacgcggcggttctgcgggccggcatccggtacgcgcaggccgacggtgcggttttcttcgccccactccacgtttaccggcgccgaggtatcgggcaggaagcggcggaacgagttcacgttgggggcaaacaacggcagcaactcggggatgaatttctgcaggccgccaatgtggttgaggaacaactggctcatggtcccgtcttcattggagaaaacgttcttgccggtagcgatgtcgatgatgctctggtgcaggtgcatcgcgctgccgggctcgccggtcatcggcttggccatgaaggtagcggccacatcgtgcttgagcgcggcttcacgcatggtgcgcttgaacaccaggatctggtcggccagggacaaggcatcgccatgacggaagttgatttccatctgcgccgtgccgtcctcgtggatcagggtgtcgaggtccagctcctgcagttcgcaccagtcgtagacgtcttcgaacaatgggtcgaattcgttggcggcttctatagagaaggactggcgaccggtttccgggcggccggaacggccaatcggcggctgcagtgggaagtccgggtcttcgcagcgcttggtcaggtagaactccatctccggcgccacgatgggctgccagccacgatcggagtagagcttgaggactttcttgagtacgttgcgcggcgacagctcgatcgggttgccttgcttgtcgtaggtgtcgtggatcacctgggcggtcggctcgatagcccacggcaccaggaacaccgcgttctggtcggggcggcagatcatgtcgatatcggccgggtcgagcaattcgtaatagatgtcgtcttcgacatagtcgccggtcacggtctgcaacagaacgctctcgggcaggcgcatgcctttttccgcgatgaacttgttggtcggcgagatcttgccccgggtgatgccggtgaggtcgccaatcatgcattcgacttctgtgatcttgtggtctttcaaccaatcggtgagctggtcgaggttgttactcataaatgcctctgggctgggtttcctggcatccattaaaaggccaggcgttggttgacgcagcatccgcgtcgtttttacattcagggtaggagcttacctgccatttgctgcagcgttgcattcctcacgccaaacttgtgcagaatcatgagcaaccccgcaggcgcaagccattgagaggcaaactcgagggcagtgaagaagcaaagaagaggtcggcccgggcgtcaagaatattgaccggggcgcaggggttcacgcaggacacatgaacgggtgaaaaagcccgactggagcaggccaagacgccaagtggcggcaggaaaaacatgaagcaccccggtattattgctgttatgggtttgaatcgagcttagccttgttcatttttttacacaacacccccgtaaaaaatcctacacgccccgctcaagcctgctggtcacaagcacgttaaacccggaaaaccgccccaaaaccccgcaaaaaagccctcacggcgcttttttagggcaaaaaagccctcgcttgacttcggcatgccgttcgggttgactgaaaccagaaaagatcaatgattgatatttttaacaacaaaggtgttgcatcatgtcggtacccccgcgtgccgttcagcttaacgaagcgaacgcgttccttaaggatcatcctgaggttctgtacgtagaccttctaattgcggatatgaatggtgtggtgcgcggtaagcgcatcgaacgcaccagcctccacaaggtttacgagaagggcattaacctgcctgcctctttatttgccctggatatcaacggctcgacggtggaaagcaccggcctgggcctggacatcggtgatgctgaccgaatctgttatccaatccccgataccctgtgcaatgagccctggcaaaaacgccctaccgcgcaattgctgatgaccatgcacgaacttgaaggtgaacctttcttcgccgatccgcgcgaagtgctccgccaagttgtaagcaagtttgacgacctcggcctgaccatctgcgccgccttcgagcttgagttctacctgatcgaccaggagaacgtgaacggccgcccacaaccgccccgctcgcctatttccggcaaacgcccgcactcgacacaggtctacctgatcgacgacctcgacgaatacgtcgactgccttcaggacatcctggaaggtgcgaaggagcaaggcattccggccgacgccatcgtcaaggaaagcgctccagcgcagttcgaagtgaacctgcaccacgtcgccgacccgatcaaggcttgcgactacgcggtactgctcaagcgcctgatcaagaacatcgcctacgaccatgagatggacaccaccttcatggccaagccttacccgggccaggcaggcaacggtctacacgtgcatatctccattctggacaaggacggcaagaacatctttgccagcgaggatcccgagcagaacgccgcattgcgtcacgcaatcggcggtgtgctggagaccctacccgcccaaatggcgttcctgtgccccaacgtcaactcctaccgtcgtttcggcgcacagttctacgtgcccaattcgccgtgctggggcctggataaccgcaccgtggcgattcgcgtacccactggctcgtccgatgccgtacgtatcgaacaccgtgtggccggcgccgatgccaacccttacctgctgatggcttcggtcctggcgggcgtgcaccacggcctgaccaacaagatcgagccaggcgcaccggtggaaggcaacagctacgagcagaacgagcaaagcctgccgaacaacctgcgcgatgccctgcgtgagttggacgacagcgaggtgatggccaagtacatcgatcctaagtacatcgatatcttcgtcgcctgtaaggaaagtgagctggaagagtttgaacactccatctccgaccttgagtacaactggtacctgcataccgtgtaagtggttgcggcattgaagaagcgccacaggcttagggtctgtggcgcttttttatgggcttattccgggagaccgaattggcctcatcgggagcaagtcgaatcgtcgcaccgcccctcccacatttagatctgtgaatacattcaaaatgtgggagggggattgctcccgatggcggtctggaagacaacacacctccctgctcatacaatgcccgctgccttgtaggagacttccatgcccacccgccccgccacgcctcgcaaaccccgcgcccgcagccaggcgcggatcgacgcgatcctcgacgccgcccgcaccttgctggccaccgaaggcgtggcgagtttgtcgatctacagcgtggccgaccgggcgcagattccaccgtcgtcggtgtatcacttcttcgccagtgtgccggcgttgctggaggcgttgaccgcccaggtacacgccgccttccgcgccgccatccaggcgcccatcgaacatgactcactcaagcactggcgcgacctgtcctgcatcgttgaacagcgcatgctcaacgtttacgaccaggacgcggctgcacgtcagttgatcctggcacagcacgggttgactgaggtgacccaggccgatcgtcagcatgatctggagttgggggccttgatgctggaggtgttccaccgccacttcgaagtgccgagcttgcccaaggatgtggatgtatttgccctggcattggagctgagcgaccgcgtgtatgcgcgttcagtgcatcagcacgggctgattacgccgcgtatggcgcaagaagggatgcgcgtgtttgatgcctatgtggggctttatttgccggcgtatctgcccaagcggtgagccttgtgttggctggccggccctatcgggggcaagccccctcccacattttgaccttattgttcctgaataaacgcggtccagtgtgggagggggcttgctcccgatagcggtctcaagcaatcacaacttggcaatcgacacctcagtggatttcacaaaggcaatcacttcactgccaatcaccagctccagctctttgaccgaacgcgtagtgatcaccgaagtaacgatgccggacgcagtctgtacgtcgatttccgacagcacgtcaccgaccacgatttccttgatggtgcctttgaactggttacgcacgttgatggctttaatagtcatgatgtttttcctgtgtgggttattgagcccaacgcaattgcgtcggcagcggtgaaacaggttcgggttccggcggtgagccgggcagcgacagcacacggttgagtacttcggcttccagagcggccaggcggtgtgaaccccgggcccgagggcgtggcaggtcgacgttcaggtcgaggccgatttcgccgtcctcaatcagaatcacccggtcggcaatcgccacggcttcgctgacatcgtgggtcaccagcaacacagtgaaaccgtgcttgcgccagaggttctcgatcagttgctgcatctcgatgcgggtcagggcgtccagcgcccccagcggctcgtcaagcagcagcaggcgcggctggtggatcaacgcacgggccaatgccacgcgctgcttctggccaccggacaaggcagccggccattcattggcgcgctcggccaggcccaccgcttcgagggcctccagcgccctggggcgccagttgcccgtaaggccaaggccgacgttgtcgatgatctttttccacggcagcaaacgcgcttcctggaacatcaatcgtgtgtcttcaatcgcctcgtgcagcggcgcggagccggccagcagctcgccgccactggccttgtccagccccgccagcaggcgcaacaaggtactcttgccgcagccgctgcgaccgaccacggccacgaattgaccggccggaatatgcaggtcgatgtccttgagcacttcgcgagtgccgaaggatttgcgtaatttgcgcaccgccagggggatgcccttgagcaggcgcgggggttgttgagctgtcatgccgcacctcctttgacttgatacgccgggtgccagcgcagccatacccgttccaggccacgcgccgccaggtcggcgagtttgccgaggatggcgtacatgacgatggccagcaccaccacgtcggtttgcaggaattcacgggcattcatcgccaggtagccgataccggagctggccgaaatggtttccgccacgatcagcgtcagccacataaagcccagggcaaaacgcacgccaaccaggatcgacggcagcgcgcccggcaggatcacttgccagaacaagctgaacccggacaagccgtagctgcgcgacatttccaccagcgccgggtcgacgttgcggatgccgtggtaggtgttcaggtagatcgggaacaatgtgcccagggccaccaggaaaatcttcgcggtttcgtcaatgccgaaccacaggatcaccagcgggatcagcgccaggtgcggcacgttacgaatcatctgcacagagctgtccagcaagcgctcgccccacttcgacaacccggtgataaagcccagggccaaaccaatgctgccgccgatcacaaagcccaggccagcacgccagccactgatggccaggtgtgtccagatttcgccgctgaccaccaggttgactccggcttcgatcaccgcactgggcgccggcaaaatgcgcgtcgacaaccaccccgccgacactgacaactgccacaccgccaacaacaagatcggcagcacccagggcgccacgcgatggctgaatttttcaaagtccatggcggcgcctcaactctgtgacgcagctttgggaaggatatcgttggcgaccatctcgccgaaggggctgacgtagccagcgcttttcggcaactcgggacgttcgatatccaaatgcgggaacaacagctcggcgacccgataagactcttccaggtgcggataaccggagaagataaaggtatcgatgcccaggtccgcgtattccttgacccgcgccgcaaccgttgggccatcgccgaccagcgcagtcccggcaccgccccgcaccagcccaacgccggcccacaggttggggctgacttccaggttgtcacggctgccgccatgcaaggccgccatgcgttgctggccgaccgagtcgaagcgcgccagggatgcctgggcgcgggcgatagtgtcgtcgtccagatgggagatgagtttgtcggcggctttccaggcttcttcgttggtttcgcgcacaatcacatgcaggcgaatgccgaagcgcagggtacgtccgagtttttcggccttggcgcgaagctgggcgattttttccgcgaccgccgccgggggctcgccccaggtcaggaccatttccacctgttcggctgccaggtcctgagcggcttcggaagaaccaccgaagtacagcggcgggcgcggttgctggaccggcgggtaaagcagcttggcgccttttacgctgatgtgctcgccgtcgtagtccacggtttcgccttccagcactcggcgccagatgcgggtgaattccaccgaggcctggtagcgctcttcgtggctgaggaacaagccgtcgccggccagctcttcggggtcaccaccggtgaccaggttgaacaacgcacggcctccggacagacggtcgagagtcgcggcctgacgtgcagccaccgtcggggaaatgatcccggggcgcagcgcgacgaggaatttcaagcgctgggtcactggaatcagcgaggccgccaccagccacgagtcttcacaggagcgaccggtggggatcaacaccccaccgaaacccaagcggtcagcggcctgggccacttgctgcaggtaaccgtggtcgacggcgcgagcgccttcggcggtgccaaggtaatggccgtcgccatgggtaggcaggaaccagaaaatattgaggctcatggagttgtctcctgaagaagtcgaattacggcgctttggcaaccgcggcgggtggcgtccagatcacgtccttgatactcaagggcttggggatcaatttgagttgatagaaggtgtcggcgattttttgctgtgcggcgactacttcgggcgtcaggaacagcgcgccgtaaccctggcgtttcaccgaggtcagggtgatgtcggccggcaggcccagcagtggcgcgacttgttcggtgacctgctcagggttggccttggaccactcgcccactgcgcgcacttcttccaccaatgccttgatcacttcagggtgttgctcggcatagggtttggtggcgaggtagaactgatggttgtcggcgatgccggtgccgtcacgcagggtgcgggcctgcagttgattttcggcggcagcctggtagggatcccagatcacccaggcgtctacgctgccgcgctcgaatgcggcacgggcatcggcgggcggcaggaagaccgtcttcacgtcggtgtagttgaggccggcatctgccagggcacgcaccagcaggtagtgcacgttggagcctttgttgagcacgacctttttgcctttgagctcggccaccgatttgatcggcgagtccttgggcaccaagatggcttcgctggtgggcgctggcggttcgtaggcgacatagagcagatcagcgccggcagcctgggcaaagaccggcggggtttcgccagtgacgccgaaatcaatggaaccgacgttcaggccttccagcaactgcgggccaccggggaactcggtccactgcacctgcacgccctgggcggcgaggcgtttttccagggagcccttggccttgagcagcaccagggtgccgtacttctgataaccgatccgcagcgtctcagcggcttgggcttgaacaatggcgccgaaggacacagccgcagcaaacagtgcgaccagaccacgacgcaagatgacagtgcgcatggcgctctctccacagttgcgattagggttttggctgcacctgcttggccgttgacggctgagtaaggtgagtatttctcgatattgggtgaggctcagatgctccagcgagcgctcaacaaacgttcattcaatacatcggggtccagtggtttcgggcgtcgggccatggcgctgtagagctgctccagggcctcgtgcagacgctgctcgagcactggcaccagttgcgcctggacgctgccttcgccataggcgatctggctgtcctcggcaaaaataccgtggagcaattcctgggctttgagggctgacaacaccggcttcaaggcgtagtccaccgccagcatgtgggcgatgctgcccccggtggctatcggcaacaccaccttatgcgccagggcgcgttcaggtagcaggtccaacacggttttcagcgcgccggagaacgacgccttgtacaccggcgtggcgatcaccaggccgtcggcattggccacctgttgcagcaggtcgatgaccttggggctgtcgaagcgcgcatgcagtaagtcctctgccgggaagtcccgtatctggtaactcaccacctccacgccctggcgttgcagccattgacgggttttatccagcagcaccccggagcgggaacgctggctgggactacctccaagtgttacgaccagcatgtagggaattccttaagcaagtgtcagcggttcgcggtgtggcgatggcgccaagatggaacagaccttagcagcagatttatatatctataaatcttatttattcatttgtttattccataaaaacatatgcgttttattattcgccaggcgaaaaaaaaggccgttaaaacggcctgaaaacccctgctatgtaagtaccagttgtaggagcgagcttgctcgctcctacagagggcttgtgcgtaacgccttaacggttgggttgtggggtgaggcgcaggtacggcttcacggcgcggtagcccttcggaaagcgtttcttgatctcttcctcatccttgagcgacggcacgatcaccacttcatcgccatcctgccagttggccggggtggcgaccttgtggttgtcggtcagttgcagtgagtcgatcacccgcaggatttcatggaagttacgcccggtgctggccggataggtgatggtcaggcggatcttcttgttcgggtcgatcacgaacaaggagcgcacagtgagcgtgtcactggcgttcggatggatcaggtcgtagaggtccgagaccttgcgatcggcatcggccaggatcgggaagttgacgatggtgtcctgggtttcgttgatgtcttcgatccacttgtggtgcgagtccaccgggtctaccgacagggcgatggccttgacgccacgtttggcaaattcgtccttgagcttggcagtgaagcccaactcggtcgtgcacaccggggtgaagtccgccggatgggaaaacagcacaccccagctgtctccgagccattcgtggaaacgaatcttgccggcgctggaatcctgttcgaagtcgggggcgatgtcgcccagtcttaggctcatggtgtggctcctgatggatgcttatggagcccactgtgcatggatctgggattttttaaaaagaataaatatcgatttatctagacgataaaggaatattaaaaatgtgttcattggacttgggtacaagcgaggaccaacattgttttcaaggttcgagaaggccttgagacgctgtaaaagagggttcaggaagggcttgcgggggttgagcccgacttggacaagcaagacaccttgcccggcattgcgccgggcaaggttttacaggcttacaacagcgggatcgagtagctgacgatcaggcggttttcgtcctggttacgtgcgttggcgatatcgctgcgccacatagcgtttttccacgccacgccaacgttcttcagcggaccttccggtacgacgtaggcaacagtgatgtcacgttcccactcggactggccggtgaactcggcacggttgctggcaacggtgtcgatatggtcgcccttgaggtacacgacgccggcggtcaggccaggtacgccgaccttggcgaagtcgtaggagtagcgagcttgccaggtgcgctcgccagcacgggcgaatttctggatctgcatgtcggtagtgatgtaggccgacgagccgtcaccctggttcaaccaagggaagtcgctgctgccgttgctgacctggtaaccgccaccgaaggtgtgaccggcaaccgagtacaggaacagaccgctgtacaggttgttatccaccttgccacgaccgttgttgacgccaccgtagttacctgtggagaagtaggcagactggttgccattgttaccgtcgtcggagctgttgaagtaacgcaggtcggacttcagcacgccagggccgatagcccagttgtgggtcaggcccaggaagtgttgcttatagaaatcttccaggttgccgtagtagtactgggcggtcaggtccttggtgatcttgtagtcaccaccggcgtagtagaacttgttgctcgaacgccagttcgcaccacggctgttggcgccggagatggacaggctttcgttgttgctggagttacggcccttggctttttcgatctggccggcgaccagggtcaggtccttgatgtcgctggaggtgatctggccaccctggaaggtctgcggcagcatacgaccatcgttggtgacgatgaccggcagcttaggctgcaaggtacccagcttcagttcagtctgggagatcttggctttggcagtcagacccaggctcgagtagttatcaacggcttcgccattggacttgctcgggaagatggtgccgccgtaggagctggcagttgcgccgttggtaccgccgccggagtccaggcgaacacccagcaggccgatagcgtcaagaccgaagccaacggtgccttgggtataaccggagataaagcgcagatcgaagccttggccccattcttcgttcttgctcgggttggcggtgccttcacggttatcggtgttgatgtagaagttacgcaggcccagtgtggccttgctgtcttcgataaagccggcagcgcctgcttgctgggcaactgcgcccagggctacagccagtgccaaggtggacttattcatgtaccgctcctctcatttctaatttttgtatttctttggtcccgggtctgacgccctggatccacagatgcgcgattagcgccagatagtgactgccaagtcaatcgtaaccttgtgtgtctactaccttggtctaatcgcagttgatttggtccctgcagggtaatgagtttttcatacacccaaaaagaattatttcattctttttcatacgatccaggaataagactttccatgcagcagacgggtcaggatagactctccgctccataagctaattcctaaagggtatttaccagtgcttttttagatcgattagtgtgaccgtacggttgcacacgtcactcacgatcaaaaaggcgacgccatcatggccaaacgcacatcctcccgtcaatttgttacagtttttgtatcgctaatactttcttttagtgtcagtgccgccgatttaaccgtcggttatcaaaccggcatcgaccccagcaaagtcccccaggccgacggcctttatgaaaaaaccattggcgagaaaatcgcctggcgccggttcaacagcgggccggaggtggtcacggccattgcctcgggtgatgtacaaatcggcaacctcggctccagccccctcgccgcagccgcttcgcgcaatctacccatcgtcgcgtttatcgtatcggcacagatcaacacttctgaagccttggtagtgcgtaatggaagtggcatcgacaaacccgaagacctgatcggcaaaaccatcgccacgcccttcgtctcaacctcccattacagcctgctcggcgcgctgaagcactgggggctggacactaaacaagtcaaagtggtgaacctgcaaccggccgagatcgccgccgcctggaagcgcggcgatatcgacggcgcattcgtgtggtcaccggccctgggcgaaatccgcaagaccggcaagaccctgaccgatgcggcgcaggtgggccaatggggcgcaccgacgtttgaagtgtgggtcgcgcgcaaggatttcgccgaaaaacatcctgaggtagtggccaagtttgccaaggtcaccctcgattcattcgccgactatgccgcccataaagaaagctggacggtggattcggaaccggtgcagaagatcgccaaattgacaggctccaacgccgtggatattccagagttgctggcgggcacgacgtttcccgatgcgcaggcacaacagaccgacgccctgctcaagggcggcacggcgaaggcgattggggagacggcgaagttcttgaaggagcaaggcaaggtggagacagtgttgccggattattcggcctatgtgaccgacaagttcatcacagaataaacgcggtccaatgtgggaggggcggtgcgacgattcgacttgctcccgattgcggtctgtcagtgacttatctgttaactgacccaccgctatcgggagcaagtcgaatcgtcgcaccgcccctcccacatttacaacgctttctcgaagatcttggagttgcgctgatagttgtaaagagaagcccgcgccgacggcaggcggtccacgctgctcggcacgaacccgcgctctcggaaccagtgggccgtacgagtagtgagcacgaacaacgtcttcaacccctgggcccgggcccgggtctcaatgcgctccagcaattcatcgccgcgcccaccgtggcgatattcagggttaactgccaggcaagccaactcccccgcatctgaatccgcaatctggtagagcgccgcgcaggcgatgatcatgccttcgcgctcgaccacgctgaactgttcgatctcacgctccagcacttcccgcgagcggcgcaccaggatgccctgctcctccaacggactgatcaggtcgagcaagccgccgacgtcttcaatcgccgcttcgcgtaccagctcgaattgttcctgggccaccagcgtaccgccgccgtcccgggtgaacagttcggtaagcaaggcgccgtcttcggcatagctgacgatatggctgcgccccactcctccccggcaggcttgcgcagcggcatcaagcagctcggcttgatagttgctgcccaggcgttgcaggtgcgctggcacttgctgtgggcgcagctcacgcaccaggcgaccgttttcatcgatcaggcccaggtcggcaccaaacaacagcagcttgtcggcgcccaaatcgatggcggcgcgggtggcgacgtcttcgcaggccaggttgaagatctcaccggtgggcgaataacccaatggcgacagcagcacgatggaacgctcgtccagcaggcgattgatgcccttgcggtcgacccgacgtacttcgccagtgtgatggtagtcgacgccctcaagcacaccaatcggccgcgcggtcaccaggttgccgctggccacccgcaggcgcgagccctgcatcggcgacgaggccatatccatggacaagcgcgcttcaatggcgatacgcaaatggcctactgcatcgatcacgcactccagcgtcgaagcatcggtgatgcgcaagccttcgtggtatgccggggtcaggccgcgggcctgcaggcgggtttcaatctgtgggcgcgaaccgtgcaccaacaccagccgcacacccaggctgtggagcagcaccaggtcgtggacgatattgccgaagttggggtggtccacaccatcgccgggcagcatgaccacaaaggtacagtcgcgatgggcgttgatgtagggcgaagcgtggcgaagccaattgacgtattcgggcatggaacctgggcctgtaataaaaagcagccgaaaaatggatgagtcgcaaaaacgcacagcgggctgatggttatcgtcggaacaggcttggcgacacgctcgctctccttatgtacgaatgggcaaaggttaatttatgcaggtttcaggcagtaatgttcgaccagttcccgcaatagacgcactgtaggcgtcaagcgtgacatttcgaggtactcgcccggctggtgggcacaggcgatgtcgccggggccaagcaccagggtttcacaaccaaggcgctgaagataaggcgcttcggtgccgaacgctactgcttcggcacgatgaccggtcaaacgttccgccacccgcaccaactcggcgtcctcaggctgctcgaaaggcggcacttcgggaaacaacggcgcgtaatcgatcttgaccttgtggcgctcggccaggggttcgagcttctgccggatcgccgcacgcagcacctcggggtccatgcccggcaaagggcgcaggtcgaattcgagggaacactggccgcaaatgcggttgggattgtcgccgccgtggatgcagccgaagttcatggtcggttgcggcacgctgaattgcgcattgcgatactcgcgctgccaggccaggcgcaggccgcgcaattcgccaacggcatcgtgcatcgcttcgagggcgctgtggcccaggcttgggtccgacgagtggccgctgcggccgaggatgtcgatgcgttccatcatcacgcccttgtgcaggcggatcggcttgaggcccgtcggctcgccaatcaccgccgcccgccccagaggccgccccgcctcggccagggcgcgtgcaccggacatggagctttcctcgtcacaggtggcgaggatcagcagcggctgcttgaacggctggtccagcaacggcaacacagcttcaatggccagggcaaaaaaacccttcatgtcgcaactgcccagccctacccaacggccatcgacttccgtcagcttgagcggatcggtcttccacagcgcctcatcataaggaaccgtatcgctatggcccgccagcactaagccaccggggccactgccgaaactggcgagcaggttgaatttgccagggctgacttgctggatgtcgatagcaaagcccaagtcgcccagccacgcggcgagcagatcgatcaccgggcggttggtctggtcgagcgacgcttgggtgcagctcaccgacggcgcggcgatcaaggcggcgaactgctctttcatggacggtaacggcatgcgcggtctcccaacttcccggatgaacctcactatagaggcatctgcacgacacaataaaccgttgcgccacgttgcctggctcagtcctgtacactgcacgaccttggcagccacatttttccccggctgcgctcccgatcctggattttccggccatgcagaaagaaaccgaaatcaagctccgcgtcagccgcgaaaccctcgccgcgctgcgtgagcacccgctactgaaaaaacgcaacaaaagtggctgggaacgccgtgagttgatgaaccagtacttcgacacccccgagcgcgacctggcccaggccaaggttgccctgcgcctgcgcaaggacggtgacgacatcatccagaccctcaagacccgtggccaaagcgtcgccggcttgtcggaacgcaacgagtacaactgggacctgcccaaagccaagctcgacgtgaagaaactcgacggcgaatgctggcccgagcaactcgctgagctggacaaaaagaccctcaagccgatcttcaccaccgacttcgtccgcgaacgcgccgaaatcgcctggggccgcggcaaggccaaggtggtgatcgaagccgccctggacctgggccatgtggtggccggcaagcagaaggaagaaatttgcgagctggaactggaattgcgcgaaggcgaacccgctgccctgctggaactggccgccgaactggccgcgaccctggcgctgatgccctgtgacatcagcaaggccgagcgtggctatcgcctgtacgatgccagcagctactccctgagcctgcctgcgccgcagatccacgccgaaatgccgctggacgatgctttcgccgcaatcatgtggcacctgctgggcagcagccagcgcctggccgagcaataccgtttcaacggccactggcgcctgctgcaggactgggtcgaaaacctcggcgaactgcgcgccctgatcggcagcctcggccaggccgctccgcgtcagtccaccagcgagctgcgcagcgccctggatgcactgctggaagactggcgcccgctggttcaggccggtgatgacgatgaagacattcgcaaagccgcgccggagcagttcgtcgaagaactgaccgacgtgcgctggggcctgttctcactgaacacctcgcgctggctgctggcccgcacctggaccgccgagcgtaacgtgcgcggtaaccgccagggcgctgcgcaaatcaccaactggctgccacgcctgctggccgatgacgccgtcgccttgcaactgccacgctaccagcaacagccggaagacctggccgagcaactgccgcgcatcgaacgcatccaggcctggctgcaccatgcgcgtcatgtggtggacattccagaactggaccgcttgtacggcgagctgaacaagctcgcgcacctggctaaccagccgattaccgatgagtcgctggatgcgcgtatgcatcaggcgattgcggtgtatcagaatcgggcctggaagaccctcctgcgtctgtaacgctatctaccctgtaggagcgagcttgctcgcgaagatcgttaacgataacgcgcaaagcctggcacccacgttgctcttgagtttttcgcgagcaagctcgctcctacattaagggccctgcctgtcagcgcaatactggcaggctggtagtggacttgatctccgacaaagccacaatcgaattgacctcctggatccccggcaccatcgacaacttgtcaaagaaaaaccgttcgtacgcctcgatgtccgacgcgacgatacgcagcagaaaatccaccgctcccatcagcacataacactccagaacctccggaaacccacggatcgcctcggtgaactcggtgaagttggagcggccgtgggcattgagtttgacctcggcgaaaatctgcgtgttaagcccgattttcttgcggtccagcaaggtgacctggccgcggatcaccccctcttccttgagccgctgaatgcgccgccaacagggagactgcgacaggccgacctgctcggcgatctgagcgctggagagcgaggcatcctcttgcagcagggccaggatgcggcggtcatagacgtccaactcgctgtgcattgaaatacctgcaaataagcttattttgaattgttcgatttgattaatcgcaaaagaagctcatcttagataagaattctcccgaggcgaatgtaaaaatttctccagtcgaatctggagagtcagcatgcatgccgttgaaaccaaccaccctgccacccgtgtcgatgcctgggccgtcaacagcgcccattgccaggcgcactatcacatcgtcgcagaagcagaaccggacgtgctgtgccgggtgctgaactatttcgcgctgcagttcctgacccctgcccaggtcagtgtgagccgggcagccgacctgctgaacatcgatatcgtgatggacggcctgagctggcaccgcgcccaagtgatcggtgaaaagattcgaaacctgatcagcgtatgcgacctcaagctttggtcggctgatgtcgagcggcctcaagcgctggcggcaagtgctgggtaatagcctgcaaaacacccagggaggaggaattccagaggctggctagccttggatttacatcccaagcctcccaggaaaaacctgcatgtccgttgcctctcgcgattaccccttggaactgcatcaattgttgccggcattgatcgagcaagggctgatcacagcgcaggcggcgcaaaacgtttcggcagtgccctgcagcctgcatcccctggaacgcatcgcggccgaaggcccttgcctggagagcctgacccaatggctggctgggcatgtgggccagccttacctgcgcatagacccgttgcagatcgacgtagcaacggtggtgcccctgatgtcccatgccttcgcccaacgccacggcattcttgcagtggccgtggatgctcagagcgtcacggtcgccagcgcacagccccatgtcagcgcctgggaagccgggctcgcccaggtgctcaagcgttcgatcaagcgcgtagttgccaacccccgggatatccagcgctgtatcaacgagttttaccgcctggccaagtcggtcagtggcgccgatcaaaagatggcgacgcctggcaaagtcgaattgcttagcctcggcgccagcgacaaggagccggatgccaatgacgcacatatcatcaacatcgtcgactggctgttgcagtacgcctttgcccaacgggccagcgatatccacatcgagccctgccgcgatcagggccgggtgcgctttcgcatcgatgggctgttgcacgacgtctatcaatttccgccccaggtcaccaaggcggtggtcagccgtttgaaaagcctcgggcgaatgaatgtggccgagaaacgcaagccccaggatggacgcgtcaagaccaggaacccggcgggcgtcgaggtggagctgcgcctgtcgaccctgccgacggcgtttggcgaaaagctggtgatgcggatttttgacccccaggtattgctcaaggacttcgaccagttgggcttgtcgaacgctgaccagcagcgctggcacgccatgacccggcaagccaatggcatcatcctggtcacgggcccgaccggctcgggcaagaccagcaccctctacaccaccctcaagcaactggcgactcgggaagtcaacctgtgcaccgtggaggacccgattgaaatggtcgagccggccttcaaccagatgcaggtgcagcacaacatcgacctgaccttcgccagcggcatccgcgccctgctgcgccaggacccggacatcatcatgatcggcgaaatccgcgaccaggaaaccgcagagatggcgatccaggcagcgttgaccggacatttggtgctctcgaccctgcataccaacgacgcgcccagcgccatcagccgactacaggaactgggcgttgctcattatttgatcaaggctacgctgataggcgttatggcgcagcgcctggtgcgggtgttgtgcacccactgcaagcgcccggcagcgctggaagatgttggcggcttcgaggcggttggctgtgcggaatgtcgtgacagcggttatcggggccgagccgggctctacgaaatcatgctcatggacccggcgctcaagagtttggtcacacccggcgcggacatacaggcactgcgccgcggggcattggcgcagggcatgagcagcctgcgcatggccggcatcgataaagtgaaggccggcctgaccacgatgacggaggtattacgggtcacgcctggagattcagaaacaaatcctttgtttgttgggccgtgaaaccgtctttatccgtgaccagaccgttacaatcggcctaatgtcgttcactgacaccttcagatagggaatcgttatgcagatcggaaccgtactgcttcttttcgtgggattggccatcgccatcctgttcatgggtttcaaagtggtgccccaaggctaccagtggaccgtcgaacgtttcggtcgctacaccaacaccctcaagcccggcctgaacatcatcatcccggtcatggaccgcatcggtcgcaagatcaacgtgatggagagcgtgctggatatcccgccccaggaagtcatcacggccgacaacgccaccgtgcagatcgatgccgtgtgcttcttccaagtagtcaacaccgcccaggccgcctacgaggtcaacaacctcgaacatgccatccgcaacctgctgcaaaccaatatccgtaccgtacttggctccatggagctggatgccatgctgagccagcgcgacggtatcaacgaaaaactgctgcgtactgtggatgaagccaccgcgccgtggggcatcaagatcacccgtatcgagatcaaggacatcagcccacccgccgacctgatggccgccatgtccggccagatgaaagccgagcgaatcaagcgtgcacagatccttgaagccgagggcctgcgtgcgtcggcaatcctgaccgccgaaggcaagaagcaggcgcagatcctcgaagccgaaggtagccgtcaggccgcgttcctggagtccgaagcgcgtgagcgtcaggccgaagccgaagctcgggcgacacaagtggtgtccgaagccatcgcatcgggcaatgtgcaggcggtcaactacttcgtcgcgcaaaaatacatcgatgccttgggcaagctggcatcggccaacaacagcaaggtcatcctgatgccgctggaagccagccaggtgattggcgccgtgggcggtatcggcgaaatcgtcaaggcgactttcggcaaccagaaaggctgaggccaacaacatgtgggactttttgctgcatttgtcgttctgggattggttggcgctgggcaccgtgctgttgattctcgaggtgttcggtgccggaggctacctgctgtggatgggtatcgccgcggctgcagtgggggtgatcaagttcctggttccgccgctcgggccggagtggcaactgctgctgttcgccatgctgtcgatcctgacagccgtgtattggtggaagcgccaacgcagcagcgccaaggtcagcgatcaaccggggttgaacgagcgtggctccgaattgattgggcgcaccttcatggtgcatcaggcgattgtggatggccggggcaagattaaagtcggcgatggcgtgtggatggtcaccggtgccgatgccccagcaggcgctcaagtacgcgtgattggccaggatggggtgattttaaaggttgaaactgtttagtcagtgatggaactggatcggcttaactacaatcaaaacgtacagataacccaccggagtcacccatcatgcgtcttaaatatgctgtcgccaccctcgctgtgctttcccttcctgtcggctcagccatggccgatagcttctggcgtaatgtcatctcgtcgggcgccaccaccggctcgacttacctgaccttcaaggaccacaagctggtcgttgccgcccaggatgatgcaggcagcttcgttgccagcgacggcggcattcgcggcccgtacctggaagcggccatgcagaaagtccgcgccgataaccctggcctcaaggccacggacatggaactggctaacgccatcctggcgaagaatgctgtaaccgagtaacagccgcaccgataaaaaatgccgctttttcaagcggcatttttttgcctgccctatgacgaatcgttcataagcgacaggctatattcagtcttgccgtgcaaccatgcgttactgacacgtttaacattcatcgcctatcttgaacggatgccttcttcgtcatgagccaacagcctttcctgccgttttccaaaccgaccattgatgaagccaccatttcggcagtcggcgatgtcctgcgttcaggctggatcaccagcgggccaaaagtgcaggcgttcgaggcgcagttgtcggaatactttggcgggcggccggtgcgcaccttcaattcgggcacctgcaccatggagatcgccttgcgcatcgccggtatcgggcctggggatgaagtcatcacgacaccgatttcctgggtggccactgccaacgtcatcctcgaagtcggcgctactccagtgttcgccgatatcgacccgatcacccgcaacattgacctggcccaggttgaggcggcaatcacaccacgtaccaaagcgatcatcccggtctacctggcgggcttgcccctggacatgccgatgctttacgcgctggccaataagtacaacctgcgtatcgtcgaagacgccgcgcaagccttgggctccagctgggacggggaacgcatcggtgcaaccggcgacttcgtgtcgttcagctttcaggcgaacaagaacatcacctcatccgagggtggctgcctggtgttgaacaacgccgaggaggcccgcctggcagagaagtatcgcctgcagggcgtgacccgcagcggtttcgacggcttggatgtggatgtgttgggcggcaagttcaatatgaccgacattgccgcagccattggcctggggcagtttgcgcatatcgagaagatcaccgcccaccgccagaacctggcgcgccattacttcaagtgctttggcagtgattttgaagaaaagtacggcgcgcaactaccgccgccggacttcgaaaacagcaactggcatctgttccaactggtgctgccggagcgtcacgatggcctgcaggcacgtgcgacgttcatggagcagatgcaggcccagggcgtcggcattggctatcactacccgcccattcacctgctgagcctgtatcgggcgcagggtttcaaggaaggcatgttcccggtggcagagcgtgtcgggcgtttgatcgtgtcgttgccgatgtttacggcgatgacggaggcggatgtggagcgggctgtggcggcggttaaagcagtgttgaaagccggctgagcacttattaaatgtgggagggggcttgctcccgattgcggtgtgtcagctacaagtgagctgactggcacaatgctatcgggggcaagccccctcccacatgggtcttgcttttactcgctgatagtggctgcgtaaccggcagcgtcaagcagcttgtccagctcggccgggttgcttggcttgagcttgaagatccacgcatcgtagggggcagagttcaacagctccggactaccacccaactcttcgttgaccgcgatcacttcgccagcaaccggcgagtagatatccgaagcggccttcaccgactcaaccacacctgcggcatcgcccgcggcaaacaccttgccaatttccggcatttccacaaacaccacatcgcccagagcatcctgtgcatactcggagatgcccaccacgataagatcaccctcctttttcgcccactcatgactttcggcaaaacgcaggtcggcagggatattgctcatagtctgtgtcctcaagaagaaatgtcagcggccttcggcctgccggaaaatagttagatcaaggttttgccatggcgcacgaaggtcggcttgaccactcgcaccgggtaccatttgccgcggatttccacttcggcccggtcggcagtcgccgtcggtacacgcgccagggcaatggatttgcttagcgtaggcgagaaactaccactggtgatctctccttcgccaacattggcgatacgaaccacctgatgagcccgtaaaaccccgcgctcctcgagcaccagccccaccagtttgaactgcacaccggcggctttttctgcctccagggcggcgcggccaatgaagttgcgtccgacgggctcccaggcaatgctccaggccatgttggccgccaggggcgaaacagcctgatgaatgtcctggccgtacaggttcatgccggcctccaggcgcaaggtatcgcgggcgccgaggccgataggggaaatgccggcacccaccagatcgttgaaaaaccccggggcctggtcggcgggcaggacaatttccaggccatcttcaccggtatagccggtgcgggcaatgaaccagtcaccgtcggcctggccttcgaaaggcttgagctgatgaatcagggtgccacgggactgggtcaccagttcagcgattttctgccgggcgtggggcccctggatggcgagcatggccaactcgggccgctcatgcagttgcgcctggtaactgcccaattgcccttgcatccaggccatgtcctgatcgcgggtggcggcgttgaccaccagtcggtaaccgctttcggtgcggtagacgatcatgtcgtccactaccccgccctgctcgttgagcatggcgctgtacaacgcacggccacagccgtgcaatcgatcgacatcattggccagcaagtgctggagccattccttggcctgaaggccgctgacatcgattacggtcatatgagatacatcgaaaaccccgcagtcgcgtcgcacctgatggtgctcttcaacttgcgagccgtaatgcaaaggcatatcccaaccgccaaaatcgaccattttcgcgccgagggcgagatgcaggtcatacagaggcgtacgctgtcccatgggtttctccttccgggcttggcgaaggtgcgcagagctgccacctgcgccgaacaccctgaattacaaggcccacaggcacatacagcaggtcgacccgaaagacggagcgcaccgaatgccgcgcattgtagcctcaagctgtaggactggcacctaaccgatttgtcgggcagagcggcgaatcagcccgatgaccggcaacaacccgaccagcaccagggtcagcgccggcaaagaggcccgcgcccattcgccttcactggtcatttcaaagatccgcaccgccagggtgtcccagccgaacgggcgcatcagcagggttgcaggcatttccttgagcacgtcgacgaacaccagcagcgccgcgctcaaggtgcccggcaacaacaacggcagatacactttgcaaaacagtcgtgggccgctcactccaaggctgcgtgcagcttcgggcagcgacggacggattcgcgccaggctgttttccagcggcccgtaggctacggccaggaatcgcaccaggtacgccaacaccagtgcagacaggctgcccaacagcaagggcttgcccgcacctcctagccagccggacagcggcaccaccagctcacggtccagatagctgaacgccagcatgatcgacaccgccagcaccgagcccggcaaggcatagccgacattggccaggctgatgccggagcgaatcgcccgggtcggcgccaggcggttggcaaaggccagtaccaacgccacgctgacggtgatcagcgccgcgataccgcccaggtagagggtgtggacgatcaggccggtatagcgctcatccaggtcgaagcgcccgcgctgccagaaccaggccaccagttgcagcatcgggatcacaaacgcgcaggcgaagaccaggccgcaccaggcgctggccgcagccgctttgagcccgcgcaggtggtacaacgccttgcctcgtggtcgctcattgctcggtcggctcgccccacgcgcgcgccgttcgccatacagcaccagcatcaccaccagcagcaacaggctggccagctgcgcggcactggaaaggctgaaaaaaccataccaggtcttgtagatggcggtggtgaaggtgtcgaagttgaataccgagacggcgccgaaatccgccagggtctccatcaaggccaaggccacgccagcaccaatcgccgggcgcgccatcggcaaggccacgcgccagaacgcttgccagggcgactgccccagcacccgcgccgcttccatcaagcccttgccctgggccaggaacgccgtgcgcgccagcaggtagacgtaagggtagaacaccagcaccagcacgatgatcacgccactggtggagcgcactcgcggcaaacgcagcccggcaccgaaccattcgcgcagcaaagtctgcacgggccctgcgaaatccagcaggccgacgaacacaaaggccagcacataagccgggatcgcaaagggcagcatcagcgcccaatcgagccagcgtcgcccggggaattcgcagaggctggtcaaccaggccaggctgacacccaacagtgtcacaccaagaccgacgccgagtaccagggtcaaggtgttgcccagcaatcgaggcatctgagtatcccagagatgggaccagatctggtggtcgatgctttgccaggacagcagcagcacgctcagcggcagcagcaccagggcggcgacggaaaagaccggcaggtaccaacggcgttgggcggggtgggccaaggaaaagctctctatgaacagactattcaaagacaaacacaaaacaatgtgggagggggcttgcccccgatagcggagtgccagtcactgatgattagactgacactccgccatcgggagcaagccccctcccacatttagatctgtggcaatttacacattcagttccagccggcgcgatccatcaggcgaatggcctcggcctgacgcttgcccgccacttccaccggcaaggtatcggccacgaacttgccccagctcgccacttccgccgatggcggcaccgccgggttggcggggaactcctggttcacgtcggcaaagattttctgcgcctcaggcgtagtcatccactccaccagtgccttggccgcttccgggtgcggcgcgtgcctggtcaggccgatgcccgaaaggttcacatgcacgccacggtcgccctggttcggccagaacagtttcactgccaggtccggcttctgcttgtgcaggcgaccgtagtagtaggtgttgacgatacccacgtcgcactgcccggcgtttatggcttccagcacggcaatgtcatcggagaacacgtcggtggacaggttgttgacccagcccttgacgatctcttcggtcctggccgcgccatgggtttcgatcaaggtcgcggtcagcgactggttatagacctttttcgccgtacgcaggcacaggcggccttcccactgcttgtcggccagggcttcgtaggtggtcagttcgcccggttttacccggtcggtggaataggcgatcgtgcgtgcacgcaggctcaaaccggtccaggcgtgggccgatgagcgatattgcagcggaatattcttgtcgatgacggcagaggtgaagggttgcaggatgtccatctgttcagcctgccacaggttgccggcatcgacggtgagcagcaggtcggcggtggcgttctcgccttcggccttgatgcgctgcatcagcggcgcttccttgtcggtgatgaacttgacctgcacgccggtcttcttggtgtaggcatcgaaaaccggcttgatcagttcgtcgatacgcgaggagtagaccaccacttcgtcggccgcctgcacggtagtgctgccgatcaggatgagtgccagggcagtcaggaggcgcttgggtgccaacatgggtgcggtctctctcatttgcaaattgagggcaaatgataaggactcacatttggtaacgctcggcggaggcgttaccagatgttgcacagcccgaatatgcgcgaggattgagtgcctcatcgggggcaagccccctcccacaggggactgtattttaattcagggtttagcgagttctggtagatcgccagtcaaacctagcgcctggcgcacaaacactgccttggcttcgggcatctggtcgacgattttcaagccggtattacgcaaccagcgcaacggcagttgatcagcctggaacaggcgctcaaagccttccatcgccgccatcaacgccaggttgtgcggcatgcgccgccgctcgtaacggctcagcaccttcacgtccgccaggcgctcgccgcgctcggtggccgccagcaatacttcggccaacaccgccgcgtcgaggaagcccaggttcacgccctgccctgccaacgggtggatcacatgggccgcgtcgccgatcaacgccaggccctcggccacatagcgtttggcatggcgctgacgcaacggcacgcaaactcgtgggtcggcgctgatcacagtgcccaggcggccttcgaaggtacgctcgagttcccggcagaagcgttcatcatccagagccatcaggcgctcggattcagccggcgtggtcgaccagacaatcgagcaccagtcttcctgcccatcccgtaccagcggcaggaacgccagtgggccggtatcggtaaagcgttgccaggccgtgcgctggtgcggctggctgctgcgcacgctggtgacgatcgcgttatgcaggtaatcccactcgcgggtcggggtgccggtcaggcggcgtactgcggagttggcgccatcggcggccaccaccagcggcgcacgcaacttgcgcccatcagccagggtcagcagccagtcatcgccggagcggcgcatctgctcaaggcgcgcattggccagcaggccgaggtcgcagtcgtgcaggcgctccagcaaggcatcctgcactacgcggttttcgacgatatgcccgagcacctcggcatgcacgctggccgccgagaagtggatctgcccggtgccgctgccatcccacacctgcatctcgccgtaagggctggcgcgacgctcgacgatgccgtcccacacgcccaggcgttcgaggatgcgctggctggcagccgacaacgcgctcacccgtggttcaaacgccgcatctggctcgaacggtttgacactcaaggggctgccgtcgagcagcagcacctgcaagccactgccctgcaacgccagcgccagcgcgcttccgaccattccggccccgacaatcagcacatctgcgtgcatgtccatgctttaagccttgtctcgtgtgcggcacaggccgccgataaagtagtgggccggttcagacatcggcgcgcgtgcccaggcccatggcctggcgggcgaaccagcgtttggccggcggcaacaggtccaggcccagcaggcccaggttgcgacccagcgccatcaacggctggccgctgccaaacaggcgcgtgacctggtcggagaaacccacggtgagttgctggtccagacgctggcgctcgcgatagccttgcagggtcgccaggtcgcccggcacggccggcccggccagcaacgcctcggccaaggcattggcatcgcgcagggacaggttgaagccctgcccggcaatcgggtgcaggctgtgcgccgcattgccaagcaccgccaggtgcgagcgcacttgctcttcggcttccaccagggtcagcgggtacaggtgacgggcacccacctgcttgagggtgcccaggcgatacccgaacacaccctgcaattcgctcaggaagcttcgctcgtcaaggctggccaggcgctgggcgtccatgccgatgcgggtccagaccagcgcgcaacggttgtccggcagtggcagcaaggccatcggcccttcatcggtaaagcgctcgaacgcttcgccattgtgggcttcgctcggagtgatgttggcgatcagtgcgctctggttgtagggccggctcttcacgccaatacccagttgctcacgcaaaccggagcggccgccatcggccagtaccgccaggtcgcactccagcacggtttcatcgttgagagtcaggcgatagccatcgggcagtggttccatgcgtgtgacttccgccgggcagcgccagctcaccacgtccttgtccaggccttgccacaggcattggccgagccaggcgttttccactacatagcccagggccggcacgccctcttccatggcggacaaacgtgccgtggagaaacgcccacggtccgacacatggatttgcttgatcggctcggcacgctgggagatggcctgccacaagcccaggcgctggtaaatctggcgggcgccaaacgacagcgccgaagagcgcgcatcgtagctcggctggtagctgtcacccggcgcaaagggctcgatcaacacgatcttccaaccccgcgtcttggccccggcctgcaacgccagggcgaggctggcgcccaccaggccgccgccgatgattgccaggttgacccggctcatcgggcagccgccatgagcgcttcgatctcggcaacggttttgggcacgccgccagtcaggatttcacagccttgcttggtcactatcacgtcgtcctcgatgcgtacgccaatgccacgccatttctttgccacgttctggttatccggggaaatatagatgcccggctccacggtcaaggccatgccgacttccagcacccgccattcaccgccgaccttgtactcgcccacatcatgcacatccatgcccagccagtggccggcgcggtgcatgtagaaagcgcggtaggcctcgctggtgatcagctcgtcaacgtcaccttgcagcagccccagcttcaccagcccggcggtgatgacctgcacggtcgcctcgtgggcctggttccaatgtttgttcggcgcgatctgcttgaaggcggcttcctgggaggccagcacaatctcgtagatcgccttttgctcaggcgaaaacttgccgttgaccggccaggtgcgggtgatgtcgctggcgtagcagtcgatctcacaaccggcgtcgatcagcaccaggtcgccgtccttgagcagcgcgtcattctgctggtaatgcaggatgcaactgttgcgcccggcggcgacgatggagccataggccggcattttcgcgccgcccttgcggaattcgtaatccagctcggcttccaggctgaactcatgcagcccggcacggctggcctgcattgccctcacgtgggcagcacaggaaattcgcgccgcctcgcgcatcaccttcacttctgccgccgatttatacaggcgcatatcgtggagcagatgatccagggcaacgaattcgttcggtggctgggcgcccaggtgcgccttggatcggatcacgttgatccactccatcacatgccggtcgaattcggcgttgctgcccatggccgaataaacccggtcgcggccttcgatcaggccgggcaggatgtcgtcgatatcggtgatagggaatgcgtcgtcggcgccaaagtcacggatcgcgccttcagtgccggcgcgcaggccatcccatagctcgcgttcagcgttgcgctcacggcagaacaacacgtattcgccgtgctggcgaccgggcatcagcacgatcaccgcctcgggctccggaaagccgctcaggtactggaagtcgctgtcctggcggtacacgtgctcgacatcgcggttgcggatggccacggcggcagccggcaggatcgcgatgctgttgggttccatctgcgccatgagcgccttgcggcgacgggtgtattccgctttggggatatgaatcatgggcagatgggcttcctttcttagtgcaacgacggcttggccgcgaccggttcagcggactttctggtctcggtgaacagcagcaacggcgcgacgcgcaggtattccatgacttccatgtagtcgccttcgccgtcttcggattcttccagggcatcttgcacctgggagatggctgccaggtcctgcagcacttccttggcgtcggtgctcagctccaggccgccggcgttaacgccgaaaccgtggaggaaaccctggcaccactggcccagggcggcagcgcgctcggtgagcggcgcgtcatcggtcggcagcagcaggaccacggtgacgtcgtcaccggtcagctcgcccttgaccatctcttgcaggccaatcaacgcgttgcgcacgttttcgttgggttcggtttccagcagctcggctacatcagccagccagttgtcggcatcaaagcccacaccggtgcaactgcggcccaacagcacgccgtgcagttcggcaggcgagcatgggtgaccgctggtgctcagcagttttgaaaaagcgtcgtacggggaattctgaatgggcatggtgagctaggcgccagacggcgcaatgtctagaatggagcgctgtatcctagcaccggcagacgcaccaagactatcgagggcgtcagatcgtttatcctgcagttgccattcatcagacaaatccagtggaacccaatggaagacaccgacctgcaagcgctgatggccagactcgaactgctaattgatcgggtcgagcaactaaagagtcaaaacggactcctattagctcaggaaaagacctggcgcgaggaacgcgctcacctcattgaaaaaaacgaaatcgcccggcgtaaggtcgaatcgatgatttcgcgcctgaaggccttggagcaagactcatgagttcaagcaatagcgtaaccgtgcagatcctcgacaaagaatattcgatcatctgcccccaggaagaacgcagcaacctggtgagtgctgcccgctatctggacggcaagatgcgtgaaatccgcagcagcggcaaagtcatcggcgccgaccgcatcgccgtgatggccgcgctgaatattacccacgacctgttgcataagcaggaacgccctgacgtacaggccagcggctcgacccgcgagcaggtacgtgacctgctggagcgcgtggatctggtgctttctaccgattcagacacacccaagggctgattgccgagtctgtttaaggtatactcgcgtcactccctggcgtgtttgccagtcggcgatgtccctgagccgattcgcactaccctggaagttgcacgttgggctggtgtgcatgtccgctagacggaaagccttaaagcctactgcttcttccaccttgaactttcgggttcaagggctaagtcgacagcggctctgtcggggagcctgaatttccaaactcaatgccagtcccaggactggcattgttttatgagccgaaaaaccatgaccgaacctgcgccgctttcccgtccgcaacttcgacgcatgttgcgcaaagcccgccgggcactcacgccgagcgagcagcgccaggccgcccttggggtgtatcggcaactggcacagcacccgctgttacgccgggccaaacatatttccttatatctaccgacggacggtgaaatcgatccgcgcttgctgctgcgtgcagcccagcgccggggcaaggccacctatctgccggtactgagcgcctggccgcgcaccaagatggtgttccagcgcgtgcggcctggggaaaagttgttgcccaaccgctttggcattcttgagccacgggtcaatgcccatcgccaacgccaggtgtgggcgctggatttggtgctgttgccgctggtgggcttcgatgatgtgggcgggcgcctgggcatgggcggcgggttctacgaccgcagcctggcctatctggcccgccgccatagctggcgcaagccgacgctgctggggctggcccacgaatgccagaaagtcgggcgactggcgcaggcaagctgggatgtgccgttggcggggacggtgaccgataagcagtggtatgtcgcagaaacgccgctggaaacagcggcgccttagttaatgcttcgagttaacgcttgaacggttgtggctgctgctgagccagttcaaccggtgcatcggtcttgttcgaccacaggctctgggcataaccggtggtcacgacgcccagaccaaacaaaataaccaaaatccatagtaaatccggtttacgttgcatcgattgccccccttcaggcatctcgtacacgatgacaacaacgttccaaagtagtccgttgcagctgcgtcaagcctaaaagcgcgcattctgcggcaacgtgaaccaacacgcaaaccttgacgccaaccgactgtcggtttgtgatggaattgcccgacaacttgcccaatgcctttttcaggagcccaaaaatggcctactggctgatgaaatccgagcctgacgaattgtccattgaggacctggaaaagctcggcgaagcccgctgggatggggttcgcaactatcaggcgcgcaactttctgcgcgccatggcggtgggcgatgaatttttcttctatcactccagttgcccgcagcccggtattgccggcatcggcaaaatcatcgaggccgcctacccggaccctactgccctggaacccgacagcccttatttcgacgccaaggccagcgcagagaaaaacccgtggagcgcaatcaccgtggcccacgtcaagaccttccccaaggtgctgagcctgggcgatttgaagcagcaaaccgcccttgccgaaatgccgctggtgcagaaaggcagccggctttcggtcatggcggtcacgcctgaacagtgggcggccatccttcatctgctttaactgaccgatatcaagaccctcacggggtaaacccgtcacactgggacgctaacgccgcaggatgcagccatgtctacgaaccaccgcacctcccgtcttttcgcctccgccctgatcgtcctgttgctgggggccggggcctttggttactggcgctcgacccaggaccgcctgcccgaaggcttgagcatgggtaacgggcggctggagtccaccgaagtgcagatcgccgccaagatccccgggcgcctggccgaagtacgcgtggatgaaggcgacaaagtgctcaagggccagctgctggcgcgtatggacacccgcaccctggaagcccagcgcgcccaagccgaagccgaggtgttgcgcgccaaggaaaacttcgccgccgccgaagccaacgtgcagttgcgccaaagcgagcaattgctggccagccaggaactcaagcgtacccaggagctgtaccggcgcggcttcgccagcagccaattgatcgaccagcaacaagcacgccagaacaccggcaatgcggcggtgatcgcggcccaagcccaagtcaacgcagtgaaggccgccatcggtgcggcccaggcccaggtcgcccagctcaccagcgaaatcgatgacagcagcctgcgtgcgcccatcgacggcatcatccagttgcgcctggccgagccaggtgaagtgctcggcgcgggtgggcgcgtgttgctgctgattgaccccaatgaccagtacatgaacctctacctgcccgcctccgtcaccggtcgtctgaccgtcggcagtgaagcacgcatcctgctcgatgccctgccgcagcaggcgttgccggccaaaatcagttttgtcgcggacaaatcccagttcacccccaaggaagtggaaacccgcgatgagcggcagaaactggtgttccgcgtcaaattgcacctgactcaacccagtgccgtgccgcaagccaagccgggcatgcccggcgcgggttatgtgcgcacagccgatatcgactggccggccaacctgcaatgagcggcctggcgctgcacgctactgggatcaaccaccgctacggcaagcaacaggcactgctcgacatcgccttcagcctgccggctggcacccgctgcgggttgatcggcccggacggcgccggcaagtcgagcctgctggggttgatcgccggggttaagaagctgcaggtgggccagttgcaggtgctcggcggttctatccaagaccgtcgccatcgcaacaacctgtacccgcgcatcgcctttatgccccagggtctgggcggtaacctgtaccccgagttgtccatcagcgagaacatccgtttcttcgccaccttgttcggcctgtcgaaagccgattgcgaccagcgcatgcacaacctgctgctcgccaccgacctcgcacgttttgccgagcgcccggcaggcaagctctccggcggtatgaagcagaagctcggcctgtgctgcgcgctgatccatgatccggacctgttgatcctcgacgagcccaccaccggcgtcgacccgctgtcacgccgacgcttctgggaactggtagacagcgtacgcagtgagcgcccgcaactgacactgctggtggccaccgcctacatggaagaggccgagcaattcgagcattgcctgatgctcgaccgtggcaggttgatcgccgatggactgagccgcgaactggcgacgataacgcccagcggcaagctcgatgaggccttcacccacttccagggcgacagcgcccacgacaaccaaccactggtgattccaccgcgcaccggcggcaacgccgatatcgccattcaagcccacgacctgaccctgcgctttggcgatttcaccgcggtgaacaaggtcagctttgccattggccgcggcgagatcttcggcttcctcggttccaacggttgcggcaagaccaccaccatgaaagtgctgaccgggctgatgccggccaccgagggcagtgcaatcctgctgggcaaaccggtagacgccaaggacctggcgacccgcaagcgcgtgggctttatgtcgcaaagcttctcgctgtatggcgagctgagcgtgcgccagaacctggtgctgcatgcgcaactgttcgacctgcccaaggccgacagcggcccgcgcattgatgagctgatccaacgcttcgacctcggtgaaatcgccgaccagccctccggcgagttaccccttggcctgcgccagcgcttgtccttggcggttgcggtgctgcatcgcccggaagtgctgatcctcgatgagcccacctcgggcgtcgacccggcagcgcgggatgatttctggcggttgctgatcgagttgtcgcgggaacaaggtgtgaccatcttcctgtccactcactttatgaatgaagcccagcgctgcgaccgcatctccttgatgcatgccggcaaagtgctggcctgcgacacacccgaggcgttgcaacagcagttccacggcgacaccctggaagcggctttcgtcacctgcctggaacaggcccaaggagaacccgaacccgcagccccccgggcaaccgtcaacgacacccacgcgccaccggtgagcaaacgcggtttcagcctggcacggtggttggccgtggccagtcgcgaaggcaaggagttgctgcgcgacagggtacgcatggcttttgccttgctcggggcgatgttcatgatggtgatcttcggctacggcatttccctggatgtggaaaacctcgccttcgccgtctacgaccaggaccagactccgcaaagccgcgcctacttggaagcatttcgcagttcacgctatttcgccgagcaagcccccatccgcgacgccaatgaattgcaccggcgcctgcaacgctcggaaatcaaactggccctggaaatcccaccgggttttggccgcgacctgtacgccgggcgccaaccgaccgtggctgcatggatcgatggcggcatgccgtttcgcgccgaaaccagccgcaactacgtcgaagcggtacaccaaggcaatctccagcagttggccgaattgagcagcctgccccgcagcacacaagccgcggtcaagctggaaacacgctttcgctacaaccaggacgtcgtcagcgtgaacgctatcggcccaggcgtgatggcgctgatcctggcatttatcccggcgatgctcaccgccctgggcatcgtgcgcgaaaaagagctgggttcgatcaccaatttctacgccacgccgctgacacgcctggagttcctgctgggcaaacaggcgccctacctcgccgtcagcctggtcaacctggcgctgctggtggcgatgaaccgctggttgttcggtgtaccgttcaaaggcagcggcttgaccctggctttcggtggcctgttgtacgtgctggcgaccacgagcatgggcctgttgatctcggcattcacccgcacccagatcgcagcgatcctcggcaccatgatcatcaccagcctgccgactatccagttttccgggctgatcgtgccgcgctcctccctggaaggcgcagcggcactgatgggcatgctgttccccgccgggcacttcctggatattgcggtgggtaccttcaccaaggctctggacctgcgccagttgtggccgcagtgcctggcgttgttcgggtttttcgtcggtttcaccgggctgagcctggtgatgctcaagaagcaggaggcctgatgcacaagctcgcccatatcctgcgcctggggctcaaggaactcaccagcctgcgccacgacagcgtgttgctgctatttctgttctacgccttcaccgtggcgatctacatgcccgctgccggctcggtgattggcgtgcacaacgccagcgtggcctttgtcgatgaagatcacagtgcgctctcgcgacaaatggccgaggccctgcagccgccagaattccaagcgccggcgccactggcctacgaccagctggacaaggtcatggacagcggtcagtacaccttcgtcgtcaatgtaccggcgaatttccaggccgatctgttggcggagcgccagccgggcgtgcaggtgaacgtcgatgccacggcaatgagccaggccttcatgggcgccggttacatcgggcggattttccaacgcgaactgctgacctacagcggccaggccgacgctgccggcaaagccccggccctgctgaccacccgggcgctgttcaataccaacctcgaaggtggctggttcctggcggtgatccagatcgtcaacaacatcaccatcctcgccatcgtgctgaccggcaccgccctgctgcgcgaacgcgagcacggcaccctcgatcacctgctggtgctgcccctgaccgcgctggagatcatgctggcaaaaatctggagcaacatgctggtggtggtgttgtgtacgtggctgtccctggaactggtggtcaaaggcttgctcggcgtgccgttggccggctccatgagcctgttcctgttggtgacggcgttgtatctgtttgcgagcaccgcgctggggatcttcctcgctaccctcgcccgctcgacaccgcagttcggcctgctggcgatcccggtgatcatcccgatgctgttgctctctggcggcagtacgccgctggacagcatgcccgagtggctgcagtgggtgatgcagggttcgccgtcgacgcactttgtgagtttgagtgcggcgattttattcagggatgctggggtgagcgtggtgtggccggatttgctggcgctggcggggattggcttggtgttttttgcggtggcgttggcgcggttcaggaagagtctggcgtcttgaggcgcctgaccgacagctatcgcggacaagcccactcccacaggggatttcatttcaatgtgggagtgggcttgcgagaaagtcgcgcagcgacttactggatgatcaggttgttgaagagcaggtcttcgaccaccggcttgccggtctcatcgttcatcacttgctgggtttgtttcagggcttcctggcgcagtttttccttgccttcaacggtgctcatggcctcgctggtctgctgggtgaatagcgccaccaactgattgcgaatcagtggatcgttggctttgaccgccgcggcggcttcggtgccggttacgcgcagggcgatgtcggctttgtacaccttgagcttcgccgtgccatccaggccatagttgcctacgaatggcggcgtcaggctgatatagctgaccttcggcgcctcgccttccttggcctcttcggcctggacagccatcggcaatgtcagggccagcatcaacaggatccacgctttcacagttcattcctcgaattcggttgcccggtagcataacgctagcaaggctgagcacaagcttatggcggcttatcaggcccgggcatgctcgttgacccgcgggcgtaccctcctacacttatcggccacgacgccaaaaggaatagtccgatgaaagctgtgctgtgcaaagccttcggccccgccgaaaccctggtgctggaagaaatcgccagccctgcgatcaagaagaacgagatcctgctggacgtacacgcagccggggtgaatttcccggacaccctgatcatcgagggcaagtaccagttcaagccgccctttccgttctcacccggtggcgaagcggcgggtgtggtcagtgaagtgggtgagaaagtcagccatctgaaagtcggtgaccgcgtaatggcgttgaccggctggggcagctttgccgagcaggtcgcggtgcccggctataacgtgctgccgatcccgccaagcatggacttcaacaccgctgccgccttcagcatgacctacggcacctcgatgcacgcgctcaaacagcgcgccaacctgcaacccggcgaaaccctgctggtgctcggcgcttccgggggcgtgggcctggccgccgtggaaatcggcaaggccatgggcgcccgggtgatcgctgccgccagcagcgccgacaaactcgcggtggccaaggcggccggcgccgatgagctgatcaactacagcgaagccagcctcaaggacgaggtcaagcgcctgaccgacggcaatggcgccgatgtgatctacgacccagtgggcggagatctgtttgaccaggccatccgcgccatcgcctggaacggccgcctgctggtggtggggtttgccagcgggcgcattcctgaactgccggtgaacctggcattgctcaagggcgcggcggtagtgggggtgttctggggctcgtttgcccagcgccagccgcaggataacgcggcgaattttcagcagttgttcacgtggtatgccgagggcaagttgaggccattggtgtcgcaggtgtatccgctggagcaggcggcccaggcgattgatgacctggggcaacgcaaggcggttggcaaggttgtcgtacaaacccgctgacagatttgaaatgcggtccatgtgggagggggcttgcccccgataggagtcggtctgaactggcctaatgatcccggacacctcttaagggcgatatgattcgcccattcaggaggttccatgcaagaacgaaaaacctatacccgcgagttcaagcaacgtgctgcaagcatggttcttgatgataactgctcagttcccgacgtctgtgcatcgatggaggttggccctacggctctgcgccgttgggttgatcaggttcgtaaagagcgtcagaaagggcagccagtggccggtaccaaggcaatcagcgaagaacagcgagagctgcagcagctgcgagccaaggtcaagcgtctggagaccgaggctgaaatcttaaaaaaggctacggctctcttgatgtcggatcccgatcgtttttcctgatcgaggagctgagggagtcgagttcatatccgacctgcctgctttgcagtgcgctgggcgtttcccgtagcgcgttttacgactggcttaagcgtcgctcagcgcccaataccaagcgtgacgcgctcagagcaaaagtcgtgcaactgcatgacgaaagccggggaagtgcaggcgcgcggatgatctctcagcacttgaaggcccagcaggtcaaggtgggacggcatttggccggaaaactcatggcggaggcaaatctggccagcaggcagcgccgccgccatcaatatcgctctagaggcgtcgaagcatttgtggccaagaacctgcttgagcgtaactttgagccaaccgcaatcaatcaggtctggtgcggcgatgttactagcctgatggttgggaaacgctggtatcacttggcagcggtcattgatctgttcgcccgccgaatcattggctgggcgttttccctgatcaacgacgccaacctggttagcaaggcgctaagaatggcggtggaggttcgaggcaaacatgggggcttgatgtttcattcggatcaaggctgccaatacaccagtcagcgctttcagtccgagctgctggaacatgggataacgcaaagcatgagccgcagaggacagtgctgggacaacgcgccaacagagcgtttcttcgggacactcaagtcagagtgggtgcccaccaagggttatacgacagttgaagaagccaggcaggatatgaccagcttcttcatgcggtataaccgaattaggctccacagctacaataactacctgtctccaatagccatggagcagcaggcggcttgaccaccgtaatcggtgtccggaaaaacttgaccagaacagtcagtgagtccatgagtgactgaaccaccgctatcgggagcaagccccctcccacattttgatccccagtgctcaagagaactgatcacgacccatacttatctattagcgacatgttcgtaaaagaacatgcgattgctcccctttcctgtgtttgcagataagaggcgatgctattttcggtaacgaaactgtaacattcgcatccgcagtcaaaacaagaaatttggagctcttgaatgtttgctttctttcgtcctgccgcacaccaggcgcccctgcctgaagaaaaaatagacagtacctaccgacgcctgcgctggcagatctttgccggtattttcttcggttacgccggctattacctgctgcgcaaaaacttctccctggccatgccctacctgatcgacgagggttatacccgcggtgaactgggcctggcgatgtcggcgattgcgattgcctacggcttgtccaagtttctcatgggcctggtctccgaccgctccaacccacgctacttcctgcccttcggcctgctggtttcagcgggtgtgatgttcattttcggtttcgcgccttgggcaacgtccagcgtaaccatgatgttcatcctgctgttcatcaacggctgggcccagggcatgggctggccgccaagtgggcggaccatggtgcactggtggtcgcagaaagaacgcggcggcgtggtgtcggtatggaacgtggcgcacaacgtcggcggtggcctgatcggcccgctgttcctgctgggcatggcgtggttcaacgactggcatgcggcgttctatgtgccggccacggtggccctggcggtggcggcgtttgccttcatcaccatgcgcgacactccgcaatcggtgggcctgccaccgatcgagcagtacaagaacgattacccggaaggctacgacgccagccacgaagacgaattcagcgccaaggaaatcttcgtcaagtacgtgctgcgcaacaaaatgctgtggtacatcgccttcgccaacgtgttcgtctacctgttgcgctacggcgtactggactgggcgccgacctacttgaaagaagccaagcacttcacggtcgataagtcgtcctgggcgtatttcttctatgagtgggccggtatcccaggcacgttgttgtgcggctggatgtcggacaagatcttccgtggcaaccgcggcctgaccggtatcgtgttcatggctctggtgactgtggcgaccctggtttactggctcaacccgccgggcaacccgatgatcgacatgatcgcgctgttctccatcggcttcctgatctacggcccggtaatgctgatcggcctgcaggcgctggaactggcaccgaagaaagccgccggcaccgcagcgggcttcaccggtttgttcggttacctgggtggttcggtggcagccagtgcggccatgggctacacggttgaccatttcggctgggacggtgggttcgtgttactggtcggtgcctgcgtactggcgatcgcgttcttgattcctacgctgtggcacaccaacagcgtcagctcggcgcgttaagcacccgggcaatccttggcacaacgcttgagccgcgcctccaggttcttatctggcatggcgtggctacgcagggcgttcacggtctgctcgacataatcgcgagtggtgccgtaacgcccgcaagcgctttgcagcacgtgattaagcacaatatcgggcaagttgccggcgtagctgggcaagtgccgctccaacacaaaccccaacgcctgcacggtactgccatcttccaaccggcaactgagccagtgtggccgataagaagggtaaggcatctcgcgctgccacaaggcgtacagcgaggcctccaactggtcttccggcaagcggtaggcaaacccgctgcaggacccgccgcgatccagcccgaacaccaaccccggcaactccggcgtgccccggtgctcgtgggaccacaggtacaagccgcggtgataaccatgaacccgtgcgcgcacccgttcggtcgacgaacattcagggcgccagatcagcgaaccataggcaaacagccacactggcccacccttgtgccgggccatagtggcctgcatcgagctcattaattgttcgtgagtgagttgcggcccaagatcgagccgcggagggtaagccaactgcaaaagatcggtttcaatggcggtcatggcgaaaagcggtgcgcctcctgtgtgttaccagttgtaagcgactttaccgtaataaaacgcgccgctgtaaccgtacggcgaaaaagtgctataggccagattgccgccactgctggcgtaggcattgaccttctctgggtatttgtcggtaacgttgtcgccccccagggtaaaggtccagttcttgagcttgtagtcggctgacaggtccagcacccaggcggccttgaaagtctggtcgttgatcttgtccgcctgatagctggtgaactcgccatagcgcaccaggttgctgtgcagcgcccactggccaaaggtgaagtcgttgcccaggctcagtttgtgctggggcgtggtgtcgccgagcaaaccgatacgctcacgacgatcgacccgtactaggttggccccgaggctgtcgagaatcgccgggttggctttcacgtcagtgactttggtgtggttgtagttatagcccagggtgctgttccaacggatgccgttatcaaactggtagcgatagttggccaccaggtcgaccccatcggtgctggtgtccgtggcgttgttgaagtaccgggcggtggtgtagttaatattgccgacgccattggcttgcaggtaggcaaccgtagccgggttgagattgaggttggaggacaggctgatgcgatcgcgaatatcgatgcggtacacatcgagcgtgacggtcaggtcatcggccggctccagcaccaggccgaggctgtagttgcgcgacttctcggccttgaggtcctcggcacccagcaggcgggccacctggctgttggccgggaaggtgccagcctcctggatggtgcttccgatcagctgcgacgaggtgtaggcaaaattctgctgggccagggacggcgcacggaaaccgttggagatgctgccgcgcaaggccacttgaggggtgaagtcgtagcgggccgacagcgagccgctgaggttggagccgaagtcgctgtaatcctcgtggcgcacagcggccgaaacactgagtttttcggtgaaattggtttccaggtccaggtattgcgcccagttgtgccgggtactggtaccggcatccgcatcgcggaaaccacccaggcccgagctgccggtctggtaataggaggcaggctcgcccgcttcgatttcgtagccctgatgcaggtattcaccgccgaacgccacggagaccgggtatggcagcaagcccacgtcgaattcacgggacaggtccagactgacttgtttctggtcgttgctcagggtgccgttgttgaacttgcgcggcgtcgccaggcccagggaggtgttgatggtttcggtgcccagctcgtactgattcttgccgtagttggccgaaaagtcgtaatgccagtcgtaggccagcaggccgcgcaggcccaccaccagtgaagtgtcttccaggttgcccttgatcagcggcaggtagccgtcggggttcagtgcagggatgttattggaagcgttgctggcccggtagaacgccgctgtttcaccgcggcgcttgctgtagccaccaaaggtgtagaactcggctgcatcgctgaaggaatattccgaattgaactggaacttgccttcattggtggccggctcgccttgacggaacacacgctggccgtaggtggtggagccaatgctacctgggcggtaatcgttgccggcgcggttggtgtaatcgttgtcggcgccttcggccgacaggttgataaagccgctgtcgcccaacgccaggccagtattaccgctgacattacgctgaatgccgtcgcctttcttgtactcgccgaacttggtggaaatcgagccgccatggtcggcgtgcttgaggatcacattgatcaccccggcaatcgcatcagagccgtaacgtgcggaagcaccatcgcgcagcacttcgatatggtccaccgccgacagcgggatcgcgttcaagtccgccggggccgaaccgcgcccaacggcaccgcccaggttgacgaaggcactggtatggcggcgcttgccgttgaccagcaccaacacctggtccggcgacaagccgcgcaactgcgccgggcgcaccagttcggcgccatccaccaggcttggccgtgggaagttgatcgacggaatcaagcgcgccaatacggcgcccagttcgtcggagccggtgctgcgtagcgtctcaccggagatcacatcgattggcgacagcgaagcactggccgtgcgctcttgggcgcgggtgccggtcacgatcaccgtgtcgagcctgggcgcatcggcggcggctgtttcgtctgcctgtactggattgaaccccacaacggtcagcaaattggccgacaaaatcgccatgtatagcgtgtgtttcctgtagctccccataccgctcccctttgaatcaagaatagaactgcaacactctgagttcgtatgatcgatccggctggcggcggtggcggtcagtgattggttactgttgatgaagtcggtagcccgttgccatatagcttaaagacatttatcagccagaataaataccttaaaagaataagcaaaagcataagcgcacccgcccactcgtcaggatctaaaccggtaatttcggtaatttcagccccggttcagcctgggtacgcgccaagcagtcaaaatagcgcacacatcacgacccacttagccgctcatcacatcgactatcgaggtcgctccatgaagaaattccgcctgcctggcctgctgttcctggcccaggccaccaccgcactggctaccgaaaccccacctgccgatgacaagggcttctggtatgcccagaccagtgtctacacccggcactttgcgccagacccggagcacaacaacaagcaggatttgatcggcctggaacgcaacgaggcgtcgggcctggtgtatggcggggtgacctttcgcaactcgttccgccagcgctcttactacgcctatgcgggcaagcgctatgacatggccgactacccggtgtatgcgaaattgaccggcgggctgctccagggctatcgcggcgagtatcgcgacaagattccgttgaaccgattcggcgtagcgccggtgatcattccgtcggtgggtacccactatgggccagtggcggcggagctggtgctgctggggttcaatgcagcgatggtgacgaccggcgtacggttctgacactgacacggcacgtgtctactgtggggctggcttgcctgcgatagcggtgttggctgacagaccgctacgcaggcaagccagctcccacatggattcagcttgagtctttagggccgtggagcgtaggcgaacacatcggcgcgcatacggtgcgcatccattccggcgttgaccagtgcgtccagggtgccgtagatcatcgctggcgaaccgctggcatagacatgcacgctattgaggtcggcaatgtcctcgcacaccgcttcatgcagcaaaccacagcggccttcccagccacacaggtcgctgaccaccttgtgcaggaacaggttgggcaattgctgccattgctcccaatgctcgatctggtaaaaatcttccgggcgacgcacgccccagtacaggtgcaccgggtgcttgaagccggacgcccggcagtgctcgatcaggctgtgcatctgcgccatgccggtgccggcggccatcaacaccagcggcccgtccggcaactcggccaggtgggtgtcgccgaacggcagttcgacgcgggccatctggttgcactgcaattgttcaatgaggttgcgtgcgctgtcctcgcgggccagcacatgcagctccagctcacgtccggcatggggcgccgatgccagggaaaacgccgatttctcgccattcgcccgctcgatcatcaggtattgcccggcgtggtaacgcactgccttgcccgccggggcacgcaggcgtacacgccacacatcgccgccgacgtctaagcactcaatcaattggcacgacaatttgcgcaacggcaactcccccggcgccagtaccccatcccacaacacaacgcagtcctccaagggttcggcaatacaggtgaagaattcaccatgatcacgcacctcgccggcttggcgtacccgcccttccaccagcaacgccgcacacacatggcatacaccattgcggcaggcttgggggcactcatagcccaggcgacgtgcgccgtcgaggattcgctcgccagggtccagctccagcacagcgccggaaggttgcagggttacacgcatcaatctattcccaattctttccagatcgcatcgacacgcgccgtgacggcttcatccttgacgatcacccgaccccactcgcgagtggtctcacccggccacttgtgggtggcatcaaggcccatcttcgagcccagccccgagaccggcgaggcgaagtcgaggtagtcgatcggcgtgttatcgatcatcactgtgtcgcgcttggggtccatgcgcgtggtgatggcccagatcacgtcgttccagtcccgggcattgatgtcgtcgtcagtgacgataacgaatttggtgtacatgaactgtcgcaaaaacgaccacacacccaacatgacccgcttggcatgtcccgggtacgacttcttcatggtcacgatcgccatgcggtacgagcaaccttccggcggcaggtagaagtcggtgatttcggggaattgcttttgcaggatcggcacgaacacttcgttgagcgccacgccgaggatggccggctcatccggcggacggcccgtgtaggtactgtggtagatcggcttgaccctatgggtgatgcgctcgacggtaaacaccgggaagctatcgacttcgttgtagtagccggtgtgatcgccgtaagggccttcatcggccatctcgcccgggtgaatcacgccctcgaggatgatttcggcggtggccggcacttgcaggtcgttaccgcgacacttgaccaattcggtgcggttaccgcgcagcaaaccggcgaaggcgtattcggacaggctgtcgggcacaggcgtcacggcgccgaggatggtggccggatcggcgcccaaagccactgaaaccggaaatggctggccgggatgcttctcgcaccactcccggaagtcgagagcgccgccacggtggctcagccagcgcatgatcaccttgttacggccgatgacttgctgacggtagatgccgaggttctggcggtccttgttcgggcccttggtgacggtcaggccccacgtaatcagcggcccaacgtcgcccggccagcaggtctgcaccgggagcatggccaggtctacatcatcgccctcgatgaccacttcctggcataccgcgtccttgaccaccttgggggccatggcaatgatcttgcgaaagatcggcagcttcgaccaggcgtccttcaagcccttgggcggctcgggctccttgagaaaggcaagcaacttgccgatctcacgcagttcgctgaccgactcggcgcccatgccaaaggccacacgctcgggggtgccgaacaggttgcccagtaccggaatgtcaaagccagtcggtttttcgaacaacagcgccgggcccttgctgcgcaaggtgcggtcgcaaatctcagtcatttccagcaccggagaaatcggcatctggatacgtttcaactctccgcgctgctcaagttgctgcacgaaatcccgaagatccttgaatttcattaaccatgccacccgtaaaataggcgtacatcctacctgctctgagggcggctggcagcttaattggccgtcagccctcgtgattgcaaggaactgaacaatggttccaggaaggcttcgatgtgccgggcaccaacgtctgacagatggttatcgtcggtatacaacgctcgaccattgagttcgacccggcacaaaccatcgctgccgcacagcaggggcgcagggtccagcaccttgacaccgctgtcgcccgccgccagttcgtcaaacaactgcgtgataaaagcctggcgcttcacatgctcggctacggcgagcccttcaccgtccactgaccggttcatcatcgccaggcggctcagacgataaggcacgatgatctcctgcagcggcacttccttgaccagccagaccttatggccggcagcacgcaagccctggatgcgttcacgaaggccttgggcgaagcgttgctcggcgacggcacgcacatactggccagtgccggggtccttaagcgcatgctccttgtcacccgacatttgcccatagacgtacaggctccaacgggccgccagcaccacatcgctgaacacctgctcggccatggccttctcgacgcgatggttgaagtgcgcgcatcgagcaatattctccaggccatccagcgggatacagccggcaaaactggcctctaccagactgatattgtggcgatcagccccctctttgagcgcgggtatcagcgcagtggcgtgactgtcaccccataccagcgctgaaacagattggcttttcggaccgaaatggcagaacagccgatcatcgggggtgtctttgtcagccatgcacgccagcaggtccgggctccacttcttggcctgggcaaaacgcaatgcctgttcggacaaacgcgaaggcacgccgtcagcttcgcgtatcgccaagccggtaaagccaagccccaggatgccgaccaaggctgacgccagaatcgccttgcgtccggccagcaagcgtttttcccggaacggcgtttccacgaagcgccaggacagataacccagcaccagcgaaagcagcatcagcccagccagttccaaggcgctcaagccatccactgcggcatagttggcatacacgaataccggccagtgccacaggtaccaggaataggaaatcagcccgatacccaccattacccgcgtacttaacaaccgccctacccaggtgtgctgctggccgttggcccagatcaagccgacgacccccagcacaggcaatagagcggttgcgccgggaaacggcgttttcgcgtcataacccagtacagcgatcagaatcagtgccatggaggccaggctgaccccttgcgccaaagcgggcgaagcgcgccactcatgcttgggcaacactgccagcatcgcgccggccagcaattcccaggcccgcagatgcaacaggaagaaagctttttgcggctcatgctcaaccgcccagacgctcatgccgaaagacccgagcagcaccgcgaacagcgccaggcgccagtgtttcaggcggctcgacagcaatgccagcaacagcgggaagaagatatagaactgctcctccaccgccagcgaccaggtatgcagcaaaggcttgatgtctgaagacacatcgaaatagccatgctggcgcgagaacagcaagttggaggtaaaggtcacctgatagtgcgccgaccggcccaactcctcgtagtccttaggcgccaacagaaaccaacccgctaccagtgtcgcggcgatcatcacaaacagcgcgggcaagatacgccgggcgcggcgagcccagaagtcgataaaactgaagcggccagcctggcgctcacgccagataattgacgtaattaaaaagccggaaatgacgaaaaacacatcaacgccaacaaaaccgccagtaatgccaggaacgccaaaatgaaataacacgactgcgaggacagcgatggcacgcaggccgtcgatgtctctgcggtaagcaagagtggtcataaggatgtgatcagtctgtgacgaaaggagttagcgtagtcacgcgtcaatttttgttacttaacggatacttatgccacaaatgccgcaaaatctcgacgcataaaaaaaggcgcccctgaggggcgccatttttttggacctgaaacgccttattatttgcgcttcatcgacaggaagaactcgtcgttggtcttggtggttttcagcttatcgatcaggaactcgatggcagccacttcgtccatcgggtgcagcagcttgcgcaggatccacatacgctgcagttcgtcgtctgcggtcagcaactcttcacggcgggtgccggaacggttgatgttgatcgcagggaacacacgcttttcagcgatgcgacggtccagaggcagctccatgttaccggtacccttgaactcttcgtagatcacttcgtccatcttcgaaccggtctcgaccagtgcggtggcgatgatggtcagcgagccgccttcctcgatgttgcgcgcagcaccgaagaaacgcttgggcttctccagggcgtgggcatcgacaccaccggtcagcaccttgccggagcttgggatcacggtgttgtaggcacgcgccagacgagtgatggagtcgagcaggatcaccacgtctttcttgtgttcgaccaggcgcttggccttctcgatcaccatctcggcaacctgcacgtggcgggttggcggctcatcgaacgtcgaggcaaccacttcaccgcgcacggtgcgctgcatttcggtcacttcttccggacgctcatcgatcaacagcacgatcaggtgaacttcagggttattacgtgcgatgttcgctgcgatgttctgcagcatgatggtcttgccggctttcggcggtgcgacgatcaggccacgctggcccttgccgatcggggcgcacaggtcgatcactcgaccggtgaggtcttcggtggaaccgttgccggcttccatcttcatgcgcacggtcgggaacagcggggtcaggttctcgaagagaatcttgtttttcgcgttctcggggcgatcgaagttaatcgtgtcgaccttgagcagggcgaaataacgctcgccttccttcggaggacggatcttgccaacgatggtgtcaccggtgcgcaagttgaagcgacggatctggctcggcgagacgtagatgtcgtctgggccggcgagataggaggcgtctgcggagcggaggaagccgaagccgtcctggagaatctccagcacgccatcaccggagatttcctcgccgcttttcgcgtgcttcttgagcagggagaaaatcacgtcctgcttgcgcgaacgggccatattttctatgcccatttcttcggccagctggagcaggtcggtaatcggcttttgcttgagttcagtcagattcatataggaatgacgtaatcattttatggaggggggaaattaagcttttggcttaatgaggccgcgccgcagagaaggcgacaggatcgcgtactaatcgaaaaggaatgcgtcggcgacggcttgcagggggcagtggagaaaccagtgcggggccgaatgtaccacctgaatttctgagcgtctagccctgtttcacgaaaaagccccgcgatttgcggggctttttcgacaacgcttaaatgttcgcgtcgaggaaagcttgcagctgggacttcgacagtgcgcccactttagtggcttcgacgttaccgttcttgaacagcatcagcgtaggaatgccgcgcacgccatgcttggctggggtttcctggttgtcgtcgatgttcagcttggcgatggtcaacttgccttcgtaggtggttgcaatgtcgtccaggaccggagcgatcattttgcaagggccacaccattcagcccagtagtcaaccagcaccgggccttgagccttgagtacttcggcctcaaaggtcgcgtcggtgacgtgcttgataagatcgttgctcatggatgtctccggaatgtaagcaaaaaaaacgttgctcatcatagctgcccttcccccgttcaggaagccgcgtctgattgagtcttgctatggcgctgcatgagtgtgggtataacccattcacgacgtgacgggcgtcacgaatgctatgccggtgcgcaacgccgcattgcgtacgtgctcctgcatggctttctgtgatgtcgcactggcgcgccgggccagggcccgcaggatcttgcggtgttcctgccaggtctccatggctcgttccggtcggatgaacggtagtttctggctctccaggaacacctcggcgctggcactgagaatgctcaccatcgcctggttgccgctggccagcaggatgcgctggtgaaactcgaagtccagacgggcggccgcttcgaagtctccaaccttgagcacgttgcgcatcgccgcaacattgtcttccaggctgtccagctcatcaatggtcagtgttaccgccgccaaccccgccgcgaacccctccaatgcgtagcgcaactggaagatatccagtggcgtggcctgcgccgcaaagggccaggcgaaccccggcgcgtcttgcaggccttgcacgaacacgcctttacccggctgcacgctgaccacgcccaaggcacacaggggacgacaatgcctcgcgcaacgacgcccggctcacccctaattgcaccgccaggtcacgctgggaaggcaacgcatcgcccggcccgaagccctgctccttgatcagcttgcggatggcttgcagggccgcctccggtacggcttgggcgatggaattcataaaaaaccaggtttccaggtcactgtgctgctagttgtaaagctatttacaaccggctgcaagccacgccccaaaggggctcgcatagttttgtcgacgcccgaaaagggtgcgaaacaggcgacaactgttcagaccagtaagaccgccgccgcccagtaaatccaagcgttgcaggccattacaagaggaatggcatgggctgtgcactgagcaaatccagaaaattccttcgcctttctcggagagttgtcatgaccaagcgctacagcgccctgctcactgccctgtttgccagcctgatgctgagccaggctcccgcccaggctaatggtctggatgacatcgtcgcccgtggcaccctcaaggtcgccgtgccccaggacttcccgccatttggttcggtcggccccgacatgcaaccacgggggctggacgtcgacaccgccaagctgctggccgaccagctcaaggtcaagctggagctgaccccggtcaacagcacgaaccgtattccgttcctcaccaccggcaaggtcgacctggtgatctccagcctgggcaaaaaccccgagcgtgaaaaggtcatcgacttctccaaggcctacgccccgttttacctggccgtgttcgggccgcccgaggccgccattggcagcaccgatgacctcaagggcaaaacgatcagtgtgacccgcggcgccatcgaggatatcgagctgaccgcagtggcccccaaggaagccacgatcaagcgcttcgaggacaacaactcgaccatcgccgcctacctggccggccaggtcgacctgatcgccagcggcaatgtcgtcatggtcgccatcagcgaacgcaatcccaaacgcgtacctgcgctgaagatcaagctcaaggattcaccggtgtacgtgggtgtgaacaagaacgagccggcgttgctggagaaggtcaaccagatcctggtcacggccaaggctgacggcagcctggaaaagaatgcactgcagtggctgaaagaaccgctgcctgccgatctctgaagcggagctgaccgatggcctatcaattcgactttgtgccagtgctggccaataccgacctgctgctgcgcggcgcactgttcaccctggagctgacggccatcggcgcgatcctcggggttgccctgggcaccgtcggcgccgtggcacgggcgtggaagatccagccgtttgcgtggatctttggtgtgtatgttgaattgatccgcaacacccccttcctggtgcagttgttcttcatctttttcggcctgccgtccctggggttgaaaatcactgagtggcaagccgcggtactggcaatggtgatcaacctcggcgcctactccaccgagatcatccgcgccgggatccaggcgatcccacgcgggcaactggaagcggctgcagcgttggcgatgacgcgcttcgaagcgttccgccacgtggtgttgctgccggcgctgggcaaggtgtggccggccctgagcagccagatcatcatcgtgatgctgggttcggcggtgtgttcgcagatcgcgactgaagaattgagctttgccgccaactttatccagtcgcgtaatttccgtgcatttgaaacctatgccctgaccaccctcgtttacctgtgcatggcgctgatgattcgccagttgctcaactggataggccggcggtttgtgatgaggaacagccgatgagtgagttcaccttgtgggacatcgtgcgcaacctgttcaccggtctgcaatggacgctgctcttgtcattggtggcgttcgtgggcggcggcctgatcggcctgctggtgatgacgatgcgcatcagccgtaaagcgttcctgcgcaatagtgcccgcacctatatcgaactgttccagggcacgccattgttgatgcagttgttcttggtgttcttcggtgttgctctgctcggcgtggatatatcgccctggctggcagcggcaatcgccttgaccctgtttaccagtgcttacctggccgaaatctggcgcggctgcgtagactccatcgcccatggccaatgggaggcctccgccagcctggccctgaacccactggagcaacttcgctatgtgatcctgccgcaagcgctgcgcattgccgtcgcgcccacggtgggcttttcggtgcaggtggtcaaaggcacctccgtgacctcgatcatcggcttcaccgaactgaccaagaccggcggcatgctcgccaatgccaccttcgagcccttcatggtctacggcctggtggccctcggttatttcctgctctgctaccccctgtccctcagtgcgcgctacctggaaaggaaactgcatgcctctgcttagaatttctgccctgcataaatattacggcgatcaccatgtgctcaagggcattgacctgacggtggatgaaggccaggtggtggcgatcatcggccgcagcggctcgggcaagtccaccttgctgcgcactctcaatggcctggagtcgatcaatgacggtgtgatcgaagtggacggcgaatacctggatgccgcccgcgccgacctgcgcagcctgcggcagaaagtcggcatggtattccagcagttcaacctgttcccgcacctgagcgtcggcgaaaacgtgatgctggcgccgcaggtggtacagaaagtgcccaaggccaaggcggcacagctggcgaggcagatgctcgagcgggtcgggctgggcgagaagttcgatgccttccccgatcgcttgtccggtggtcagcagcaacgggtggccattgcccgggcattggccatgtcacccaaggtgctcttgtgtgatgagattacgtcggccctggacccggagctggtcaatgaagtgctcagtgtggtgcgccaactggcccaggacggcatgaccctgatcatggtcacccacgaaatgcgctttgcccgggaagtcggtgacaaactggtgttcatgcatcagggcaaagtgcatgaaaccggcgacccgaaaatgttgtttgccaacccaggaaccgccgagcttgccaatttcattggctcggtggaacaaccgagctgaccagctcaaagctgccctgcccctccaagtggatttcactgcggaccgccaaggcatcggagggcagttcggcatggatatccaccagggccgtgagtcgccgaccgaccaccgaccggccgcctgcgtgcgctaccaccgcctggccgggcagcaactggccgctggctggtgcgccaggcacatgggcaaccgcccaatcgacggagcggccatccacctgggcatttttgaggctcaaccggtaacgcccctcgcggccaaaccgaaaaccctgcccatcggcggcaacgccaacaaaacgcagggccatggccgctggctcaatgcagagtacattcacgctgatcgagcggaccgtcagcgccactgtggtgctttcagcctctgcatgcctgcgtatcgggccataatcgatgcgcggctgactcagcgataggcgacagttttcagccaacgcatcagacggcgccagcaacgtgcaacatagcgccaagggcaggcttgcagccttaaccaccttggcaaaccgccgatgcggcttcatagaatttgtcattgtctggcttggtctcggggtcaatgttcaacaagcaagtggaagagtccggcaatgaaacccgcagggtttgcgactcagtgacgtcgttgaggaaaatcatgccctcgcccaccacgctggtgatgaaacgattgcctttgccgaataccgaggcgccctgaggtaatggccggccgtgctgatcgttcgcggtcaccagcattcgacgcactttcactacgtcgaaatccacggagttgaacgagcctcgacccgcggcaagtacctgggtgccgtttttcaggtccgcccgcttgggcaacgattgggtctgcacctcgactcggctgttggtgtaggccggcaggcccgcgatcacggcttgcccgctgaagtcggtccagaccgggccctgtggtgtctggactttcgcggaaccgatatcgccgaccgaaacgacgccgaacgtgtcctgtacggtataaggcgagaaggtcaggccaccttcgtgagccactgcaccgccctgcaactgccccgtgtagctggtgcccagggggtcgcgactgacgcccaggcccacccgggtataacgtggcagcaggtcaacctgagcacgcaccgattgctccctggcccggatgtcgcgctcgacgccgacttcgtaattcacatactcgttgaccctttcgctcagcgcagtccccgcggtgaactggtctccacggcgactggtgaagctgcttacacgacgatccccacccagcggcacactgacctgtaaccgcaaggacaggtcgttatccagagaactgtcaggcccactgccggcaaatgaagagtcacggcgggcccgtttgccacccacttgcgaatccgcgatgaatgcaacatcgacgcggccaaacgtcttgttccatgaggcgaacacatgttcggtggtttgcccgccaaattgagcactgcgcgtgtagttcagagaaaatatgcccaggatggcgtcgttccagctcatgcccgccgtgtattggtgtttgaagtacgagtccagctcatcggttctgagcgaatgccccacttcagtgacttcgcggtaaccgcgcgtttgggtggttgcacttaagttgacatcgatattggcgaccaccgggctgctcacggacaggctgctacgtgaaccggacacagccttgtggctgtctcgggacaggttatgtcgtgcgttaaccgaaacccgctggaaaaacacactgctcaggctgccacccgccgcccaataatcatcggcactcaacaagccaaaacccgcagacgaatcgcgccccagcccccaggtgccgctgcccatggcgatcaacggtgacgggccctcttcacctgccgttctgcgcagttcgccaagcgagaaataatagccaggcgccgccggggcagcccccgcgaacgacgccgccggcacaacaaaactgcgcttggcgccccgcacgtcaatcacactgacttcaaggtcactggtgccattgagcaggggcaatccggtcaaccggaacggtccttcgggcaccagggtactgtggatcaacatgccggactggcgcacctcaacccgggactggctttgggccaaaccctcgaccaccgcattgttgttgcctgcgggtatccgggactgcccatcgggaaaaaactgcaagccggagagctggatgccaccaaacagcgggttattactggacagttggcccgcctggaaagtcgaatgcaacgcggcgatgtcccgctgcgcataagcatgcagatgttcagtgcgcgtcttgccgttgtcagacacatagaactggcggctgcggacgatccagtcttccaggttgaaacccgcttcggtataggccgacacgaaccgtgtgggcccgctgcgcgagtggctgtcataccccagcacgtcatagttgaacaaggccgccgccccacccctggaaaaacttccggcctcccactgcggctcacgcagggcctgggtgggcaccacgagcaccacttcgtcagtaccgggccgcaggcgcaccatcgtcgtcgggaactgcccgaggaaatcatgacaagtctggtccggcgtgacgccttccagaagaacgccccggggcttgaccagtccagccttctccagcagcccaggggtgaaacacagccccccctgtgcgtcgaaccgggcatcgaccagtccaagggggtttccattgacgcgcaaccccaccaccttgacgccttcgcggaagcgcgccgcactgcgaaagtagtcggaaaccttggggtctatgccgtgggtggtgagcgctgcaagatcgaatccctcgccgatctccagcgcagccacgagaccaggcaagctccatagcgccgcaaacccgacgagcaatgtgggtttgcaaggccgcgaaggggcggcgacacggttattcagaggcatcatcatgggtcgatcaaccctcatcggtgttgatcggagcccggtagctatcgaccgaaaacccatagaccgttgctggctgaatctgaacttgcgcggtgccgtccatggctgcgtcaaccttcgccaccagcacctcgcccggcaagatgtaggtacgcggcaacatggccgaggtatttcctggcagcagttgtacgtccggcgccaggcgcacgacataggcgctgtcgttatggacggtcagttgttgccccgcccgcttccacttcagcaactcccaaggtgtgtggtgccgcgccagcccctgcggatgcaggatcagcggcaaattctgacgcagggtaatgccgatggtcgcaccacccgcggcccgagcctgggggatgccctcgaaggagatacgcttgagccgttgggtcttgagcggctccttcaaggtgctgataaagcgcaccagttgcgtctcccctgcctccactcgagtgataggcggtgtgacaatcagtagcggctccaggtcctcaggcacgttttcaacaacagcatgaagcagcgccggtgcctcgtcagtattcttgatattgatggtggcttcaccgtcttcttcatatagcaccaccaccgttgtttccggcaacataccgtccgccgtggcaacagcgctgaaacaaacactccacagcagcgcaaaacttattaaaaaaacacgcactcggcattctccgcaactcatgaagttgacgatctgctatcaaccgcgcacagaaaaacagccaataagaaatagtggtttcttgatcggctgttttcagttgtttagatgtaactcaataccagcgtggcgcgaccatcaatggaaacgtcgcggctcagatccaagtcctgagccctgttgattaccgccttcactgcaagtgtgccggtcagttggctgatagaggccggtgtgatagtcacgctgttacgccaagaatactggcttggcgactgggcaactttgccatcactgttctgccaggcccccaggcctgtacgcatgataggatgcagcaccgttgcggaagaccgcaggtccctgagggtcacagaataaccaccggttcgccggcctcccaccatgcccaagccaaagttttgcgcttcgctaaagcctgcccccaggatacctgtcaccttgctgcccgcttgcaggtcagtaagggtgagcccgaacctggccggtgtggcgccgcaattgatgacaagagaagtggtcctctcctcgcgcgggttgaacgacgtgcgggacaactcgccggagcgaatcgtaccgtagtcgatgatgccactgcctgccagactgagattgcatgcagcgggggtaatggtgcccctgacgaccaactgggcactggtggttgcctgggcactcagggtcgcagccaggcacgcaatacctaaggtcaatccaataatttttttcatgtttgtcctgtcacttgaagttctcaggcgctctttattttcggtcttggcgactccgtcgcccaacgccttatcttccgtaatacaaaactataaataaataacacctaggcagaattgccgagtgacagtctggcgcctcggcgcttagcaattgaatcagacaacacgtcatttattgtggtatcgggttaaatcaagcaataacctttatccattagcagagtagtcccaagcaaggtatcggacaaagaactattccaacccctgtaagcaaagtcatgggtatcttggcaaccgcatatgattaaatactcttaccccccgaagcacctcttcaacggccacatacaaatttctcctacatttataatgaaacacccttacagacagcattcataaaattaccgaagcacaacgcgttggcgtcagcggtcgatcgtggcacgatggcgaggttatcgaccgagatccccaaaccatgccgcaatcccaagccaagaacctgtccttgatcgccgccatcgacctgggctccaacagctttcacatggtcgtggccaaggctcagaacggcgagatccgcatcctcgagcggctcggcgagaaagtgcaactggccgccgggatcgacgacgagcgcaagctcaatgaagaatccatgcagcgcgggctcgattgcctcaagcgctttgcgcaactgatcaacggcatgcctactggcgccgtgcgcatcgtcggcaccaacgccttgcgcgaagctcgcaaccgcaacgagttcatccatcgtgccgaggacatcctcgggcatccggtggaagtcatctcgggccgtgaagaagcccgcctgatctacctcggcgtgtcccataccctggccgatactcccggcaaacgcctggtggcggacatcggcggcggcagcaccgagttcatcatcggccagcgttttgaaccgctgctgcgtgaaagcctgcagatgggctgcgtgagttttacccaacggtatttcaaggacggcaagatcacgccggcgcgctatgcccaggcctacaccgcggcacggctggagatcatgagtatcgaacacgccctgcaccgcctgacctgggatgaagccatcggctcgtccgggaccatccgcgccattggcctggccttgaaagccggcggccatggcactggcgaggtaaacgccgaaggtttggcgtggctcaagcgcaaactgttcaagcttggggatgcggaaaaaatcgacttcgacggcatcaaacccgaccgacgcgccattttccccgcgggcctggcgattctcgaggctatcttcgacgccctcgaactgcaacgcatggaccactgtgacggcgccctgcgcgagggcgtgctctatgacctgctgggccgtcatcaccacgaagacgtgcgcgagcgcaccctcagctcgctgatggagcgttaccacgtcgacctggaacaagctgctcgtgtggagcgcaaagccttgcacgctttcgaccaggtcgccgaggattgggaccttgaagacggtgtctggcgggagctgctcggctgggccgccaaggtgcatgaagtgggcctggacatcgcccactaccactaccacaagcatggcgcctacctgatcgagcattcggacctggccggtttctcccgggaggaccagcagatgctcgcgctgctggtgcgcggccatcgtcgcaatattcccaaggacaagtttgccgagttcggcaaagacggcatcaagctgatccgcctgtgcgcgctgttgcgatttgcgatcctgttccaccacattcgcggtacccaggaaatgccccaggtgaaactgcatgccgttggcgacagccttgacgtggtgttccccaagggctggctggatgaaaaccagttgacccaggcggacttcgcccaggaagcggaatggctgacgcgggtggggttcagcctgaacctgcgctaaaaagcacaccgatagataaatgtgggagggggcttgctcccgatggcggtggccctgccgactaatgtgtcgactgagtcaccgctatcgggagcaagccccctcccacattttttagacctcgctggtgctggggtttagttcaccgcaagaatcgggctacccagcttctccagcaacgtcgcctgcgcgctgcgcgggttctggttgccggtcggcgtgttacgcacgtagcgaccgtccgactgcaggctccagctgtgggtgttgtcggtgaggtagctttccagctccttcttgacccgcatgatcagcttcttgccttccaccgggaaacaggtctccacccgcttgtcgaggttgcgctccatccagtcggcactggagaggaacatctgctcttcgccgccgttgaggaagtagaacactcgcgtgtgctccaggaagcgaccgatgatcgagcgcacgtggatgttatgcgacacgccgacaatgcccgggcgcaggcagcacatgccccgcaccaccaggtcgatgcgcacgccggactggctggctttgtacagcgcacggatgatcttcggatcggtcagcgagttaaatttggcaatgatgtgcgccggtttgccgtcgagggcgaactgggtctcgcgggcaatcatgtcgagcatgcccttcttgagggtgaacggtgcatgcagcagcttcttcatgcgcaaggtcttgcccatgccgatcaactggctgaacaacttgccgacgtcttcgcacagcgcgtcgtcggacgtcagcaggctgtagtcggtgtagagcttggcgttgccggcatggtagttgccggtacccaagtgggcgtagcgcacgatctcaccggcttcacgacgcaggatcagcatcatcttggcgtgggtcttgaagccgaccacaccgtagatcaccaccgcaccggccgcttgcaggcggctggccagttgcaggttggactcttcgtcaaaacgcgcacgcagctcgatcactgcggtgacttccttgccgttgcgcgcagcatccaccagcgcatcgacgatttctgagttggcgccactgcggtacagggtctggcgcacggccaggacatgcgggtccttggcggcctgacgcagcaggtcgaccaccggggtgaaggattcgaatgggtgcagcagcaggatgtcctgcttgcttatcacgctgaaaatgttttcgctgttttgcagcagtttcgggatctgcggggtgaacggcttgtattgcagctccgggtggctgtccaggccggtgatgctgaacaggcgagtcaggttcaccggaccgttgacctggtacagctcggactcggccaggttgaactgcttgagcaggtagtccgacagatgtttcgggcaggtatcggcgacttccaggcgtacagcgtcgccgtagcgccgcgagaacagctcgccgcgcagggcacgggccaagtcttcgacatcttcggagtccagcgccaggtcggcgttgcgggtcaggcggaactgatagcagcccttgaccttcatgccctggaacaggtcatcggcatgggcatggatcattgacgacaggaatacatagttgtcgccagcgccacctacctcctcgggtaccttgatgatccgtggcaacaggcgcggtgccgggatgattgccaggccggagtcgcgaccaaaggcgtcgataccttccagctcaacgataaagttgaggctcttgttcaccagcaacgggaacgggtgcgtagggtcgaggccaatgggggtgatgataggggaaatctcgtcacggaagtagcgccgcacccaggtcttgatcttggcggtccagtggcgacgacgaatgaagcggacctgatgcttttcaagctccgggagcaggatgtcgttgaggattgcgtattggcgatccacatggccgtgcaccagctcgctgatgcgagccagggcttggtgcggttgcaggccgtcggcaccggcttgttcgcgggcgaaggtaatctgcttcttgagcccggcgacacggatctcgaagaactcatccaggttgctggagaagatcagcaagaatttcagtcgctccagcaacgggtaggactcatccagcgcctgctccagcacgcggatgttgaattgcagctgtgacagctcgcggtggatgtacaggctgctgtcatccaggttggtgaccacggccaccggcgccggcgcaggcgcttcaacgaccaccgcaggcgcggccggctccagttccggcggggtctcggcgacttgttcaaccaccgggtgagcgtcttttacagccacttctgagagtccttcggtattcatcgagtgttcctgtgagggctattgttgctctctaagcaattgggcggcgcgggcggcgaagtaggtcaggatgccatcggcgccggcacgtttaaaggcagtcagggattcgaggatcaccccttcactcaaccaaccattctggattgcggccatatgcatggcgtattcaccgctgacctggtagacaaaggtcggcaccttgaattcctctttgacccgataaaggatgtccagataaggcatcccgggcttgaccatcaccatgtcggcgccttcggccaggtccgccgcaacttcgtgcagggcttcgtggctgttggcagggtccatctggtacgaggccttgttggccttgcccaggttcagggccgagcccaccgcatcgcggaacgggccgtagtaggcgctggcgtacttggccgagtaagccatgatccgcacattgacatggccggccagttcaagcgcttcacgaattgcctggatgcgaccgtccatcatgtccgacggcgcaaccacctgggcgcccgctgcggcatgggataacgcctgcctgaccagcgcatcgacggtaatgtcgttctgaacgtaaccgtcttcgtcaagaatgccatcttggccgtgggtggtgaacgggtccagggccacgtcggtaatcacgcccaactccgggaagcgctcgcgcagggcgcgggtggcacgctgggcgatcccttgtgggttccaggcttctgcggcgtccagggacttgagctccgacggcgtcaccggaaacagtgccagcgccgggatccccagttcgacccaattggccgcctcgatcagcaactgatcaatggtcaaacgctccacacctggcatcgatgccaccgcttcccgacgattttcaccatcgagcacaaataccggcaggatcagatcattcgtcgtcagtacattttcacgtaccaggcgacgagaaaaatcatcacggcgattgcgacgcaggcgggtagcggggaacaggcgattggcaggggtaaagctcacgacagactcctgagcccgcgtttacgggcgagcgttgcagttataagcggccattatgacgaaggaatgacagttgtgcttatcgatgcgacctgtagtcgcattcgtcatttatgtaggaattgttcacttcgtgacacatctcgatactttcatgaatcttcgtgaaggcgtaggctgcgcgttcatttcgccagcaccccagaccatgcttcaacaatttctgcatgacttcggttactttgccctcttcctcggcacgttcttcgaaggcgagaccatcctcgtgctcgcaggcttcctggcgttccgtggctacatggatatcaacctggtggtggtcgttgccttctttggcagctacgccggcgaccagctctggtactacatggggcgcaagcatggccgcaagctgctggcacgcaagccgcgctggcaattgatgggcgacaaggcgctggaacatatccgcaagcacccggatatctgggtactgagcttccgcttcgtctatggcttgcgcacagtgatgcccgtggcaattggcctgtccggctatccgccactgcgctatttgatccttaacggtatcggtgcggcgatttgggctgctgcgctgggggctgcggcttatcacttcggcgcggtgctggagggcatgctcggcagcgtcaagaaatacgagctgtgggtgctgggcgcgttgctggtgctgggccttgtcctgtggctgcgccgccgcttcaagaatgcccgtatcgcccgggaggcgtgtgccgaggccaaggcccggctggctgccgagccagccccggtggaaacacctaagacaccagtcgagtaagccggcttctgcaacagtagaggccgatcacgctcagcagactgtagctcgccagcgccagccaggccaggttgctggcgggccacagacccaccaacggtgccagccataccaacggcgcattcagcgccagccgcgccagctcggccttcaacgcccacgggcgattctccagcgccacccccaaggtaaacaggcccagcgccatggttccccagcccaggaccagtgccgccgagggcatcgcctcgccgaaattcattagatagctgccaaatcccacatacgctgcaaattgcaaagcgatgtacacctgttgccgcgcatccagcggcacctcgaatttgcggaactggctcaggtccggcttggccatcgggtacttggccttgacgtccgccgggcgccagccggtgcgcatgaaccagatgcgcaacttgtcccaccagctttcagtacgtcgggcgtcatgccataactgcgcataaaactgcaggttggcccacagcgggttccaactggccaggggcgtggtcacaccgaaaatgaccggctcgttgtcgtcttcctcctggaacgtgccgaacagtcggtcccaaataatgaacaccccgccgtagttgcgatccatgtagagagcgttctgtgcatggtgggcccgatgattggacggtgtgacgaagaaccactcgaaccagccaagcttgggaacgtgacgggtatggacccagaactgatagagcaggttgagcgacgccacgctgataaacaccaccagcggcacaccgaccacagccaggggcaggtagaagatccagctcagcaggaaaccggtgctggtctggcgcaaggcagtggtgaggttgtagtcctcgctctggtggtgcaccgaatgcgcggcccagaggatattgcgctcatgacccatgcgatgcagccagtagtagcacacgtcatagaacacgaaggcgaacacccaggtccaggcactctgggtcgaccactcgaacagcgccaggtgcttaagggcgaatgcgtaggtcagcagacccacacccttggtcaacaacccggtggtggtggacagtacgccggtgctgaggctgttgatggcatctgccactcgatagttgtgcacgccgcgccaacggtcggccagcagttcaaccacgatcagggcgatgaaaaacggtaccgcgtaaggcacgaagtccatgggttagtccggtgtattttttgttacatcaagattaggtgcaccgccatgagatcccattggcaacagcttacaaattagtagacatttaacgccatgaatcaggagaaatgcccatgagcaaaaagattgcagtgatcctttccggctgtggcgtgtacgacggcgcagaaatccatgaaagcgtgatcaccctgctgcgcctggaccagcgcggcgctcaagtcgaatgttttgcgccgaatatcgcccagttgcacgtgatcaatcaccttaccggtgaggaaatgcctgaaacacgcaatgtactggtggagtcggcgcgcatcgcccgcggtgcagtgaaggacattcgcgaagccaacgccgcagactttgatgcgctgatcgtgcctggcggcttcggcgcggcgaagaacctgtctgacttcgccgtggaaggcgctgcctgcagcgtcaacccgcaggtactggagctggccgaagccttcgccgaagcgggcaaacccgtggggttgatctgcatttcgcctgcgttggccgcgaagatctacggcccgggcgtgacctgcaccatcggcaacgatgccgacacagcggcggccctggacaagatgggcgccacccaccacgaatgcacggtggaggacatcgtcgaagacaaggcgcgcaagttggtgagcacgccggcgtatatgctcggcaaaaacatcagcgaggtcgcatcaggcatcaacaagctggtggaccgggtgttggaactgacccacgaaaatgactaacgccctctttctgtaggagcgagtctgctcgcgaagaacgtcaacaataacgcgggcaagctggatgaacgcagcgctctcaggttcatcgcgagcaagctcgctcctacagaggcctcatcaaacgggtcaggattcggtccagcgcattagcaaacgcttgcttgtctttttccccatggggcggtggcccgccgcccatctggccctgctcacgcaggtcggtgaacaggttacgcaccgccaggcgttcactcatgttcgccgggctgaactccttgccccgtgggtcaagggctgtgacgcccttcttcaccagccggtcggccaagggcacatcgctgcagatcaccagttcaccgggcacagcatgctcaaccaggtagtcatcagccgcatccggcccgctgggcacaacgatgagcttcacacaggaaaagctcggcttgatctggctttgcccagccaccagcaccacctcgaactggcgcttgagggcaaacttcactacctggtccttggccgcccgagggcaggcgtcggcgtcgatccatactcgcatgctacgccgccgcccggcgcttctcggtcagccggctacggccatacagcaccacaatcgccaggatcgccacggcctgcgcacccaacgaatacgcatcggcatggatgcccagccagtcgaagtcaaagaacgccaccggccgcgtaccgaagatgcccgcctcctgcaaggccttgacaccgtgcccggcgaacaccaccgacagcgcgcacagcagcgccgcgttgataccgaagaacagcgccaacggcagcttcgccgaaccgcgcaggatcacccaggccaggcccactagcagcaccagcgccgtggccccacccgccaataccgcgttatgcccggccgggccggcttgcagccacagggtttcgtagaacaggatcacctcgaacagctcgcggtacaccgagaagaacgccagtaccgcaaaaccgaaacgcccaccgccgcccaccaggctgctcttgatgtagtcctgccaggccgccgcgtgacgccgatcgtgcatccatacgccgagccacaacaccatcacgctggcaaacaacgccgtgcagccttcgagcagttcgcgctgggcaccgctgacgtcaatcacatacgccgccaaggcccaggtggccaagccggccaacagcgccaggccccagccgacgttgacgctacgtaccgccgattgctggccggtattgcgcaggaaggccaggatcgccgccagcaccaggatcgcttccagaccttcgcgcagcaggatcaacaagccggaaatgtagctcaacgaccagctcaagccatcgccgcccagcaagccggcggactcggtaagcttgcccttggccgcgtccaggcgttgctgcacctgctcggtaggcaaaccgtcctgcaatgattgccgataggccatcagggccttctcggtgtctttgcgcacattggcatcgacgttatccagggagctttccaccagttcgaaaccttcgaggtaagcggcgaccgacaggtcgtaggcctgctcgtggtcaccgttgcggaaggctgcaaggctcttgtccaaggtggtggcggtgtagtcgagcaactgcgcggggccacgctggacttgcggcggctgcgcacgctgggcgcggaaagccgcggcggcggccggaccattggcggcgagcacttcattgggggtctggcgcgccaggtcggccaagttgaacgcctgcgcgcttttggcggcagccgggtcggcggtgaaaccggagatgtaggtagccaggtcccagcgctgacggtcgtccagttgatcagcgaacgatggcatatcggtgccttcgacacccaggccgagggtgttgtagatcgcgtacaggctcaagcgatccaggcgtgcagcatcgcgcaggttcgcgggtggcggcgtaaggcccacgcccgccgggccatcaccggcaccggccctaccgtggcagaccgaacagtgctgagcgtacagcggcgcgccgcgtgtagggtcgggcgtgatggccggggcctggctgacttcataggccaccgccagcttggcacccaactgacgggtctgacgagccacacccgcaccgtcctggcgggcattgaccgccgccagcagttcatcgacgccggttaccagctcggcgcgctcaggcttatccggcagatcggccaccagaccctgcaacaccccaagaaactccacctgctcgcggtattccgagtcgtccaccaccttgcccgcctctaccgtcggagggtagtcggcgccaatgtagtccagcaaatgcagggcttgtggcgcgccttcggcggttgcggccaagagattgaagctgcacgacatcagcgccggcaacagcagccacgcaagaaagcggaaaggggcagtcatgaatgaatctcaagtggaaatacgaagtaacactattgttgagctttaatggattcgactcaaggtgttatttcatatcgccacaaaaccaatgtgggagggggcttgctcccaatgacggagtttcagtcaacagactcatcgactgattcaccgctatcggggcaagccccctcccacctttttgtgccggcttgttcagttacgttgtggcgcggtgcaagcttgcgaggaaaccggcggcaccgacaaacaaaccggcaaaggtgcggtttacgcgtttctgctgcttgggcgtgcgcagcagccgcagaactttagaggccaaccccgtgtagcccgccatcacgatcatatcgacactgatcatggtcgcaccgaggatcaggtattgaatcagcaacggagcctgcgggttcacgaactgcggcagcaccgccagcatgaacaccagggccttggggttgctggcgttgaccaggaacccccggaacatcatcgccatcggcttgccgatcgggcgtacggcggcgtcatcggtcatgtccatgggcaaggcgcgccattgcttaatggccaggtacaccaagtaggccaccccaaaccatttgattgcatagaacgcggtagacgacgccgccagaatggcgcccaagccgcccgccaccacggcaatctgcatcgccaggccaagctgcaggccgatggcgttccagtagccacgcacaaaaccgtattgcagaccgctggacatcgaggcgatggctccggcgccaggggaaagagaaatgatccaactggccaggaagaaagccagccacgtgtcgagagccattgcgcacctcagaagggagttagcggttgtgccttaagctaactccaccgaccaaagcctggctataaatttctgtaggagcgagcttgctcgcgaaaaactcacaagcgatacgggccggctggatgcactgcgttaccgttgacgattttcgcgagcaagctcgctcctacaagatattcgtacctgttcccggccaacgtcgcaccgaacgctggaagaacaaactgttgggcacctgcaccatcgcgctgctggtgccggcttcctcgacttcgatcaacgtggtgtagagcagattgatcgccaccacccgtcccttcacgccaggtttgtcgacggtgtccaccagttcgacgatgtcaccgagacggaacggcccgaccgtaaagatcaggatcgcgcacaacaggttggacagcaccgaccacatggcgaagaacgccactgccgccaccgcgacaaaccccgacagcgccgtccataagacagtggcggacacacccaggcggcccagcacaaagatcagcgcactgcccatgatcagccagcgcaggccgccacgcaggggcatcagtaactgcggcggcagcgggtagcgctcacccaggcgggtcaggcccttggcgacaaagcgctgggccaggtagccggccaacaggatcagcaggatttgcacgccgatccatacgggctcgacccattgcgccggcaacggcagttgcaacgcttccatcaggacagcgcctccagctccgcttgcagggtttcgagcaactcgagggcctccatccaggtttcctccaactgcccttcgcgcaccttgagcttggcctgttcggccagcaggtcgcgcagttcatccttgcgcacggcctcgtacacggcgctgtcgcccaggctggcttcgatcatggccaggcgctcgtgcaccttgcccaactcggcttccagcttgtcggcttcacgcttgtgcggggccaactgctggcgcaatgcggcggcagcctggcgctgggctttcttgtcggtcttgtctggattgaccggcgtgttactggccggcgcattgcgcaggcggtaatcggtcagccagcgcgcatagtcgtccaggtcgccgtcgaactcttcgaccttaccgtcagccaccagcaggaagttatcggtggtgctcttgagcaaatggcgatcgtgagagaccaccaataccgcaccgctgaattcctgcagggccatggtcagcgccaggcgcatttccaggtccaggtggttggtcggttcgtcaagcagcagcaggttcgggcggtcccaggcgatcagggccagagccagccgggctttttcgcctccggagaaattcagcactggctcatcgatgcgcgcaccacggaagtcaaaaccaccgaggaaatcacgcaaggtctgctcgcgttcggtcggcgccaggcgttgcaggtgcaacagcgggctggccttggaatcgagcgagtccagttggtgctgggcaaagtaacccaccaccgtgttctcgccacgggtcaggcgaccagacagaggctcaagctcgcccgagaggttcttgatcagcgtcgacttgcccgcgccgttggggcccagcaaaccgatacgagcgcctggcgtgagctgcagcttgaccttctccaggatggttttgtcgccataacccaggcgcgcatcagagaggtccaacaatgggctggagatcttcaccgattcgcggaatacaaagtcgaacggcgaatcgacatgggccgccgacagctcttccatgcgctccagggccttgatccggctctgggcctggcgggccttggtggcttgggccttgaaccgggcgatgtagctttccatgtgcgcacgttgcgcctgttgcttctcataggcctgttgctgctgggccaggcgctcggcgcgggcgcgttcgaacgcggtataaccgccacgataaagggtgatcttcttctgttcgacgtgggcgatgttatcgaccacggcatcgaggaaatcccggtcgtgggaaatcagcagcaacgtaccctgatagttcttgaggaagtcttccagccacaggatcgcatcaaggtccaagtggttggtcggttcgtcgagcagcagcaggtccgaagggcacatcagcgcttgagccagattgaggcgcatgcgccagccaccggagaagtcggcgaccgggcggtccatctgttcgttggtaaaacccaggccggcaagcatcttgcgggcacgggcgtcggcggtatagccgtcggcactgtccagctcagcgtgcaggcgggcctgggcggcaccgtcctgggctttttcggcttcggcgaggtcgtgttgcacctggcgcaggcgcaggtcgccatcgagcacgtagtcgatcgcgatgcggtccagggtgtcgatctcctggcgcatatgggcgatgcgccagtcggccggcagcaggcagtccccggagtccggggtcagctcacccagcaacaaggcgaacaacgtggatttgccggcgccgttggcaccgatcaggccggctttgtgaccggcgtgcagggtcagctcggcgtcttcaagaagacgttgcgggccacgctgtaatgttaggctttgaagtcggatcataatggcggcggagtctaccagcttcgttggccgctggcttgggtgtgaatatgtgcgctgacctgtggagctttgccctctcgacctacgctcgcccgggtgtagaggctgcttgcctgcgcttgcaggaacaaggagcggatgtgtgcctgttgctgtgtggtgcgtggctggaacaacgaggggtggcgtatacgttcgaacgcgtgcaggcattgcagctgctagctcgcccctggcggacacaggtggtcgaaccgttgcgacaagtgcgtgtgcaatggcgaaccatggcgcagcaggatacgcaactggcatcgctacgggagcgggtcaagactctagaaatggaagccgagcgagcattgctgatgcgcttggaaacgctggcgcaggcatggcctatcaatgagggggtgggtcagtacggatggcttgaaggcttggcgaccgaagccgccaaccttgaccacgacgcgctgcagcggctgcgcgtcgtagtcgccaacacttaagaagcgttggtttgggtggtgcttggcgctatcgatgcaggggtgctgctggtcgatgcggttggagcggttgaagcggttgcattggcagcaggtgctactggagtggctggcttggcgggtgctggttttgcagcagcgggtttggcggctggtttcgcggcagcaggtttagcagctggcttggcggccggtttcgcggcagcaggtttggcagctggcttggcggctggtttcgcagcagcaggtttcgcagctggcttggcggccggtttcgcagcagcggtttggcagctggcttggcggctggtttcgcagcagcggttttggcagctggcttggcggctggtttcgcagtagcggttttggtagctggcttgacagccggtttcgcagcagcagttttcgcaaccggcttggctgcaacttttgcaggggcacgagcgcccagtgctttccctacggcttccttcacacgaccaatgccctgggccagcttcaggctttcctgagcgtctttcttgagttgggaaatgtagctgcgggtctcagcttgacgatccttgagggcatccagcaggtcctcaagttctttaacggcgtccttggctttggcttgcgccttggacttgccggctgtagcggcgtcttgcaatttggtgcgggacttgtgcagtttttcttgggctttaccgcgttgtttttccagtttggcgagcagtttttctgcatcggccaacgcctgggaacatgcgctttcgagatgttcgagcaggctgcccgaaagttgttggagcaagtgcaacggggtatttacaggcttctgtttggccgacatggtttacctcctggctgacgtgggtgcggctcatactagccctctgctcttaccgccgctagggcatgttgacagtatcgtttgccttgcgttgcaccgtacgaaaattcttatcgatataacgaaaaaccgcgccactttttactcactcaccctggcataatccgtcgcactttcgccgggagactgcccatgtcgcgttacctttttctagtgcttggcttggcgacctgcttagcggatgcgagcgagcaactgccgtcaaaaaccaccgcctcggatccgcacgatcttgcctatagtctcggcgcaagcctcggcgaacggttacgccaggaagtccctgacctacagatccaggcactggtggacggcctcaggcaagcctaccaaggcaagccgcttgcgctggacaacgcacgtatcgaacagatactcgcccagcacgaagcacagagcgccgccgacgcccaaatccctcaaagcgaaaaagcacttgccgccgaacaacgattcctgacgcaggagaaagccgtcactggcgtgcgcgaattggcagacgggatcctgctcaccgagctggcgcctggcacaggtaataaaccgctggccagcgatgaggtgcaggtgaaatacgtggggcgactacccgacggaactgtcttcgacaaaagtacgcagccgcaatggtttcgcctggacagcgtaatcagcggttggagcagtgcgttgcaacagatgccggtgggtgcgaaatggcgcctggtaattccttcatcccaggcctatggcgcagatggggcgggtgagttgattccaccctttactccgctggtgtttgagattgaactgctcggcactcgccactgacccataaaaaacggtgcgacatgcgcaccgttttttatatcgtcgccaaggttcagacctgggtggccggctcttccttgtgagcgttgtgcagcacttcgatcaggcaatcctccaactcgaaacgctcatgcagcagcgcacccaattctttgaatttttccgctacacatttccctgcatcacacaggtcggtgaacgccagcagtttctccgtgatcacatcgatgcgcgggtaaatagtctctgccaggtcgaggccacgctggtcgtcgaaggcttgcgcctctttggtcagttgctcgtagacgccgaaatggcctgccgatacataatccaccagtgctccacagaaatcctgcaatcgctcgcgattctcacccaatgcttcgggcttggcaccgagagcatcaaaggcccgaaccagttcgtggcgtgccttcaaccagctgtcgatcagcttgtgcaccccaccccagcgttcctgagcattctgacaactttccagcatgatgatctctcttccctataggggggtgctgctgctatgtacctgcgcaacacttcgaggataaagcagcagccggacaaggccgcgtctgacaaacggtttggataacgcgtgcgggccagattatgcccgcacgactgtggcttcaaggtacgcaggagagaaagttcatacaagtgtttaatccactcctacaaactgcgttcggttttcatggccttgcagggcgcaaatgcctacaaaataacaaccttgaaaattgcatggtgcccaggatcagcatggttacgaagaacaacaggctccactcgggaaggctcagttcaaatagcgtccaggtgatttcgacgcaatcgacagtgccgttgaacactgcacgtatggcttgccagaacgacaggctctcaatcatggattgcaggttgggccagcaatcccggacctggcctggcggcatactctgcagtagcacttggcgccccgcggtaatggcgccaagcagcgcacatcccatgctcgccagcccatacaggcaaacgcccaagcgcccagggttataaagagcagcgaccaggttgatcaacgtaaacgtggcaagcaacaggcgttgtacctggcataaaaaacaaggctgtagcagcgcgccatattccagataaaaggacgcgcccaacgtcagcgcacctgccatgaacgccaggaaaaacaaagagcgtaaaggggccaaagacattgtttatccgcactgcaagagataggacgctacggtagagtaaaggcccgacccctttcaatacgctctagagcagactattccgcgaaaacgtaaggacatcccgccagagcccggaggaaatccaattacaacaagtaggaattagtaacaacaccgcttaagccaagtgtttacgggggcatggcggaccgggtgtcagataggtcggagccaatctgttcaccctttcctacttcaaactcgcacagggactggcagcggcgaggacagcagacgattgtccagcaaccccaggccttcctggaacaattggttgctgcgctcggtgtcgcccaactgggccagcaggcgggccagttcggcgcaggcttcaggattgcgctgcacttgcaggctgctttccagatagtcccgtgccttgccccacagactgttttgcaggcagaggcggcccagcgtcaacagcaaactggcatcgccaggatgatccttgagccagccttcggcaaacttcaattgacgtgcaggatcactgccgcgcagcaggccatacagccggatcaagtgactgtcatagccacgcttgagcgcgccacgtagcacctcctcggctttggcatccgcgccaagtcgacgcagctggtcggcatacgccagcaccagctgtggctgctggcgctgggccgaagtcaattgctcccatgcccgttcgagggactgcaagcccgcttcaccttgctcttcacgctgggcagccaggctgaggttctcgccccaggcgcgacgctccagctcggccagctcgcccgcaggcagcactttgtccttgcgcagttcaggcaacaggcgaatcaccgacgaccagtcgccacgctgctgatgcaggcgttgcaactgtcgtagcacctgcgcgttatgcggatgacgctcgtgcatcgcctgcagggtaaccagggcgccgtcggtatcgcctcggtccatctgcaattgcgcatggctcagcgcaaccgccagttcggcctggggctggcgctccagggcgcgctcgagcaagccatcggactcctcataacggccctgctcattggccgcacgggcggcaccgatgtaatacaacaacggctggcgctctgcttccgcggcgcggtgcaaatggcgttcggcgctggcccagcggccctcggcaaggtccatctggccttgctcgatagcaatctgcacacggcggctgcggttgcgccgcgaccagggattgaccacgccactggatgtggtgaccaggctcaacaacacgcgcaccaggtagatcgccaggccgatggcaaataccgccaccaaggtagcccacaggctcgattcgtaatgcagcaaatggggataggtaatcagcacgtagccggtgtgtttcgaaatgcccacgcccagcgccagtgcgaccgcaatcgccagcaccaggatcacatagaaacgcttcatcagctctactcctgggtcgccggttggccagccgaggccttggcatcatcggcagactgatgacgacgttcgaggtacgcctgcactgcggccaggctcgccgccaggtctggggtcaccaccgaaacggccttgggctcgagttcagcgatacgcgccagcatcgccttgctctgcgggttgtcctggttgaagttgtcttgcaacacgctacgcgcttcacccagcgagcggctgtacaccgccgactcgccattcagtgcggcccattgtgcttgctccagcgccaggctcagggccagtcgcacttggttcaagccttggcccgccaacaatgggcggatgttgtcatccgggttgaagtcgatgcggaagtaacgggaaatctgctcccaccactggctcaaccagttctccgtatcgctggtaggacgcccttgggaggaaggctcggtgagttgatactccggcgcaatcgccgccaactgcacgacctggtcacgcaaggccgccagctgcaggtaaaggccggtacgatctggttgctcggtgctacgcagcgcggccaggctcttggccagttgctcgcgcgcggcgaaagcgcctgggtcgctctgctcgcgaagaatttcgtcggcgccctggaccagcgactgagcgctgttgatgtcttgtaaggcggacaagcgcaagctggccagacggatcaggtgctcggcttcggccagccgccagtccttgcggctggcgcccaacacggtttccagacgctggttcaggcgctgctgatcaccctgcagttgggcgaccaggcggcgacgctcttccagttcatccgcgcccggcaactgcgccaggcgggcggccaattgttgctggctttgcttgaggctctgggattggtcatccagggtttgcacctggcccagctgatgctggctgctggcttgcagcgcgcggacctgccagatcccccagccgccggcggctacgcccacagcgcccagaagcaaggcgacgattgccaggccattgccacggcgtggcgtactgaccggtgtctcgaccggcgcatcgagcgcgggctgagcttcatctttaggcaaggctgtttcgctcacgtatccgtcctttgcgtatcagagagtgggaacgggatagctccctaacgccactaacaaagccgcggcactcgcgccacgacaatccacaactttttctgcaccagcggcccgcgccatttcatagacgcgcggactgggcacgaacaatggcagctgtgccacctctggccaatcggggccggccatggcctgcaagtgtaaaaaaccctgcccactgctgaccaccaggccgttcaagcgttccaactggatgcgctgcatcagtgcgcccgcctcgtaagccgggagaaaacgccgatacaattccaggtagtcgacactagcaccttgctcgcgcaaacgctctgccagcagctcccgcccgccttcgccgcgcaggatcagcacccttgcacccggccgggcagtagcctcgcgcaatgcaggcaattgaagcaaggcctcgctgtcatcgccagtggctggatagtgaacatcgaggccatgatcggccagtatctgcgccgtcgccgccccaacgctgaaccagggcattggcgccggagtactcttcaatcgttgcaaggccaggcgcgcggccggtttgctcaccacgatgaccgcgcaatagcgctgcagcgcgccgaacaacgcttgttgctcgggcgtgaccggcaacgcttcggtttccagcaagggtaggctgctgctgtagataccagcctcggacagcaaggcccccagggccttcgagtcctcggcaggccgcgtcagcagcacgcgccagtcggtcactgcgggccggcctcgccatagactttctgcaggatggcgccagcgcctttgcccagcaactcctcggcgacctggatgcccagggccgtggcatcacgttgcgggccgcgcacttcggcggtcagcagcgtaccgccgtccgggtcgccgaccaggccacgcagccacaggttttcaccttcgagcaccgcatagcaggcgattggcacttggcagccaccattgagatgcttgttcaaggcacactcggcggtgacacgcacttcggtatccgcgtgatcaaggggcttgagcagtgcgtggatttcgccgtcggcggtgcggcattcaatgccgaccgcaccctgcccgcccgcgggcaggctgtcttcgatgctgatggctgacgtgatgcgctcttcgaagcccaggcggatcaagccggcagcggcaaggatgattgcgtcatattcgccggcgtcgagcttggccaggcgagtgttgacgttgccgcgcaggaaacggatctgcaaatcggggcgccggctcagcaactgagcctggcgacgcaggctggaggtgccgacgatactgcccagcggcaattcatccagggatgcgtaggtgttggaaacaaaggcgtcacgcgggtcttcgcgctcgcagatgcaaaaaaggcccaggccttcagggaagtccatgggcacatctttcatcgaatgcacggcgatgtcggcttcgttctccagcagcgcggtttccagctccttgacgaacaagcctttgccgccgattttcgacagtggcgagtcgagcagcttgtcgccacgactgaccatgggcaccagggataccttgaggcccggatgggcctgctcaaggcgtgctttgacgtattcggcctgccacaaggccagggcgcttttacgggtggcgatgcggatttcgcgagaggacatggatcaatccgaactgaatagttacagcggataataacagctcaggcaaatacgctttgatttgaatcagcaagtgcggggcctccctggccacatcgcaccgggataaggaatgcagaccgcgccgcagcccttgggctaaagctgctgcatcatcttgcgcacgccggcgacgtggcgtcggctgacaatcagtgcatcgccgttgagtcccttcaggaatagctgaaagtgccccaggggcgtacgttgcaggcgctcgatacgttcacgggctaccagcgcgttgcgatggatgcgcacgaagcggtcgccaaactcgtcctcgagagccttgagcggctcatcgagtaatacctcgcccaactcatgacgcagggtcacgtacttatgatcggcaataaagtagacgacctggctaaggggtatcagctcgatgcccttgcgggtgcgcgcactgatgtggctgcgtggcccgttaccactttgggcggccggctgggtcaaggcagcgagctgggcgcgattgggtcgctcggctttcttcaaagccttgagcaaggcttcggcgctgaccggcttgacgagaaaactgacagtgctgtcttcgagcgtctgagcagaaaactcatcctgggccgcacacaacaccacggccggtggcgattcgcgctcgctcaggcgagcggccacttgcaggccatcgaggcccggcatgcggatatcgagcagcaccaggtccggcttgaggctgtcgatcagggtcaacgcctcctcaccgttggcggcactcggttcaaggattgtataaccctcgagttcactgaccagacggctcagtcgctcgcgggcttggggttcgtcatcaacgatcaggacattcatattgcgctggattcctgcgtgagtctcgcacaaggatagcgtagacaggtgcggtgacttacgtcacagcgatccacgctaagactagcgcgagcggcaaaaagtgccctgagagcggcacccaaatttacccggacctgttcaatagcgcccaggacctgctgccgtcgggcatcgtcgtagggttcactgatacacaatccgaatacccccctgtttaatggatagtctggttatgaccgcatcagtcgactttggtgcattcacacactatcagtgcaactgtagacgctcaccgagacgatattgctcaatcgtcaaatatcgtttcaataagtacctgcctccagtctcgtcccggatgcggccggcggcaaggcacttagccatctacgccgcaaataaaattgccaggcacccgcaacaccgccaccaagggcaaccctgttattatcgccggcacacctccatgcctctttcaaacagatcacgagcgaatccatgagcaccgacaagaccaaccagtcctggggcggccgcttcagtgaacccgtcgacgccttcgtcgcccgcttcaccgcctccgtcacctttgaccaacgcctgtatcgccacgacatcatgggttccatcgcccacgccacgatgctggccaaggtcggcgtgctgaccgatgccgagcgtgacagcatcatcgacggcctgaccaccatccgcggtgagatcgaggccggtacgttcgactggcgcgtcgacctggaagatgtgcacatgaacatagaggcgcgcctgaccgaccgcatcggcgtgaccggcaagaaactgcacaccggccgcagccgtaacgatcaggtagccaccgatatccgcttgtggctgcgcgatgaaatcgacctgatcctggccgaaatcacccgcctgcaaaaaggtttgctggagcaggccgagcgtgaatcggacaccatcatgcccggcttcacccacttgcagaccgcacagccggtgaccttcggccatcatctactggcctggttcgaaatgctcagccgcgactacgagcgcctggtggattgccgcaagcgcgctaaccgcatgccattgggcagcgccgcgctggcgggtaccacctacccgatcgaccgcgagtacaccgcacaactgctgggctttgacgccgtgggcggcaactccctggatggcgtgtcggaccgtgacttcgccatcgaattctgcgccgccgccagcattgcgatgatgcacctgtcgcgcttctcggaagagctggtgctatggagcagcgcgcagttccagttcattgacctgccggaccgcttttgcaccggcagctcgatcatgccgcaaaagaaaaaccccgatgtgcccgagttggtgcgtggcaagagcggccgggtattcggcgcactgatgggcctgttgaccctgatgaaaggccaaccgctggcctacaacaaggacaaccaggaagacaaggagccgctgttcgacgccgccgacacgctgcgcgactcgctgcgagcctttgccgacatgatcccggcgatcaagcccaagcacgcgatgatgcgtgaagcggccctgcgcgggttttccaccgcgaccgacctggctgactacctggtacgccgtggcctgccgttccgtgactgtcacgaaatcgtcggccatgcggttaaatatggcgtagataccggcaaggacctggcggaaatgagcctggaagaactgcgccagttcagcgaccagatcgagcaggatgtgtttgccgtgctgaccctggaaggttcggtgaatgcccgcgaccatgtgggcggtactgcaccggcacaggtcaaagctgctgtagtacgcggcaaagaattgctcgccagccgctaaaactgtgggagggggcttgctcccgatggtggtgggtcagctaaggttttcttacctgatacaccgccatcgggagcaagccccctcccacacttgattattttttggccgcaatcatcgccatgaatgacggcagcgccgcctgcctgtccgcctccaccttttgcgcgttgggcatttcattcaggcgcgcgagcagcgtcttcgcctttggtaactcagccagcagatccaggccaaacagcttctcgcccacaccacaggccagattcaagctgtacatgaaatacagatcggcaatggtaaaactttcacctgtcacataaggtgcgaacttgccatgccgccccaaagaagcgatgcccagcaacaactcggccttggatttttccttgatcgcctccggcaccggcatgccgaaaaatgcctcggcgaaacacgctcgcgcaggcagctcgatgtagagctcgatttctcgacacaacgccagcacctgagcccgttgaaaaggctcggccgggagcagcgcagggccctcctgggtctgctcgatgtattcgaggatcacgctggtttcgttgataaacccctgcttcacgcccagcaccggcaccttgccgcgggggcttatcgccagtgcttcgggagtttgcccggcataaaaaggtacctcttcgaaaggcagccctttctccagcaacgccagtttcaccatgttgtagtagttgctgaccgaaaatccgtaaagcttgagcatcgcaaagcctccaggccgggtgcggggttggctgcaagagttatagatgcccgaagcagggctgaccagcagcatcacctacctgaatggcggtagactgacgtcctttccttaaggagcctgccatgagcgagccgaccgatattgataacgacgaagaagagttcaccgaaagcacgctgacccaggccatcgaaaaccagatcgaaagcgacaacccgcctgccgccaaggccaccttcaataaactgaccttggtaggttacgagcgcgaagacattttgaacctcatggcccatgtgctggcggttgagatagacaagatgctcgaagaagaccgtgctttcgataccgaatggtatgaaacggcgttgcgagcgctccctgaactaccgcctgaaaacaactgaaaccagcctcggcgtggccgggaagcccgcttcctcgccacaaatctgcgccatatcaatacctacgactttctcactggacagcccgccaaagtgcgttcaccttatggcgtgctagcctctaataaatttagaaagtctggagtccttatgtcgtatacacccgagttggttgccgaactggaaatccttgcactcttcaacctgggcagttcccaggaaggtctgaaagtccaccagactgccgctcctgccgccattgccgctgccaagcgcctgttcgagaaaaaactgatcgaccagccggatggcggttatctgaccagcctgggtcgcgacgccgccgaacaagcacaaaccctgctgactatcctgaccaccagctcgaccaaagaagccgcctgataactgataccgcccgtggagtccgccctcgcggattccaagggtgttgctgtgcaacggcgaaaattctgacaccaaaatcatttcccctctaaacctcctacgcttctggctgtaaactcctacacggccgcccatgtcgggccctgcgagccgccgagttcgacatgacccgcacccatgaaatccgccccgacctggacgaaggcatcgaccgcaaggtgctgacccagttgcgcgcgcgcttcatggcactcaatgaagagcgcatggcccgtgccgtcgaggggctgaccccgcgccagcaaagcgtgctgaccctcctcccgctatttttccacgtcaatcacccgttgttacctggctacgtctccagcaccaccccggccggcctgtcgaatttcgaacctgacgatcaagccctgaccgaagcccagcgcctgacccgctcattctcttataagccccgccacggcaacccgccccgaccgatccacggcctatttctgatgggcagcctcggcacgctggcccaggccgatcaaagcgatatggatgtgtgggtgtgccatgcgcccgatctgaacgacaacgaactggccgagctgcgcaagaagtgccaattgctggaggtctgggccctgggcatgggcgccgaagcgcatttctttttgatcgagccgacgcgtttcgtattgggtgagcgcgacacgcaactgagttccgacgattgcggcaccacccagcactacctgctgctggacgagttctaccgcaccgccatatggctggccgggcgcacgccgatctggtggctggtgcctgtgtatgaagaaagccgctacgccgaatttacccacacactgatgtccaagcgtttcatccgcgccgacgagaccctagaccttggccaccttgcccacatcccgccgggcgagttcatgggtgccgggctgtggcaattgttcaaaggcatcgaatccccctacaagtcggtgctcaagctgttgctgaccgaggtctacgccagcgaacacccaaacgtgcaatgcctgagcctgcgttttaaacaggcggtgttcgccaatcaggtcgatctggatgagctggacccttacatcatggtctaccgccgcatcgaggagtacctcaaggctcgcaacgagccagagcgcctggaactggtgcgacgcagcctgtacctgaaggtcaaccgcaagctcagcgtcggccagcgcactaccggttggcaacggctgctgctcgagcgcctcgctcttgagtggggttgggaccaacgccaactggccctgctggacagccgcagccagtggaaagtgcgccaggtcgcttccgaacgccgtgccctggtcaatgagctgaactacagttaccgcttcctcacccagttcgcccgtaccgaacagaccgtcagcctgataaacaagcgtgacctcaatgtgctgggccggcgcctatatgcagcgtttgagcgcaaggccggcaaggttgagttcatcaaccccggtattgctcccgacctggccgaagataccctgacactggtgcagtcgcccaaccgcaaggaaactggccagtaccattggggcttgtataacggcaacctcacggccttggaatgggagcacttcgcgccgatcaaacgcagccgcgacctgctggaaatgcttacctggtgccaccgcaacggggtaatcgacagcagtacccgcctggcgctgcacccaggcaccagcgacatgaccgagttcgagctgttcaacctgctgggcagcctgcagcagaccatcgccctgcccctggccagcgtcgatgaagtccgcctgttgcgtccggcagtgccggaagaagtgttgttgctgatcaacgtcggcgttgatccgctcaaacatcatcgtgagctgaatatcctgatgaccaccgagcgcaccgactccctgagctatgccggtgtacgcgacaacctggtgctgaccctggaccaggtcacgctcaatagctggaacgaggtgatggtcagccgctacgacggcccccacgcgctgctcgactgcctgcgcgactacctcaaccaactgccgtcagatcatctgccacggctgcgggtgcgctgcttctgtcacaaccgtgcgcagttcattgcccagcgtgtggaggaggtattcgacactgcgcagaacctgctgctcagccagggcaatcaccgctacctgcttcaggtgcagcagcactatcacgtgatggaactgacaccgggccaggccactcatgtgccgctgcccacacaggacgcgctgattgcctacctcagtgaggaactggccagctacagcccgtggcacctggacgccatggccctggaagaccacgacctggcgctgctgctacccatgggccaggccgattgtgtgcaggtgttctatcgggtcaacgaaggcttcgccgagctgtacgtgctcgacgaattcaatgccctctggcagcagcgcctgccattccacgatgaacagagtctgctggcgccactgcagcgcttcctgcaatcgaccctttaccgccgggaggcgttatcgtccctggacgcgcagccacccctgggtgagattcataccctgtactaccagctattgccctcaggcaactcccgcgcgcgccgcgtcgagccaaggccagccccgcaaaatcctgccgacaagccgttttatgacgtgcaggcgattatcggcaagggcgcgccgggccaggtggggattacgttgtactgcaatcagcgggaattttccgagctggaattcggcgaccaactgtttgccgtggtagcccgggagatcgtcgcgcaacgccaggaaaccgaacgataccgctgctatatcaccgatctggatttgtcgggcctgctgggggacgtgcagagcccgagcaatctgtacctgcgctacaaggcagaattggaacagtcactcaatgcggcgctggatcaggtctagagcgtgaaggcgccgccatctttgggctggccttcgacgttgagcagttcaagcttgagtgtcttgccgcccggcgcaggccagtcgatatgctggcccacttgcaagcccagcaaggcactgcccaccggcgcgaggatcgagatcttgccttcgtcggcattcgcgtccttggggtagaccagggtcaggtggtagtccttgccactgccttgctcacggcagtgcacactggagttcatggtcacgacagttgcaggcacttcatcgtggccaaccacttcttcggcgcggtcgagttcgtgttgaagggcttcgacgcccggcgagtcctcgccttcacggtcgatcagttgctcaagacgctgcacgtcgagacgggtaagaatgatggaaggtgcggtcatgattcaggcagactccttttttctgcacaaaaaaagcaaaaccccgccaggaaaaggcggggttctcacggacctcgatgagttgaggtgtatccggacactaccacagcgacacaaataaacaagacaacgtcaggcgcgtgccttgcgttgctcggcttcggcgcagatcacccggcgccgcgcatcgtcggcagagcgccattcgcggatatcttccacatggcggaagcagccgaggcagaccttctgttcgtccaggcgacacaaactgatacaaggtgacggcaccgccgggctgacattactgaacagcggcttgggcgggcgtacaggtgcaggctgggtcacggtcagatctcgtcctgccccaactcatcaaagtccagctcgacgccggtatattcctggaccaggcgggtgagcatctcgcccaacaattcttcgctcttgtcgcactgccatttgccgctttcttcgtcgtagtcgaagtgaacgccaccggagcgcgccgccagccacagctgacgcagtggttcctggcgactgaagatcagttgctggccgctctcgaacttgacggtcagcacaccggccgagctttccagatccacatccaggccgctgtcgtcgaaaatatcttccagcttctcctgggtggtatccaccaggtcgtgaaaacgggcttcggtcaaactcatcgtggcaacctcaaaagtgtctggttttgctcaagcgccgcacgatacggacgcgcttcgccgattgcaaaggataccgatttcattacagacggcagtacgaaatatgctctaacagcgtaacccgcttcccagtcatctcggcaaacccccgccggacgggtattgcggcgcataggcaagctggcgggtggtcggtatactcgggcgcaattaatgcatattcaaggatttcgccatgaagcgcctgatctcttcccttgctgcgctcgtcgcggtcgcctgtctcgtcagtgcctgtggtcaaaaaggcccgctgtaccttcccgatgacagcaaagacccgaatgaacaggcgcaatcgtcgcaaaagccgtcaaaagcgcataagcacgacacctactaagggacacttatggacgcttttaactaccgggacggcgagctgttcgcggaaggcgtggcgttgtccgcgattgcccagcagtttggcaccccgacctatgtgtactcccgtgcgcatatcgaagcccaataccgctcgttcaccgacgcgctctacggcgtaccgcacctggtgtgctacgcggtcaaggccaactccaacctgggcgtgctgaatgtcctggcgcgcctgggcgccggtttcgacatcgtgtcccgtggcgagctggaacgcgtactggccgccggcggccaggctgacaagatcgtgttctccggggtcggcaagagccgcgatgacatgcgccgcgccctggaagtcggcgtacattgcttcaatgtcgaatccaccgacgaactggagcgcctgcaggtcgttgccgccgaaatgggcgttcgcgcgccgatctccctgcgcgtcaacccggatgtcgacgccggcacccacccttacatttccaccggtctcaaagagaacaagttcggcatcgccatcgccgacgctgaagacgtgtacatccgcgccgcgcaactgccgaacctggaagtgctgggcgtcgactgccatatcggttcgcaactgaccaccctgccacccttcctggatgcgctcgaccgcctgctggcgctgatcgaccgcctgggcgagtgcggcatctacctgcaccacatcgacctgggtggtggcgtgggcgtgcgttatcgcgatgaagaaccaccggcgatcgccgactatatccaggccgtgcgcgaacgcattgaaggccgcgacctgaccctgatgttcgagccgggccgttatatcgtcgccaacgctggtgtactgctgacccaggtcgagtacctcaagcacaccgaacacaaggatttcgccatcgtcgatgcggcgatgaacgacctgatccgcccggcgctgtaccaggcctggatgaatgtcaccgccgtgacgcctcgcgcaagcgttgcccgcgcctatgacatcgtcggcccgatctgcgagaccggcgacttcctggccaaggatcgtcagttggccctggaagaaggtgacctgctggccgtgcattcggccggtgcctacgggtttgtcatgagttccaactacaacacccgcgggcgtaccgccgaggtgctggtggacggtgatcaagcatttgaagtgcgtcgccgcgagacggtagcccagttgtatgctggcgaaagcctgctgccggagtaagccatgctgctgcgttttaccaaaatgcacgggctgggcaatgacttcatggtcctcgacctggtcagccagcacgcgcacatcctgcccaagcacgccaaacagtggggcgatcgccacaccggtatcggcttcgaccagttgctgctggttgaagcgccgagcaacccggaggtggatttccgctaccggatcttcaactccgacggttccgaagtggaacagtgcggcaacggtgcgcgctgctttgcgcgctttgtgctcgacaagcgcctgaccgccaagcgccagattcgtgtcgagaccaaaggcggcgtgatcgaactagatatccgcagtgacggccagatcagcgtcaacatgggcgcgccacgcctggtgccggcggatattccgttccaggccaccgagcaggccctcagttacccgctggatgtggatggcaagaccgtggatatcgctgccgtgtccatgggtaacccccatgcagtactgcgggtcaccgacatcaataacgccccggtacacgaactgggaccgaagatcgaacatcacccgcgctttccggcacgggtcaatgtgggcttcctgcaggtgatcgaccgtacccgtgcgcaattgcgcgtatgggaacgtggcgccggcgaaacccaggcttgcggcaccggcgcttgcgccgctgccgtggccgcgatcagccaggggtggatggattcgccgctgctgatcgacctgcccggcggacgcttgtccatcgagtgggcaggcccaggccacccggtaatgatgaccgggccggcctcgcgtgtatacgaaggacaggtccgtctatgagtgagccaagccaatgaccgataagcctcaagtacccgcacacgctaccccgagtgaaagcctggaggccgctgctgtcgcggcgtaccttgaggctaatccggacttcttcgtagagcacgaagagttgctgccggccctgcgtatcccccaccagcgcggtgacaccgtgtcgctggtggagcggcagatgaagatcctgcgcgagcgcaatatcgaaatgcgccatcggctctcccatctgatggacgtggcccgcgacaatgaccgcttattcgacaagacccgccgcttgatcctgaccctgatggacgccgccagcctggaagaaacggtgatcgccgtggaagacagcctgcgcgaggatttccaggtgccttttgtaagcctgatcctgttcagcgataacccaatgccggtggggcgctgggtcacaggtggcgaggcgcagacggccatcggtggcctgctttccgaaggcaagaccgtcagcgggaccttgcgcgaacatgaactggacttcctgttcggggccgaacagcgcaagcagatcggctctaccgcagtcattgccctcagccatcagggcttacacggcgtactggccattgccagccgcgaccctgcacactacaagagctcggtgggcactttgttcctgacctacatcgcagaagtgctgggccgtgtcctgccacgccacaccaccaccctgcgcgcggtgcgctgaccatggagcggcaactggacgcctactgcgctcatctgcgcaacgagcgccaggtgtcgccccacaccctcgaagcctatcgtcgggacttgaacaaggtcctggcctattgcgaaaaacagcacgtcagcagctggaaggccctggatatccaggccctgcgcagtctgatcgcacggctgcaccagcaaggccagtcctcgcgcagtttgtctcgcttgctgtcggcggtgcgtggcctctaccactacctcaatcgcgaaggcttgtgcgaccacgacccggccaatggcctgtccccgcccaaaggcgaacgacgcctgcccaagaccctggataccgaccgcgccctgcagttgctcgatggcgccgtggaagatgacttcctggcccatcgcgaccaggcgatccttgagctgttctattcctcgggcctgcgcctgtcggagctgaccggccttaacctcgatcaactggacctcgcagatggcctggtgcaagtcctcggcaaaggcagcaaaacccgcgtgctgccagtcggcaggaaggcccgggaagctctcgagctatggctgccgctgcgcctgttgaccaatcctgaggacgatgcggtgtttgtcagccagcagggccgacgcctgggaccacgggcgattcagctgcgggtcaaggccgccggtgcgcgggaactcggacagaacctgcatccacatatgctgcgccactccttcgccagccatctgctggagtcctcccaggatctgcgcgctgtgcaggaactgctcggccacgccgatatcaagaccacgcagatctacacccatctcgacttccagcacctggcaacggtgtatgacagcgcccatccacgggccaaacgcatcaagggcagcgacttatgagcatcaagctgatcaccttcgacctggacgacaccctctgggacaacgtacctgtcatcatcagcgccgaagcgtcgatgcgcgaatggctggcggtcaacgcctccaaggtcggggacttgcccctggagcatttcgccagcctgcgccagcaagtactgcagcgccatcctgaactcaaacaccgcatcagtctgttgcgacatcgtgttttggtgcatgcgttcgaggaagccggttacccccaaccagaagctgcgcagatggcggatgtctgctttgaagcgtttatccatgcacgccaccagctcaccgttttcccggaggccgagccgatgctcaaagcgctgcgccagcactttttgctgggagtgatcaccaatggcaacgcggacgtgcagcgcgtgggcctggcggactactttcactttgccttgcgcgccgaagatatcggcatcgccaagcccgatgctcgcttgtttgaagaggcgttgcagcggggcggcgtggatgccagtgcggcagtgcatgtgggcgatcaccctggagatgacatcgccggcgcacagcaggcggggctgcgggcggtgtggtttaacccgacgggcaaagtgtgggaagcatcaaagcgtccggatgcagagattcgtagcctgacggagttgccgcagttgctgcagagctggcagtaacaccgcagatcaaaatgtgggagggggcttgctcccgatagcagtggttcagccagcacatgtggcaactgatacaccgcgatcggtagcaagccccctcccacatttagaacaccacaaggctcggataaatcataaggcgtgaaaaagcccgcagcgacggcgggctttttcggcaagcaggaggcagactcagatgggtcggctgccgtacttgttgtccggcttcttcggtggatcagccaccacgttgggctcgacttcgaccactttgccgcctttagcgaggaattcttccatcgcacgggccagggcatcgcgctctttgttcttggcttcaacgctcggcagctcgtctaccgagaccgcagccttggctttgcctttggctttggggctcgcctcatcgacactgctctcatcgacatcgtcagcaacgtcttccgctgctacttcaagaccttcttcggtttcgtcttcatcacctacttcgaggtcgtcttgttccagatcatcgtcgctcatgttctacctcatgacttgcgaaaagcagattagttatagcccagcttcaccctctgtcgaggtcgccggaaaaaaatcaacatccaccggataaccagtggcttatgcctcttcaccctgcaaggtggcgaggactttacgagcaccgccatgatcacggtgctcgcccagataaacaccttgccaggtccctatcgccaagcggccggccttgaccggcaaactcagctggcagcccagcagactggccttgaagtgcgccggcagatcatccggaccttcgtcgttgtgttcaaaccctgcgccaccttgtggcaccagcaggttgaaaaaccgctcgaagtcacggcgaaccgccgggtcggcattctcgttaacagtcaacgaggccgaggtgtgctgcagccacagatgcaacaggcccacacgacacgcctttaattcaggcaagccggcaagcaactcgtccgttaccagatgaaagccccggggcttggcccgcagggtaatcagggtctgtcgccacatacagttctccgcccatcggcgcgcattctagcgtgctctgtgaaaaaacaaagcgccgaatacgccttcatagctgtaagacatttgcacccttgaaagtgccgtgtggataccatcacaaagtcgacaaaaacccacgtacctttagccacagacaaacgccaggcaaaaaaatgcccggcaagccgggcatcttttttcatttgcttacaagttgtagccgcgctcgttgtgttgcgccaggtcgaggccaaccgcctcttcctcttcggtgacccgcaggcccatgaccatgtccagtaccttgaggatgacgaaggtcacgatcgccgtgtagataacggtgaagccgacgcctttgcactggatccagacctgggcagcaatgtcggtcacggtgccgaaaccgcccagggcgggggctgcaaacacacccgtgaggatcgcaccgacgataccgccgatgccgtgcacgccgaaggcatccagggagtcgtcatagccgagcttgcgcttgaggctggtggcgcagaagaagcacaccacaccggcgaccaggccgatcaccaaggcgcccatcggccccacagtgccagcggctggtgtgacagcgaccaggccggccaccacgcccgaggcgatccccagtgcgcttggtttaccgtgggtgatccactcggcaaacatccagcccagtgccgcagcggcggtggcgatctgggtcaccagcatcgccatgcccgcagtgccgttggccgccgcagcggaaccggcgttgaagccgaaccaaccgatccagagcatggcggcgcccaccagggtatagcccaggttgtgcggggccattggcgtggtcgggaagcctttgcgcttgccgagcacgatgcacgccaccaggccagccacaccggcgttgatatgcacgacggtgccgccggcgaagtccagcacgccccagtcccacatcaggccaccgttgccgctccagaccatatgcgcgatcggcgcatagaccagggtgaaccagatcgccatgaagatcagcatcgcggagaacttcatacgctcggcgaaagcaccgacgatcagcgccggggtgatgatggcgaaggtcatctggaaggtaatgaacaccgcttccggaaacagcgccgcaggcccggtaatgctagccggggtgacacccgccaggaacgccttgcccatgccgccgaagaatgaattgaaattgaccacgccctgttccataccggtggtatcgaacgcgatgctatagccgtagacgacccacaggatgctgatcaggccagtgatggcaaagcactgcatcatcaccgacagaatattcttggagcggaccatgccgccgtagaacagcgccagcccagggatggtcatgaacagcaccagtgccgtggcggtcagcatccaggcagtgtcgccggagttgaggactggagcagccacttcatctgccgccatggccaggcctggcattacgatggacagcagggctccgagccctgcgaatttacgcagagtcatattgttttctcctggggcgttggggtttggcggcttagattgcgtcggtatcggtttcgccggtacggatgcgaatagcctgttccagattgaccacgaagatcttgccgtcaccgatcttgccggtgttggccgccttggttatcgcctcgataacccggtcaagatccttgtcgtcaatggcgacatcgatcttcaccttcggcaggaaatcgaccacgtattccgcgccgcgatacagctcggtatgacccttctgccgaccgaagcccttgacctcagtaacggtaatgccctgcacgccgatctcggacagtgactcgcgtacatcgtccaacttgaacggcttgatgatggcagtgactagcttcatgaaaactctctcccgaattggtggacttgccccaggaaaacaaacccgtctcaagtctaagcgcagcgcctggctttgtaacgcatcgtcgcctcggcatatgccgtcacgacgccagcgaaccactggtgacgaaacctttaccccctgatccctcggcgcactgcattcgtcacagcgactgcgtcagtgcatgggtcatgatcgtctaagcagaaaccttgccagctccgtaaaaaccactgaaaacagtcctttgcccacttgtgcccaccctcggggcgtttgcgcggcggcaatgcgcatcaaaacagtgcgcgactgcccgccccactgcgcgaaaagcgtgcgcagcggggacgtgaaaagactatagacgctgcgtgatacactgccggccaactgtttccggaatatttcccatgctcgcgcccaaagacttcctcgacgccctgagcggccacgcctctcgcctgttcagcggcgacaccccgctgccccgcaatgaaatcgaaagccagttcaaggcattgctgcaaagtggtttcagcaagctcgacctggtcagccgcgaagaattcgatagccagatggtggtgctcgcccgcacgcgtgcgcgactggagagcctcgaggccaaagtggcggaactggaagcgcggctgacaccaacatcgactgaataaacgcaatccatgtgggagggggcttgcccccgatagcagtgtgtcagtcaccattaatattggctgatgcatcgccatcgggggcaagccccttcccacatttgttttgcatcgcactatggatacgttctgtaaaacctcccccgcctcgctcttccacacctcgtctacccttgaagaacccgcaggaagcggccctcatactcaaggaacgagcatgtccctcgccatcgtccacagtcgcgcccaggtcggcgtcgaagcccctgccgtcaccgtcgaagtgcatatggccaatggcttgccatcactgacactggtgggtttgccggagacggcggtgaaagagagcaaagaccgcgtgcgcagtgccatcctgaattcggcgctgcaatacccagcacgtcgcatcaccctcaacctcgcgcccgccgacctgcccaaggacggcgggcgttttgatttggcgattgccctggggatcctcgcggccagcgtgcaggtgccggcgttgatgctcgacgaggtggagtgcctgggagagctggcgctgtccggcgaggtacgggcggtaaagggtgtgttgccggcggcactggcggcgcgcaaggctgggcgcaccgtgatagtgccccgagccaatgccgaggaagcgtgcctggcgtctggattgaaagtgattgccgtggatcatttgctgcaggtggtggcgcacctgaatggacacgtgccgattgaaccgtacacatccgacggcctgctgtatttgaacaaaccctacccggacctgagtgaggtacagggccaattggcggccaagcgtgcgctgctgatcgccgcggccggtgcgcataacctgttgttcagtggccccccgggcaccggtaagaccctgctcgccagccggctaccgggtttgctgccgccgctgagcgagcaggaagccctggaagttgcagcgatccaatccgtggtcagcctccagcccctgagccattggcctaaccgcccgttccggcaaccgcaccattcggcatccgggccggcgctggtgggtggcggctcgaagccgcaaccgggggaaatcaccctggcccaccacggggtgctgttcctggatgaactgccggagtttgatcgtaaggtgcttgaagtgctgcgcgagccattggagtctgggcatatcgtgatctctcgagcccgtgaccgggtgagtttcccggcgcgctttcaactggtcgcggcgatgaacccctgcccttgcggctacatgggtgagcccagtgggcgttgccggtgcacgccggagcagatccagcgctatcgcaacaagctctccgggccgttgctggaccgcattgacttgcacctgacggtggcccgggagaccactgcgctgaacccctcccaacagatcggcgaaaccaccgctcaggcatccgcccaggtagcgcaagcccgcgagcgtcagcaacaacgccagggctgtgccaatgcgtttctcgacctgccgcggctgcgcgaacactgccagctggcaaaagccgatgaaacctggctggaggccgcgtgtgaacgcctgacgctatccctgcgcgccgcacaccggctgctcaaggtagcgcgcacgctagcggatcttgagcaagtagacggcatcgcccgccatcatttggcggaagccttgcaataccgaccggccgcgattggctgacagcggtcaggagaaccccagcagcagcctcgccacctccagcacttcatccaatgccgcttctgccgactcggtggaaggcttgagcatcaggtcatcggcatagcccatcgccagggcaaaaatctgccgtgcagcgcgttggggcgactcgcagtgaaacgcgccggcggcaacgccgcgttcgatcacctcggcaagcatgccttgccattgggcgttgatcgccaggtaagcctgggccatttgcgcgtcgtgcatggcctcgtcccaggcgtcgagccatagcgcccaaccggcatcggcagtgctgggcaggcagtcgtgcaagaaccccgcgagcgcctccagcggtggcgcatcggccaagggctcgcgcacttcgtgcaattgctcattggcaaagcgcacaaaggcttcgcggcgcagttcattccagtcgctgaagtagtgataaacgtgactgcgcgacagcccggcatgttcggccaggtcacgggtggatacatcggcaaaacccttgctgcgaaacagctccagggcggcggcgatgatctggtctttacggtcgatacgcgacattgagcaattccttcgagcgtgaacagataagcggcgcttgctttttgagcgatcgctcaaggatacttgagcagtcgctcaataatagcgtctatcattcctttggtgcaccccatgacatccgtcaccccacacattctgatcgaagaaagcaagaaaatcggtcaacagtccgccagccagacactcaaggctattgccaaagcctatcccggcaagctgtcttgcaccttgtcgctggtggcgcttgagaacgcactgttgttggcttacccgctgtttgccgggttcgcggtggattcgattatccgcggcgataccaccagtgcgttgctctatgccgccgtggtcatggcgttctgggccgtaggagcggcacgacgggcactggacacgcgcacgttcacgcgcatttacgccgatctcgcggtgccggtcattctcaaccagcgcctacagaaccacagcacctcgaaatcggcggcacgggtggtgcttgcacgggagttcgtcgacttctttgaaaaacacgtgccaatcattgccacggcgttagtgtcgattgtgggcgcggcggtaatgttgatcgtgattgagccatgggtaggcatggcgtgcctggccgcgctgctgctgtgcatgaccttgttgccacgctttgcccaacgtaatcagacgctgcacgagcgcctgaataatcgtctggaaaaagagatcggcctggtcgaaaaggtcggcgcgccaaccctgcgacgccactaccaggtgctgtcacgcctgcgtatctggctgtcagaccgcgaggccgcggcgttcctgtttatcggtgcgatcgcagccttgctgttcgtggttgcgatcagccagttggccatgaccccagcggtcaaggctggccacatctacgcggtcatgacctatctgtggaccttcgtcaccagcctggacgaagcgccaggcatggtggaccaactggcgcggctcaaggacattggcaagcgcgtggatccagggcttggagagccctgagcctcaacgaaaccggtcgacctcctgacgcaagcttgccgccaaggtctccagctccttggcggtaaccgccaggttcgacaccacttcgcgctgctcgctgttggccagtgcaatgctctgcaagttgctgctgagcaaggtggcggtactgctctgctcctgggtcgcggtggtgatcgcagcgaactgctggccggccgagcggctttgctcgtcgatacgcgccagggccgaggccacggcggcgttacgcgacaggccctcctgcatcagtacattgccgtgttccatggtgctgatggcattgccggtttcctgctggatgctctggatcatcgtggaaatttcatcggtagcctgacgggtgcgcgacgccaggttgcgcacctcgtcggcgaccacggcgaaaccgcgaccctgctcaccggcgcgggcggcttcgatggcagcgttgagcgccagcagattggtctgttcggcgatggccgtgattacaccaacgatcccgccgatttcctgggagcgctggcccagggtgttgatcaccgcagcggtgctgttcagggcagtggcgatatgctccagggacgatgacgcctcctgcatcgaatcgcggccaatgcgggtctgctgggcattctcttgcgccaggcgctcggtattgcccatgttgtcggcgatgttcaacgaagtggcgctgaattcttccaccgcgccggccatgctggtaatttcgccggactgctgttccatgccttcataggcaccaccggacaaacctgacagcgcctgggcgcggctgttgacctgttcggctgcgttgcggatatgcgaaaccatggtcgacagcgcgtcacccatctggttgaagctgcgcgccaattggccgatctcgtcatggctggacacgttgaggcgtgcactcaagtcgcccgcgccaagagcttctgcctggcgtaccaggtcgctcaatggcgccagcttgctgcgcaacagccacaccgtggcacccactgccagcaacatcgccagcacactgccgattaccaggcggataccgacttcccaagtcacggcgcgaatctcagccttgggcatgctcgctaccactgcccatgggccgccgtcgaacggcaccgagacgctgtagaagtcctcgtgcttgtcgctccagaagcggccagctccaggtttcttcgccaggtcgagcatcaccgcaatggcctcatccggcgcctgcacgccagctggcgccaccagccaatgcttctgttcatccagcagcgcgagggagcccgtctggccgatacggaagcgcttgagattttcaaactgggcgttctgggcgtcggtgtaatcgaaaccgatgaacaacacggcgatgaccttgccgctgctgtcacgcaccgggctgtattgggtcatgtaggaacggtcgaacaaaaccgcacgaccgatataggtctgcccctcggcaacgcgctggtaagctgcgccctgacggtcaagcacggtgccaatggcgcggttgccatcctgcttggtcagcgaggtgctgacgcggataaagtcgtcgccgctgcgcacgaacaccgtggccacgccgccagacatctgcttgaactcatccacctcttcgaaattgttgttcagcacctcgtcgcccaggtaaaggctcggggtctgcacgccggccaccgccaccggttggtcagcacgcacactcaagccggcgacgaagcgcttttcaaacagcccgctcaaacgctgggtactttcgcgcaaggtgctgtggaaggtattgagttggtcggcgagcaaacgcgcctcactggccaggtgttcctcacgggtgtcgaggttggcggagtcgagggagcgcagggcgaagacggtactgccgctgataacgacagccagaatcacggcaagtgcgagacctaactgggaggcaatccgggcacgaggttgagacatgggagctcctggccgaggccaggatcatcctgatctcttagcgctgctcggcaaattattctagtgggaaacgttggtgcacgatggttccaacaccccttcttcggcggcatttgccaatacttgagagaattacaggggtatcgcgcaaacgattgcacgaccacttaagtccactcaatctaggcgctcgacccgaggcaattccatcgccttgacttcgctttgaagaaactccgccaagcgccgcaaacgctcgccgcctggacgggttttcggccacaccaggtagtagttttccctactggcgaccgccgtgggccagggcaggctcagccgaccttgcgccacatcctcagccaccatcagcagatcgcccatggaaacgccatagcctcgcgccgcagcgatcatgcccagttctagggtatcgaatacctgcccgcccttgagggatacctgggacgacaaccccatgcgttccagccagttgcgccagtcgcgacggtcgggggtggggtgcagcaattccgcactcgccaggcgcgcggcgtcccaaggaccatcgtccagcaggttcggcgcgccgacggggatcagcaactccgggaacaagtaacaggcgtcccagtccgccggaaaatgcccgtagctcaacaacaccgcacagtcgaaaggctcctggttgaagtccacttcgtccacgttcatccatgcactggtcagttgcacctcattgcctggctgcaaggcgcggaagcgactcaaccgcgccagcagccagcgcatggtcaatgtggacggcgctttcatgcgcaggatgtcatcttcggcattcagggtatgacaggcgcgctccagcgcggcgaacccttcgcgcaccccgggcaacaacaggcgtgcggcttcggtgagctgcaggttgcggccgctgcgctggaacaggcggcaagcgaaatgctcttcgagggtgcggatatggcggctgatcgcactctgggtaatggacaactcctgcgccgcacgggtgaaggagttgtgtcgcgaagcggcttcaaatgcacgcagggcatacagcggaggaagacgacgagacattgggaaagctccgacggcgcaatatcggcaccctaccagaatcaatccagcatgagttttaatcatgcgaacgatcgcatttatccttttgtgcagtggacgcaaagcgccgagaatcaaccctctcccaacactctgaatattcgagcgtgatgatcatgcaacatccggcacgtaccgagctctgggccattctgcggctgtcggggccgttgattgcttcacagctggcgcacatgctgatggtgttgaccgacaccctgatgatggcgcgcctgagccccgaagccctggccggtggtggcctgggcgcggcgagctattcgttcgtggcgatcttctgcatcggcgtgattgccgccgtgggcaccctggtcgccattcgccatggcgcgggcgatatcgacggcgccacccgcctgacccaggccgggctgtggctggcatggttgatggctctggcggcggcattgctgctgtggaacttgaaaccggtgctgctgatgttcggccagaccgaaaccaacgtgcacgcggccgggcaattcctgacgatcctgcccttcgccctacccggctacctgagcttcatggcactgcgcggcttcaccagcgccatcggcaaagccacgccggtaatggtgatcagcctgtgcggtacggtagtcaattacctgctcaaccacgcgttgatcgaaggcatgttcggcctgccgaagctgggcctgatgggtattggcctggtgaccgccatcgttgccaattgcatggcgctggccctgatgtggtacatccgcagcaaccgcgcctacgcggcctacccgctgagcaccggcctgctgcgcctgaatacccaatacctgcgcgagctgtggcgcctgggcctgccgattggcggcacctatgcggtggaggtcgggctgttcgcctttgcggcgctgtgcatgggcaccatgggcagtacgcagttggcgtcgcatcagatcgccctgcagattgtctcggtagcgttcatggtgccggcgggaatgtcctacgcagtgaccatgcgtatcggccagcattacggcgccggccagttgctgcaggcacgcatggccggccgggtcggcatcggctttggcgccatggtgatgttggggtttgccgttgtgctgtggctgttttccgacccactgatcgggttgttcctcgatcatgacgacccggcgttccatgacgtcatcgtcctggccgtcagcctgttggccgtcgccgcctggtttgagttgttcgacggggtgcagaccatcgccatgggctgcatccgtggcttgaaagacgccaagaccaccttcctggtggggctgggctgttactggctgattggcgcaccttcggcctggctgatggcgttcactttaggctggggaccaaccggcgtgtggtggggcttggcgctggggctggcgtgtgcggcggtgagcctgacgtgggcatttgaggcgaagatgaagcggatgattcggcaggagctgcaagctcatggtgggagggggcttgcccccgatggcggtgtatgagccaacacattcagcaactgacactccagcatgggggtcttccacagaatgtttagcccggcaacgcctgctggctttgcccaaacatcaggtattcgaccaattccggcaatggcaacggcttgctgatcaggtaaccctgggcctggtcgcacccgaacaagcgcaacaatgccaactgctccggcgtctctacaccttcagccaccacttccaggttgaggttgtgggccaggttgatcatcgcgtgcaccaacttgcggttttcctcgcgttcttccatgccaccgacaaaactcttgtcgatcttcaacaaggcgatcggcaggctgttgaggtgcacaaacgacgaaaagccggtgccgaagtcatccagggagaaccgcacaccgagtcggccaagggcgtccatggtctgcttgaccaagtcgctgcggcgcatcacggcagtttcggtcagctcgaactccagccattgcgcttccacaccgcgctcggcaatcaggcgactgagcgttgacagtaattggctgtcctggaactggcggaacgacagattgaccgccatgtgcagcggcggcagaccgcgttcgcgcaggtcttgcatgtcgcgcaaggcccgggaaatcacccagtagcccaatggcacgatcaggccgctctgctcggccagcggcacgaactcgctgggcggcaacaagccgcgctcaccgtggcgccaacgcaccaaggcctcgagaccgacgatatggccgtcgtccagatccaggcgcggctggtagtgcagttccaactcatcgcggcgcagggcccggcgcagttcactttccaggtcggccaggctgcgagcattgcggttgatgcgttcgttgaagatatgaaaggtgcagccctgggtgcttttggcctgctgcatggcgatatgggcgtgccacatcagcgggtcggcgccggctcgggcgcgggcatgggccacgcccaggctacagccgatcaacaggctttcaccgtccacccagtacggctcggccatcacttcggtgatgcgctcggccatccactcggcacgctgcggcgcccgacgggtatcgatcagcaaggcaaactcatcgctgcccaggcgggccagttggtcgccggcctcgagctggctcttgagccgcgacaccacttgcaggatcaggcggtcaccagcctgatggccgagggcgtcgttggcatgacggaagttgtccaggtccaggtggccgagggccaggccgcggccttcgttttccaccagccgcgccgccagcagggtctggaaaccctggcgattggcgataccggtgagcgggtcctgctcggccaggcgctgcaaggtgttctccagcacgccgcgctcgcgcacatggcgcaagcagcggcgcagtgtgtcggcgtccaacgcatccaggatcaaccagtcgctgacacccagcggcgcaaccaatggttcctgctccagcagcaatacacacggcaagctgcagcggccggggccgggttgcaggctcggtgtggtcaatagcacagcaccttggtcgtcatcgaacagacgactcaccgagtcccagttgggcgcactgatcagcacagccccctcgcccatcggcgccaggcactcgcgcaacaacgctgcccacgcaggctcttcggccagcagcagcaaacgcaagggttcgacaggcgtagacacgctaactccctagactcggcaaaatttcgttggcggtggcattatgacgtgcggcctggcaatgataaatgcatgacaaatgcatggcagatgataggtgttatcaaacacgcagactgtgaaaaatagtctgagtattccccacatcctgcggcaaagtagcaaaaccggcaaatttagatcgagtggtacgtcacaccgtcgttctatggcagcagaatctttccagcctgttaaaatgcccgcccttttgaacaacgactccttaaattccgtatgtcccgactcaatccccggcagcaagaagccgtgaactacgtcggcggccctctattggtgctcgccggcgccggctccggcaagaccagcgtgatcacccgcaagatcgcgcacctgatccagaactgcggcatccgcgcccagtacatcgtcgccatgacctttaccaacaaggcggcgcgggaaatgaaagagcgggtcggcaccttgctcaaaggcggtgaaggccgtggcctcacggtgtgcaccttccacaacctgggcctgaacatcatccgcaaggagcatgtgcggctgggctacaagccggggttctcgatcttcgacgagaccgacgtcaaggccctgatgaccgacatcatgcagaaggaatacgcgggcgacgacggcgtcgacgagatcaagaacatgatcggcgcctggaaaaacgacctgatcctgcccgccgaggccctggaagccgcacgcaaccccaaggaacagaccgctgccatcgtctacacccactaccagcgcacgctcaaggcgttcaacgcggtggacttcgacgacctgatcctgctgccggtcaagctgttccaggaacacaaggacatcctggagaagtggcagaacaaggtgcgctacctgctggtggacgaataccaggacaccaacgccagccagtacctgctggtgaaattgctgatcggcacgcgcaaccagttcaccgtagtgggcgacgacgaccagtcgatctacgcctggcgcggcgcccgcccggaaaacctgatgctgctcaaggtcgactatccgtccttgaaagtggtgatgctggagcagaactaccgctccaccagtcgcatcctgcgctgcgccaacgtgctgatctccaacaacccccacgagtttgaaaaacaactgtggagcgagatgggtcatggcgatgagatccgcgtgatccgctgccgcaacgaggatgccgaagccgagcgtgtggccgtggaaatcctcagcctgcacctgcgtaccgaccggccctacagcgatttcgcgatcctgtaccgcggcaactaccaggccaagctgatcgagctgaaactgcaacaccaccaggtgccgtatcgcctgtcgggcggcaacagctttttcgggcgccaggaagtgaaagacctgatggcctacttccggctgatcgtaaacccggacgacgacaacgccttcctgcgcgtgatcaacgtgccgcgtcgggaaatcggctccaccaccctggaaaagctcggcaactacgccaccgaacgcaagatctccatgtatgccgccaccgacgaaatcggcctgggcgagcatctggatacgcgcttcactgaccgcctgtcgcgcttcaagcgcttcatggacaaggtccgcgagcaatgcgccggcgaagacccgatcagtgccctgcgcagcatggtcatggacatcgactatgagaactggctgcgcaccaacagctccagcgacaaagccgcggattaccgcatgggcaacgtctggttcctgatcgaagcgctgaaaaacaccctggaaaaagacgaagacggcgaaatgaccgtcgaggacgccatcggcaagctggtgctgcgcgacatgctcgagcgccagcaggaagaggaagacggcgccgaaggtgtgcagatgatgaccttgcatgcctccaagggcctggaattcccttacgtgttcatcatgggcatggaagaggaaatcctcccgcaccgctccagcatcgaagccgacaccatcgaggaagaacggcgcctggcctatgtgggcattacccgcgcgcgtcagaccctggccttcaccttcgctgccaagcgcaagcaatacggcgaaatcatcgattgtgcccctagccgtttccttgacgaactgccaccggacgacctcgcctgggaaggcaacgacgacacccccaccgaggtgaaggccgtgcgcggcaacaccgccttggcggatatacgcgcgatgttaaagcgctagaatcgactactttttaatctactttcggcgcctgttgcgccatcagaggaagtttccgtggaagcactgcacaagaaaattcgcgaagaaggcatcgtgctttccgatcaggtactcaaggtcgatgcctttctgaaccaccagatcgacccggcgctgatgaaactgatcggcgacgaattcgccgcgctgttcaaggactcgggcatcaccaagatcgtcaccatcgaggcctcgggcatcgccccggcgatcatgaccgggctgaacctgggcgtgccggtgatcttcgcccgcaagcagcagtcgctgaccctgacggaaaacctgctgtcggcgacggtgtattccttcaccaagaaaaccgagagcaccgtggcgatctccccgcgccacttgaccagcagtgaccgcgtgctggtgatcgatgacttcctggccaacggcaaggcgtcccaggcgctgatctcgatcatcaagcaggccggcgcaaccgtggcaggcctggggatcgtgatcgagaagtcgttccagggtgggcgtgcggagctcgatgcgcagggttatcgggttgaatcgctggcgcgggtgaagtccttgagcggtggtgtggtcaccttcatcgagtaatttgctccacagcaaataccaagtgaacacagtttaaaatgtgggagggggcttgctcccgattgcggtgtatcagtcaccagatgtgttggctgacccactgctatcgggagcaagccccctcccacatttaccctctattgcctgttaatgcgcggtggcctggaggccggcgagtaacaggcgctgatacagatcctccttgaacccctcgggattatccaagcgcatccgcttcaaatgctcgggaaatgcctccggctccggcgcgtcgagtgccgccttgcccaactccagaatctccgtcagcttgaatttgctcttgagccagttcaacgcccgcaacaaatcccgctcttcacctgtgaaatcactgcccagcgggtattcagggaagagtcgtcgatgcctggcttgaatcgcttgcagccgttccggcgtgttgtcgccaaagcgcggatccagctggaaatccttgggcagcttgccggccttttgcgcctggtcgatcaactcgccctggaaccgtgagtcggtgacattcagcagcgcttcgatcaccttggcatccgtctgaccccgcaaatctgcaatgccgtactcggtaatgacgatatcccgcagatgccggggaatggtgcagtgcccgtactcccagacgatattggaactgacctcccccgccgcctcgcgccaactgcgcaggatcaggatcgaacgcgcaccttccagcgcatgcccctgggccacaaagttgtattgcccgcccacaccgctgagcacgcggccgtcttccaattggtcagccactccggcaccgagcagtgtcaccatgatcgcgctgttgatgaaccgcgcatccaggcgttgcaaacgcttgagttcttcctggccgtacagctcgttgatatagctgatgcccgtcatgttgaattcgaggcgcttggcgtgggtcatttcctgcaggcgctggtaaaagctgcgtggccccaggaagaaaccgccatggatcgacacgccatcgggctgggccgcatcatccagcaagccggcattagcctgcgcctgggtcgccacatccgggtacaccttgcgccggataatcccggcatccgccagcaccagcaggccgttgacgaacatctcgctgcaaccgtaaaggccccgggcaaaaggctcgacaccgccttcacggctgatcaacggcgcccactgatacacatccatgtccgtcagcaacaaccggtaggcttcgttatcggcctggcgcgccagcaaggcagcggtcagcgcatcgcccatggaaccgatgccgatctgcaaggtgccgccgtcacgcaccagggtgctggcatgcaggccgataaaatggtcctggaaacccaccggcatgttcggggtagaaaacagcgtggtgctgtctttttcatcgagcaggtagtcgaaggcgtccatgcccagttccgcatccccaggcatgtagggcagatcgctgtggacttggccgacaacgaggatggtttccccggcttcgcggcgcttggcgatcatcggcagcaggtcgagggtgatatccgggttgcagctcaggctcaggcggtcgggatgctcggcgctgctggcaaccagttgcgccaccaggttcaggccggcggcgttgatgtcgcgggcggcatggctgtagttgctgctgacgtaatcctgctgtgccgacgtgctgtggagcaggctgccgggctgcatgaaaaactgctggacctggatattcttcggcaggctgtctttatgcaggtcggcgagaaaatccaactcaggatagtcaccaaacacccgctcgatgaaaggttcgaggaagcgtttctgcaaaccatcgcccaaggttggccgacccagactcaaggcggtgtagatcgtcagtgcccgctccggcaacttggcgatgcgccggtatagcgcattggcaaacaggttgggcttgcccaggcccagcggcatacccatgtggatatgcgccggcaaccgcgccagtacgtcgtcaactgcttgctcgattgaacacaactgcaccatccgactgctcccgaacattccatgaattggagttggaccgagcttgccgggtctttgctgcaatgaacagcttcgaaacataaatcgcgggcacaaaaaagccgctcgtaagcggcatttttggcgaagatcgtctgattacagaccggacatcttcttgatggcgcctttgaggtcttcatccgagcaatcagcgcaggtgccttttggtggcatggcgttaataccggtgatggccttggccaggatgccgtcgaggccgccctgatgatcggcgcgctctttccaggcagcggtgtcgccaactttcggcgcacccaagaggccagtgccgtggcacgcgttacagtgcttggcgataatctcgtccggcgtcttcgcaccgccgccacccgctgccacggccacttccatgcccttgcactcctggccctggacgcacacctggcccacgggctccaggcgcttggcaatatcatcattggtcgcagcctgggcgctgacagcccatagggccagtacggttgctggtgcagccagcattttcataattaggttcacgcgttcaccctcaatggtggctattcacgcctgcggccacggtttcgcaggcggcgaaagtataacggttagcccgcctggccgaaacaaccctattaaataaagggagattcaacctcgcggaatactgcacgggcgtctctacaacgttggcaggacgcctcttctgttaaaagttcgcgggcgtggctgcgctgattagtcgcgccggcacgtcgaacgggttgcgaaaacgatgcggcttggtgctttcaaagtagtagctatcgccagcttcgagcacaaaagtttcaagaccgaccaccagttccaggcgaccctccagcaggatcccggtttcttcaccttcgtgggtgagcatttcttcacctgtgtcggcgcccggtgggtagatttcattgagaaatgcgatagcccggctcgggtgcgcccggcccaccagcttcatggtgacggcaccgtcggagatgtcgatcagctcattggctttatagacgatctgcgtcggtatttcctggaggatctcctcggaaaagaactcgaccatggacatagggataccgcccagcaccttgcgcaaggagctgatcgaggggctgacgctgtttttctcgatcatcgaaatggtgctgttggtgacgcccgcacgcttggcgagctcacgctgggaaagacctttgagtttacggatggattgcagtcgttcgccgacgtccaatgcaggagcctcctaggattcaggctttgttgtaattgagcgttatcatggcgacagcgttcagtatttacaacacttgggcctaaatcccggacagcttggttcgtagccggcggctaagccccggaatagaggcgtggcactcggcgcaggttgcagaagatctggtagggaatggtctcagcggctacggcgacgtcactggcgaggatagtcttgccccacagctccacagtgtaaccgaggcccgcctggggtatgtcggtgaggtcgacacacagcatgtccatggacacacgccccaacagttggctgcgctggcccgccaccagcactggcgtgccggttggcgcatggcgcgggtagccatcggcatagcccatggcaaccacaccaatacgcatcggcttgggcgtgacgaacttggcgccatagcccacgggctcaccggcgggtagctcgcgtacgcagataactttggactccagggtcatcactggctgcaaacgggcagcgagcgcttggtcttcaccaaatggcgttgcaccgtagagcatgatgcccgggcgcacccagtcactggtcatcgtcggccagcccagcaccgacggcgaattgcgcaggctgacttcggccgccaggccttttcgcgccgcttcgaataccgccacctgttcgtcactgcgcacgcaatcgagttcatcggcgcgggcgaagtggctcatcaacacgatcttggcgaccttgccgctggccagcaggcgctgataggcctcgtggtaatccttgggatgcaggccgacacggtgcatgcccgagtccagcttgagccacaccgtcaacggcttgctcaggcgggcctgttcgatggcatccaactgccatagcgaatgcaccacgcaccacaagtcatgctcgatgatcagcggcagctcgtcggcctcgaaaaaaccttccagcagcagcaccggcgcacgaatgccggcagcacgcaattccagggcttcctcgatgcacgccacggcaaacccgtcggcctcggcttccagcgcctgggccacacgcacggcaccatggccgtaggcgtccgccttgatcacggcgagggccttggcccccgtgacttcacgggccagttgatagttatggcgcagggcttggaggtcgatcagggcacgggctggacgcatggcggcaggcttctaggcagcaaggtgaagaaaaaaccggtgccgaccaacagcgtcggcgccgggagagggatcgttattaaggcagcgcagccacgacggacagctcgaccaggatttgcggctcgcagagcttggcttcaaccgtggcgcgagccggggcgacgcccttgggcagccacttgtcccataccgcgttcatgccggcgaagtcagcttcgatgtctttcaaatagatcgttaccgacagcaacttgctcttgtcagtgccggccaggtccagcagacgctcgatattggccagggtttcacgggtctgctgttcaatcccggcgctcatgtcgtcgccgacttgacctgccagatacacggtaccgctgtggacaacgatctggctcatgcgctcattggtgagctggcgctggattgacatgtttcgcggactcctggtggttgccataacgggaaatatcgagacctgcggcgctgatctgcggggttttcctggccatcaggtcggccagcaagcgaccagagccacaggccatggtccaaccgagcgtgccgtggccggtattcaggaacaggttcttgaatggggtggcaccgacaatcggcgtgccgtcgggcgtggtcgggcgcaagccggtccagaaactggcttgggccaaatcgccgccctgaggataaaggtcgttgacgatcatctccagggtttcacgtcggcgtgggttcagcgacaggtcaaaaccggctatttcagccatgccaccaacacgaatgcggttgtcgaaacgggtaatcgcgactttgtaggtctcgtcgagaatagtcgaggtcggcgccatggccgggttggtgatcggtacggtcagcgagtagcccttgagcgggtacaccggtgccttgatccccagtggcttgagcagcttcggcgaataactgccaagggccaggacgtagcggtcggcagtttccagcttgccgtctatccacacgccgttgatgcgatcacctgcataatcgaggcgctggatgtcctgttcaaagcggaactccacacccaactgcttgcacatatcagccaggcgcgtggtgaacatctggcagtcgccagtctggtcattcggcaaacgcagggcaccggcgaggatatccgtgacgctggccagggctggctcaacccgggcaatgccggcgcgatcaagcagttcgaacggcacgccggactcctgcagcacggcgatgtccttggcggcaccgtcgagctgggcctgggtgcggaacaactgggtcgtaccgaggctacggccttcgtaggcaatgccggtctcggcgcgcaactcgtcaaggcagtcacggctgtactcggacaggcgcaccatgcgctccttgttcaccgcatagcggctggccgtgcagttgcgcagcatctgcgccatccacaggtattgatcgatatcggcggtggccttgatcgccagcggcgcgtggcgttgcagcagccacttgatggccttgagcggcacgcccggcgcagcccatggcgaggcgtagccaggggacacctggccggcgttggcgaaactggtttccatggcagcggcaggctgacggtcgaccacaacgacgtcaaagccggcccgcgccaaatagtaggcactggtcaccccaatgacaccgctacccaagaccagaacgcgcatttttatatcctcatcacgggcttagccgctgacgtgtgttattcgagcaatgatgagcgcagtataaaaagcaatcaccagtgcatttcactatataaatgcctatatttggcgacaattctcggcaaaaacccttttcacagaggcgtatcccctatgcgtaccaacacccagaccaagcgggagctggacaagattgaccgcaatatcctgcgcatcctgcaaaccgatgggcgtatctcgttcacggagttgggagagaaggtcgggctgtccaccactccttgtaccgagcgggtgcgacgcctggagcgcgaagggatcatcatgggctacaacgcgcggctcaatccccagcatttgaagggaagtttgctggtatttgtcgagatcagcctcgattacaagtcgggcgataccttcgaagagtttcgccgcgcagtactgaaactgccccatgtgctggagtgccacttggtgtcaggggacttcgactacttggtgaaggcgcggatttccgagatggcctcgtatcgcaaattgctcggcgatatcctgctcaagttgccccatgtgcgcgaatccaagagctatatcgtgatggaagaggtgaaagagagccttaacctgccgattccggactgactcaccagcccaactcatccaaatgtgggagcaagcccccacattggccgagaacatccgctagaccaatacctgccgggtgctcgccatgtactcatggatctgtttttccacccttggatgaatcagctccaccggtccccgtccattggggcatggcagggtcttggtggtgccaaacaacctgcagatcaagggccgctcgtcatacaccgtgcaaccgttgggccccaggtgcacgcagttcaactcgtccatggccgcctcctgctctgcggcggtcttgcgcggcaggcgcgacatttcctcaggcgacgtcgtcaccggcccgcagcagtcatggcaacctgggacgcactcgaacgaaggaatctgtcgacgcagcgcgctgattttctgcctgttgcaactcatcgaaacacacaccgaaccgcgaataagcgtggattctgacgcaaaacgccctgcgcagacagcctcgtccgaccgctgtatcctgcgtcaaattttccaaacagggatgctcccccatgaccgccagcgcccggcacaccgcttcctactatgccgccagcagcctgccacaaccggattacccgacattgaccggcgatgtgcgtgccgatgtgtgcgtgatcggcggtggtttctccgggctcaatgccgccctggaactggcccagcgcggcttcagcgtggtgttgctggaagcgcgcaagatcggctggggcgccagcgggcgcaatggcggccagttgattcgcggcgttggccacggactggatcagttcgccaatgtgattggcagcgacggcgtgcgccagatgaaactgatgggtctggaagccgtggagatcgtgcgcgagcgcgtggagcgtttccagattccctgtgacctgacttggggctactgcgatctggccaacaaaccccgtgacctgcaggccctggccgaagacgccgaagagctgcgcagcctgggctatcgccacgaggtgcgcctgctgcaagccagcgagatgggcagtgtgatcggctccgaccgctatgtcggcggcatgatcgacatgggctccggccacctgcacccgctgaacctcgcactgggtgaagccggcgtcgcgcagcagttgggcgtgaagctgtatgaacaatcagaagtgacccgcatcgactacggccccgaggtcaaggtgcacaccgcccaaggcagtgtgcgcgcccagaccctggtattggcctgcaacgcctacctgaacgggctcaacccgcaactaagcggcaaggtgctgcccgccggcagctatatcatcgccaccgaacccttgagccaggcgcaagccgccaacctgttgccgcagaacatggccgtgtgcgaccaacgcgtgacggtggactacttccgtctgtccgccgaccgccgcctgttgttcggcggcgcctgccactattccggtcgtgacccgaaggacatcggcgcctatatgcagccgaagatgttgcaggtgttcccacaattggccgaggtgaagatcgactaccaatggggcggcatgatcggcatcggtgccaatcggctgccacagattggtcgcctggccgataaccccaacgtgtattacgcccaggcttacgccggtcatggcctcaacgccacccacctggcgggcaagctgttggccgaggctatcagcggcgagcaacaggggcgcttcgacctattcgcccaggtgccacacatcaccttccccggcggcaagcacctgcgctcgccgctgctggccctggggatgctctggcaccgcctcaaggaactggtttgatcaatcgcgccagaagggtttcaaaccttcatggcgcgcctgttcagcgctaagccctacgtcgcgcagttgctcactggtcaggtccagcagggctttgcgtgtatgacgacggcgccagaacataccccagcgactctcggtcggcgcgatcatcgcccgcgcttgccccgcttccagttcctggctgcgtaacgccaaccgcacatcgctcataccgttcattttgctgtccctcattggtgtgttgccttgagtgaacagcatgcgcgagcggtcaaaaccattacagattcaacctatttttattaaaccaatacagacactgcctatgggtggctgaatcctgtattttcaccctatctgtactggtccctcgggagcgaccatcatgaccctctacgtcaaccttgccgaattgcttggcacccgcattgagcagggtttctaccgtccgggggatcgactgccttcggtgcgagccttgagtgttgaacatggggtcagcctgagcaccgtacagcaagcctaccggttgctcgaagacaatggcctggcgacgcctagacccaagtctggttactttgtgccagccagccgcgagctgccggcgctgcccgaggtcggtcgcccggctcagcggccggtggaaatatcccaatgggacttggtgctggagctgattcgcgcggtgccacgcaagggagtcatacagctgggccgtggcatgccggatgtactgtcgcccaccctgaagccgctgctacgcagcctggcccgcgtaagccggcgccaggatctgccggggttgtattacgacaacatcctcggctgtatggagctgcgtgagcaaattgcccggctgtcattggactcgggctgccagctgaacgccgaggacatcgtgatcacgaccggttgtcacgaagcgctgtccgccagtatccatgcgatttgtgagcctggggatatcgtcgcggtagattcgcccagcttccatggcgctatgcaaactctcaagggcctgggcatgaaagccctggagatccccaccgacccgctcaccggcatcagcctcgaggcccttgagctggcgctggagcagtggccaatcaaaatcatccagctcaccccgaactgcaacaacccgttgggctacatcatgccggaggcgcgtaaacgcgcactgctgaccctggcccaacgcttcgacgtggccatcattgaagacgatgtgtatggcgaactggcctacagctacccgcgcccgcgcacgatcaaatccttcgacgaagatggccgcgtgctgctgtgcagttcgttctcgaaaaccctggcgccaggcctgcgcattggctgggtcgccccggggcgctacctggaacgggtgctgcatatgaaatacatcagcaccggctccaccgccacccagccgcagatcgcgattgccgaatttctcaagggcggctatttcgagccgcatttgcgcaggatgcgcacgcaataccagcgcaatcgcgacttgatgctcgactgggtcagccgctacttccccgccggcacccgcgccagtcggcctcagggcagcttcatgctttgggttgaactgccggagggcttcgacaccttgaagctcaaccgtgtgctggtggaacaaggtgtacaaatagccgtaggcagtatcttttcagcctccggcaagtaccgtaattgcctgcgcatgaactacgctgccaagccaacgccacagattgaagaggccgtgcgcaaggtcggcaccgccgcaagcaaactgctggcagaaacggcggactgacctttaccgctcaattgccgtcatataccgacaaacgccatgatctggaagcagctcccttgatgattcgacggcttttaccgtttttcctgttgggagccctggccctgggtggctgcgcgacggtcagcgtaccgcgcattcccagcgatgccctggcggcgacgcagtcgtcattcggccgctcgatccaggcccaggcagcgccgtaccaggggcgttcgggcttccgcctgctgcccaacagcagcgaggccttcatggcccgcgccgagttgatccgcaacgcccagaccagcctcgacctgcagtactacatcgtgcacgacggcatcagcacgcgcatgctcgtggacgaactgctcaaggcggctgaccgcggggtgcgcgtgcgtatcctgctggatgacaccaccagcggcggcctcgaccaggtcatagccaccctcgccgcccacccccagatccagattcgcctgttcaaccccctgcacctgggccgcagcaccggcatcacgcgtaccctggcgcgtgcgttcgacctgtcgctgcaacatcggcgcatgcataacaaactgtggctggcggacaacagcgtggcgatcgttggcggacgcaacctgggcgatgagtacttcgacgccgagcctaacctgaatttcaccgatatcgacatgctcagcgtcgggccggtggccgagcagttaggccacagtttcgaccagtactggaacagcgccctgagcaagccgatcgacgagttcgtctccaacaagccctccaggctcgacctcgctactgcccgcgtgcgcctggaagcctcactggccgagtcgcgacagcagaaccatgccttatataaccgcttgcgtacctaccagacccagccacgcatggacatctggcgtcgcgagctgatctgggcctggaaccaggcgctgtgggacgcaccgagcaaagtactggccaaggctgaccctgatccgcgcctattgctcaccacccaactggcaccggagctggaaggggtcagccaggagctgatcatgatttcggcgtatttcgtcccggggccttccgggctggtgtacctgacgggacgcgccgatgcgggtgtctcggtaagactgctgaccaactcccttgaagccaccgacgtaccggccgtgcacggcggctacgcgccctatcgcaaggcattgctggagcacggggtgaaactctacgagctgcgtcggcaaccgggcgatccaagcgctggtagcggcccacacttgtttcgtcgaggcagcttccagggctcggactccagtctgcacagcaaggcgatgatcttcgatcgaaagaagtcgtttatcggctcgttcaacttcgatccacgctcagttctgtggaacaccgaagtcggcgtgatggtagacagccccgaactggcggaacacgtgcgcaacctggcactgcaaggcatggccccggcgttgagctacgaggcgaaactgcaggatggccagatcgtgtgggtgaccgaggacaacggccaactgcacaccctgacccgtgagccgggcagttggtggcgcaggttcaatgcctggttcgccacttcaattggcctggaacgcatgctctaagaccaacgaagcccacgcccacaagttcagaccggttgcgctgctccaaacgccccctggcgcagcaacaacaccaccagccccaacgccccaactgccatcagcaacggcaacgcatgcccgctgatccactggctgcccgcaccggccaccagcggcccaaccaggcagccaatgccccacagctgcgccacatgagcattggcacgcaccagcgcatcgtcgcggtaacgctcgccaatcaaaatcagcgacaaggtaaacaacccgccggcactggcgccgaacagcacccacaccggccagatcagcagtgtgtgcatcaacagcggcaccgccaggctcgacgccagcaacagcagggcacagcccaggaacagcgtgcgccgtggcaggtagtcggccagcgcgccgatgggcaattgcaacagcgcatcacccaccaccaccgtgctgaccatcgccaaggcgatttcggcagtgaagccctgttgcaggcagtacaccggcaacagcgtcagaatcatcgcttcaaacgcagcgaataatgccaccgcccaggcaatcgccggcaggctcaggcagaaccgccacagctcgctgaacgtgacactgaacgcatccgccgtcggtgccccggaacgccccagcaacagcagcggcgccaccaccaacaggcccacgcccacccagaaaccgtagtcatggtcggtacccatcaggcccagcaacaatggccctgacagctggctcaaggcataggtacagccatacagcgccaccaggcggccacgccactgctccaccaccaattggttgatccagctttcgcccagaataaatacgatggtcaggatcaccccgatcatcaaccgcagcaccagccacaccggatagctgggcaggattgccagcaagccgatggacaccgccccggcccacaggcacaggcgcatcaggttggcggtgccaagccaggacgccattcggctggagaccttggcccccagcaagacgccgaacgctggcatcgccgccatcacgccaatcgcgaaactgccgtagccccagccttcaaggcgcagggataccaacggcatactgacgcccaaagccagaccaacgctgagtaccgaggccaggacggcgaagtaagtcgcccaacgcattgccacgctcctgtggagatttaaaggttcacacaaaacagtgtgggagggggcttgctcccgatagcttggtatcagccaccgcatgtggtgactggcctaccgctatcgggagcaagcccctcccacatttgcctgcggcgtttcctgcaggtttagagcttgatccaggtcgccttaagctccgtgtacttgtcgaaggcatgcagcgacttgtcgcggccattacccgactgcttgaacccgccaaacggcgcggtcatgtcgccgccgtcgtactggttgacccacacgctaccggcacgcagggccttggccgtcaggtgcgccttggagatatccgccgtccacaccgccgcggccaggccgtattgggtgtcgttggcgatggcgatggcttcttcggcactgtcaaacgtaatcaccgacagcactgggccaaagatctcttcctgggcaatcttcatggcattggtcacgccgtcgaaaatcgtcggctcaacgtaggtgccgccggactcctccagagtgcgcttgccgcctgcgaccagcttggcgccatcggcgtgaccggcctcgatgtaggagagcacggtgttcatctgctgcgtatccaccagcgcaccgacgttggtggccgggtccagcgggttgcccggtttccagcccttgagcgcctcgattaccagcggcaggaaggtgtccttgatcgaacgctccaccagcaggcgcgagccggcggtgcagacttcgccctggttgaaggcgatggcgccagcggcagactcagcggccgcttgcaggtccggcgcatcggcaaacacgatgttcgggctcttgccgccagcttccagccacacacgcttcatgttcgactcgccggagcggatcaacagttgcttggcgatcttggtagaaccggtgaacaccagggtatcgacgtccatatgcaccgccagcgcattgcccacggtgtgaccatagccaggcaatacgttgaacacgccttttggtatgccggcttcaacggccagggcggcaatacggatggccgtcagcggggacttttcagacggcttgaggatcaccgagttaccggtggacaacgccgggccgagtttccagcaggccatcatcaacgggaagttccacggcacgatggcacctaccacgccgactggctcgcgggtcaccaggcccagttggtcgtgcggggtggctgcgacttcatcgtagatcttgtcgatggcctcgccgctccagctcagggcattcgccgcgcccggaacgtcgatgttcagggaatcgctgatgggcttgcccatgtccagggtttcaagcaacgccagctcttcggcattggccttgagcagcgcggcgaaacggatcatcactgacttgcgcttggccggcgccaggcgcgaccagacaccggagttgaaggtggcacgggcattttccacggcacgctgggcatcgctggcgtcacagctggcaacggtggccagcaagcggccatccaccgggctgatgcactcgaaggtgtcgccggaaacggcggcggtgtattcgccattgatataggcacggccttcgatcttcagatccttggcgcgttgttcccagtcggcacgggtcagggtggtcatgcgagtgtcctcctcttattgaatacaaggggcctggggttcatcccggcaccttcacgaattcttgcccggccagcctgctgttcggctcaaggcagctgccaccctaaaccagcggctgggggtgtttcaatatatttgacagaacggcggcaaacgcccttgcgatgttcattttaataaacatagactttgggctctccaaccccaggccagacgggacacgcacatgagcatccaggatatcgtcgatttcagccaagccaacacggcccccgaccgctaccgccccgccgccgaaaaagttctcaagggcgatccggagcagacgctctataaccactacaacagtccgtgcgggcagatgaatgccggggtgtgggaaggcgaagtcgggcaatggaaggtcaactacaccgaacatgagtactgcgagattgtgcagggggtttcggtgctgcgcgacgccgagggcaacgccaagaccttgcgtgctggcgaccgctttgtgattcccgctggtttcagcggaacctgggaagtactggagccgtgccgcaagatctatgtggtattcgaacaaaaagcctgatcagcacatcacagacaaaaaaaagcccgcatcgtgagatacgggctttttttcacaaggaagaaaatcaattacttgattttgccttctttgtagatcacgtgcttgcgaacgcgcgggtcgaacattttcttttcgagcttgtccggggtagtacgcttgttcttgtcggtagtgtagaagtgaccagtaccggcgctagagatcattcgaatcaattcacgcatgatagagctccttagatcttgccagcggcgcggatttcggccagcacgacagtgatgccgcgcttgtcgatgatacgcatgcctttggcagatacacgcaggcgaacaaaacgtttctcttcttcaacccagaagcggtgatgctgcaggttcggcaggaaacgacgacgggttttgttatttgcgtgggaaatgttattcccagtcaccggacccttaccggtaacttgacagactctcgacatgcctcagccctctaaaaccacatgcccaacccggcatgggttggccgcttaatctctcagtcatttggcgccaggcgccgcgtttctttagggtcttaccggctacacctacaagcgaaggaaccgggcccctagaaaagagcgctgctttataccagaaagaccccagtgcaacaacagcccgtgtgtttttaccaccgtaaatcttagtggcagacgcctgaaccactgccaggaggggccgctgtgacagccgaccgctcgtcgcacagaatgatttacagcgcccacaggcacggggaagtacacggcgaaacgcgctgaggcgccatcaaaacagcatttgggccaaaagcacaggcaaaaatgggctagtcatttatcaatcagacctctacggtaggctttttccagactgcactcgcagatgggccttcgatctgcacaggaaaccgaatatgcgcctcgctgccctaccgctattgcttgctcctctctttatcgcgccgacggctatcgcggccaccaacctgagcgtctgcaccgaggccagccccgaggggttcgatgtggtgcagtacaactcgctgactaccaccaatgcctcagcagacgtgctgatgaaccgcctggtggacttcgacgcagccagcggcaaactggtaccgagcctggcggacagttgggaagtctcatccgatggcctgacctacaccttcaagctgcacccgggcgtgaaattccaccgcacaaactatttcaaccccagccgtacgttgaccgccgaagacgtacgtttcagcttcgagcgcatgcttgatccggccaacccgtggcacaagatcgcccagagcggcttcccccacgcccaatccctgcagttgccggcactggtcaagaagattgacgcccttgacccgttgaccgtgcgtttcaccctcgaccacgccgactccaccttccttgcgtcgctgagcatgggctttgcctcgatctacccggctgaatatgccgacaaactgctcaaggccggcactcccgagaagctcaacagccagccaatcggcaccggcccgttcgtttttgtgcgttttcagaaagatgccgtggtgcgctacaaggccaacccggactacttcgccggcaagccggcggtggataacttgatcttcgccattactccggatgccaacgtacgcctgcagaagctgcaccgcgatgaatgccagatcgcactttcgcccaagccattggatgtgggcgaggccgaaaaagacccagccttgaaggtggaaaaaaccgccgcgttcatgaccgcattcgtcgccatcaacagccagcacccaccgttggacaagcccgaggtgcgccaggcgatcaacttggcctttgacaagaacagctacctcaaggccgtattcgaaggcactggcgaagcagccaatggtgtctacccgccgaacacctggagctatgcccaggatttgccgggctatccacaagatctcgccaaagccaaggcgctgctcgaccgtgccgggctcaaggacggcttcaagaccacgatatggactcgccctaccggtagcctgctgaaccccaacccgaatcttggcgcacagctgttgcaggccgacctggccaaggtcggcatccaggccgaaatccgtgtgatcgaatggggcgagttgattcgccgcgccaaggccggcgagcatgacctgctgttcatgggctgggctggcgacaacggcgacccggataacttcctgaccccgcagttctcctgcgccgcagtgaagtccggcaccaacttcgcccgctattgcgaccccgcgctggataagttgatccgcgccggcaagaccaccagcgagcaaggtgtgcgcaccaagctgtatcaacaggcccaggcgcagatccagcagcaggcactgtggctgccgctggcacatccgacagcgtttgccctggcccgcaagaatgtcgagggctatcaggtgagcccgttcgggcgtcaggattattcgaaagtcagcgtcaagccgtaaggcgcaacaccttgcactgtaagagcgagcttgctcgcgaagatcgttaacgataatgcgaaaaccctgatgccccgcgagatcatcaggttttcgcgagcaagctcgctcctacagatacgggtgtcgttatatccacccgtattcagccatcgacagcgggtcaccatctccaacaatgatgtgatccagcacgcgcacatccaccgcctccaacgccttttgcagcaacttggtcaattttcgatcagctgcactgggctctacactcccggacggatggttgtgacacaggatcaacgccgccgcgttgtacgccagcgcacgctttaccacttgtcgcggataaacaatcgcggtgtcgatggtgccctgaaacattgcctcaaaccccaacacccggtgtcttgaatcaaggaacaggcagccaaaaatctcatggggttcatggcgcagtagtgccttgaggtactcgcgcacggccagcgggctctccagcaccgaatcagcgcgtaagcgctcggccatgtggcgccgggacatttccagcaccgcctgcagctgggcaaactttgccggccccagccccagatgctggctgaacagcgtctggctggcctccagcagtgggcgcaagccaccgaattgcgccaatagatggcgcgccagatcgaccgcacttctaccggaaacccctgtacgcaggaagatcgccaacaactcggcatcggacaggctcgccgcgccgccttccaacaacttctcccgcgggcgctccgccacgggccaatcacgaatactcatcctacctccgtgtgtacctgctccgctgttgcccagcgggcgctgtgttatcgtaggcgctcttttttgcatgcgatttcacctggggaggggtcatcgcaggcgtcactgaactggcatcactgaactggaaaggcaaaccaatgcagcgtctgtatcggaaacgcatcgttctcggcgtcggcggcggcattgccgcctacaagagcgcagagctggttcgcaggctcctggaccagggcgccgaagtgcgcgtggtcatgacccgtggcggcagtgagttcatcaccccgctgaccatgcaggccctgtccggccacccggttcatctggacctgctcgacccggcggccgaagccgccatgggccatatcgagctggccaaatgggccgacctagtactgatcgccccggccaccgccgacctgatcgcccgcctggcccagggcattgccgatgacctgctgaccacgctggtactggccaccgacgccaccgtcgccatcgccccggccatgaaccaggccatgtggcgcgacccggctacccaggccaatacccagctcctgcaaagccgcggcctcaaggtgttcggccccgcttccggcagccaagcctgcggcgatgtcggcatgggccgcatgctcgaagccaccgacctggcacagtgcgccgccgagtgcttccagcacctggccctgaccggcaagcacgtgctgatcaccgccggcccgacccaggaaaacatcgacccggtgcgctacatcaccaaccatagctcaggaaaaatgggcttcgcgttggcagaagcagcggtcgaggcaggcgcacgggtcaccctgatcactggcccggtgcatctgcccacccctgaccgcgtcacgcgaatcgacgtagtcagcgcccgggacatgctggcagcctgtgaagcggccattccctgcgacctgttcatcgcctcggcagcggttgcggattaccgcccggaagtcgtcgccccgcaaaagctcaagaaagaccccacaagcggtgacggcctgctcctgcaaatggtgcgcaacccggacatcctggccaccatcgccacgcgtccggatcgcccgttcagtgtaggttttgctgccgaaaccgaacacctgctggactacgccgcacgcaaactgaaagacaaaaacctcgacctgatcgttgccaatgatgtcgccaacccgagcatcggcttcaacagcgaggaaaatgcctgcagcgtgatcgaccgcgagctgcacgccacccttttcgcccagaccagcaagggcaagattgcccgccaactgatctcttttatcgcccaacggctgaaccaggtttaatttccatgcacgctttgcaagccaagatcctcgatccccgcatcggcaacgaattccctctgccggcctacgccactccaggctccgccggcctggacctgcgcgccatgctcaagcaagacaccgtccttgaaccgggccagaccatcctgatccccaccggcttgtcgatttatgttggcgaccctggcctggcggcgctgatcctgccgcgctccggcctgggccataaacacgggatcgtgctgggcaacctggtcggcctgatcgactccgactaccagggcgagctgatggtgtcgtgctggaaccgtggccagactgcgttcaacatcgcagtgggcgaacgcatcgcccaactggtattggtgcccgtagtacaagcgcacttcgaactggtagaagagttcgacgaaacccagcgcggcgcaggcggttttgggcattccggcagtcactgactaagctgaatcaggccggacaccctggtccggcccgatgccaccgcccggcgtttcaggatgaagaatgcgcggagctcacgaacgagatttatccagcaaaatcaatgtattacttgaccgtacgggcaagccaaaagccccgatggcacttttacaccacgaactctctgccgaaaacgccgtcatacccttcagtttgagcctgccggccagccacattcaggccagccttgccccttccagatggagtttcccccgcgatgagtactgcagcccgcgtagcccctaccttccccgacagcatttttcgcgcctatgacattcggggcgtggtacccaagaccctgaccgccgaaaccgcctactggattggccgcgccatcggctcccagagcctggcccagggcgaacccaacgtgtcagtggggcgtgatggccgcttgtccggcccggagctggtcgagcaactgatccagggcctggccgacagcggctgccacgtcagcgacgtcggcctggtgccgacacccgcgttgtactacgccgccaatgtcctggccggcaaatccggggtgatgctcaccggcagtcataacccttcggactacaacggtttcaagatcgtcatcgcaggcgacaccctggccaacgaacagatccaggccctgcacaagcgcctcaaaaccaacgacctgaccagtggccagggcaccgtcaccaaagtcgacatcctgcagcgctactctgacgaaatcacccgcgacgtcaaactcgcgcgccgcctcaaagtggtggtcgattgcggcaacggcgcggccggcgtgatcgccccgcagttgctcgaagccctgaactgcgaggtgatcccgctgttctgcgatgtcgatggcaacttccccaaccatcacccggacccgggcaagccagaaaacctggtggacctgatcgccaaggtcaaggaagtgggcgccgacgtgggcctggccttcgatggcgacggcgaccgcgtgggcgtggtgaccgaaaccggcgagattgtgttcccggaccgcctgctgatgctgttcgcccgcgacgtggtggcgcgcaatgccaacgccgagatcatcttcgacgtgaagtgcacccgccgcctgacaccattgatcaaggaatacggcggtcgcccgctaatgtggaagaccggtcactcgttgatcaaaaagaaaatgaaggaaaccggcgcgctgttggccggcgaaatgagcggccacgtattcttcaaagagcgctggttcgggtttgacgacggtatttacagcgccgctcgtctgctggagatcctcagcaaggaaaaatctacggcagaagagctgtttcagaccttcccgaatgatatttctacgccagagatcaatatccatgtgaccgaagagagcaaattcagcatcattgacgcactgcatgatgcgcaatggggtgaaggcgccgacctgactaccattgatggtgtgcgagtcgattacgccaaaggctggggcctggttcgcgcgtccaacaccacaccggtgctggtcctgcgtttcgaggcggataccgaggctgagctgcagcgcatcaaggacgtgttccacgcccagctgaaacgtgttgcccctgatcttcaattaccgttctgatttattgcccggagccctgaatgaccctcgaacgcgaagccgctgccaacaccgccaaggtcctgtccgaagcgttaccttacattcgacgctacgtcggcaagacgctggtgatcaagtacggtggcaatgccatggaaagcgacgagctgaaaaccggctttgcccgcgacatcgtgctgatgaaggccgtagggatcaacccggtggtggtgcacggcggcggcccgcagatcggcgacctgctcaagcgcctgtcgatcgagagtcacttcatcgatggcatgcgcgtcactgacgcgcagaccatggacgtggtggaaatggtcctcggcggccaggtcaacaaagacattgtcaacctgatcaaccgccacggcggcagcgccatcggcctgaccggcaaggatgcggagctgatccgtgcgaagaaactcacggttacccgcaagactcctgagatgacccagccggaaatcatcgacatcggccaggtgggcgaagtgatcggcatcaacacagatctgctgaacctgctggtcaagagcgacttcatcccggtgatcgcacctatcggtgtgggcgccaacggcgagtcctacaacatcaatgctgacctggtagcgggcaaggtggctgaagcactgcaggctgaaaagctgatgctgctgaccaacattgccggcctgatggacaaggaaggcaaggttctgactggcctgtccacccagcaagtggacgagttgatcgccgacggcaccatctacggcggcatgctgcccaagatcggttgcgcactgggcgcggtgcagggcggcgtcggtagcgcgctgatcctggatggccgtgtaccgaatgcggtgctgttggagatcttcacggataccggcatgggtacgctgatcagcaaccgcaagcgtccttaaaacgctgcaaataaaaggccccgctcaatccgattgagcggggcctttttgtatagagcgagaggacaatggagatcccctcccacacaaacccatttcaacaaaaagtcggtatcagacgccaaactgctcgcgatacgcccgcactgccggcaaatgctgcttgagctgcggatcatcttccaggaactgcaacacctggttcaacgacacgatactcaccaccggaatgccgaaatcacgctcaacttcctggatagccgacaactcaccgttgccgcgctcctggcggttcaaggcgatcagcacaccggcggccttggcgccgtcctgtgatgcgatgatctgcatcacttcacggatcgcggtgccggcggtgatcacgtcatcaatgatcagcacatcgccggtcagcggagcgccgaccaggctaccgccttcaccatgggccttggcttccttgcggttgaaacaccatggcagatcctgcccatgatgctccgccagggccaccgctgtagccgcagccaggggaatacccttgtaggccgggccaaagagcacgtcgaaggaaataccgctttcaacaatggctgccgcgtagaaacgacccagctgagccagggccgaacccgagttgaacaggcccgcattgaagaagtacgggctggtgcgcccggacttgagagtgaactcaccgaagcgtagaacgccgcgatcgatggcaaaacgaatgaaatcgcgttgatacgcctgcatgaaaaaagcctcagataccacggatttagctaattaggtggacggcgtgtatcatacacgcacgcgatttttggggccatttatgcggatcatcagtgtgaacgttaatggtattcaggctgcagtcgagcgtggtttgctcagttggctgcaagcacagaatgccgacgtcatctgcctgcaggacacccgcgcctccgcctttgaactggacgacccagccttccaactggatggctacttcctttatgcctgcgatgccgaagtgcccacccaaggtggcgtggctttgtactcgcggttgcaacccaaggcggtcatcagcggcctcggcttcgagacagccgaccgctacgggcgctacctgcaagccgatttcgacaaggtcagcatcgcgaccttgctgcttccttcggggcagaacggcgatgaagacttgaaccagaagttcaagctaatggacgacttcgcccgttatctggataaacagcgacgcaaacgtcgcgagtacatttattgtggctcgctgtacgtggcgcaacagaagctggatatcaagaactggcgcgacagccagcagtccccgggctttctggcgccggaacgggcctggatggacgagattgtcggcaacatgggctatgtcgatgccctgcgtgaagtcagccgtgaaggcgaccagtacagctggtggccggacaacgaacaggccgagatgctcaacctgggttggcgcttcgactaccagttgctgaccccaggtctgcgtcggttcgtgcgcagtgcacgcttgccgcgccagccgcgcttttcgcagcacgcgccattgattgtggactacgactggacattgaccatctgaggtcgatctccaggcacaaaaaaaaccgacagcgatgtcggtttttttgtggccggtcggttacttgaccaggcgccaggtccacggatagcggtaagcaacgcctttgttggcctggatcccggcgatgatcgtcagtatcagcgccccgatcaccagcacggtcatcagcaaaaagccgatgacgacaaagcccagcaccaggcacaccagccaggcgatcgccacggtaatctggaaattcagcgcttccttgccctgatcatcgataagcgggtccacgtccttcttgaactgccacaggatcagcggccccaacaagctgccgaagggaaataccaaccccgcaaacgccgcgaagtgacacaacattgccaactggcgtacttccttggacggtgccggaaccggcaactggctgtcactcatggcgtttctccttggcaccggctcagtcggccagcgcggcattctgcagttggaaaatttcggtcatgcctttctgggccaaggccagcatcgcgttcagctcagccggctggaatggcgcgccttcagcggtgccctgcacttcgatgaaaccaccggtgctggtcatgaccacgttcaggtcagtctcggcggccgaatcctccaggtagtccaggtccagcacaggctcaccctggtacatgccgaccgataccgcggcgatcatctgcttgagcgggtcaccggccttgaggccgccgcgcttcttgatcactttcagcgcgtcgaccagggccaccatggccccggtgatggaggcagtacgggtaccgccatcagcctggatcacgtcgcagtcgacgtacagggtcacgtcgcccagcttggacatgtccagggcggcgcgcagggaacggccgatcaggcgctggatctccagggtgcgcccgccttgcttgccacggctggcttcacgctggttacgctcgccagtggcgcgcggcagcatgccgtattcagcggtcaaccaaccctggccctggcccttgaggaaacgcggcacgccgttttcgacgctgacggtgcagatcaccttggtatcgccaaactcgaccagtacggatccctcggcgtgtttggtgtagttgcgggtgatgcggatcgagcggagctgatcggcagcgcgaccacttggacgtttcataggggatacctgtacgaaggacgaaaaactgccgagcattatagagccgccagccgattcggggcacttctaaaaattcggttacgaatgcgcatgtttgggcgcctcctgcgcactgcgctacaatcctgcgcctctcgactgtaggagcgagcttgctcgcgaaaaacactaacgataacgggggtctcctgattcagcgcgacgcccttgcgttcttcgcgagcaagctcgctcctacaggtcggcctggccaatctctatttatccaacacgaggtacctccatggtgcacagcatgaccgccttcgcccgtgtcgaaaaagccggggcccaaggcaccctcagctgggaattgcgctcggtcaacagccgttacctggagccgcacctgcgcctgccggagtcgttccgcgacctcgaaggcgcggtccgtgaagcactgcgccagggcatctcccgtggcaagctggaatgcaccctgcgctttaccgaagaaactaccggcaagccactacaggtcgaccgcgaccgcgccgcgcaactggtggccgccgccgaaaccattgccggcctgatcaagcaaccggccgcactgaaccctctggaagtgctggcctggcccggcgtgttggtggccgacgcaactgacccgcaagccttgaatgcagaagccctcgccctcttcaaccagggcctgaaggaactcaaggccggtcgcgagcgcgaaggcgccgaactggcgcgcctgatcaacgagcgtctgacctcgatcgaagcagatgtagtcacgctgcgcgaactggtgccgcagatgctcgccacccagcgccagaaggttctcgaccgcttcaccgacatgaaggccgaccttgacccgactcgcctggaacaggaaatggtcctgctcgcacagaagagcgatgtggccgaagagctcgaccgcctgagtacccacatccttgaagtgcgccgcgtcctcaagtctggcggtgccgccggtcggcgcctggacttcctgatgcaggaactcaaccgcgaagccaatacactgggctccaaggcgttcgatccgcgcagtaccacggccgcggtcaacctcaaagtgttgatcgagcagatgcgcgaacaagtacagaatattgagtaaggcaacctccatgacccacagcaccggcaccctttacatcatttccgccccttcgggcgcgggcaagagcagcctggtcaaggccttgaccgacgctgacgagcagatccgcatctcggtgtcccacaccacccgcgccatgcgcccgggcgaggtcaatggcgtgcactatcacttcgtcgagcgtaccgagttcgtcaagatgatcgaacatggcgatttcctcgaacgtgccgaagtcttcggcaacctctacggcacctcccaaagtcacttgcaacaaactctggacgaaggccacgacctgatcctggaaatcgattggcagggcgccgaacaagtgcgccagctgatgcccaaggctcgctcgatcttcatcctgccgccgtcgctggaagccttgcaccaacgcctgaccaaccgcggccaggacagcgacgcgatcatcgaaggccgcatgcgcgaggccgtcagcgaaatgagtcactacgtcgactacgactacctgatcatcaatgacgatttcgcccaggccctggacgatttgaaggcgattttccgcgccaaccagctccagcaaaagcgtcaacagcaacgttttggcaaattacttgccgaattgctcggctgattggctcttcccaaaactgctgcaagggccttacattggcacttgcagcggttttgcgagggtctgcgaaaaatcagcgcttccctaaacgctggtgtttttttaaactgctcagtccgctcgcccaaccgggcagcgcgcatcttgcattcgctccgaggaataccatggcccgcgtaaccgttgaagactgcctagaacacgtggataaccgctttgagctggtcatgctctctaccaagcgtgcccgtcaactggccactggcggcaaagagcccttggtccagtgggaaaacgacaagcctaccgttgtagccctgcgtgaaatcgctgagggcctgatgagctatgagttcatcgccaacgccgaaatcgttgaagacgaaccgctgtttgcagcgttcgaaggcgagtccaacgaggacgtctaagcctatgcctggtcgacgtagcacggcgcggggtcacagccatcggcaggagttcacactttgccgagcatagacgccctcgccgatcgcttatcgacctacctcggcccagaccaggtcaacctggtccgccgagcgtatttctacgccgaacaagcccacgacggccaacgccgccgcagtggcgaggcgtatgtcacccatcctcttgcggtggcaaatattcttgccgacatgcacatggaccatcagagcctgatggctgcgatgctgcatgacgtgatcgaagacaccggcatcgccaaggaagcgctcagtgcgcagtttggcgaaaccgtggccgaactggtcgacggggtcagcaaactgacccagatgaacttcgagaccaaggccgaagcccaggcggaaaacttccagaagatggccatggccatggcccgggatatccgggtgatcctggtcaagctggccgaccggctgcacaacatgcgcacgctggaagtgctgtccggtgaaaaacgccggcgcatcgccaaggaaaccctggaaatctacgcgcccatcgccaaccggctgggcatgcacgccattcgcatcgaattcgaagacctcggcttcaaggccatgcacccgatgcgttcggcgcgcatctaccaggcggtcaagcgcgcccggggcaaccgcaaggaaatcgtcaacaagatcgaagagtccctgagccattgcctggcgatcgacgaaatcgagggcgaggtcagcggccggcagaagcacatctacggcatttacaagaagatgcgtggcaagcgccgggccttcaacgagatcatggacgtgtatgcgttccggatcatcgtcgacaaggtcgatacctgctaccgcgtgctgggcgctgtacataatttgtacaaacccctgccggggcgattcaaggactacatcgccattcccaaggccaacggctaccagtccctgcacaccacgctgttcggcatgcatggcgtgcccatcgaaatccagatccgtacccgcgaaatggaagagatggccaacaacggcatcgccgcccattggctgtacaagtccagcggcgacgagcagcccaaaggcacccatgcccgcgcccgccaatgggtcaagggcgtgctggaaatgcagcaacgtgccggcaactccctggaattcatcgaaagcgtgaagatcgacctgttcccggacgaggtctacgtgttcacgcccaagggccggatcatggagctgccaaaaggctccacggcggtcgacttcgcctatgcggtgcacaccgacgtcggcaacagctgcatcgcctgccgcatcaatcgtcgtctcgcaccgctgtccgaaccgctgcaaagcggctccacggtcgagatcgtcagtgctccaggcgcacgcccgaacccggcgtggctcaacttcgtggtcaccggtaaggcacgtacgcatattcgtcatgccctgaaactgcagcgtcgttccgagtccatcagcctgggcgaacgcctgctgaacaaggtgctcaatggcttcgacagcgccctggacaagatcccgcaggagcgcgtgcaagcgatgctccacgaataccgccaggaaaccatcgaagacctgctggaagatatcggcctgggtaaccgcatggcctacgtggtcgcccgccgcctgctgggcgaaggcgaacagttgccaagccctgaaggccccctggcgattcgtggtaccgagggcctggtgctcagctacgccaaatgctgcacgccgatccctggcgacccgattgtcgggcacttgtctgcgggaaaaggcatggtggtgcacctggacaactgccgcaacatcaccgaaatccgccacaacccggaaaaatgcatccagctctcgtgggccaaggatgtcaccggcgagttcaacgtcgagctgcgggtagagctggaacaccagcgcggcctgatcgccctgctggccagcagcgtcaacgcggccgacggcaatatcgagaaaatcagcatggacgaacgtgatggtcgcatcagcgtggtccaactggtggtcagtgtgcacgaccgcgtgcacctggcccgcgtgatcaagaaactgcgcgccttgaccggtgtgatccgcatcacccgtatgcgtgcataaccgatccattacaaggagtcattcatgaccaagacagttatcaccagcgataaagccccagccgccatcggcacctactcccaggcgatcaaggcgggcaataccgtctacatgtccggccagattccactggacccaaagaccatggaactggttgaaggcttcgaagcccagaccgtacaagtcttcgaaaacctcaagtccgtggccgaggccgccggcggttcgttcaaggacatcgtcaagctgaacatcttccttaccgacctgagtcacttcgccaaggtcaacgagatcatgggcaagtacttcgaacaaccctacccagctcgcgccgccatcggcgttgccgccctgccaaagggcgcacaggttgagatggacgccattctggtcatcgagtaaaacacccggcgcagccccaaaggctgcgccggcttcgtttcataaggatttcgtaatgcgcaaagcgcttgtagcctcttcgttgctcgcactgttgctgggcggctgtgccagcaacccggccgacctggacgtaagcggtacctggatcaaccaggccgccatcgacgcggcagccaagggcggccctttgcgtgaagccctgcaatcctatggccccaaccttgagtgggaggtcaacaccaaggcgttgcaggcgcgctactacaacggttttgaagtagcggaaggcaagttgtcgggtgaaaaacccggcgcgtggagcgtggacttctatggcagctccgccaccgaactcaagcgcaaaggcaaacaactgctgcaagtggccaacgacaatgagccagagcagctgttcgcccgcgccaaagacccggcccccgaaggcgcaccactgggtgccaacttcgagcgggcgctgtacgcggcctacatgggtggcgactggaagatcaccgacggcacaggcagcggcgccacggtgcagttccaggctgacggcaaggtcgccggcctgcccggtgttgaccgctactcgctgtgcctggcgggtgattgcgcctccatgagcggcggctacgacagcatctggctgcaactgaacggccagggcaccccatggatcttcacgcgcaagggtgaacaactggaaatcttccaggcgatcaataccgcgcaggcggatgaagtgcctcagttcaccccaggcccacgccagtggctgcttgaaaagtaataacagcatcacctgaatctaaatgtgggagggggcttgcccccgatagcatcacaccagtcaatatttccttggctgactcaccgctatcgggagcaagccccctcccacatttttgaccgggtttcatcctttcaggatggaggtatagccttcccggtaagtcgggtatgttggcgcccagcccagcgccttgatgcgcgcattgctacattgcttactgcccgcacgccgcacactggcgtcatcagcccattcggtcacacccaggtactcgcgcaaccagcccaccacctcggccaatggcgccggcgcatcgtcgacaccgatgtagactttgtccaatgtaccgccctgctctacgtgccgcagtaaaaacgccagcagcccggccgcatcatcagcgtgaatccggttgccatataaaggcgggtcaatcgctacccgatagccttggcgcacctgggtcaacagccattcgcgccccggaccgtaaattccggtcagccgcacgacactggcggggatgccgctgtcgagcgccacttgctctgcctccagcatcacctgcccggagtaacccttcgcttgcgtctctgacgtttcgtcgacccattcgccgttctgctgcccatacacgctgctgctggatacgaacaacagatgtttcggctcctggccgtagtccttcaaccactccagcacatgttgtagcccctgcacgtaagcggcgcgatagccggcttcgtcatggtcggtggcagcggcgcaatacaccaggtaatccaccccgccgataggccaggtgtcagggcaatccttgtcgaacaggtcgccggcgatgccaatcaccccgtcgggcaggcgcgaaatatcgcggcgcaagccatgaacctcccattccgaggccagcaattggctagccagccgactacccacatcgccgcaaccggcaatcacaacagaaggcacagacatcacaaaactccgttcttaaaggtgcagattagccgccaggcatgaccagcggccagaaaaagcacaaataaagttactgtattacttctgttaacaagaattacttgcaataataaccacccatttgtcctcgaccccctgggtctggaaggacaatcacccattttttctctcaggtccggccagcatgacacgtaatacaaaccccgcttcgccaaccaagcctcacagcccatcccgcgcctggcgtgcgattgctgcgatgctgttcagcgtactgctggcaccgaccgccgcattcgctgatgccaccgcccccgccgctccggctgccactgagcaaaatgctgctaccccggcggccgttccagctccggcgccagccgctaccgatccggcccaggctgcgggcgacgctgcacctgccgacgaaactggcgtagtgctggaagaagacaacaccctgggcatggcccacgacctgtcgccatggggcatgtaccagaacgccgacgtggtggtgaaggccgtgatgatcggcctggccatcgcctcgatcatcacctggaccatctggattgccaaaggcttcgagctactgggcgccaagcgtcgtctgcgtgctgaaatcgtccacctgaaaaaagccaccaccctcaaggaagcgagcgaaaccgcgaccaggaagggcactctggccaacaccctggtgcacgacgccctggaagaaatgcgcctgtcggccaatacccgcgaaaaagaaggtatcaaggagcgcgtggctttccgcctcgagcgcctggttgcggcctgcggccgcaacatgagcagcggcaccggcgtactcgccactatcggctccactgcaccgttcgtcggccttttcggcaccgtatggggcatcatgaacagcttcatcggcatcgccaagacccagaccaccaacctcgccgttgttgcccccggcatcgccgaagccctgctggctaccgccctgggcctggttgccgcgattcctgcggtggtgatctacaacgtcttcgcccgttcgattgccggctacaaggcccaggtttcggatgcatcggcagaagtcctgttgctggtcagccgtgacctcgatcacctgcctaccgagcgcagctcgcaaccgcacatggtgaaagtggggtaatcggccatgggcctgcatttgaatcaaggcgacgacgagctcgtcgagaaccacgaaatcaacgtcacaccgtttatcgacgtgatgctggtgctgctgatcatcttcatggtggcggcaccgctggccaccgtggacatcaaggtggacctgccagcatccagcgccaagccggcgccgcggccggagaaaccgatcttcctcagtgtcaaggcagaccaacgcctgttcctgggcgaagaagaagtcaagactgaaagcctaggcccggtgctcgatgccaagacccagggtaagaaagacacgacgatcttcttccaggccgacaaaggcgtggactacggcgacctgatgagcgtgatggatgccctgcgggcagccggctacctcaaggtgggcctggtcggacttgagacggcagccaagaaatgatcacgacgcgccacaaactgacgcgttatggcaccagcctcgccgtcgtgctgggcgtgcatgccgtcgcgatcatcatcgcgctccaatggtccgcgccgcaggtgatccagttaccacccgccgccatggtcatcgacctggcgccgatgccagcgccgccgcctccggcaccgcccaaggtggtgacgccgccgcagccacctgccccggtggaagagctgcctctgccaaaaatggccgaggcgcccaagccaacgatccaggtacccaagccggtcaagcccaagcctaaaccgaaaccgcccaagcccgtggagaagaagcccgagccacccaaggaaaaaccttccgaggagccaccgagcgaaactccaccgaccaatacaccggcggaaaaatcggcccagcccgcaccaggcccatcggcacagcagatagcggcccaggcgtcctggcaaagcaccctgctggcgcacctgcagaagtacaagaagtacccacccgccgcccaacagcgcggcaaggagggtatgaaccgcttgcgctttgtggtcgatgccgaaggcaacgtgttgtcctacgagctggaaggccgctccggcaatgccgacctggaccgtgcgacgctggagatgatccgcaaggcccagccgctgcccaagccaccagccgacctgctgaaaaatggcagcgtcgaactcgttgcgccgttcgtctacaacatcgacaaacgtcgccgctagatccatctacacagctatgcgggagatattttctcccgcatgcgctggcgccacatcagcaaaatttccgacattcctcacttaatccccagcaaagttctgataacgtgcgtctatcgattgcagccggtatgcttggcctgcaaccttatggacgcccgctatgactcttacagaattacgctacatcgtgaccctcgcccaagaacagcacttcggccacgcggccgagcgttgccatgtcagccagccgacgctgtcggtgggcgtgaaaaagcttgaagatgaactcggtgtgctgattttcgagcgcagcaagagcgccgtgcgcctcactccggtaggcgaaggcatcgtggcccaggcccagaaggtcctggaacaagcgcaaagcattcgcgaactggcccaggccggcaaaaaccagctcaccgcacccctcaaggtcggcgcgatctacaccgttggcccttacctgttcccgcacctgatcccgcaactgcaccgcgtcgcaccgcagatgccgctgtatatcgaagaaaacttcacccacgtgctgcgcgacaaactgcgcaacggcgagttggacgcgatcattatcgccctgccgttcaacgaggcggacgtactcacgctaccgctctacgacgagccgttctacgtgttgatgccggcctcccacccgtggaccaagaaggacaccatcgacgccgccctgctcaacgacaagagcctgctgctgctcggcgaaggccactgcttccgcgaccaggtattggaagcctgcccgaccctgaccaagggcagcgacggcgccaagcacaccacggtggaatccagctcactggaaaccattcgccatatggtcgcttccggcctgggcatctcgatcctgccgctgtcagccgtagacagccatcactacgcccagggcgtgatcgaagtgcgcccactcacccctccggtgccgttccgtaccgtggcgatcgcctggcgcgccagcttcccacgccccaaagcgattgagatcctcgccgattcgatccgcctgtgctcggtggccaagccgcccgtcgcgagctaagcaaccgtatgactgagctgtcgcaggtgccggtgacggcactcaagggtgtcggtgaggccatggccgagaagctggccaaggtcggcctggaaaacctccaggacgtgctgttccatttgcccctgcgctaccaggatcgcacccgcgtggtgcccatcggccacttgcgccccgggcaggacgcggtgatcgaaggcaccgtcagcggcgccgacgtggtgatgggcaagcgccgcagcctagtggtgcgcctgcaggatggcaccggcggcttgagtttgcgcttctaccatttcagcaacgcgcagaaagagggcctaaagcgtggtacccgcgtgcgctgctacggcgaggcgcgccctggcgcttcgggcctggaaatctaccacccggaataccgcgccattaccggcgacgagcccccaccggtagataccacgctcacaccgatctacccgctgaccgaaggcctgacccagcaacgcctgcgccagctgtgcatgcagaccctgaccatgctcggcccgcaaagcctgcccgactggctgcccctggagctggcccgcgactatcaactggcgcccctggctgatgcgatccgctacctgcaccacccacccgccgacgccgatgtggacgaactggccctggggcatcactgggcccagcatcgcctggccttcgaagaactgctgacccatcagctgtcccagcagcgcctgcgcgagagcatgcgctccttgcgtgcgccagcgttgcccaaggccacgcgactgcccgcgcaatacctggccaacctcggctttgcgccgaccggagcgcaacagcgcgtaggtaatgaaattgcctacgacttgagccagcaggaacccatgctgcgcctgatccaaggcgatgtgggcgcgggcaagaccgtggtcgccgccctcgccgccctgcaggcgctggaagccggttaccaagtggcgctgatggcgccgacggaaatcctcgccgaacaacatttcattactttcaaacgctggctagagcccttgggcctggaagtcgcgtggctggcaggcaagctcaagggcaagaaccgcgccagcgccctggagcaaatcgccgccggcgcaccgatggtggtgggtacccatgcattgttccaggacgaagttcagttcaagaaccttgccttggtcatcattgacgaacagcaccgcttcggcgtgcaacagcgcctggccctgcgccagaaaggcgtgggcgggcgcatgaacccgcaccagttgatcatgaccgccaccccgattccgcgcaccctggccatgagcgcctacgccgacctcgacacctcgatcctcgacgaactgccgcccgggcgtaccccggtcaataccgtgctggtcaccgacacccggcgcgtcgaagtgatagagcgcgtgcgcggcgcctgtgccgaaggccgtcaggcgtactgggtgtgcaccttgatcgaagagtctgaagagctgacctgccaggccgccgagaccacctacgaagacctcaccagcgccttgggcgagctcaaggtcgggctgatccatgggcgcatgaaacctgcggaaaaagccgcggtgatggccgagttcaaggccggcaacctgcaattgctggtggcgaccacggtgatcgaagtgggcgtggacgtgcccaacgccagcctgatgatcatcgaaaaccccgagcgcctgggactggcgcaactgcaccaactgcgcggccgggtcggccggggcagtgctgccagccactgcgtgttgctgtatcacccgccgctgtcgcagatcggtcgtcagcgcctgggtatcatgcgcgaaaccaatgacggttttgtcatcgccgaaaaagacctcgaactgcgcggtccgggtgaaatgctcggcacgcgccagaccggcctgctgcaattcaaggttgccgacctgatgcgcgacgccgatctgttgcctgcagtgcgcgacgcggcgcaagccttgctcgaacgctggcccgatcacgtcagcccgttgctggatcgctggctgcggcacgggcagcaatacggccaagtgtgacgcctgacgcacttatccgaccaacacctgtatcaagctggttatactccaatgaatgtaagaaattggatcaggccatgtcagaagttgccctcgccacagccccactgaccgccccgccggtcattcgggcgctgctcgccaagctcgccatcccctacacggaagtcatcgaacaacctggcatgaaccctgctaaaaaggtccaggcggtgttgcttgaagatgcggttggcgcactcatggtgctgttcccccaaagccagttgcttgacctcaaccgcctcgccgaactcacgggtcgccgcctcacggccgttgcccctgagcgcgtcgaacgcatgctcggcaagcatgccctgagtctgctgccgggcctgccggcactcaccagttcaccgtgcctgtatgaaggcagcctgctcaacgagccgagcctgctggtgcattcgggcgaagccggtctgttgctggaaatctccggcgacgcgttcaagggcatgctgaccaaggccagcgccgcgcagttcggtgaaccgctgagcaatatccgcccaaacctcgaccgccccaatgatgaccgcgaggaaatcacccaggcgatgcaggcgttcaccgcccgccgtatccagcaacgtcttgaggcgaccatcgagattccaccgctggccgacacggcgcaaaagatcatcaagctgcgcgtcgaccccaacgccaccatcgatgacatcaccggcgtggtggaaaccgacccggccctcgccgcccaggtggtgagttgggccgcgtcgccctactacgcatcaccgggcaagatccgttcagtcgaagatgccatcgtgcgcgtactgggctttgatctggtgatcaacctggccctcggcctggccctgggcaaaaccctaagcctgcccaaggaccgcccgcatcagtccacgccgtactggcaccagtcgatctacaccgctgccgtgatcgaaggcctgacccgtgccatgccccgcgcccagcgtccggaagccggcctgacctacctggccggcctgcttcacaacttcggctacctgctgctggcccacgtattcccaccgcacttttcgctgatctgccgacacctggaggtcaacccccacctgtgccacagctatgtcgagcagcacttgctaggtatcacccgcgagcagatcggtgcctggctgatgcgctattgggacatgcccgacgaactgtccaccgccctgcgcttccagcatgacccgacctatgatgggcaatacgctgagtatccgaacctagtgtgtttggccgtgcgcttgttgcgtagccgggggattggctccgggccggatgaaaccatcccggacgagctgcttgagcgcttgggtttgacgcgtgacaaggctgaggaagtcgttggcaaggtgctggatgccgaggtgctgttgcgtgagctggcttcccagttcagccagggctgaatagacaggcggtgaggccgctatcgggagcaagccccctcccacatttgaccgagttccaactttggaatgcgacaaatgtgggagggggcttgctcccgatgaatccaactcggttttactgaaaaacctcagctcttctttttcttcggtttcaaatacttggtcaacccctggaaccagatcaccagcgccgggttgcccttgatctggatcgacttgtcctgaatccccgtcatgaacgccagttgcttgttcttcgcctgcatggtggcgaagccataggcggcatccttgaaggcaatcgcaaaggcaggctcagggtgaacacctgaacggctggtgatgcgctggtctttgacaatgaagtgacgggcaaccttgccgtcgagggtctgcagctggaaggccaggtctttgtcacccagttgctgctggaacgcggggttggtgcggctggctttgcccatcatcaggcccagcacccacaggagaagacgaaatttcatgcacacggcctcggtgtatttattggagtggccgcagcagtgtaacgatttgcaaaaagaacgccaccgatctcgcgctttagacgcagatcggcgggcgtttaacgcttatagcaacaagtgcttagacgttagggcaaggcactggtgcccagtcgaccaggttcgggttggtgcagttgagcttgagttgcgaatcacccgcgttggccacctgcttgctttcagcttgcttggcctgggccgtttgcaaggtcttctcggtggtgaccgcttctttcggcacggttggcagcactggctttttcggtggcttggtacccgtgccttttttcttggtcggtgtcacaacaggtgccgcatcggcctgggccacggtgaccacgtcggcacgctgtacgccgacttgttgcaggtctttttcgtaggcctgggtgtagttgttgaggtcttcgctggctttgccgttgaccgcaacgatcaggtcattggactccttgaggcccgcaacgatttccgccaggcgcttgcggccttcggtgtcgttgacagtcttggctttgcggtcggccaccagcttggtgaacgcgctctggtagcactgttgcgaagccttcgcgtaggcggtgctgcggtcgatgtcggagacgcttttgttcacatcagcggcataggaggcaatgcgctggttgtcatcggcaatctgcttctgacgctcggtgtagtaacccgccgcgccgccggccagggcgccgcccgcagcgccgatggcggcgttacggccacgcttttccttgtcgccggtcagggcgcccaacaacgcaccgccggccgcgccgatggcggcaccggtcaccaccgacttggtcatgttcgaatcggtagcgcgcaggtgctgcaccggctcgtagcagttggggtagtactcgaccttggtgctcgacgcgaccttggaggctggcgacgtagcgcaaccagtcaacacggtgctgaaaccggctgcgatcagcagcaggtgacgcttggaaaccgccttacgggaaaaaagcataggtgtgatctctattaagtttgacttgcccagcacggcccaccgccgcctgagtcctttccaagctcgctagacagccaacgatcaagaccgctgaccgctcgctgcgagcaattccttcaagatcgttgccgggtcggcccgctgttgcttgcggtagttgccgacatggcgaacgaacagtgtcgcgcgcgtcaccaggctcttgccgagcactggcttgcgatccaactcttccttgattcgttgaaactgcgcctggatcaccgcatcggtatagcgcgtgccggtggccaggttgtcgatatagatcgccaccgcgccgtcgagggcgctgcgtccattggtaatggccgtggcgaacagctgcgcgctggcctcgtccttgctgtccaaggcctgctggcgactcttttgcaggttggccaggcgaatgttgtagttgctgatggtctcggccaccaacgccgccgactggatcaggttgcccgccgcttcttcacgttgctgggcaatcagcgaaacgttgcgcttgagctcttcgttgaccaggcccagctcggcttgcagcttggggtcgacgctggcggcgatgatgctgtccaggcgcttggtcgggtcctgggcgtcgtcgatggcgtcagtcaatgaggccaggcgcccttccttctgccattgggcaaacaattccttgtaacgcgaacgcggcgccgacagtgcgccaatcgccacgcgaaagccggtggtctcgttgctttgctcggtgccatcggcagcaaacagcggatactctcggcgcatgccggtaaacagcgtgccctcgccttccaggtagttgccgcccttgactacaaagccgccataggtgccctggcgccggccggcgtggaccaactggaaggattcctggaccatttccgcagcgttgccgatcacgtcaaacagaccgatggggttgggcaacttggtgccgatgggcatcagccgtgctgcctgaccagtgccgccggccacttggttgaacaccgcgtagtcggccaacgggccatcgctttcgctgccctcggcgcggcgtgggtacaggcgcccttccaggtcctggcggctgaccgcctggccaccgcgtgcggcgtattcccactccacttcggtgggcaggcgcacaaagcccaggccgccgtcttcggccgacgatccacgcccactcaccggcagcaattcacggtggtacttcatcagccaggcgctgtagaccgccgaaaaccgctcggcttcaaagcgcgacagtttcaccttgggcaagcgcccggccatgccggcaggcgcgtcacaggccggggccggctcgccgctggccagggactgcgcctgggccatcacctgggcatactggcgcgcggtcacttcgtacttgccgatgaagtacagcatgggcttgagaggggtcttggcgtcggtcttcggcatcagcggcgcgatgaccttgttccagtccttgggcaagtccttgagggtgaactggccattgatgaagtcgcggcgatagccggaaataaacgactgctggtaaccggcctcgccttcggcgaaggggtagccgaggctgatttcgcggtcatccagggtgccctgggccaacacataggcgtagcggaacaccatgttgccgtcgcagggcagcggtaggctgacgtcatccggcaacggcttggggttgtcgagcttatcgcttgcctcatccgcccaggccagcgaggccaggctcagcgccacacaggcgcccaataacttatacatctctgattccctcagaagcctggatacgcgccacccgccaaccaccaccggcagccgccacggcgctgacgccgaacacagcagccagggccagaccgtagtgacgcgccaacaggtggctggcgtattcgcccggcacctgcacaaaaagcttattcagcgcggcctcggccaggccatacagcccaccactgagcacggcggcaaggcctgcgctgtacagcgcctgcagcagtacaaacaacaaaagcgctccggtggaaaaccccagcagacgcaacaccgataattcccggcgcttgcgcgccaccgccgccagggttgcggcgaagatcgccgcgaacgccccggccagggccaacccggcgatgatccagaacacaatcgacaggttgcgactcaacgactgcacctgggcgatggtgttcgcctgggtcgacaccagcagattctgcccggcgaagaacacccgcaaaggctctacatcggcgaggctgcgcgcatacaagcgaaacgccgggtacacccgctgctcgctcaccgccaccgcatcacctgcccaccccaacgccgctactgcacgaccatcgcggtaatcttccgccgcttccaacaagcccaggcctgcaaacaaaccgtcacgggcgaacgcttcgaacggcaacacggccaacacctgcaatcgcgtgtgctgggcttggacctgcccggccacctgccgcgcaaaactggtttccaaccagtcgccaggcctggccgcgagcttttcagcagcggtatgactcagcacgatctgatcaaggccttggggtatcggcaaaccggccaacaacggatcacccacggcggtcggcagcatttccagggtcagcgcgcccacctgggcggttgccgcaatctgccgtgtacgcggcaaggcaaacgccacatcgctgcgctgccccagctgctcgataaacgccgcactgaatcgaccaccccccaacgggatgatttcacgggtggcggggtcagtctccaagcgttcggtcaaactgctgaccagtccaaatttcaggccgaataacaccagcaacggcgcgatgaccgccaccagcgccagcaccgaacaggccgacagccagcgatcgttgcggtagtcctgccaggcgagcgatgtgatcaggccgatgcgcatcagcacacctccccgagggtcgcagtgacgccgccgtcagcatcgcgacggcaactgatacgccgcacctgcaagccactggcacgggccagtggctcgtcatgggtggcgatcacacaggcagtgcggtgctcgcgggcctgggccagcaaagcctgcatcacacgctcggcgttgagcgggtcgagggacgcagtcggttcatccgccagcaccagttgcggcccatgggccaaggcccgggcacagctcacacgctggcgctggcctaccgacaaggccgccggctgcttggccagttggtcgctgatctgcaactgctcggccaggcgcgccacgctgccgtcgtctttcaagcccagcaattgccgggacaaggcgatattgccgcgcacatcgagaaaccccaacaaaccaccggtttgcggtacatagcccaggtgctggctgcgcaatgcagccaggtcggattgctggtcggcacgccacagcgcgccgatgtcctgctggttgaagtcaaactgctcggcctgatccggcgccaagaccagcgccagcaggtccagcaaggtacttttgccgcaaccgctgggcccgacaatcgccagttgttcacctgcaccaaggcgcagcgccgcaatcaccaggctatagcgctggctaccgacaccccggctcttgtgcaccgcgttcaggttcagcattacggcagcgtcgacagtggcacgcggtacaacgcatcgcccggttcggcatcgccgaaacggacccagttggccacgtcgttatggaaggtttcatacaggcggatcttcgaatccagctcgtcgataaagtcttcctgctcggccacgctcaacgacaaccacaaatcctgggtcatgttcagcgacttgctgcgatacggcaggccctccagatattcgccgagcaagccgccgtcggacaggttgccgcccttgcgcagggcttgcgggtcgcggctcatataggccgaggcgctggcgatttcctggaagaaatccttgggtgagctttgggtcttgcgcgccgcatccacgatcaacttcagcgactgctgcaagtcgttgagttgcagcttggtcagcatcacgcacacctggaatgccggcagcgccgggttggtgagatcgcggtcggcggtccaggcgctgaccagttgcggcgcctggctggcggttttgcgcccgaggaagtccatatgcatggcatagccgactgcggcggacttgtccgccaggcttggcgccgaaccgagcagcggcaccggttgtggcgtgttactgcgcacctgatgcaccaggttggcgaataccgtgccgatctcatccacacgctcacccagtttgcgcacatcaccacccggcaccggcgtatagaggtcgccgatctgcgggttggcgtcggcggtaaggatgcggtattggctctcggcgccagcgtgggttttcttgccggcgtcggtgcgcaggtgcagcgcatagatcttgatctgcttgcccagcgccgcctggcgaacctcggcttcattcatctgggtggcggcgaacgggtcgttcttgcgcaacgcgcctgcgtcggtgaccagcaggatgatgcgacctccgtagcccgaccaatccatgccgtccaccgcctgcatcaccccggcaaacgcatcttcgttgaaggaatggctggacaccgtagaagccttgacctggcgcgccatgtcgaggaagcgttgcgggtcgcggccttggtcgaggctgatcagggtcttggcgacatattccaggcccggggttttcttgatgctgctgcggaaacccaccaggccgaagctcacactgtccagctcgccacgttcggcaatgcgggtttgcagttcgtgaaccacatcgcgcacctgatcgatatacggctgcatcgacacggtggtgtccaccaccagcaccacggcggtgcggaaggcgtcggcgttggcgctgatcaccggcgtagcttgcttggcctgcgcgctgctgcccgggtcgatggaggcgatattgagcaactgcaccggctggccgttctcgtcgaagctctctttggaatcgaagattggcagcaggtagaactggtcctgcggcaccgcgctggcggtgggttccagggccaggacttgctggttgtcttcacggttgttctgcgccttggccaacacgcttttcgcggcggcgggatcggccagcagtttttccacttcggccgattggcgcaggaacatcactggcgcgcggcccgagcgttcggtgaacttgagcaccaggctttgtttccagtcgctgacctgggaggccggcaaccaaccgtcgctgcgaccatcggtggcagcgccgacgcgtacccaagggctgccatcgacatccttgcgttggtacacatagagcacggagaacgccggcaaggctttaccgggcgcactgcccgcatcggtggacagcttggcgccgggcttgctcagcacgcgctggaatagagttttcttgcccgccatcagcaagggtcgctggccgccgtccacttcagcggcggccacgggtggtgtcaccttcggcacgacggcagccggcggctgggccggttcatcgctgccactcaaccaccagtagctggctcccccaatggccaaggcaaccgccaccgcaacagcagccagtgccaacaccggtccacggcgctgctcggacggcgcgttgtgctgcgtcggcgtcaccaccggctggcgcactatcggctgcggctgtggtttatcggtcgggatatcgatggtgacgggcgtcatgcccgccaggtcgaaactcaatggaatcggcagcggccgcaccaaggtggcttctgccgagtccgccggcagttgctccagtgcctccagcaacgccgccgcattcgggaagcgctccgccgggtccttggccagcaacttgcgcagcacgccctgataacgcccgtggtgcaccggcagctccggcaacggctcggtcaggtgcgccagtgcggtagagagcgcatcagtgccgctgtagggcagcttgccgacgaggatttcgtacaacaccacgccgagcgcgtagaggtcggcacgaccatcgatctcctggcctcgcgcctgctccgggctcatgtagcttggcgtgcccacggcaaacccgacctgggtgaattgggtgcggtcgtccagtgacttggcgatgccaaagtccgagagcactgcggtgccgtcagcacggaacaggatgttcgccggcttgacgtcgcggtgcaccaggccttgggcatgggcataacccagcgccgaggcaatctggcggatcagcgtcacgccctgctccggcgtcaggccggcggcaatgcgctccttgagcgtgccgttgggcaggtattccatggccatgtaatacagttcaccgacgttgccgatgtcatggatggtcaccgtgtgcggatgcgacaagcgcgccagggttttgccctcgcgcaggaagcgttcgcagaacgtcgggtcggccgccagcgctgccgccatcaccttcaacgccaccttgcgctccagcgaacgctgggttgccaggtacacgctggccatggcgccttcgccgatctcgccttcgatgtcataacccgggatgacgatgttcatgacgagaccttcacgacaatggcggtgatgttgtccggtgcgccgcgattgagccccaggtgcaccaggctgcgcacgatttcatccggcgcgtcatggctgagcacctcgcggatttcatggtcttcgacggtcttgttcagtccatcgctgcacaacaggtagctgtcgccgggggcgatcaacaggtccaccgaggcgacatccaactgggcttccacgccaacagcgcgggtgacgatattggcgcgtggatgtgtgcgggcgtcggcttcactgagcaagccgctgtcttgcaaatcctggacgtagctgtggtcacgggaaatgctttccaacacaccgtcgcgcaagcgatacaaacgactgtcgccggcccacaggcacaccccgcgcaagccgcgtgcagcgaacaccaccacggtgctgcccatcatggtcacgccacggttggcggtttcttcgcgcacagtggtgttgatgcgcagcaggtcattgcgcagcgcggccgagtattcatcgagggaacggcccagcgggacaatgcgcaggctgtcgacgatcaggctgctgacatagtccccagccgcatgcccgcccatgccatcggccactacccacaggcgattttccggcaggtccaggcaggcatcttcgttgacttggcgaaccatgcccacatggcttttgctcgcggatttgtacgttgcccccatctacaccacaccttcttgtccgagcaaaaactgcgcaaaatcgtcggcggcaggcaaaccctggcaccgtaataaacctggggaaatacgctgcgaaccccggccccaccacaggctcgcgccctcgcacgcttgttcggccagtgcggtcatgcgctgatggggctcgctggctgccacccgttgcaggccggcgaaacggctgtccactgcacgcggctcagtcgccggcacgcccagggtgtcgaggccagcgttgaagctttcgaaggtggcgccgctgtccaaggtggcgagcaatagcgcttcggcctgctcgaaccaagtgtccgggccgcccaccagagaggcggggttggtgtcgtgatccagcaagctgaccaccgtcaacggaaaataccgcccgacccggtcaatgctcggcatcaccacccccgccgccgcatccggcccgcacacgcccggtgccaggacaaaacgccacaacgggctgaccaggtataccttgagccagtcgccacccaggctcttctggctggcgagcaaacccgccgccagccagctgtcccaagggccgataaaactctggggcaaggcgcggctgacaaagtccccgcggctggccaccttgccgtagaaacccaggctggtcatagccgctccggcaggttgaagccactgagtacccggctcttgaacgggttaaaggcactgttggcgcgcaattcgtaggcgatgctggcgccgtcgacccgcaagcgcaggttgaagcgatccggtgagttgccggcggtaagatccgattgctccagcaggcggaaccaggcccatgggccatccagggtgatgccggagcgaccactggccgacggtggcatgatggagatgcgcactacgccaatactgccggggttaggccattgcatcgccaccgggcggctcgggccgtggtcgtagctcaattgctggccgtccagatcgagcaggaactgggtgatggtcgggtccatcgacaccggcttgagctcgaaacgcacgatcggctgggtgcccccggatctgaaaaacgcatcacggatagtcgccgcacgctggaaggtttgcagcacgcccggggcaatccccagcttctgcgccgcgccgggctgccagcgccaggtctgtgccgatgtatccacatagggctgcaggtatttgcggaagtagttatccatcactccgcccacgccgaagaactggccgaagtcatccagggtggcgtcccgcgcactgcccggcgacatcggatagcgaccggccaacgactggcgatacacgttgaccacctcgctgacccaggccgcgttcaactggttgcgaaccccgcccatcatgctgttggtggtggaattgaccaccgacttgaccatgccctgcaccagcggcggctggcgctcggcattcaggctgacccgcgtggccgcagccgctgcctggttcttggcctcaccgagcagcgcatcgccgctggcgccgaccatggcgctgacttgcacatacagcgcattcatgtccgagagcaggccgtcgatggccgccggctcaccttcgtttttactgacgatgctgttgagttcggcaaagtgcgcggtcactggatcatccgcagtcatcggggcattggcgttgggttgttcctgaccaagcaagctgccgaggcgctccttgagtttgtcgacgccgccttccaccggcacacctttggcggccaattggcgttcttcggcttgcaggtcggtttccttggccaccgccaccaacagctttttcaacggcgaagtcgggccggaaatcacccgtagcacgtcggcagcctgggccacgctggtgatcggcacgaagtcgatgtcggcgagcagcgcatcccactggcgctggtaatcctggaaatacaggcggcgcacatcggcggccaggctcaccacgttctgctgatcggcctgttcttggcccaacacccactgttcctcagccagggtgccggtttggttcaggctgctcagcaggaatgcctggcgatagcccttggcggtgaagaaaccactcaaaggctcgcccaagggcttgccgcttttgcggctgaacaccaacgccgcgtcacgcccggcagcttcgttgaggcgaaagtcagggatgccttcgggcagcttctggcgcttgacccggtcatacacgcgctgggccaccggcagttgctgcaactggcgacgcaggtcatcgatcaggcgtgggtcaaggcgggcgctcggcgggtgccgctcgaacagtgcctgcaagtgcccggccagtgcctggcgttggtcggccggcaggtcgcggggcaggttgcggtcccagtccagggcaatccaggccttgataaagtccgcgtcatagtgctcggtgtcggcgagcatcaggtaagccttgaggccctcatagaggaagtcagagttaccgccgccgtgcagttgctcttcgatacgcgtcaccagacgcggcgcgaagacggcgatcaacagcttgcgatagacgctggcggactcggcttcgagcatatcgccttgatacagcccaagcccttcggaccagcttggcgagtcccccgccaggttcttgaccgcattgagcaacggcagcaaggcaagcacttcccgttgtgccgggctcaggttctgcacagtctggcccaggggcgcgaccttctggtcgacctgggcgatatacgcttggttggcgcgataactcacccaccacaaactgctgaccaccatgaccaaagcgacggtggcggccagtacgccacgggcgatccacttgcggcgccgttcgactttcgggttcacccccaccaaaccacgctcggcgaaagccactgcggtgaagagtttttcgatgaagtaactgcgcccggtgccgctctggcgcgccaggtgctggcggtccaggttcatgctctgggccatggcgccgatcaagcggtcaatcgggctgccttcctgggtgccgctggtgaaatacacgccgcgcagcaacacgcgctcttcaaaggcgttgggtttgaacacgccttcgaggaagctttgcaggcagtccttcaacgcgccgaactgctgcgggaaaccgtagatcagatcgcgccgcgccgggtcgcgttcctgttgcaggcgctcgaccaagcgttcattgaggcgctgttccagcccggcgaattcgctttgcaggtgcgccaacgggctgtcgctgtgcttgccgtcatcaagggcaaaggtcatgccccatacctgggcgcgctcttccttgctgaggttatcgaagaactccatgaagcccggcaccaggtcgagcttggtgagcatcaggtagatcgggaaacgcacgcccagttggctgtacagctcctggatgcgcaggcgtatcgcggcggcatgggcagcgcgctcggcgtctgtacccaatagcagatccgacaggctgatggcgataaacgcaccgtcaatgggccggcgcgagcgctgctttttcagcaggtcgagaaagcccagccacgcggctttgtccaccgtggagttgctgtcttgggtggtgtagcgaccggcagtgtcgagcaataccgcttgatcggtgaaccaccagtcacagttgcgcgtcccgccgacaccgcgcaccgcaccggcacccaattgtgccgccagcgggaaatgcaacccggaattgaccagcgcggtggtcttgcccgaacccggcgggccgatgatcacgtaccacggcagctcgtagaggttgcgacgttcgtcgccgccgagcttggcttttttcagcagcgtcagggcttcgtccatacgctggcgcagggtcgacaattcttcggcagtggcgacgctgttagggtcggccggggtttcggcggccaggctgcgcatcacttcggcggcctggcggcgggcctggatgatgcggaacacgcggtaggcgatccacagcgcaaacaccaggatgatcagcgcccaacgtcgcccctcgggcatcagcacatcgagcaacggcccgacaaaccagatgatcaggctcagggcaatcaggcccagcacggggatcacccagcgaatcatgaaactgaaaaacgccttcactcgacgccctccgccaatacggtgatttcaacccgacgattgcgggcacggccttcggcagtactgttggtcgccaacggctcggtgtcgctgcggccttcggcgctgaagcgatcaccctggccggtcttggccgcgaggatctccagcaccgacttggcccgggcttcggacagcgcccagttcgacggaaagcgcagcgtggcaatcgggcggttgtcgctgtggccggtgacgcgtacctgacccttgaccttgcgaatggcgtcagcgatacgcagcatcagcggctggtagtcatcgacgatgctggagctggcggacgcgaacagttcatcgccacggatggtcaccaccgagcggtccaccttgtcttccacagccacgcgaccggccttgatgtcttcggccaggaagccggccaggcgtggccgctcaatgacttttggctgcgccaccggacggtcgatggcctgcaccggaatctcacccagggcatggatgttcttgaataccggctcggcatccgaggccagcttcatgcgcaggccgaacagcaacgccagcaataacgccaggccaatcgccacagcaatccacggcggcaggaattgcgccaggcgatcacgggccacggtcacgccgcgccagtgcggcgacagctcacgctcgtgttcgccacgggcactgcgaatcgctgcggcggtgcgctcgcgcaaggcctccaattggctgcgcccatcggtcatcacgcggtagcggccttcgaaacccaggcacatgcacaggtacagcagctccagcaggtacaggcgttcccgtgggctttgcaggcagtggtcgagcaactggaagaccttttcaccgccccaggcttcgttgtgcacagtgatcagcaggctttgtttaccccagtcactggtgctgccccacggcgtactcagtaccgcctcgtccaatgcagtgcacagcgcgtaacgggccagcagcacttcattgcgcgctacgccggcggcctcggcgcgctcttcgaactggcgcaggtaggccagcaactgcgcacgcaggctggctggcgccgggtgggcgatggtgttgcgcagccgcgtcagcagtgccaacagcgggccggcggcgctttccagtgggttcaggccgtggctcttgccagtgaggatcggcgcggccggcatcgacaaaggtgccggctctgcacgtgcaggttctggcgcacggcccccggggcgcggcatgaactgggtgcggtcatcatcattgggatgcatcgcggattatcctcggatcgcccagaaggccaggttcaagcccgggaactgcccggcgatatggaaggcaaaaccgccggaattgctcaactgctgccagtgctcgctgccccggtccagttcgtaataggtgctaccggcgtggtacggcagttggcgcggcgccaccggcaacggcagcaggccaatgcccggcagttgcaggttgaccatgtcgcggatgtgctccaccgaaccgactttgctttgctggccgaagcgcgcacgcagggtttcgccaggcacatcggcacgcaccacgaggatgaaactggcgttgtcgagcaaggtcttgtcggccaacatggccacgtggatgccgtaggctttctcgacaatcgggattggcgtggccttgctgtcgatcagcatcgacagcgcctcacgcaaggcggccatgaccggcgtgaagctcaaggccaggtcgtcatgctggtattgcgggtattcctgggggcgccgacccgaggttgaaaaggtggaaaactcaccggccaggctcaccaactcactgaagaagcgttccgggtgcagcgggctcaactggttgaaatgctggatcagcggctgcgcgcgattgaccagttgcaacagcatgaagtcggcaatctccgaggcgccgccagcgccggaggccacaacgcggccggccaaagcttcgccacgctggtgcaacaggccgagcagttcgctgcgaaaggccgtcaacggtttgcttgcggccacatccagcaccggcgggatataggtgtcatccagcaccaacgcgcggtcggcgcgtttttccttgatgcgtaccaggccgatggcggcgtagtcgctgataccgtcctgcgccgtcagcaggcgtaacgctcgcgaacccacggccactggtgcgcggttttcgaaaggcgcgttgtcgtcgcgcacttcgcgcacctggctcacataacgtgcggcttccagggcttcgccctcatcgacggtgtcgcgggcacccgcacgcttgagcggcagggccaggtacaccaggccgtcgcgcagattgtcgtcgatattcaacgggctcggcgccaggtcatcctgggggatattgaacggcgtgccgtccggcaacaggccacgggccgacacaatcgccagcttgccctgggccagcagaccctggtcgatcagcaattcggaaaagccccaggcgcctgccgacaacgggcggctgcgggcgtcgatcaggttttccaggtaacggtcatgctgctggaagtgctgcgttccgatgaacatgccttccgaccagaccacgcgattgttccaggacatgggggctccgattgcttgttattgggcagggctggatgggggagccacgacatcggcgcgcacggcacgcacatcgaggctgatctggtattcactggattggcgcggcggcacgttgatgacggtgcgccattgcgcacggtccaactcgcgatagcccaccagcacgccgatctggcgcgtggccgggtcaaggtcgcgctggatgctcagttgctggccgggttgcaccatcacttcatcctggtccagcaggtcgaggccgagggtcgattgcgcacggtccgccagggcgaagtaatcggagcgggaaaaggtcgcggcgtttttcaattcgaaaatgcgcacccgcaccggcgcggcttggccatttgcaccggggttaagcccggcaatggcgtgaaagtgcagctcgacggcggtggtgttggcttgcgcgtcggcaaccgcttcgggtttgaccgcgtcgttggcacacgccgtcagcagcagcgcggttgcagctgcgagtaaaaacctgggaatcatcctgcgtcctcaatgacgtacttagctatccgttttatccattcgtacaacgcgcttttagcgtcgctgtcgtgcgctgtgttcttcgtaggcccggctgaattcgcggccgaacaggtcttggaaatcctcctgggcctcgcgggaaatattgctgtagagctcggtgaattgctgccaatactgggcctggcgcgagccgttgaaaatactcgaaaggccaccgggcttgcccatgcgctcttccaactgcgccggttcaaagcgcatgagcaggtgctttatcgctgcttccaccccagccatcaccgccaattggtgggcgcgcaagtcgtcgaagctgtcacgcaccgcaacatccggcgccataaacgcctggttgccgtgacgaagcaacagcagtaaggcttcgtcggcattcggggcgaatttcaacgggttgttttcggcgggacggatcatcgtctgctgcatgcggaactcgcccttgaggctggcccgggcgcgcaatacgtcaatcaggccctcgaccatcagccggtagctgcggccaatgctttccatctgggcgcaggcgtcggctttatccaggcgtagctggtcgaggccggcaccgcgcaggaaggcttgcaacaagtcgggttgtggctcggcgccggccacggggagcgcaacaggctcgaccacaggtggcggcggggcaataggggcagcaggcggcgcagtattgacgaccggcgcgggagcgtcgccaaacaggtcccagtcttcgggaatgaccgagccttgcacctgcggtttctcaggtatgggcgcaggcacagcgaccggtgccggcgggcggaaatcgtgctgctcggacggtacatggtcggccacggtgggcggcggcacggcggtggggctgaggaaatcgaacagatcgggcaaggtttccatcgacgaagcgccgtggaactgcggtgcgatcatcggcgttggcgcaggcgggctcgccaccgcgcccatcagcgcttcaaagctgttcggcgaatcaccggcaaacggctggctgccgacggcctgcacgttgaagtcgatacgcgcctggacttcataatcgccaatgcggatcagctcgccatcttgcagcggctcgctattacccctgcgcaaacgaataccggcgttaaccagttccacaccgttggtactgttatcagttaagtaataacgtccatctttgtattgaataacgcaatgttgggaggagacgagacgttcagggtcaggcaatacccagtcattctctgaactgcggccgatagccatcacgccctggtccatggacttctcggggcactgcccaggggtgatcttgtgataactagtgatagtcaaacacagcgccatcttgcctccttgctgatacatcgcgcgcggtctatccaaagggacacgcttccctgaagacttgcccacggtcgcgcaaaaaacgaccgccaaaatctgccgttaccagcatgatcgctgatattaactggcttgcatgacaaaaatcctctacggacacgcctttcgacccgtcagtcgcgcaggttgttaaacaccgcacatctgtcacagagggcgaatagcttaccttgacaaggcataagtactacaccaaaaatgcacaacttcttgaacatcagtgatagcccaatagtggcactctgatgttatgaccaggaaaacatgcaaagttcatcgcgtaactcgagcatgcgttgcccgccgttcagcgggccgataaggagatcgaattcagtggatgtgccgttgctgctcaccgccgtttctgcgacttcgccttgtggcgaagacatggagtatgacgcgcaattcttgcaactggagcgtgatgccaagggccagcccgagcgcagcatgggcgactcgatcctgcccgctgaaccgccggaatggcgcagcatccagcagcaaagcctcgacttgttgcagcgcagcaaagacctgcgcatcacccacttcctgctgcaaagctccctcgccctccagggtgtggccgggctggccgaagtccttacgctgatcaacgccctgctgcgcgaatactgggccgacctgcatccgcgcctggatgccgacgacgataacgaccccaccgtgcgcatcaatgccctatccggcttgaccagcgacacgacgattcgcctgctgcgcgagagtattctcacgcgctcgcgcaccttcggccccgtgagtttgcgcgccgcgcttaacgcaagcggcctgctgagcttccccgatgagcaactgggcagccagcagctcaatgccgcgttcctcgacagcgaccccgaactcctgcaagccactcgcgacgccttgagcgcagcgcgcgcggcgtgcgaagccatcgaacaacaggtcaacgagcaggtcggttccgcccagggcgtggatctcagcgccttgaagcaaccgctcaagcaggccctgcaaattctcaatcaagcggtgcccggcaccgacagcggcagcggcagcgatcccgaggccgtcagtgacgacaacgccccctcggtcgattacgccactgcgcccgcagccccgcgcccgacgggcgacatcgccacgcgggatgacgtgctgcgcagcctcgacaaaatccttgcgtattacacccggcacgagccttcgagcccgctgccggtgttgttgaaccgagcgaagaatctggtacacgccgacttcgcggccatcgtgcgcaatctgattcccgacggcatgtcccaatttgaaaacctgcgcggcccggacagcgagtaagccgccggaccgtgcagtaacaacaccgtcgctcaagcgaccaggagcagcaacgtggcgaagcaaagttctcagaaattcatcgcgcgcaaccgtgcgcctcgagtgcagatcgagtacgacgtcgagctttacggcgccgagaaaaaggttcagctgcccttcgtgatgggtgtgatggccgacctggccggcaagcccgccgagccgctggcagccgtggccgatcgcaagttccttgaagtggacgtcgataacttcgactcgcgcctcaaggccatgcagccacgcgtggcgttccacgtacccaacgagttgaccggcgaaggcaacctgagcctggacatcaccttcgaaagcatggacgacttcagcccggccgccgtggcgcgcaaggtcgattccctgaaccagctgctcgaagcccgcacccagttggccaacctgctgacctacatggacggcaagaccggcgctgaagaaatcatcatgaaggcgatcaaggacccggcactgcttcaggcacttgccagcgcgcccaagcctgcaggggagcagtaagcatgactgacaatacagtacgcgaaggcgcatccagcctgggcgccaccgaagaaaccagcgagttcgcctcgctgttgatgcaagagttcaagcccaagaccgagcgtgcccgcgaagccgtggaaaccgcggtgcgcaccctggccgaacaggccctggcgcaaaccgacctggtgtccaacgacgcaatcaagtcgatcgaatcgatcatcgccgccatcgacgccaagctcaccgcccaggtcaaccagatcatccaccaccaggatttccagcagctggaaagcgcctggcgtggcctgcactacctggtcaacaacaccgagagcgatgagcagctgaagattcgcgtgctcaacatctccaagccggacctgcacaagaccttgaagaaattcaagggcaccgcgtgggaccagagcccgatcttcaagaagatgtacgaagaagaatacggccagttcggcggcgaaccttatggttgcctggtaggcgattactacttcgaccagtcgccacccgatgtggaactgctgggcgaactgtcgaaagtctgcgccgccatgcactcgcctttcatcgctgccgcgtcgccaaccgtgatgggcatgggctcctggcaggagctgtcgaacccgcgtgacctgaccaagatcttcaccaccccggaatacgccggctggcgctcgctgcgtgaatcggaagactcgcgctacatcggcctgaccatgccacgcttcctggcgcgcctgccgtatggcgccaagaccgatccggtggaagcctttgccttcgaagaaaacaccgacggcgccgacagctccaagtacacctgggccaacgccgcgtacgcgatggcggtgaacatcaaccgttcgttcaagcactacggctggtgctcgcgcatccgtggcatcgagtccggcggtgaagtggaaaacctgccggcccacaccttccctaccgatgacggcggcgtggacatgaagtgcccgaccgaaatcgccatcagcgaccgccgtgaagcggaactggcgaagaacggtttcatgccgctgctgcacaagaaaaacaccgacttcgccgcgttcatcggtgcgcagtcgttgcagaaaccggccgaatacgacgacccggacgccaccgccaacgccaacctggccgcacgcctgccgtacctgttcgccacctgccgtttcgcccactacctgaagtgcatcgtgcgcgacaagatcggttccttcaaagagaaggacgagatgcagcgctggttgcaggactggatcctcaactacgtcgacggcgacccggcacactccaccgaaaccaccaaggcccagcacccgttggcggctgccgaagtgatcgtggaagaagtcgaaggcaacccggggtactacaactccaagttctacctgcgcccgcactaccagctggaagggctgacagtgtcgttgcgtttggtatcgaagctgccttcggcgaaaagcgcgtaaaaaatcgggactggctcgctccccgtaggagcgagcttgctcgcgaaaaacttcaaggcaccgcgttcattcaggatgccagcgtcatcgttaacgaccttcgcgagcaagctcgctcctacaggggtcggtggcgttaatacattcggtggcagagtccacacagggagaaaacatggctgttgatattttcatcaagatcggcgacatcaagggcgagtccatggacaaggcccacaaggacgaaatcgacgtattgaactggagctggggcatggcccagtccggcaacatgcacgtcggcggtggcggcggtgcgggcaaggtgaatatccaggacctgtcgctgaccaagtacgtcgacaaggcttcgcccaacctgatgatgcattgcgccagcggcaagcacatcgacaaggtcaagctgaccgtgcgcaaggccggtggcgaaagccaggtcgagtacatggtgatcaacctggaagaagtgctggtcacgtccctgagcaccggcggctcgggcaccgatgatcgcctgaccgagaacgtcaccctgaacttcgcccaggtgatggtcgactaccagccacagaaagccgacggcaccaaagatggcggcgcgatcaagtttggctggaacatccgctccaataccaagcgctgatagcccctgtggccgtggcctcgcgccacggccacagataccttgtccctctcgcaacccgtccgtggagctgctttggtggtaactgaaatcgcttcccgcgaccgtctgcaaccgtccctgctggaccggttgactgatgacgacccgaccaaccccaaggaaagcgccgacaagcgtgtgctgtccctgacccaattgaaagcctcggtgctgcgtgacctggcgtggctgctcaacaccacgtcgttgctcgatgccgatgccacgctgcacaccccagccggtacctcggtggtcaattacggcctgccggcgctggcgggcaacagtgtttccagcgtcgatatcaaggcactggaagccctgatctaccaagccatcgccaccttcgagccgcgcatcctgcgtcacaccttgcgggtcaaagcccgagtcggccatggcgaaatgaaccacaacgccctgagcttcgagatcgaaggcgacctgtgggcacagccagtgcctttgcgcctgttgctgcaaaccgacctcgacctggagtcgggccatgtgcgcgtggtcaacgccgaccagcggaggcgcccatgaacccgcgcctgctggagctgtacaaccaggaactgcaccacgtgcgcgaaagcgccgccgagttcgccaaggaatacccgaagatcgccagtcggctgaccctgtccggcatggactgcgccgacccctacgtcgaacgcttgctcgaaggtttcgcctacctgacggcccgggtgcagctcaagctcgacgccgagtacccgacctttacccacaacctgctggaaatcgcctacccgcactacctggcgccgacgccgtcgatgaccgtggtgcagctgcagaccgacccggatgaaggctccctggccagcggtttcccgctgccccgcgacaccgtattacgtgctgccctgggccgcgaaacccagacctgctgcgagtaccgcaccgcccacccggtgacgttgtggccgttgcaggtcagcgccgccgaatacttcggcaaccccgccgccgtgctcgggcgcctggccgccagcgagccgaaagccaaggcgggtttgcgcctgaccttgcgcaccggcgccgaattgccattcaacagccttgagctggataacctgccgttgtatctcagcggcgccgatgagcaaccgttccgcctctacgaacagctgctgggcaacgcctgcgcggtgtttgcacgcaagcctggtggcgattgggtcgagcgcctgccccagggcgcgttgcgctcgcggggtttcgacgatgccgacgcagccatgccggtggtggcgcgggcattccagggctatcgcttgttgcaggaatacttcgccctgccccatcgcttcctgttcgtcgagttcgccgaactgagccgtgcagtcaagcgttgcgacggccaggagctggagctgatcgtgctgtttgaccgtcatgagccgagcctggagggcagcgtcggtgcggcacagttcctgccgttctgcaccccggcgatcaacctgtttcccaagcgcgtggaccgcatccacttgtccgaccgagtcaacgaacaccatgtgatcgccgaccgcacgcggccaatggatttcgagattcactcgttgagcggcatcactggccatggcactgggccggagcagccgttcttgccgttctacgcggtgcgtgacccgtcgcgctatggccgtgacctggcttactacaccgtgcgccgcgagccacgggtgttatccagcgaccagcgccgcaacggcccgcgctccacctatgtgggcagcgaaaccttcgtcagcctggtggacagccgccaggcgccctacggccatgacctgcgccagttgggtgtcaccgcgttgtgcaccaaccgcgacttgccgctgttcatgagcgtgggtaacggcaagaccgacttcaccctggccgacagcgccccggtgctgtctgtgcgctgcgtcgccgggccaagccggccgcgcgccagccatgcccatgacgcaaaggcctggcgcctgatcagccagttgtcgctcaattatctgtcgttgagcgaacagggccagggggccggggctttgcgtgaactgctgcgcctgtacggcgacagcaacgatgccgccctgcaattgcagatcgagggcctgcgcgaagtcagcagcaaggccgtgacccgacgcctgccgatgcctggcccgattgtgtttggccgtggcttggaaatcaccttggagttcgatgaaaacgcgtttcgcggcaccggcgtgttcctgctcggcgcggtgctggagcgcttcctggcacgttatgtgtcgatcaacagttttaccgagacggtgatccgtaccaccgaacgcggcgagatcatgcgatggaaagccaagcccggacggcgtccgaccctgtgagtaccctggatgcgatgcaccaggagccctgggaatatgacttcttccaggcgctgcggcgtatcgagtgcgaatcgccggacctgccgcgcctgggccattccctgcgcctggcggatgacccgttgcgcctggggcaacaagccgattgcaccttcgccccggccacgctggcgtcggtcgaccccggtggcgacggcaagccggcgcggctcgagcaattcttcttcggcctgggcggccccaacggtccgctgcctttgcacatcaccgaatacgtacgcgaacgccagcgcaacaacgccgacagcaccagcaagcagttcctggatgtgttccaccaccgcttgctgagcctgttctaccgggcctgggccgaggcgcggccaacggtcagccacgaccgcccggatgatgactactggtctgcacgcctcgccgccttgagtggccgcggcatgccaagcctgcagaatcaggggcttatcccggataccgccaagctgcactacagcggccacctgtcggcgcagacccgctacccggacggcttgaaagccattctcagcgaatacttcggcctgccggtggagatcgaagagtacgtcggccaatggctggagctgcccgaacgtagccgcgtgggcgtgagcgccaataggctgggcgtggacttttgcctgggccgctttgtgtgggaccgccagcacaaattccgtattcgcctcggcccgctgaaactcaatgactacatgggcatgctgcccggccgccagccgttcaacgagctggtggcgtgggtggccgagtacctgggccatgaattggactgggacttgaacctggttttgcaacaacccgaagtaccggcgctgcacctcaacggccagttccgcctgggcttcaacacctggctcggccgccctgcgcatgacgccaacgacctaatcctggcccggcattacgccgatcacgccaccacctcaaggaatccagagcatgggtgaaatcagtcgcgccgcactgttcggcaaactcaacagcgtggcctacaaggccatcgaagccgccaccgtgttctgcaaattgcggggtaatccgtatgtggaactggcccactggtttcaccagttgctgcaactgcaggactcggacttgcaccgcatcatccgccagttcaacgtcgaaccggcgcgcctggcccgagacctgaccgaagccctggaccgcctgccacgcggttccacctcgatcaccgacctgtcctcccatgtggaagaagccgtggagcgcggctgggtgtatggcagcctgatgttcggtgaaagccaggtgcgcaccggctatctggtgctgggtattctcaagacgccgagcctgcgccatgcgctgctggggttgtcggccgagttcgacaagatcaaggccgaagccttgagcgagcgctttgacgaatatgtcggtgactcgccggaaaacgcactgactgccagcgacggtttcaatgccggcgccgtgccgggcgaagccagtggcgcgatggcgccaagtgcgatgggcaagcaggaagccctcaagcgcttcactgtcgacctgaccgaacaggcccgcagcggcaagctcgaccctatcgtcggccgtgacgaagagatccgccaactggtggatatcctcatgcgtcggcgccagaacaacccgatcctcaccggtgaagccggggtaggcaagactgccgtggtcgagggtttcgccctgcgcattgtcgccggtgacgtaccaccggccctgaaggatgtagaactgcgcagcctcgacgtgggcctgctgcaagccggcgccagcatgaaaggcgagttcgaacagcgcctgcgccaagtcatcgaagacgtgcaggcgtcgcccaagccgatcatcctgtttatcgacgaagcccataccctggtgggtgccggtggtgctgccggtacaggtgacgccgccaacctgctcaagcccgccctcgcccgtggcaccttgcgtaccgtggccgccaccacctgggccgagtacaagaagcacatcgagaaagaccccgccctgacccgccgcttccaggtggtgcaggttgccgagccgtcggaagacaaggcgctgctgatgatgcgcggcgtggcctcgaccatggaaaaacaccaccaggtgcagatcctcgatgaagccctggaagcctccgtgaagctgtcgcaccgctacatcccggcgcgccagttgcctgacaaatccgtgagcctgctggacaccgcctgcgcccgcgtcgctatcagcctgcacgcggtgccagcagaagtggacgacagccgtcgccgtatcgaggccctggaaaccgagttgcaaatcatcgcccgagagcatgcgatcggcattgccattggtgcgcgtcaaaccaatagcgaagcgctgctgagcgccgagcgtgagcgcctgtccacgctggaaagccgttggggtgaagaaaaagccttggtagatgaattgctggctacccgtgcaaccctgcgcgaaaaagccggcgtggtggacagcggcaacgatgaattgcgtgcgcaactggtcgatctgcaacagcgcctcaccaccctgcaaggtgaaaccccactgatcctgccgaccgtggattaccaggcggtggcctcggtggtcgccgactggaccggcatcccggtgggccgcatggcccgcaacgaactggagaccgtgcttaacctcgaccagcacctgaaaaagcgcatcatcggccaggaccacgccctgcagatgatcgccaagcgcatccagacttcccgcgccggcctcgacaacccgagcaagccgattggcgtgttcatgctcgccggcacctcgggcgtgggcaagaccgaaaccgccctgaccctggctgaagccatgtacggcggcgagcagaacgtgatcaccatcaacatgagcgaattccaggaagcccacaccgtgtccaccctcaagggcgcgccaccgggctatatcggctacggcgaaggcggcgtgctcaccgaagcggtacggcgcaaaccctacagcgtggtgctattggacgaggtggaaaaagcccacccggacgtgcatgagatcttcttccaggtgttcgacaagggcgtgatggaagacggcgaaggccgggtgatcgacttcaagaacaccctgatcctgctgaccaccaacgccgggaccgagctgatctcccaggtgtgcaaagacccggcgaacatccccgagccggaagagatcgccaaggccctgcgccagccgctgttggagattttcccgccggcactgctgggacgtttggtgaccattccctactacccgctgagcgacgagatgctcaaggcgatcacgcgcctgcaactgaaccgcatcaagaagcgcgtggagagcacccacaaagtcgcgttcgactacgacgacgcagtggtcgacctgattgtttcgcgctgcaccgaaaccgaaagcggtgggcgcatgatcgacaccatcctcaccaacagcctgctgccggacatgagccgcgagttcctcacgcgcatgctcgaaggcaaggcgctggcgggggtgcggatcagcagtcgggataatgaattgcactacgacttcagcgattgacctgacggaattcgataaaaattgtgggagggggcttgctcccgatagcggtgaatcagtcacccaatgcataactgacacactgctatcgggagcaagccccctcccacatttggactcggtttcttcagttatttagtcatttacgggttaaccgatgctattcaaccaagcctcacgcctggccaagatcaccagccccctcgggccggatgtgctgttgctcaatgaaatgggcggcggtgaagagctcggccggctgttcaactacgagctgcaactgacgtccctggacgccaacatcgacctcaaccagttgctcggcaaacccatgagcgtgggcctgcaactggccgatggcggcgagcggcatttccacggaatcgtcgcccgttgcagccagaacatcgaccagggccagttcgccagttaccaggtgaccctacgcccatggctgtggttgctcagccgcacctccgactgccggattttccagaacctgagcatcccgcagatcatcaagcaggtattccgcgacctgggcttttccgacttcgaagatgccctgagccgaccgtatcgcgagtgggaatactgcgtgcagtaccgcgagaccagtttcgatttcgtcagccgtctgatggaacaggaaggcatctactacttcttccgccatgaacaggaccgccatgtgctggtgctggccgacgcttacggcgcccacaccaccgtaccaggctacgcgtcgatcccttactaccccaaggacgagcagcagcgcgaacgcgaccatatgcacaactggcacctggcgcaggaggtgcagcccgggtcgctggagctcaacgactacgacttccagcgccccagcgccagcatcgacgtgcgctcggccatgccacgcccgcacaccgccggcgactacccgctgtacgactacccgggcacctatgtgcaaagcgcagacggcgaacactacgcccgcacccgcatcgaagcgctacaaacgctgcatgaacagatcgagttcgccggcaatgcgcggggcctgggctccggccatctgttcagcctcaccggcttcagccgccaggaccagaaccgcgaatacctgatcgtcggctgccgctactacatcgtccaggaaagcctggaaagcggcggtggctcgggctcggcgcagttcgaaagcagcctgacctgcatcgacgcccaacagagtttccgcccgctggccaacacccaccgccccatcgtcaaaggcccgcagaccgccctggtggtcggccccaagggcgaagaaatctggaccgaccaatacggccgcgtaaaggtgcacttctactgggaccgtcacgaccagtccaacgagaacagctcgtgctggattcgtgtgtcgcaatcctgggccggcaagaactggggttcgatgcagattccacggatcggccaggaagtgatcgtcagcttccttgaaggcgaccccgaccgtccgatcatcaccggccgcgtctacaacgccgagcagaccgtgccctacgatctgccggaaaacgcgacccagagcggcatgaaaagccgctcgagcaaaggcggcacaccggccaacttcaatgaaatccgcatggaggacaagaaggggctggagcagttgtacatccatgccgaacgcaaccaggacatcgtggtggaggtggatgaaagccactcggtggggcatgaccgcaataagagcattggccacaacgagacggtgaccatcgggagtaaccgcctgcgggtggtgcgcaacaacgataccgtgattgtgggtggggccaagtcggacagcgccgccacccactacaccatcgaagccggagagtgtcttcgcctggtgtgcggggacagtgtgatcgagctcaaggcaggcggggacatcaacctgacctgtggctcgttcaacctgttttccaccggcagcagcaagatccagacgaagggcaagctggatatcaacctgggcagcgacaagggcacatcgcccggcgcccaaggcgtgcaagacacgatcaagtccgccgtcgaatcaaaattccccggcaagcccggcgctggtcaataacgagatttcttcaccatgaattacctgatcaacgaagcacagttcaccttgccggacactgaggtacaagacacctcgatcaatatcctcaagttcgccaagctgggtactaccctggtggtgagccgcagcccgttggcggacggcgagagcctgcaaagcaatttcgaaggccagctgaaaaaactcgaacagcaggtcaaggaccttcgctattccccggcccaggcggttaaggtcgggccggcgcaggacatcgacgcctttgaagtgcagaaccgtttcaacaagggcagcgacaatatttaccaatatcagttggcaatgcagatacccggcacacgcaacctggtcgccctgagttacgtcaagacccagcccctggggcctgccgaggcggcgcattgggcaacgctgaaaaacacgctcaccttttgcgctacgccttgagtcgagcctgagcaatgagtgatgacctctgggctgcccgagaaggcgacgcactgctgcacacctcggtgatggccgatattctcggaggtgtgctggaagtggccgcctatgcggcgatcacctacgtgggctgtcttgccgtcgcggcggcggttgccatcacgaccggcgcaaccatcgccaccggcggcgttgccctggtgctggtggtcggtgctgtcgtcggtatcaccgcaggactcacgggcgccgacctgaaaatatccagttggtgcgagtccgccgccaactgggtatttccgccagtgatcgacgccttcatcaccagcggctcggaaaacgtcttcatcaatggtaaaaaggctgcccgcgcagctggcaagatgaccgctgtttcagttccgcccagcgaaccctcggcccccagcttcctggacatggccggcgagtttttctcgcagttgtggcgcccgaccgtcgcctcccccgcccccggcaccaagccttgcccactggacaccgtggcgtgcaacaagcacccgcccatgccgctgcaattcattgccgaaggttccagctcggtattcatcaatggccagcctgctgcgcgcagcggtgatcgcagtacctgcgatgccaagattgggacggccgagggcctgatttctccggatgtgcgcattggtggcgagaccattgtggtgcaggagattcggagtgggaaaacaccgggggtgggcctggcgattactgctttattgatgctgcgcggcaacgtgagatgtttctggagcaaactaccctgcctgttcggcagtgtgctggtaggggcaggcgtctcctatgggaccagcaagataacctctgccctcaaaaacgccatgaacggctcgcctaacccggtgcacagcgcgaccggtgccaagattctaggcgatgaggatgaactggattttgtgcttgcgggcctgctcccaatggattggcagcgtttctacagcagtctcgacacacggaacgacggactctttggtgcgggatggagcgtcgcctatgaggtatccgtcgagatcgatatagacgaaaaactgttttacatcgatgagcagggacgccgcctggatatcggttacgtccccctgtcaggcggggcgttcgacccagtcgagggtcttgtggtcaggcgcagcggcgacggcgcggtcttgatcgagagtatcgacggcctgtatcggctgttcgagcccgacccgctgaacggctttcggatgcgcctgcagttgctgggtgatcgcaacgaagggcgaatctttctcgactatgacactcaggggcggctgtatcgcctgcgcgatacccacgacttaatgcacgtcgaactgaactattcggcccaacacccacggcgcgtgagccatatcgaacgacgttacttgcgccaagagcattttgacgcgcgcagcgacgtgctggtcagctatcgctatgaccacaacggcgacttggccgaggtcatggatgcacaaggcgtgacccaaaggcgctttgcctacgacagcgcgcggcgcatgatcgaacaccagcgttcaagtggtttgcgctgcttctaccaatgggctgaggtgcttggaccgcaaggcccggaatggcgcgtcagtcgccactggagcgatgcaggtgatcaatacacgttcgactacgatctggacgctggtatcacccacgtcactgacgggcttatgcgggtcggcacccggcattggaacccgcagtaccagatcactcgctacgtcgataacctgggccatacctggcaattcgattggaacgaagaacgccaattggtgggtgccattgacccgcaagacggccagtggcacttcaactacgacgcgtcaggcaacttgagtgcagtcatcgacccactggccagaaccagcggcacgcagtggctggaacactgggcattgccccaagtggaaaccgacccggcgggtaacagttggcactatcgctatgatcagcgtggcaactgcatcgaagaaatcgaccccctcggacactgcacccgctacgtgtatgacggtttcgggcagccagtgcgcatcattgatgcgacgcagaaaaccaggacactacattggaacgagtggggtcaactggtcgaagaggtagattgttcgggttatccaacgcgctatcagtacgacgccttcggcaatctgctaatgcagaccaatgccgaaggtgaatcagtgcgttaccggtacggtcttcaggggctgcttctggagtgtcagctaccggacggccgcgtcgaacagtttcaacgtagcgccagcggttctctgattgttcacgttgaccctgccggcagcaccacacgctatgcctatgacgttcgcggcctggtcaaacaacgctgggacgcgcataaccgttcggtcaaattcgatcatgatgcctacggacgactgtgcaagctgaccaatgagaatggcgaaagctatcgctttgagtgggacgcagctgaccgtatggtgcagcagcaggatttggatcaaacccggcgctgctacacctacgactcactggacaacgttgtcgccgtggactatctaccgggggctgagggcgagccggtaacgccgctgtcgcaccagttcgagcgcgatcctggtggacgcctggtcagtaaaaccaccgcggacggcaccaccgtttatgagcacgacctgaacgaccaactggtcggtgtcaccttcaccgcccctgacggtcgccaacaggtactcggtttcaactatgacgcgctggggcaactgcttgaagagcaaagctcggcagggcctgtgcagcatcgttacgatgaactgggaaacctgatccagaccggcttacccgacggtcgatggttgaacaggctctactatggcagcggtcacctgcatcagttgaatatcgatggcaaagtcatcagcgacttcgaacgtgaccgcttgcatcgccaagtgcagcgtactcagggccaaatcaagacaagtaccgcctacgatcgaagtggcagggttcgctcacgccagcgccgcagcatcgatcagccttggcaactgccgcctttggtcgagaccgattacagctacgaccctagtgataatctgatcggccgacgtcgcgttgaccgccagcacgatcgccaagagcacctgggttacgacagtaccgatcggattcttttaagccatcaggctggccgcaccgaaacctatgcctatgacgccgcagccaatctgctggacagcccaaatcatggtggtctcgtacggcataatcgcctacttacctatcaagacaaacgttatgcatacgatgctttaggtcggatgatcgagaagcgcagcgctgctcatggcttgcagtgttttgcctacgatgctgaaagtcggctggttgaagtgcgaaatgacaacggcaacgtggtcagaatgacttatgacccactcggacggcgcatcaagaaaactgagcacgattacaatgaccatttgttgagccagacggatttcatctgggatggtttacgccttttacaggagtacaaacacagccagaccagtctttatatatacgaaggggacggctatgaacctctggcccgaatcgacggcagcgggtcattgcaaaaaatccgttactaccacaatgatttgaacggactcccggagcaactgaccgaggccgatggacaagttacctggcaggcgtgttatgaggtgtggggccgcacattggcggaggttcgggaaccccattacattgaagagcaaaacctacggtttcaagggcagtacctagaccgggaaacgggactgcatttcaatacatttcggttctatgatcccgatgtgggccgttttacaacgccagaccctgtcgggctggcaggaggttttaacctttatcagtattctcctaacccttacggatggatcgatccgctgggatgggccccgtgcggctcaaccactgctaagcttcaggcacacgccaatgcggctagaaaggctatctacagtaacccacaaagatcgttgaccccgagacagagagcggcagttaaacgggcctatgacagaggtgatctcggacaggcacgttctcgctatcgtcggtatgtagggcagcgaattgatgcaaacttcaaaaccagggtgaaaaatgacccatcactgggtcacttggaggtatcgaagtcaggacagcgtcttcccgatgtgtatgaaactaaaactaaaacctggtgggaccttacgacgaaggctgattggaaaagaggcacgcatcagcggcgttatggggactggggcaatggttatgaagggatattatggtgagtaacaaaatgccatcaacggtgttgtccggcgtacagcaggacgggctcgtattacctaaaaaaacgctctttgaaaaagagagcatcatcgactgtaaattaaaagatgcgaaactctccgatccgatttttgatcaatgcgtgttggagagctgtatgtttgagaagagtgatttctccggctcaagatttttcaataaaaccctgctgaccaattgctcattcaagactgtcgactttcagggatcgggcttcagcaacagccaattcaaggattgcacgttcataaaatgcaacttcaaagaggcgtctctgaaagactgcgagttcagcaactgcacatttacccagtgcaaaatcattgacaacacgttcagcgccagcaaaataacttccattaagttttcgggaaagctacaagaagtagctttcatagccgatcaacccaacacccctcttcttgctgactttaaactgtgcaagctggattgggtaacatttgagaactgtgatcttttacagattaccccccccgcggacacccagcacatttttttaaaagatgtatctgttcgcgcgcgcaaagcgctcgcctcgatagcgtccgagccagacaatcaaaccaataaactattgatgcgccgacttcaaaaacttaccacgcaacgaggtgcccttttcaatatcaaaaatcttgaggcgtatgaagggccggaatttaccaaacaattcattgcactacttcaagatttttaaaaaaagtcataacccgggcttaacacggttccctttaacacttttgaagctcatgtcaacctgggctttcgccaccttctgggcgaaacaagcgagagggaaaaatttattcagacctcttggccgaggtatctgaacgcggacagatttatctaaaaaaccaccccgataaatctgtacgctgttctcaacctcacgcccatctcacttcaagttaacgcttatgcttattatgcgtttgactccatcacggcccgcgctgccttgagttttttcaaaatgtacgtgtagcgtctttcaatattgtccatacgagcctcttcagtcggtggctcggatgagtcagcaggcacataaggatcgtactcgaatttataacgtttggttaagtccggcaaatgctcttccattatgtccatcctttcctcaaggttgtccatacgttcctctggagtagcatctggcgcgtcgtcgacatcctcgaaagcactgccgtctttaccttcgctgagaaaagacatcatgacggtggcaaactcaagtgagtttttagcaccttttagccgagcatccattatttgttcctgcgtcgctaaaggatctacagtgccaatcgtaccgtcctcgttctgcactgttgctccaggcatttcagcctgcgccgcctcttttttactgaagtagtcagacgtgatctgcgctcctacattaaagaatgagctgacgccgttgtttgtaactgacgttatcaaggcattcttaaaagtacctgccgctgaagaaggtgaaggggggggtggcggcagattgatattatcttgcaaattattgattgtattgatgttactatttggcttactcgctgtatttccagatccgacgggcttaattgtttgcggtttagcgcttgtaggcttaggcttaggcttaggctttgtagttgtaaccgtcggatttttacccgatgtagttgttcccgacgtagttgttcccgacgtagttgttcccgacgtagttgtgcccgttttatttgtgcccgttttagttgtgcccgttttagttgtacccgccttagttttgaccggaattttaactttcccggctcttccatcgcttccagagctcagtgcagtggcctcctcagaagtgaggctatcagcaacagccttatccgcacgtctgtttttagcatttatctcttcaggcgttgcagcagggtatttaaaggccttctcgttagtcacacttgattcagattcaactttggagcggtctggggttacctcagcttgccccgaagccggggaaccgctttcttgcgtctttttctgttcgggtagcaggtaagaagacggaactaaagcctgatcaactttcatatatacacctctaaaaaatacgtttagagagcgcattccttgctatctcgcgctatatgtgtcaatcgtcagaatttggttccaaatcaatcgaataattttaaaaaaaccgatgccgttcggcctgatacaacctcgaccgcgatttctcgcaacaatgcaataagccttctacttttgtgcccgcgaatttctctgccaaaaaaaaatgggcacgccgacccagtcggcgtacattttttaccgcccgcctcccttcgagacggcctcactagttacgggttgacgctatctttgagcgacttgcccggcttgaacgcaacggtgttgctggccttgatcttcactggctcaccggtttgcgggttcttgccggtgcgggcgccacggtggcgttgcaggaaggtgccaaagccaaccagggtaacgctgtccttgcggtgcagggcgccggtaatttcttcgagaacggcgttgagtacgcggttggcctgctctttagtgaggtctgctttttcagcgatggcggctgcgagatctggtttacgcatatgaagcctctttgacggttttttgttgttatgtccgtgctgctctctgttggagcagcgcccaaggcgccgcaggctctactctgcggcagacgggagtgaggatggcatgccctcgggcgccgcgccagtctcgcggcgacctttctcggggcttgaacgtgctgattccgacagaacgaccggtatttacgccagcaacggtggaagttctttgttcagggccagtttttccatgacagcactgccggtcagcgcgtaacccagcaggcgaccgctggcgtcgcgacacagggccttgatatcgccgcccagcccttcgacgctccacacgccttcggtcccccgtggcgcaggtgataccaccagtgggcagatcggggttttcaccgtgatcggcattggcccgtagctcacggcggtggcgttaccggccagggtttgcgccagggcgcgggcgcagctcatgagcggcatcacgtacagcaggttcaggccatcgacctctgcgcagtcgcccagggcgtagatattggcatgggaggtcttgaggtggcggtccaccataatcccgcgattgatttgcaggccggcggccgcagccaggtctacgcgagggcgcaggccgatggcagagaccaccaggtcgcactggatcacttcaccgtccgacaggtgcgcttcaaggccgtcagtggtgcgttgcaggcgattgagcaccgggcccaggtggaaacgcgcaccaatgccctccaatccagcctgcactgctgcggctgccgccgggtgcagcagggtcggcatgacttgctcgcatggcgcgaccaggtcgatttcataaccaccaacgatcaggtcgttggcgaattcgcagccgatcaggccggcgccgagcagcagcacgcggcgtttacccgcagcggcggcgcgaaagcgcgcgtagtcttcgagatcattgatcgggaaaatcagttcagccgcgtcgccttcgaccggtacgcgtacggtttctgcaccccaggccaggatcaggtcgcggtaggccaccgcttcctcgccgatccacaggcgcttgtggcccgggtcgatgccgctgacacgtgtgtgggtgcgcacttcggccttgagctgctcggccatggcgccgggttcagccatgctcaggccgtcggcttccttgtttttgccaaaaccggtggagagcatgggcttggagtaagagcgcccgtcatccgcggtgatcagcagcaagggggtctcgctgtcgagcttgcgaaactcccgggctacgttgtaaccggccaatcctgtgccgatgatcacgacaggtgcgttcattcctttctccttgtagtacgtttcttaaactaaaaatcagccgatttcgatcatttcgaaatccattttgcccacgccgcagtcagggcatagccagtcttccggaacgtcctgccacagggtgcccggtgcgatcccatcatccggccaaccgtccttttcgtcatagatcaggccgcaaactacacattgccacttcttcattacttacttcctcaggtccaggcatcttggccggcggtcggtggatccagcgttgccgcacggctcagggcgttttgtactgatcggggccggcagatgcaagcacgatcggcgcaaacggccggtttggcgcggcaaaagatcagggtgccatggtaagctcgccgcctcttttgctgccaatactgactcactgtgccgcactcaatcgcccttcccgatgctggccaatggctgacccagagccttctgagccccttgcccacgcccctgaccctcaattggctgtttgacgaaggctcgctgacacgacggctgacgtggctgtccaacgacggtttcagcgtgacgccgctgttcgaaggctggcagccgttgcgcgatgatgaatgcgccgccctgggcctggcccaggccagtgtcggctgggtgcgcgaggtgtacctgcgtgggcatggccagccgtgggtgtttgcccgcagtgtggcagcgcggggcgccttgcagggcgacggcctgcacatggacgagctgggtagccgttcgctgggcgagctgctgttctgcgaccacgcctttacccgccaggccattgaggtgtgtcactaccctcgcccatggctgccgacagcggaccagaccgacggtttatgggcgcgccgttcgcgcttcgaccgcgggtcgctgagcgtactggtggcggaagtcttcctgccgggtttctggcacgcgctgcatgatcatccggagaattgctgatgtatcaacgtctgctcaagtccctgaaccgcctgaatcccagggcctgggatttcattcagttgacgcgcatggacaagcccatcggcatctacctgctgctgtggccgacactctgggcactgtggatcgccggcaagggctcaccgtctctgctcaatattgtgatttttgtactcggcgtggtgctgacccgcgccggcggctgtgtgatcaatgattgggccgaccgcaaggttgacggccatgtgaaacgcaccgagcaacgcccactggtgagcggcaagatcagttcaaaagaagcactggtgttttttgccgtgctgatgggcatcagtttcctgctggtgctgctgacgaacgccactactatcctgctgtccctgggcggcttggcgctggcagcgagttacccattcatgaagcgctacacctattacccgcaggtggtattgggggcagcgttttcctggggcatgccgatggcatttaccgcggaaaccggccacctgcccgcgacggcgtggttgctgtatatcgccaacctattgtggacggtgggctacgacacttattacgcgatgaccgaccgcgatgacgacttgaagatcggagtgaaatccaccgccattctgtttggcgatgctgatcgtgtgatcatcctcacgctgcaggggctgtcactggtttgcctgttgctggccggtgcgcggttcgagctgggcgggtggttccaactggggttgctggccgcggcgggctgttttgcctgggagttctggtacacccgagacagggatcgcctgaaatgcttcaaggcgtttttgcacaaccattgggccgggttggcaatttttgtcgggattgtgctggattacgcgtttcggtagtgcaggactgacgccatcgggggcaagccccctcccacattttggtgtgtgaatacattcatatgtgggagggggcttgcccccgatggattcagcagcgccgtagacttaaggcttgatgatgtgccaggcgccacccttgccatctccggtcttgtcaccggtcttcttgtcgtccttgtaggtgtaaaccggcttgcctttgtaagcccattggctggtctggtcgtcacgggtgatgaccttccagttgcccgtcgcagtgtcggtggactcggccttcaacggcggccaattggtcgcgcactggtccttgcacactgacttgccgtcggcatccttatcgaaggtgtagagcgtcatgcccttgtgatccaccagcatcccgtctttcgtcatcgccggctccgccgcaaacgccaggcccggcagggtcaacaccgccgtaaccagcagggctttccaggaaacagtgctgtaagtcatcggaaccttccttttgtggttgtcaggattcggacccaaagggtagtccagagtgccgaaaattgcccaggcgactaaattactgtcacacgactgcaataattccgttatctaatgcggcgcaagacagttaaatgacaagaggattttaggcatggttggcaggagcattctgattgttgacgacgaagcgcccattcgcgagatgatcgccgttgcgttggaaatggccggctatgactgcctggaggcggagaactcccagcaggcccatgccattatcgtcgaccgcaagcccgacctgatcctcctcgactggatgctgcccggcacctcgggcatcgagttggcccgccgtctcaagcgtgacgagctgaccggtgatatcccgatcatcatgctcaccgccaagggcgaggaggacaacaagatccagggcctggaagtcggtgccgatgactacatcaccaagccgttttccccacgggaactggtcgcacgcctcaaagccgtgttgcgccgcgccggcccgaccgatggcgaggcgccaatcgaagtcggtggcctgctgctggacccgatcagccaccgcgtgaccatcgatggcaagcccgccgagatgggcccgaccgaataccgcctgctgcaattcttcatgacccatcaggagcgcgcctacacccgtggccaattgctggaccaggtgtggggcggcaacgtctatgtggaggaacgcaccgttgatgtgcatatccgtcgcctgcgcaaagccttgggcgatgcgtacgagaatctggtacaaaccgtgcgcggcaccggctatcggttttctaccaaaggctgatccagtccctttcctcccttaacagctgacaaggacgcatgtttaagtgaaccagaactggcacggcaccctgatccgccacatgcttctgttgatcactgcctgcctgctggtcgggctgatcagtggctattacggctggagcctggccgtcggcatcgcgttgtacctgggctggaccctcaaacaattgctgcgcctgcatgaatggctgcgccagcacaaacccgacgaagcaccgcccgatggctatggcctgtggggcgaagtgtttgacagcatctaccacctgcagcgccgcgaccaacgggtacgcgggcgcctgcaagcggtgatcgaccgggtgcaggaatccaccgccgcactcaaggacgcggtgatcatgctcgacagcgacggcaaccttgaatggtggaaccgcgcggccgagaccctgctgggcctcaagacgccccaggacagcggccagccggtgaccaacctggtacgccacccgcgcttcaaggaatacttcgagcaggacaactacgaagaggccctggaaatcccctcgcccaccaatgaccgcgtccgcatccagctgtacctgacgcgctatggcaacaatgagcacttgatgctggtgcgtgatgtgacccgcatccatcagcttgaacagatgcgcaaggacttcgtcgccaacgtctcccacgagcttcgcacaccgctgacggtgatctgcggctacctggagacgctgctggacaacgtcgacgagatcaacccgcgctggagccgcgccctgcagcagatgcagcagcaaggctcgcggatgcagaccctgctcaatgacttgctgcttttggccaagcttgaagccaccgattacccctcggataaccacccggtggcagtgcaaagcctgctgcacaccatcaagaatgacgcccaggcgctctccggtgaacgcggccagcagatcaccctggaagccgacccaacggtgctgctcaagggcagtgagggcgagttacgcagcgcgttctccaatttggtgttcaacgcggtgaagtacacccaggacaagggcaatattcgtattcgctggtgggccgacgaacagggcgcgcacctgagcgtgcaggactcgggcatcggcatcgacgccaagcacctgccgcgcctcaccgaacgcttctaccgcgttgactccagccgcaactccaacaccggcggcacggggctcggcctggccatcgttaagcatgtgttgttgcgccatcgggcacgcctggaaatcagcagcgtgctggggcatggcagtacgtttacctgccattttccaacaacgcaggtgacgcgttcgccagtgatcgacaatgatgaataactcaaatacagccccctcccacattggatttgtatgcttttggagaacagcttccaggccccacctggcagcaggcactaggcaagcgccccgtcagccgctacattggccgacttgcgcctgcctttcaggcccacctttcatcccctattgaacatacggaacctgcaaaaccccatcatggacccttcccctggtattaccctcgctacactcttcgccgatttcggcatgattctttttgcactggtcctggtactgctcaacggtttcttcgttgcggcggaatttgccatggtcaagctgcgcgccacccgggtcgaggccatcgcccacaagaacggctggcgcgggcagatcctgcgcaccgttcacagccagctcgacgcctacctgtcggcctgccagctgggtatcaccctggcttccctgggcctgggctgggtcggtgagccggcctttgcgcacatcctcgagcctatgctcggtgccatcggcgtgcagtcgccggaggtgatcaagggcgtgtcgttctttgccgccttcttcgtgatttcctacctgcacatcgtggtcggtgagctggcacccaagtcctgggcgattcgcaagcccgagctgctgtcgctatggacggcggtgccgctgtacctgttctactgggcgatgtacccggccatctacctgctcaacgccagcgccaacgccatcctgcgcatcgccggccaaggcgagcctggtccgcaccatgagcaccattacagccgcgaagaactcaagctgatcctgcactccagccgtggccaggacccgagcgaccaaggtatgcgcgtactggcttcggcggtggaaatgggcgagctggaagtggtcgactgggccaactcccgggaagacctggtaaccctggacttcaacgccccgctcaaggaaatcctcgcgctgttccgtcgtcacaaattcagccgttacccggtgtatgacgcggtacgcaatgagttcgtcggcctgttgcatatcaaggatttgctgctggaactggccgccctggaccacatccccgaatcgttcaacctggccgaactgacccgcccgctggagcgcgtctcgcggcatatgccgttgtcgcaactgctggagcagttccgcaaaggcggcgcgcacttcgccctggtggaggaagccgacggcaagatcatcggctacctgaccatggaagacgtgctggaagtgctggtgggcgatatccaggacgaacaccgcaaggccgagcggggcatcctcgcctaccagcctggcaaactgctggtgcgtggtgacacgccgttgttcaaggtggaacgcctgttgggcgtcgacctggaccacatcgaagccgaaaccctggccgggctgatctacgacaccctcaagcgcgtgccggaagaggaagaagtgctggaagttgaaggcctgcggatcatcatcaagaagatgaaagggccgaagatcgtgttggccaaggtgttgctgctggactgaccttcgattgcccaatgcaaaattgggcaatgtcccgagcgtcgtgacgcccttgaacgatcgtcaagcaggcagcgcgttaaaacagatatccacatttatctgggcggcagccgaaagattgactaacgcatccagagaacacttattgatcttaccgttgagcacatcgttcaggcggggttggctgatacccagtctttgcgccgcatccttctgggaaagctcccagctgcgaatggtgttgcacaattccaacagcaactttgagcgcaggcgcatattggcagcttgcacgggcgtgtcttccagagcatcccacacacagttgaaacgctcggtatgtaacttttgatttgtcatgggcttaacctaactcctgcaatctggcgcgagccagctcgatatcccgcccttcggttttctgtgtggtcttgcgcaacgcgtgcagcacgtagacagcttccggccgattgaccacatagaacactcgaaacgctcccgattcctcagtgatccggatctccttgacgccccttccgatcgttttcatcgatttgcaatcaaagggctgttcaccctgttgcaatagatccaactgaaaaccagctgcccttcgggcgtcgagaggaaaattcttgagatccttgagcgagcttcctagaaacaccacatccttgtgccttggcattagcttctcctttcctggaaagaaaaagcgtaatcgacgattcagccaaaagcagtggaggtttgtttcaaggcatagcagaggctcaagtccactggggtcttaccgagagactatatcgaaacagatataaatcaagcctactgacgggaatcagatactcggtcaatttccgctattaaggcgatcaagcacccggcacaaaatgcttctgcgccgtaccgcgcgcaatcaggcgcgagatgtaatccagcttctgcgcatcctggtcgataaaacggaaggtcagctgcagccaatcactatccggcctgggttcgaaggcgacaatggcgtgcaggtacccattgaggcgtgcgacttcggcgttgtcaccctgctcaaggtcgagcacggcgctttccaggacctgaggcaagacttcgccgcgccgcaccaccagcaacgcttccttgatgctcagggccttgattacgcattgctgggtgccactggacaggcgcaactgcccctgaccgcgaccgccagccggcgacgctgccgctggcgcttgtaccggtgggttgttgagcaggcctttgttgggtgtcgccgcgacgggagccgacttgaccgcttcgggcttgccgccggtcagggcgctcagggagtcgttgccgaaggccgagttcatcttggtcggcgcgctggcgatcagtgcatcgaggcggccgatcttgtgcagggcctgcttgaccttgttcagcaactgttcgttggtgaatggcttgctcacataaccggaaacgccggcctggatcgcctgcaccacgttttccttgtcgccacggctggtcaccatcacgaacggcatggccttcaggtgggcttgcccgcggcaccaggtcaagagctcaagaccggacatctccggcatttcccagtcacacagcaccagatcgaaggtctcgcgcatcaggatggattgcgcctttttgccgttcaccgcatcttcgatcttgatcccggggaagtaattgcgcaggcacttcttcaccaggtcgcgaatgaacgaggcgtcatccaccaccaacacactgactttgctcatcgaccctttatcctataaaaacttcggcacgcaaaacgcctgactgatggcattttgccaaaactcgccagtcacagcggggcttttttcactatcgcgctcaaattcagcccgcgcaaaaaattcggtgccacaaacgaaaacgcccggccaaaggccgggcgttaatttctcgggcaacttacttatcgtcagtttcacccggaacattagggattagatcagcggtgccttcaacttcggctttcatgcgcttgaggcccatgtgccgtacgtcggtgccgcgcaccagataaatcaccaattccgagatattgcgcgcatggtcgccgatacgctccagggaacgcagcacccagatgatgttcaacacccgcgagatcgagcgcggatcttccatcatgtaggtggccagttcgcgcaacgccgtcttgtattcgcggtcgatgatcttatcgtactgggccaccgacaacgccagctcggcgtcaaaacgggcgaaggcgtcgagggcatcacgcaccatgttgcgcacctggtcgccgatgtggcgcacttccacgtagccgcggggcgcttcaccttcttcgcacagctggatggcgcggcgggcgatcttggtggcttcgtcgccgatacgctccagatcgattacggacttggagatgctgatgatcaaacgcaggtcagaggccgccggctggcgacgggcgagaatgcgcaggcactcctcgtcgatgttgcgttccatctggttgatctggtcatcgatctcgcgcacctgctgggccaggcccgagtcggcctcgatcagcgcggtgaccgcatcgttgacttgcttctccaccagcccgcccatcgccaggaggtggctgcgcacttcctcgagctcggcgttgaactgcgcggagatgtgatgggtaaggccttctttgctaatcatgttggcgtccttggagcgtccggtaaggtgcggagaaccgcagcgtcagtgcaatgagaagaaccacggcatcctagccgtagcgaccggtgatgtagtcttcggtctgtttcttcgccggattggtgaacagggtatcggtatcgccgaattccaccagcttgcccatgtacatgaacgcggtgtagtcggaaacccgtgccgcctgttgcatgttgtgggtcacgataacgatggtgaacttggacttgagttcatagatcagctcttcgactttcagggtcgagatcgggtcgagggccgagcagggttcgtcgagcagcagcacttccggctccacggcgatggtgcgggcgatcaccaggcgttgctgctggccaccggacagaccgagggccgattcgtgcaggcggtccttgacctcatcccacagggccgcacccttgagggcccattcaaccgcttcgtcgaggatgcgcttcttgttgatgccctggatgcgcaggccgtagaccacgttttcgtagatggtcttggggaacgggttgggcttctggaacaccatgcccacgcggcggcgcagctcggccacgtcttcgcccttgcgatagatgttggtgccgtaaaggttgatcgcgccttccacacggcaaccgtcgaccaggtcgttcatacggttgaaggtgcgcagcagcgtggacttgccgcagccggacgggccgataaaggcggtcacgcgctgcttggggatgttcatgctgacgtcgaacagtgcctgcttgtcgccgtagtagaggctcaggcccggcacttcgatggccacggtttcctgagccaggctcaggctctgcttgtcgcgacccagggcagacatattgatgccgtgggaatggttttcgtgttgcatgggatgctccctgtgctaccaatttgttgtgtgggagggggcttgcccccgatagcagtgcatcaggaacatgtgtgctggctggcacaccgcaatcgggggcaagccccctcccacattgaatggtgttagctgtccagcgccttgtatttttcgcgcaggtggttacggatccacaccgccgacaggttgagcgtggcgatcaccagtaccagcagcaaggcggtggcgtacaccagcggccgtgcggcttcgacgttggggctctggaagccgacgtcataaatatggaagcccaggtgcatgatcttctggtccaggtgcaggtacgggtagttgccgtccaatggcagcgacggcgccagtttcaccacacccaccagcatcagcggcgccacttcaccggcggcgcgggccacggcgaggatcatgccggtcatcatcgccgggctggccatcggcagcacgatcttccacagcgtttccgccttggtcgcgcccaacgccagggagccttcgcgcacggtgcgaggaatgcgcgccaggccttcttcggtggccacgatcaccaccggcaccgccagcagcgccagggtcagcgaggcccatagcaggcccggggtaccgaaggtcggtgccggcagggcttcggcgaagaacagacggtcaaccgagccacccaatacatagacgaagaagcccaggccgaatacgccgtagacgatggccggtacgcccgccaggttgttcacggcgatacggatgatccgcgtcagggtgttctgcttggcgtactcacgcaggtacacggccgccagcacgccaaacggggtcacgatcatcgccatgatcagggtcatcatcacggtgccgaagatggccgggaaaatcccgccttcggtgttggcttcccgtgggtcatcactgaggaattcccagactttgctgaagtagaagccgatcttggtcagggtgcccatggcgttaggctggtaggcgtgcactaccttgccgatgccgatctccacttccttgccgttgccgtcgcgggcggtcagggcgtcgcggttgaactgggcgtgcaggtcagccaggcgcgcctcgatgtcctgatagcgggcattcagttcggcgcggtcggcatccatatcggcctgggcggcggcgttgagcttgccctccagttccagtttgcggccgtgcaggcggatgcgttcgaggccggcgttgatcgcgccgatatcggatttttccagggtcttgagctgggcggcgagctgattgacgcgcgcgacccgggcttgcagctccggccacgcggcttcgccttcagcaatgaccttgccgtcctgcttgacgttgaccagggtgccgtagaaattgccccattcgcgacgctcgatggccatcaggttggtcggcttggtctgatccttcaaccactcgccgacaatccaggtgaagtcgttgccgttaaggtcgcggttgccgaccttgatcagctcgcgggtcatgaactcagggccttcgtccggcaccggcaggccggcgcttttcaggcgctcacgcggcacttcttctttctgtaccacttcgccgatgacgatgtggttggcctggcccggcacgttgtagttggcctggatcaggtcggccggccagaaatggcccaagccacgcaccgcaatcacagccagcagaccaatggtcatgatgaccgcgatggacaccgcgccaccgctgatccagacgccgggagcgccgctcttgaaccatccattcagggagttctgtttcacagacttctacctttcttaaagcgacgagtatttcttgcgcagacgctgacgaatcagctccgcgagggtgttcataatgaaggtgaacaacagcagcaccagcgccgagaggaacaacacgcggtagtgactgccgccgacttccgactcgggcatttccaccgcgacgttggccgccagcgtgcgcaggccctcgaacaggttcatctccatcaccggggtgttaccggtggccatcagcacgatcatggtctcgcccacagcacggcccatgccgatcatcagtgccgagaagatgcccgggctggcggtgaggatgaccacgcgggtcatggtctgccagggcgtggcgcccagggccagggagcccagggtcaggccgcgtggcacactgaacacggcgtcttcggcgatggagtagatgttcgggatcaccgcaaagcccatggcgaggccgaccaccagggcgttacgctggtcgtaggtgatgcccaggtcgtgggagatccacatgcgcatgtcgccgccgaagaaccaggtttccaggtacgggctcatgtacagcgagagccaacccacaaacaggatcaccgggatcaggatcgcgctttcccagccatccggcacccgtaggcgaatggactcgggcaagcggctaaagacaaagccggcgaccaggatgccaattggcaatagcatcaacaggctgaaaatccccggcagatgcccttccacatacggcgccaggaacaggccggcgaagaagccgaggatcacggtcggcatggcttccatcagctcgatcaccggcttgaccttgcggcgcaggctcggagccatgaagtaagcggtgtagatcgcggcggcaaccgccagcggcgccgccagcagcatggcatagaacgcggccttcaaggtcccgaaggtcagcggggccaggctcatcttgggttcgaagtcggtgttggcggcggtggactgccagacgtatttaggttcgtcgtagttttcgtaccagaccttgctccacaacgcgctccacgagacttccgggtgcggattgtcgagcagcaagggttgcagcttgccgccggcctcgacgatcacacggttggctcgaggcgacatgccgaacagaccctggccctcgaccaccgggtcgaccaacagggtgcgatgggcggtgctgtggaacacgccgaactggccagaagcgtcgagggcggtgaagcctttgcggcgctcttcagcgctgatttcgacgatgggcgcagtgcccatctggaaggtacggatctgcttgaggcgttgttcgccatccgggtcgcgagccatgaaccactgggccaggccacctttggaatcccccatgatcagcgagatgccgcccaccagctgggtgctggcggtgatttcggcatcgccgttttccaataacttgtagcgaccgttgaggctcttgtcgcgcaggctgaacacgtcggccagggcgcgaccgttgaccacatacaaccactgctggcgcgggtcgatgaagatcgccttcacaggttcagtcatctgtggcagctcgacacgcttctgctcactggtgacttcaccggtcatcatgttttcttcgcggctcagggtcagcacgttcaggtgcgaacccgctgaaccagcgaccaccagcgaggtgtcggtggcgttgagggcaacgtgttccagtgggcgaccggcgtcatccagcacgatcggcgtttcgccgtaggggtattcgatcgccgggctgatggttttcttgccgtccgggtacgacactttataggtgtggcgaaacaccagggactggccattggataagccgaggatcaccaacgggctgcccggctggtcttcaccaatggaggccacgctggtaccggccggaagcggcaggtcgacacgcttgagttcagcaccggtgtccacttcaaagaacaatgcctggcccttgtcggaaacccgcatggcaacttggttctgttcttcgagggagatcatcaacggtttaccggcgtcctgcatccaggcgggcgtcagcgcgtcttccttggtcagcgaggcgccctggaacagcggcgcgacgacataggcgaggaagaagaagatcagggtaatggccgccagcacggcgaggccgccgatcagcacataccagcgggtaaagcgatccttgagcgcgcgcatgcggcgcttgcgttgcagctcaggcgtattgaaatcaatgcgcttggggggagaagttgtcgtcatggtggaattggccagatcattcatgcgcacaccctagcgatcctgtatgacagaaagatgacagtgcagtgacgcaacaaatccgccgcgaagcaagctggcagcggactagaaaattcggatgcggagccggtaggccggccccgcagaggcaatcagttgccttctttcaggcccaggtcagccagtgccttggcggccactttggctggcagtgggatgtagccgtctttcaccacgacttcctggccctgcttggacagcaccagtttcacgaactcggcttccagcggagccagaggcttgttcggggctttgttgacgtatacgtagaggaagcgcgacagcgggtatttgccgttcagggcgttttcttcgctgtcttcgatgaactcggtggtgcctttcttggccagaggcacggtcttcacgctggcggtcttgtaaccgatgcccgagtaaccgatgccgttcagcgaggagctgatcgactgcacgaccgaagccgagccaggttgttcgttcacgttaggcttgtagtcgcctttgcacagggcttcttccttgaagtagccgtaagtgccggataccgagttacggccgaacaactgcactggcttgttggccaggtcgccggtcacacccaggtcgccccaggttttcacgtcggctttggcaccgcacaggcgagtcgaagagaagatcgcgtcgacttgctccatggtcagatgctggatcgggttgtccttgtgcacgaacaccgccagggcgtccacggcaaccgggatagcagttggcttgtagccgtacttctgctcgaaggccgccagttccgtatccttcatcttgcgactcatcgggcccaggttggaggtgccttcggtcagcgcaggtggcgcggtggcggagccggcagcttgaatctggatgttgacgttcgggtattccttcttgtaaccctcggcccacagggtcatcaggttggccagggtatcggaaccgacgctggacaggttgcccgacacaccagtggtcttgacgtaagccggaattgccggatcaacaccagcggccaccgcgttggcggtcgcaacgccagcagcgacaaaagtcattgccgccatcaaacgtttcagtttcatgccttgctcctagcagatagggataattggatcggggccaagtatcgggaggccgtgtgaacactctatgtcttaaatatgacaattagatgaaaggccactatcgagaagcaaaggctgatgaggagcgagacgttgaatgaacgcctcgccacattggatcaaattggtttcagcggccgcgtttccacagatacccacccaccaacatccccatcacacacaggacggccacatagtaagccgggcccatcgggctctccttcatcaacagcgataccgccaatggcgttagcccaccgaacacggcataggcgacgttataggagaacgacaggccactgaaacgcaccactggcgggaaggccttgaccatcacgtagggcaccacaccgatggtacccacgaacaaaccggtcaatgcgtacaacgggaacagccagtccgggtgagccatcaggctgtggtagagcgtccaggaggttgccaacagcagcgcgcaaccggtgaccaatacgcggccggcgccaaaacggtcggccagggcgcccgaggcgatgcaacccaggctcaacgttacgatggccaggctgttggcttgcagcgcaaccgtagggctgaagtgatagacggtttgcagcacggtcggcgtcatgaggatgactactacgacgccggccgacaacagccaggtcagcagcatcgacaacacgatggcaccacgatggtcgcgcagcaccgcgcgcaacggcagctcggcagccagggtcttgcgttgctgcatctcggcgaagatcggtgtttcatgcagccagcggcgcagatacaccgacagcaggccgaatacaccgccgagcaggaacgggatccgccaggcgtaatcggagacctgctccggggtataggccgtattgatggcagtggccaccagcgagcccagcaagataccggcggtgaggccgctggtcagggtgccgcaggcgtagccgatgtggcgcggcggcacgtgctctgagacgaacacccaggcgccgggtacctcgccgccaatcgccgcgccctggatgacgcgcatcagcagcagcaggagcggcgcccacaggccgatctgcgcgtaagtcggcagcaggcccatgatcagggtcggcacggccatcatgaaaatgctcaaggtgaacatcttcttgcgtcccagcaggtcaccgaagtgcgccatgatgatgccgcccagggggcgcgccaggtaaccggcggcgaagatgccgaaggtctgcatcatgcgcagccattcgggcatgtcgacggggaagaacagtttcccgaccacggtggcgaaaaacacgaagatgatgaagtcgtagaactccagcgccccgcccaaggcagacagcgacagggttttgtagtcgttgcgggtcagcgggcgcgagggttgcgcactgcttgcgggcacggaggacatggcaaggtttctcttatagtagtcagaacggcaagcccgggacttgcggcaggcttggcaagatagcaaatcgctccaaaaagcacagcgtcgagcttttaacaggcaatcttaccgacgcagggcaacactcaactcggccagaagcacagttgcaggaaaaagccccgatacagcgcctatttaccgaccaaatgagccttgggaggtcgtcgcggcgccagcgtctcgatatactcggcccttgcaagcgcagaaccccggtcttgagggctgctgtgccaaacgccgttggggtcgcccagccggtttggcagagtttccctttagcacgccttacgagaaacgcgtcgaacgcgtatgtttgtgctgaaacgtttttccaatagtcggctatccactttgcaccacttataagaagcgtcacgggtcagaggcacccccggcatgatcgaactcgaacaagaagatcctatcccgcaaggcgatctcgccttgcaaatcactgcactccctcgtgaaaccaacggttttggcgatatcttcggcggctggctggtcgcgcagatggacctcgccggcacggcaatggccagcaaggttgccggtgggcgagtggcgactgtagctattgaccgcatggccttcctggtaccggtggcggtgggcgcgcagctttccttctatacccaggccctggaaattggccgcagctcgatccagatgatggtcgaggtgtggagcgatgacccgctgtccagcgaatggcgcaaggtgaccgaggcggtatttgtgttcgtcgccatcgatggcagcggtcgcacgcggtcggtaccttcacgggcgcgttaaacatcgccgggttttgacggtcaattgccccattgcctgccattgagagagctttgttatgcctacgccccacgttgaaacggtgaaagtcgacgagctggactgctggcgcattcgccacaacggcgccgaactgatggtggcccggcagggcgcgcacatcttcagttaccagcgccagggcgagcagccgctgatctggcccaaccccaaggcggtattcaagcagggcaaaggcattcgtaccggcgtgccggtgtgctggccgtggtttggtgtattcgaccgtaacccgcaaagcgttaaggggatgcgccagagcgagcaacctgctggctcacatggctttgcgcgcaccgccctctgggaattggccgagactgcaatcgaaggtgaagccctgcgtatcgaactggcgctgccggttcctccgaacggctttcccggctggcctcaccaggttgacttgacgctgagcctgctgctggacgaccaattgcatattcgcctcaccagccacaaccgtggcaccgacaccgtgaccctcagccaggcgctgcacacctactttgctgtgagcgatgtgcgcaacgtgcaggtcgagggcctggatggcttggcatacatcgataccgccgacggctggaccgagaagcgacaagccggcatgctgcacttcaccgccgagacggatcgcatctacctggacacgccggcgcagttgagcattgtcgataaggactggcagcgccgcgtcaaactcaccagccagggctcgaactcgacggtagtctggaacccctggaccgaacgggccaaggcgctcgatgacatggctgacgatggctggcagggcatgttgtgcatcgagacggcgaatgtgctggatgatgtggtgagcctggcggccggtgaaagccacaccttgggcgtgagcatcaccagtatcaccttgtaaacccgatcaaatgtgggagggggcttgctccctcccacattggttatgtgtagggttttagagatcggattcctttaccaccctgaccttccccgcctccagcgcatatgccgcgtccgccagatcgttattgaccttctccaccttcaacgtgcccgtcacccacaacggcgtgtagatatcgtcaagcttcaatcccttgggataccgcaccagcaccagttggttaggcggcggtggtggcacgtggatgcaggcgccagggtaaggcaccaggaagaacagcgtactacggcctttggcatcggtttccaacggtaccgggtagccgccaatgcggatgcttttgccgttcatggccggcacggtcttggtggaatacatcaccgccggcaagcctttgctctgtttcaagccacctttttcggtaaaggtgccttgggcttcgggggagttgtggtcgatctcgggcatggcttcgagggctttctggtccgaaagcggcattagctcaagccagtcagtttccggcagttcgccagcatgggtcaggccaggggccagcagcagaagggtcaatagaagacggcgcatggagaggctcggcaaatacaagtgccgagcattctagccctctgcgcctgcgcagcgcagaggactttgtcggctgattacttctttttgatcaggccgtagatcaccagcaacacaatggcacccaccagtgcgccgatgaagcccgcaccctggcctgcctggtagatccccagtgcctggccaccgtaggtcgcggccagggagccggcgatacccagcaggatggtcatgatccagcccatgctgtcgtcgccaggcttgaggaaacgcgccagcaggccaacgatcaagccgataaagatggttccaatgatacccatggcatttccctctgattgaatatgagtcatgacaaagcctagtcaggcttcgtcatcctgcaatcagagagacgacggccaccaatggttcccaccgaacctcgggttattgctcggcgatcagcgcctcgaccttgaggatctgtgcctgcagggtcgcacggtccttgcaacgcaggttggcatggccgaccttgcgcccggccttgaacgccttgccgtagtggtgcaggtggcagtcatcgatggcgatcacccgctcaaccggcggtaccacgccaatgaagttgagcatggcgctctcgccgaccttggccgtggagcccaacggcaagcccgctaccgcgcgcaggtggttttcgaactggctgcactcggcgccttcggtggtccaatgcccggagttgtgcacgcggggcgcgatctcgttggccttgaggccgccgtcgacctcaaagaactcgaacgccatcacgccgacgtaatccagctgcttgagcacacggctggagtagtcctcggcgagggcctgcagcgggtgattggtgctggccacggacagtttgagaatgccgttgacgtgggtgttatgcaccaaggggtagaaacggatctcgccatcgcgggcccgcacggcaatcagcgagacttcgccggtgaacggcacgaagccttccagcaggcaaggaacgctgcccagttcggcgaaagtaccgaccacgtcggcttcgctgcgcaggactttctggcccttgccgtcgtaacccaaagtgcgggttttcaacacggccggcaggccgatgttggcgacagcggcgtccaggtctgcctgggactggatgtcggcgaaggccggggtagggatgcccaggtccttgaacatgctcttctcgaaccagcggtcccgggcgatgcgcaaggcttcggcgctcgggtaaaccggcacgaactgcgacaggaaggccacggtttcggccgggacgctttcgaactcgaaggtcaccaggtcgacttcgtcggccagttggcgcaggtgatccgggtcgctgtagtcagcgcgcaggtgttcacccagggcggcggcgcaggcgtctggcgccgggtccaggaaagcgaagttcatccccagcggagtgcccgccagggccagcatgcggcccagttggccgccaccgattacaccgattttcatcgtcaacaacctcaggcgatacgtgggtctggattgtccagcacgctgtctgtctgctcggcacggaattttttcagcaccgcgtggaactgcgggtgcttggcgcccaggatgctggcggacagcaatgcggcgttgatcgcgccggccttgccgatcgccagggttgccaccgggataccggctggcatctgcacgatggacaacagcgaatccacgcccgagagcatcgacgactgcaccggcacgccaagcaccggcaggtgggtcttggctgcacacatgcctggcaggtgcgccgcgccgccggcaccggcgatgatcacctcgatgccacgggattctgcttcatcggcatactggaacagcaaatccggggtgcggtgggcggagaccaccttcacttcatacggaatgccgagtttttccagcatatcggcggtgtggctaagggtggaccaatcggacttggagcccatgatcacgccaaccaatgcactcatcgtcgtgcctcttctctctgggcgcccgcaggcgcgtcaaaaaacaacaagccacgcaggaaatccggcgtggcttggtgtacgaattaaggccggttggaccggccgaaggccgcgcagtataccgtaataatccagataaacagccccttggatgaccatctgtctagccgcccaaacccgcggttttattgactcttgagtcagtcccctacaccgcaagccccctcccacattggatctgtttcaggcttaggtattttgcgccgcaccaccttccaatttgcgccacaacaagcgcacattcgccttgcgcaccagcgcgcagcgatacaggcgaatctccaacggcacatgccattgcggcccgccacacaccaccagttcgcctcgggccagttcggcacgtacgcttaactgcggcacccaggcgatacccaagccttcaagagccatgctcttgaggctgtcagccatggcggtttcgtaaatggtggtgaaccgcagggcccgctggcgcagcagcaaattcaccgagcggccgaggaacgccccggcactgtaggccagcaacggcacactgccctcgctttccaggtcgaacagcggcttgccatcggcatcggcggcgcacaccgggagcatttcggtgttgcccaggtgcagcgatgggaatatctcggcgtccatctgcatggcggcatccgggtcgtaaaacgccagcatcaggtcgcaaccgccttcgcgcagggcgtgcacagcgtcgccgacgttagtggcaaccaatcgcgtggcgatgttcaggccttcgttgcgcagctgtgcgatccaacgtgggaagaaccccagtgccagcgagtgcgcggccgccacctgcatgacctcgccctgcccgccttccaggtgatgcaaatggcgcagcacttcaccgagttgttcgaccaccgtgcgcgcggtcaccaggaacagttgccccgccgccgtcaattccaccggcgtgcgcgaacggttgaccagggtcaggcccaacgcggcctcaaggctgcgaatacgacggctgaatgccggctgggtaacaaagcgccgttccgcggcctgggaaaaactgcgggtggccgccagggcgctgaagtcttccagccatttgctctcaaggttcatcacttcctcccaagggtatgcaccattttggcacacacgcccgccatcatagctgggtcacatccacattatgccgtttgtgcataggccagtgcttaacagcattggcccaaaaagttctacaagcctagcattcgcagcgttccggccagttccgggtccatatcgagatgatttccgtcatgtcctccgctgcatcattccgcacagaaaaagacctgcttggcgtacttgaagtaccggctcaagcgtattacggcatccagaccctgcgagcggtgaataacttccgcctctcgggcgttccgatttcgcattacccgaaattggtggtcggcctggcaatggtcaagcaagccgcagctgacgccaaccgtgagttgggccagctcagcgatgccaagcacgctgccatcagcgaagcttgtgcccgtctgatccgcggcgatttccacgaagaattcgtggtggacatgattcaaggcggcgccggcacttcaaccaacatgaatgccaacgaagtcatcgccaacatcgcgttggaggccatgggccacaacaagggcgagtaccagtacctgcatcccaacaacgacgtgaacatggcgcagtcgaccaacgacgcctaccccactgcgatccgcctgggtctgctgttgggccacgacgcactcctggccagcctcgacagcctgatccaggcgttcgcggccaaaggtgccgagttcagccacgtactgaaaatgggccgcacccaattgcaagacgctgtgccgatgacgctcggccaggaattccgcgccttcgccaccaccctgggtgaagacctggcccgcctgaaaaccctggcgccggagctgctcaccgaagtcaacctgggcggcaccgccatcggtactggcatcaacgctgacccgcgttaccaggccctggccgtacaacgcctggcgaccatcagcggccagccgctggtgccggcagccgacctgatcgaagccacctccgacatgggcgccttcgtgctgttctccggcatgctcaagcgtaccgcggtgaagctgtcgaagatctgcaacgacctgcgcctgctgtccagcggcccgcgtaccggcatcaacgagatcaacctgccggcgcgccagccaggcagctcgatcatgcccggcaaggtcaacccggtgatcccggaggcggtcaaccaagtggcgttccaagtcatcggcaacgacctggccctgaccatggcagccgaaggcggccaattgcagctgaacgtgatggagccgctgatcgccttcaagatcttcgactcgatccgcctgctgcaacgcgccatggacatgctgcgcgagcactgcatcgtcggcatcaccgccaacgaagcccgctgccgcgaactggtggagcactccatcggcctggtcaccgcgctgaacccctacatcggctatgaaaacgccacccgcattgcgcgtatcgcccttgaaagcggccgcggcgtgctggaactggtgcgtgaagaaggcttgctcgacgacgccatgctcgacgacatcctgcgccctgaaaacatgatcgctccacgcctggtcccgttgaaggcctaagcgtttgttgcaccgctcaccaggttgagggactagacacctctcaccttttgagggcctgaaggctcgttcttcaggcccttttttttgcctcaaggttgtgaaatgaagcccataaaaactccaatatcgccctgcaaacccaccttgcttgccaccgcgtggctgaaacctttaatcagcccgtgcagacggatcagtctcgcctaggtatagtgccgcccctctcgcgtctgcggccatcggtaacgaggcccgggtaccacgcgacaccgcatgaataacaacacccgcaaaaggattggggtcgaacggtcgtgcactgcctggtgccatacgacgtgtcgaaccgtcctgcgtttgccatcagaaaaatcagcgaggaacactccatgctcgaagtcatcaacgacttcctctcagggaaagtactgatcgtgctcatagtcgggctcggcggttatttcacgatccgctcgcgtttcgttcaactgcgtcactttttccatatgttctcggtgtttaaagacagcctgaagagcagcgccggccaactcagctcgttccaggcgctgatgctcagcctggcgggccgcgtaggtgccggtaacatcgccggcgtcggtattgccgtgaccctgggtggcccgggcgccgtgttctggatgtgggtcactgcactggtgggcatgtcttcgagctttatcgagtgctcccttggccagctgtacaagcgcaccgacgccgaaggcacctaccgtggcggcccggcgtattacatccagcatggcctgcacaaacgctggctgggcatggtcatggcgttcctgctgctggtgaccttcggttttgccttcaacggcctgcaagcgcacgctgtgacccattcgctgaacaatgccttcggcctcgacaccacttacactggcctcgcgctggcggtgttgctgggcctggtgttcattggcgggatcaagcgtattgcttcgattgccgacctgctggtgccggtcaagaccctggtctacattgccgtgaccctgtacgtgatcgtgctgcaattcgaccacgtgcccgccatgctcgcgaccatcgtcaagagcgcgttcggccttgaccaagccttcggtggcctggtcggcagcgcaatcatcatgggtgtgaagcgtggcgtgttcgccaacgaagccggcttgggcagtgcgcctaacgtagcggcggtcgcttcggtagaacacccgattgcccaaggtgtggtgcaagcgttcagcgtgttcctcgacacgttcatcatctgcacctgcaccgcgttgctgatcctgctctccggtttctacaccccgggctttgaaggcgacggcattgccctgacccagaactccctggcggcggtggtcggtgactggggccggatgtttatctcggtggccctggcgttgttcgtgttcacctcgatcatgtacaactactatctgggcgagagcaacctgcgcttcctggtcggcaacaaccgcaaggtgttgatgggttatcgcgcactggtgctggtgctgattttctggggttcgatcgagaacctgagcaccgtgttcgccttcgctgacatcaccatgaccatgctggccttcgtcaacctgttcgccctggcgttcctgttcaagatcgccatgcgcatcctgaacgactacgacaaccagcgtgcggcaggcatcaagaccccggtgttcgactccagccagttccctgacctggacctggaccgcaaggcctggccggccagcccggtaaaaccggagcctgccgtgcaagccactgctgaatcgatcgcccaagcgcaacgctaagcgtagatagatgacacgccgcccggccttgggcatgctctgggcccggcggcgtttttcgttcaggagattcttcaatgcaaccagctaataacgtcatggtgctctacaccggtggcaccatcggcatgcaggccagcgccaacggcctggccccagcatcgggttttgaagcgcgcatgcgcgaccagcttgccaatcaatcgatacccgcctggcgctttcgcgaaatgtcaccgctgatcgacagcgccaacatgaccccggcctactggcagcacctgcgcagcgccgtggtcgaggcggtggacgagggctgcgatgccgtactgatcctgcatggcaccgacaccctggcctacagtgcggcagccatgagtttccaactactgggcctgcccgcaccggtgctgtttaccggttcaatgttgcccgccggcgtgccggacagcgatgcctgggaaaacgtcagcggtgccttggccgcgctgggcgaaggcttggcatccggggtgcagctgtatttccacggccaactgctaccgccgacccgttgcgccaaggtgcgcagcttcggccgccatccgtttgcagccttgcagcgcctggacaaccagccccgcgccgaatcgctgccggccgcgctggattatcgccagcccaagaccatcgcggatatcggcgtagtaccgttggtgccgggcatgcgtgccgcgctggtggacagcctggtcgacagcggcgtacaggcgctgatcctggagtgctatggcagcggcaccgggcccagcgacaaccccgagttcctcgccagcctcaagcgcgcacaggtccgggatgtagtggtggtcgccattacccaatgccatgaaggtggcgtggaactggatgtctacgaagccggtagccgcttgcgcgatgccggtgtgctgtcgggtgcgggcatgacccgtgaagcggcattcggcaagctccacgccctactcggagcgggcctggcctgcgacgagatccgccgcctggtagaactggacctgggcaccgaggcccaccctagataactaccccctgccctgtcttgcgcttttctagcatggaaaccccgggcctgaacctcgggttgttcccatccatcggcaagacagggatgtaccatgaccacttcaagcgccaccgcgcaggctgccaaacccgaagacctacctcttaaattgattacccagctgtgcgtcggcccctcgatcaccgaggtggccggccaactgctgcgcgaatccctggcagaaaaataccccgacctgcacatcaatccggacaccaccctgctgggcacgccggtgtgggagctggtcgacgacaagattatctccagccccccgcagtatcgaaccctcagcaccttgctggccaggcaggccgtgttgaaggagcccaccttgtgcatcgaaggcgagcattttcttactccgctgccactcaccgaaccggtcgtgcatttgccggtgcgcatcgtcgaaatcgctaacgtcatcaacgtcctggcacctgtggtattcgaggcgttcaaggaacagctggtggattactggaacaccagcggcggcaatggcccgcattggcacgaactgtccaacacgttgcgcaatacctggaatgtgcagcaggtggacggctggaccgacgacgactgtgcgctggcgcgccgcttgtaccacgcgcccgacccggcgaaccgcagctccggcagcaagctccaggcctgcctggtcgacatcgacctggtgagcgacggcaaggccagccacaccccgcaagtatttattgccgtactgctggggcaatccgagggccaagacgtaatcctctgccagtccttcgacggctacagaaaattcaccacccaggaccaattgggcgagtacttgacgacgctggtgtatcagccaattaactacgagcgtttgcagtggcggctgtatgaacccgtcggcaactttttcgagcagttggccttctccctgatcaccctgcaaatcgacgccttcaccaccgtctccatcgacacatcggccacatcgagaacagcccccctgagtgtactgacgggaaccaccgggcaggtcaccgcaaagggcccggaccttgactggtatcgacacgtgttgccggactggctcgcccaggcctctgcctcagaccgggcgttttattcgcggcacctcaaggacctggctgcgctgcacagccagaacgagggcaagacgtaccaagacgatatcccccctctcacgcaatacgcccgcgacacgctcagggcgttgatcatcaaggagcatcctgaagccgcgcacctggccctggacaccctgactatccaggtgcagagccaggtggtttggggcgcgttcacggtaccggggcaggtcgagaccagcaccttcagcctggccgaactggccctgcaaaacctgatcgcgctgccgttgggtaaccagagcctgcgcatgcagacgcgcaaggccttgccccagtggctgactatcggctacgtgaaatccctcatcaccacggccgatatcggccgtgcctacccggcgctgatacgcagcaaattgatcgacgacaccaccgagtcgacgcggcgaaaagccttgtacacccagcacctgcgcatccagctgccgctactggccttgcagtacaagatacgccaggagggcgggatcgatgagcgcggctatcgctacgtggcagcagtgatgcaggctgaaagtgccgaccgctatgtcgatgggcaagcgattgtcatccggcacctggccttcgtgcccaagcgcaggcagagcaatggccaggatgtggtaagcaacatgtacgtcatcggcccgcaacatgccgaagccggtccctgcctgttataccgcccgctattcgaaccggtactgctgcaattcccgtcaccggcgaacctgttgtatgccatcgcacaatcgccgacgctgcgtgactcggtggtcgcctggctgccggacacggtgcgcactgactacaccaactacgtctttcctggtgacttgccgtcaccctgggcggtggccgatttcctggtggaaccggacaaactctggacctacagcggccccatgagcctgggccagcaggccctcaacggtgacctgtttaccaccctgttcgatgccaatgctaaggcgctggtgacgctggcggaccgccaatcggtgtccaacgctgaaaaccgctgggccacgttcaagcaggccggttggctgatcttcaatgccgcattgcccttcatgggccgtattgcgaataccggcgcctggatctggcagatcctcgaccaggtgcaaactttcgtcgaggcccacaaacagggcgagcaacaggcgcaatggtcagcgctcaccgatgtgctgctcaacctgggcatggccatgaccctgcatgtgtctacccacgcccgtcctggcaccagcgctgccaaggtcgagccagagattcccggcgtcagcgctgaaactgcaatcagcgttgaacagctacccacccgcacccaggaacagccgcctgccgatcatgacctgccgctcaacacccagggcgcactcactcgccccaccgccagcagcctggcgacggtactggatagtttcaaagtcgagaaacccaagggcctggcgaacgccatcagcgaagaaggggcgtaccaacatctttatctgcttgaacaacattactacgcaccggtgggcgaacgctggttcgaggtgaagctgttcggtgacgaaaccgtggtcattgtcgactcgaaagcacctgaccgtacgggaccgccgctgattcacaacgcccagggcaagtggtttatcgacccccggctacgcctggcgggcggcggtcgcaaaagcaagcagaaaaaggcagcagacgaagcaagggcaaagtccgaaaagctgagcgcgagcctgaacgcctttgaaaaaaccaagaaagcggcgcagcgcgacctgcaacaggcattccaggccatgcgcgacgcccctggcagttcgacccaggccaaacgccaggcctacctgaacaaactcgacagccacagcctggaatacgaagaggtacgccaacaactgatgaccttgaacgtcttcacccaggtgcctgatttccagcaaaaagccctcggatatgtgaaggcgcaactggatctcaacgaggctggcatccgagaactgcaaacccggttcacgccgcaactcaagacggtactggaccaaatcgaaaccccttcgacgtcgacccaggcaagccgcatcaccgacgcgcagttgatgacagacctgtgcgacgacatggtcaagcgcctggactacacccacacgcgcttcaccgaactgcgcgaacttgcccgcgcaggcacgcagctgattcaaaccgccaaggccaaactgccgctctacaccagcgaccatctacgggccctgcaggtgacgctggcgcgaaacctgtgcctggaaccgcaatcgatcagcactgcacctgacgcctggagcctgatcggcaagattgtcgacaaggccgatatcgccgtagagaccctccaagatgccctgaaagagcgcagcaaagcgcgcctggacgaacgcattgaaaccttggccagcctggtggagcagttccagctgattgacgaacaactgcaggacttctgcgaggatttccccgaaaagaccctcaacaagcccgttgaaaacctgcgaaacatgctgagcacttttgccaatcgggccaaggccgcactggcgcccttgcaccttgagcagacggacgccagaatccgacctacgccgccgcccacaccgccaaggccggcgaaaaaattcatccatacccgcttcaacggcatgctgattggcgagccccgcctgacccctgtggggctcgagaccgaccttgtcgacatcaagtctccgttgacccataaactcatcgcgaccttccatgagaaagccccgggtgtctgggtcgagcacctttcgcccagtacaacccagccggcacctgccgcccccacggtcgaagccagcgtcgcccatggccagtcgctgatcgaccaactgccaacattccagtcccgcgccacggcgcaaatcggcaagccgtcccgcaccccgatcggcatcgaacgtatgtttcatcaacatgcgcagctgctggagcaggccgcagaggctatcgaagaagcgctgacccaggtcaatgccaccgaaagcgagcagcccgccgccgccgcattgcgcaagaaactcaatgatgctgtgcaagccctttacgggcaggccaacgagcaggtgcagacgctgatcaagcaacagccacccacgctcacacgggttgaatggcttatcagccgccatctgatcagcgtcaagaagcccgttaaacgacgccgactcaaaagcgctaccaaggattatctggacgaatacaccctgaccgatgagtccacgcaaaccgtgctttggtatgcccacttccattactcgacctccgatgccccgctcgaccggtttctgcgcgctcgcttgaagaccccgcaagagcaagcgcaaggccaggcggccgatgacgttcaagggctcaacgcacagcaacaggtcgatttctatcgcagcaccatcaacctggcccaggccaagcgcgttttcttcccacccgagcgcaattgaccgaccacggcacataacttgctccagcctgtcaaacccaggctggaacccaccatgctgcattcacacctgactaccctcaatgcggtctcgcgggtgctggacaccttcaaggccgaaggcgttagctatgacacgctgctggccggcagcggtattcgcgaagccgacctggcacgcgccgacactcatatcaccacccagcaagaaatgcgcgtgtgtgccaatgccgttgccttgcgccaggacgtcggcctggaattggggcagcgcatgcacgtgtcgtcctacggcatgctcggttacgccttgctcaccagtgccaccttcggtgacgccttgcaactggccctacgctacccggcgctattgggaacactttttgagctgagcctggagccggacggccaacgcatctggttgaccgctggcggttaccgcgaggatccggccctgacccaattcaacgtggagttctgcctggtttcgctgaaggtcatctgcgccgacctactcggccagcccctgccgttgctcggtgcccgctttgcctaccccagccccgcctaccaggcacgctatgccgagcatttcgcctgctcattggagttttcagcccaggccaacgcctttgcgttcgaccggcgctggctcgaacaacccttaccgctggccgatgtcattacccatcgcgccatcgccgaacgttgccgtaaacagaacaccgagttcaccgggcgccaggcctggctgggccgggttcgccatctgctcggcgcacagttggacgcagcgcctggagttgatgggttggcggcgcagttgaactgttcttcgcgcaccttgcgccggcatctgcatgagctgggttgcagctatcaggagctgttggacgaactgcgcttcgagcgcgccaaacagctgttgggcgccgatgagctgccgatctaccgaattgccgagcaactgggtttcagtgagaccgcgagtttccggcatgccttcgtgcgctggagcggcgtggcgcctagtcagttcaggccatgatcagaggggcgaataacggacacgaacattggccctgtcgatccccttttggccgctcctgccgttttccgacgccccgcgcgccgcaacactacaacgcaccccacccagcctgcggagcccaacactatgctgacgatctactcggacgaccaccatctgcaccatggccgctgtgaattgatggacgggcaactgatgccttgcttcgaaatgccatcgcgggccgaccacgtactgcagcgggtcaaggaccgcgaactgggcccggtgcaggcgccgcaggacttcggcctggcgccgctgcaacgcattcacagccccgagtacctggatttcttcaaggacgcctggcagcgctggaccgaattcggccaggacggcgacctgctgccctacacctggcccgcgcgcaccttgcgccgggtgctgcccaccagcctgcacggccagctgggttactacagtttcgacggcggcgcgccgattaccgccggtacctggcaagccgcgtacagcgccgcccaggtcgcgttgacggcgcaagaggcgatccagcaaggcgcgcgttcggcctttgccctgtgtcggccaccaggtcatcacgctgccagcgacttgatgggtggctattgctacctcaacaatgcggcgattgccgctcaggcgttcctcgaccagggccatacgaaggtcgcgatcctcgatgtggattaccaccacggcaacggcacccaatcgattttctacacccgcagcgacgtgctgttcacctcgatccatgggcacccggaggcggagtttcccttcttcctcggctatgccgacgagttgggggaaggcgccggggccggcttcaacttcaactatccgctgccggccggttcaggctgggagcgctggagccaggcgctggagcaagcctgccaggagatcgaacgctacggcgccgatgtgatcgtggtgtccctgggcgtggacacgttcaagcacgatcccatttcacaattcaagctcgacagcccggactacctagccatgggcgcacgcatcgcgcgcctgggcaaacccacgctgttcgtcatggaaggcggttacgccgtagaagaaatcggcatcaatgccgtcaatgtgctcgaaggttttgaggagtgtgtgcaatgaacctgttcaaggtattcgccctttgtatggccgtactcggcggcgcggcccacgccgaagaaaaaaccctgaaggtctacaactggttcgactacatcacccctaaggcacttgaagacttcaaggcgcagaacccacagatcaagctggtgtacgacatcttcgacaccaacgaggcgctggaagccaagctgctcaccggcaactccggatatgacgtggtagtgccctccaatgtgttcctggccaagcagatcgaagccggcgtgttccagcccctggaccgcaaccaactgcccaactggaagcacctggaccccaagctgatgaagctgatcgaggccaacgaccctgggaacaagtttgccgtgccctacatgtacggcaccatccttatcggcttcaacccggccaaggtcaaggcagcgctgggtgacggcgcgccagtggacagctgggacctgatcttcaacgaagccaacctcagcaagctcaagcagtgcggcgtggccttgctggactcgccctcggagatcctgcccctggccctgcagcacctgggcctggatcccaacagcaacaaccccaaggactacgccaaggccgaagcgctgatgatgaaaattcgcccctacatcacctatttccactcatccaaatacatggccgatatcgccaatggtgacatctgcgtggccgtcggttattccggcagtttttcccaggccgccaaccgcgccaaagaggcgaaaaacggcgtgaccatggccatgcgcctgcccaaggaaggcgcaccgatctggttcgacatgctcgccgttcccaagggcgcccagaacccaaaggacgcctacaccttcatcaactacctgctgcagccggacgtcattgcgccgatcagtgattttgtcggctaccccaaccccaacaaggacgccaccgaacaggtggacccggcgatccgcaacaatcccaacctctaccccaccgaagcggccatggccacgctctacaccctcaagcccctgggccgtgaggccgaacgcgccaggacgcgggcctggaccaagatcaagtccggcacctgaccttcaagggggcgagcctgctcgtcccctatttatctaccgtttccgccgctcctggaatcattaccctgcgcctttcaaggtccgtcgcagccgcccgggccaacgcttgccaaggagctgcagatgcccgacacccccctcaccacggacacttcgcaaaccaaccgaccgcccaccgtggatgaattgctcatccaactgaccaccggccccaccagccgggaagtcgcggccagcaccttgcgcaccgcgctgcgcgagcaatacccaacgctggacatcgacccggacctggccatggtctgccgcccgcgttggcgcgtcatcgacgacctgatcgtctcgtccagaggacccgccgaatcactcacctccgtcatggcacaccaggccatgtggccgaggccggtggtctatatcgacggcgagcactacctctcgctacagcccgacgcctgggaggccgtgcacttgccggtgaaaatcgatgccgtcgggcgcttgatcaatgagctggcgccgctgctgttcaccgcctttcaggaacagcagctcgactactggaaccagtccagcagcggcaacggcccgcgctggcaagtgctcgccaattcgctgcgcaaagtatggaatgtgaccactgtggaaggctgggacgctgacgactgcgccatggccagaacgctgtatcactttgcgcagaaagaaacccgcagtgccaaggacccgtacaagagccgggcctacctgatcgatatagacttgctgcacgatggccaggttcgtcatatcggcgtgatggacaagacgctattgatcggcgagcacgagaaagaaaccaggattcttgcctactccctggtcgacggctacgaaaaattcacctcgctggagcaggtcggcacaagccttccgtccaaattgagccaggtgccccatggcacggtattgcaatggcgcctgattgaaccggccgacaactttttcgacagcctggcctgcgccttgatttccatgcaaatcgaggccatcggcatgctcgaagacccccagggccgcgccgccctcggccaacccggcgtaccttcgaccataacccgtgccctgcccgccctcgaagacctgagcggacagtccttgtcgcgcgttcatcaagtcaaccagcaaatgcccgactggctggccgacgccagtgatgccgatgcagccgcctatggccgttacctcattgacttggcccaggtgcacacctccaaccatggccgcttgttccaggacggtattgcaccgatacgcgactatgcccgcgcgcaattgcaaagccggttcaaggccaacaaacagagcaccacgctgaacccggacaaggtcgaagtcatcatccagagcccggtcatctggggcacctttgctgtgcctggacagatcgacgtcactcgccgcaacttgatcgacctggccctggaaaatctcaccgggctgcccaccggcgagaccagcgtggcgtataacggcggtcccgcacctgaatggctgacgtacagctaccttaaggacttgattacccaactggatatcggcgagcactatccggcgctgatcaagcgcacactgctcgaagacccggagcaatcccaggcacggcagcagctctacaccagccacctgcgtgtgcagctgccgatgctggctctgcaatggaaaatccaggggcgctatggcctggatgagctgggttaccgctacgttgccgccgtaatgcaacctgacgtccatgaccgccaattcgatgggcaggaaatcgtcatccgtcagttggcctttattcccaccttgcgccccgggcacgaccaggatgcggtgactaatatgttcgtgatcgagccccggtccgccgacaagggcccgtgcgtactgtaccgcccgctgcttgagccgatgctgcgtcaattcccctcgcggcaaaacctgctgtatgcgatcaaacatgatcggcatctgcgcgaatcggtgctggcctggttacccgaagcatcgcgtttcaactacgcacagtacgtgttccccggtgccgtgccgtcgccctggacacttgcccgcgtgctgatcgagcccgccaccgtggtgtacatgagcggcgccattgccttgagcgacgaagtgctgggcaatgacgtactgggtacactcttcaaggccaacgccaacgccatggtggagctggcgactcgtcaatcggtgtccaacgtgcaaaaacgctgggcgacctttcgccgtgccggctggcagattttcaatgcgaccttgccgttccttggccctacggtgggaatcgcggcctggatgtggcagatcatggatgacctggaagaggtcgagcaggcagtcaatgccgccgacaaagccacgccctggacctcactggtggacctgtggctcaacctgggaatggccctggcgctgcatgtggccctgcgtcatccgtccgccccggcgacagacgaaacgctcaagcccaaggtgcccgaggagccgctgtcgaacaccaacacagagcaaccggcgctgcctgcgccctctatcaccgcggtgcagctgccggacttgcccagcaccgaactgttcgcctcgcatcagggctccctgcacgtcagcggcgcactcagccgcacccccaagagcctgggcacgtggctggagagtttcaatgtcgagcggcccgccgaattgggtgagcagaacaagcaacccggtacccaccaccacctgtatcccgccgccaacaaatggttcgtacccgttggcaagcgctggttcgaggtcaaggtagacgccaacgacaacgtggttgttatcgacccggtcatcccaaaccgcaccggcccattgctgatcagtaacagggctgggcagtggttcgtcgatccccgcctgcgcctgcgtggcggcggttttcgcaaccgtcggcgcacggccaggcagcagaaaccgccgcgcattgaagaactgcgtaaaaatattgaccgtttccagatcaacgaccgggatcgacaacaacagctttccgataccctcgctgccatcggcacagagcctgggccctccactgacttacgccgtgaaaacttcatcagggatgcgaatcaacgcctgctggaatacgaagagcccattcgccaactcaggtccctgggccacatcgacgacgtgcctgaataccagagcatgatgattggcttcctgaaaaaccagttggcgctgacgcgagccgccattaatgaacaattgcccgcttatcgcgatgccttgtcgggctccctcaatgcgctcgaattacccgcctcgctggagaggcgaaccgccgagactatcgcgacccagaccctggaaatgatcatgcgcctggaatacgtggctggccgcttcaaggaactggaaaaccttggtgtcgagggtgcagaagccatccaatcgacgatgcgtgccttgcccaatatcacgctccccgacctgaaggcgctgcacatcaccctgatgcgctatctgtgtgtcaacgccggtaacagcacagtgttgacccgtgtccgcgcacagttgagcgatatcatcgacgccgctgacctgcatgtgcagagcttgattgacattctcggcgagcccgaagacagcagcctggatgagcgcatcgaaacgctcaacagcctggccgagcaattcgacatcgttgaccatcgcctgctggacctgcacgccgattatccagagcacctgcagcgcgaccccgtggaagtattgcgccagcgtatcgaagaatttcatcagcgcaccttgcacgaactggcgcagctgttgcgccagcgcaaagcccttgagccaaagccgggaccgtcgaaaccgccagagccgcctcgacgcaaaatcatcaagacccgcttcaagggcatcgtggtaggcgagccaagggagagcgaagccacgctggtggatgtgaaggcaacgctgaccggcaaggtgattgccaccttccacgaaaaagccccaggagtctgggtcgagcacaaaaggggcccctctgccccgtcaaggccaaagcccgccaaccttgggaaaagcctcaacgccgggcagcaattgctggatgatgagccggccaccacccgccgcctgttggctcactcgcgtaaacgcgggcgtatcccggtggagatcgaagagatgttccaccagcatgcggccgagctggaggatgccgtgctgacagtggaatccgccctgacccggctcaacctcaccgaaagcgaccggccttcggcggccaacctcaaccgccagctcaatgaccgcgccaaacgcctctacgaactgggcactcagactcgaatcactctgaccaagcgacaacctcccacggcagctcgtgtgaagtggttgcatgatcaagggctggtgaagatcgtcaagacgaccaatcgccgtcctttgaagggcccaggcaagaactacctggatgagtacgaaatccgcgatagccaaagcaatgccgccctgtggtatgcacactttcactacgcgtcaacccaagccgagctcgagcactttaccgccgggcacctcaagactcgcgaccagcgcaggctcggcggcagattgcagcgtacgggcagcagcgaccaggaccagatcgaaatttaccgcagtgaaatcagtccgcagttggcccagtcactgttctttgcccattgatctcagccctgccatgccacccgcaatcgcgccagcgcttgggtaatcgccgcctctggcacagcggcgaaccccagtaccaacccggcgcgctggtcgaggggagtgatcgagtctgccagccaatagttgctcaggccattgacctcgaccccagcggccaacgcctgggccagcaattgctgctcacgggccaggctgtccagcctcaccgtgaggtgcaaccctgccgccacgttgggcagcgggcctaggccaggcaggtcgccaggccagccggcgagcaaagcgttgcgtcggctcaaagccgcacgacgcatgcgtcggatatgccgctggaaatgcccggcggccatgaactcggccatcaccgcctgggtgctgacctccgaatgacgcatgtccaccgcgcgacgctgggcgaaggcgtccaccaacgccgcaggcaataccaggtaacccaggcgcaaggccgggaacgccaccttgccgaaggtgccgacgtacagcacgcgcccgctgcgatccagggctgccagtggcgaaagcggcgcaccgctgtagcggtactctccgtcgtaatcatcttcaaccacccaaccgcccgtgcgttgcgcccaggccagcagctccaggcgacgcgccaggctcatcaccacgcccaacgggtactggtgggaaggcgtgacatacgccacccggcaatcgcccagggcattgagcgcctggcagtcgataccttcgtcgtccaccggcacgccgtgcagtcgcccgccggccaaagcgaacgcgtggcccgctgcgcgatagcccgggttttccactgcaacgctgtcccccggctccaccagcagctgtgcacaaaggctgatcgcctgctgagcgccactggtgatcactatttgctcagcactgcattgcatgccccgcgagctgcgcaagtacgcggcgatcaacccgcgcagacggccatcccccgccgggtcgccatagcacaggtgttgcaggtcaggtttgcgccagaaccccgcactcagcttggcccacacctcgaacggaaacagatcgaaggccggcactcccacgcgaaatgctcggggtggtcctgacggcggctggggcaggtggtgattttttacccggtccaaacccgcgctgtggataacttcatcttccagattcccgggcaaattcgtccattttgtggataaagttggggataagcctgttgataaccttgtggatacttttgtggatagtttttttggcgtaggtaatagagcgacgtaagtgccatctccgactcggctctcgataaagccctcggcatacagttggtcataggcacgtattacgctgttgcgcgaaatcgccaacgccgcggccaagtcacgggtagcgggcaaccgcgtgccactcaccagccgcccgtccagcacccgctggctcaatgcttcatagagttggcgcgtcaggcccaggcggcgatccagctcaatgccggcggggttgaatgacagcggcggtgtagtgggcgacatattggacctatgaaatgggcgctagatggctcttacaacgaaccattagcctgcctaggatgcaggcattcgccaaggaaaatttccatgtacacacctcgcgcctttgccctcgacgatttgcctgaaatccaccaactgatccagcacacccgcctggcgcaattggtaacctttggtgagcaaggcctgcaggccagccacctgccgctgctgctcaaccccgatgaaggcccccatggcaccctctacgggcacttggccaaggccaacccgcagtgcaaagacctgcaagacggcagcgaagcgttggtgatctttgccggcgccgacgcctacatcagcccgtcgttctacccggccaaggccgagcacggcaaagtagtgcccacctggaactacatcgccgtgcatgcctatggcaagcccgaagcgtttaccgacgccgagcgcttgtgggccgtggttactgcattgactgatcgccatgaaggcaagcgtgcacagccgtggaaagtcagcgacgccccggccaactacattgacagcatgctcaaggccatcgtcggctttgccctgccgatcgaacgtgtggtgggcaagcgcaaacttggccagaaccgcagtcaggctgacatcaacggcattcgcgagggcttggccaccagcctcgacgtgcgcgaccagaccctcgcacgctttatgccccaaggagtttcagaatgagcccgatcgacatccgccccgtcaccgccactgatcacgccgcctggctggcgctgtggcaagcgtatttgcagttctacaacactgaactgccggacgccgtcagcctcagcacctggcagcgcttgatcgacgccagcgagccgacccactcggccctggcctggcaagacggcaaggccgtgggcatggtcaacttcatctaccaccgctccaactggagcatcgagaactcctgttacctgcaggatttgctggtagcaccggcccagcgcggcagcggcgtgggtcgccagttgatcgagtacgtctacgccaccgccaaggccgatggttgctgcaaggtgcattggctgacccacgagaccaacgccaccgctatccaactctacgaacgcatcgccgaacgcccaggtttcatccaatttcgccaaggtctttaaggagcgcaatatgtccacttccctcgccgactggaaaggcgtcccggccccaacggttcaactgctcgaagggcgctttatccgcctggaaaaactcgacccggcgcgccatggcgatgacctgttcaacgccctgcaaggcccgggcgccgacccaaagctatgggactatttaccctacggccccttccctgagcgcaacgcgttcgatgcctggctgaataatcacgcggcccatagcgacccgtattttttcagcgtgattgatcgcacaactggccaggtccagggcatcctcagcttgatgtcgatcgtgcccgagcaaggccgcatcgagatcggccatgtcaccttcggtgctccgatgcaacgctcgcccaaaagcaccgaggcggtgtacctgttggccaagtacgccttcgagcagggcaatcgccgcctggaatggaagtgcaacaacgccaacgcccgctccaagtatgcggccgagcgcttgggcttcagctttgaaggcgtgttccgccagcatacggtggtcaagggcaagaaccgggataccgcgtggtattcgatcatcgattcggaatggcctaaagtaggcgcgggatttgagacctggttgtcggaagcgaaccagagcggctcgggccagctgaaaaccctggccgaatgccggacctaggcctcataaccaatacaaaaccaaatgtgggaggggcttgcccctcccacactttgaagtgcggtaaatcagttggtcaggcgctgcgccagcaccgcaatatgctccggcccgataccacagcacccacccaaatggctggcgccacgcgcctgccaatcagcagcccaatgcaggtaacctggcgggtcgagatcgtcgcgtaacgggtccaggccgtcgttggccgtggcttccttgggttgcggcgggaaggcattggcgtaggcgccgatctgggtcgctacacccaatcgcttaaaggtttcacgcgccgcatcaatggccgcgccgatcacttccggctggctgcaattgaacagcaacacctgcacacccaactgcgcggcggcctcggccgcctcggtcactggctcgccggagcgcaggcgtggtacgtcgtcggtgtcttcgtctttcaaggtgaacgacagccagaacggtttgccgtcctgcggcaggcccgcatggatggctcgtgcctcaacgattgagctctgggtttccgccagccacaggtcgacgtgaggcgccaggccttgcaccagtggtgtcagcaactcactgacccgttcggcctggaacaagtcggggcgataggagccaaacagcggtggtaatgaaccggcgacctgtaccgccttaccggatgcctgcaccgcccgtcgcgccaactcaccggccagtgcggccagcgcctggccttcttgcgcgaaccgcgcttcgccgatatgaaacggcaccactgcatagctattgctggtaatcacattggcaccgctgtcgatataggccgcatgcacggcctccaccgcttgcggcgcttcgctcaaggccagggccgaccattccggctggcggaacggcgcgccacggcgctgcagttcacggcccatgccgccatcgagaattactgtgttagctgcgcccatatgctttttactcatatgcttatgaaaataactcactatgagagtcgttcttataactatttaatgcgtaccattcggttaataacaaccacttttttattcaggtgctcgattttgaaattcagactgctgcaggccctcggcctgacgatgttggccgcttccacccaagcctttggcggcgtcaccctggaccggatcgagcagaaaaaagagttggtcggcgtgctgatggaaagctatccgccgttttcatttctaaacgagcagaaccagctcgacggtttcgacgtggacgtggccaaggccgtggcacaaaaactgggggtgaagctgcgcctggaaacgccgtcgtgggacgtgatcgccgccggccgctggagcgggcgctacgacatttgtatctgctccatgaccccgagcaaggcgcgtgccgaggtgttcgacttcccggtgcaatactatgcctcgcccgccgtgatcgtggtcaacgccaaggatgatcgtatccacgaagccaaagacctgagcggcaagaaagtcggcctcaccagtgcctccagctacgaaagttatttgaacaagaacctggtgatcgagggcgccgaagatacccagctgcagtacccgttcgaagatgtgcagatcgccccatacgacaccgacaacgtagcgttccaggacctcggcctgggtgcgggcgtgcgcctggatgcgatccttaccaacctggtgaccgcgcagccgcgcctgacgcaagataaacgcttcaagctcgccggcacgccgttgtattcggagcccaactcggtagccatcgagaaaggcgacgcgcaatgggacagcaaagtgcgtgaggtcttcgcccagctcaaacaggacggcaccttgagcaagctgtcgcaaaaatggatcggcgccgacatcagccaatgagctttcgtttacggctttacctgacctgggcggtactgtttgccctgtttgccagtttcttcctgagctttgacctgaagttctcgatcatcctcgacaagctgcccaacctggtcggtctgcaccttgcacccaatggctttctgcaaggtgcggcgctgacactgttcctgtgcctgtgcgccatagttgcctcatcggtgctgggctttatcacagcgctggggcgtctgtcgaaaagcgcagtggcgtttggcattgccagtttctacgcctcgttctttcgtggcacgccgctgctgatccagatcctgctgatttacctgggcctgccgcagttgggcctggtgccaggcgccatcgtcgccgggatcattgcgttgtcgctgaactatggcgcctacctgagcgagattttccgcgccggcatcctcggcgtcccccatggtcaacgcgaagccgcgctggccctgggcatgcgcgacagggagatcttctggcacgtcaccttgccccaggcgatgcgcaccatcatcccgccagccaccaaccagttcatctcgatgctcaaggattcgtcgttgatttcggtaatgggggtatgggaagtgatgttcctggcgcagtcctatggtcgctccagctaccgctatatcgagatgctcaccacggcggcgattatttactgggtgatgtcactggccctggagctgatccaggcgcgcatggaacggcatttcggcaagggttatgtgcgccgcggttgaagctcaggacctatggcgctctgccttggctacgttcagcgattttacggtttgatattgctgtcgagcccatgagtttttaatcgcatctcaccgaagacaactcccgcaagccagcggtcactggcctgacatttatcgtcccgcgcccccgctaaattcccggcctcattcatcagaggttgggaattcatgccctttacaccccaaagaatcgcgatagtcatcagccttgcggcaaccgccagttttcaacccgtgcacgcgcgcggcgatatcgaatatcggtcgccctacgacgcggctcccgctcagtgggagttcatgtccgggttcggggccccgcccattccgccgcctttcgacggtttccttacgcagcaggccacctcgcacaacggtctacaggtcgccaaggtgctggaaccggccttgattcgactggttgcatccggccagatgagcgccgaagagctcaaggacatgcagaagaaactcgaccaactgagcaaacagcccggaggcatcggtgcagcccttgagcaattggccgccagccaaaacgccaacctggccgccgcgacccagcgcaccacgcaacacctgagcagccaattgctctccactttgcgcacactgcccactgaagacgacggccacttctgggtgcagggcctgggtaacggtggcagccttgattcacagcacggcagtgctggcctgaaacacgatacccagggcctgctgctgggcgccgactgggcagtcgactcagcctggcgagtgggcgtcatgggcgccaaaacctccggccgcttcgatgctgcgcgttttgccgctgatctggacagctggcacctgggcggctatgccgtgcgccaggatggccctttggccttgcgcatgggggcgatctacagcaagcatgccggccagaacaaacgcaacgtcagccttctgaatcacacggagtcgctcaagagcagctacaacgcccacagtcaaacgctgttctccgaacttggctatcaactgggcagtggcgattccagtgtcgaacctttcgtcggcctgggctaccagcgctaccaacgcgaacgcttcaaagagagcggcggccgaaccgcgttgaatgtcggcccacagacccagcgaaacctgaacagcaccctcggcctgcgcgtagcgacggtgtatcggttcgataacaagatgagcctcacaccccacctgagcaccagttggaaacacctctatggcgacgtcagcagccaggtcaaccagtcttcgcgccatgcgccagccctgatcgatgcattcaccatcactggcaccgccctggatcgcgacagcctggacctgcaagcgggtctggacctggccttctcgacccaacacagtatcggcctgacctataccagccaaagcggcaaccacggtcgagaccaaggtttgatggggcagtggaaggtgagcttctaacgctgccgaacgctgaataacgggcgaaaaaaaggggagcacctgcccccccgaggattaaacgttagtctcgaaggctgtaatcagccttcgatctcgatcaggatttcgccagggttgacccggtcgcccttggccacatgaacggcggtcaccttgccggcaatcgctgcctgcacttcggtttccatcttcatggcttcggtaatcagtaccgcctggccagccttgaccacatcgccttccttgaccagcacgtcgacgatattgcccggcatcgccgtgctcacatggcccggctcggtggcgtgcttgcgtttgctgccgccgctgctgacaaactcgttgagcggttcgaacaccacttcttccggcatgccgtcgatggacaggtagaagtggcgcttgccttcggccttcacccccacgccggtaatgtcgacgcggtagctttcgccatggacatcgatgacgaattcggtcggcacaccttcgccaccggcacgggccacgccaccggcttccggaatcggcagcagcacttcgggtgccagggtgccggcgtcgcgctcttcaaggaatttacgcccaatgtccgggaacatggcgtaggtcagcacgtcttcctcagacttggccaacgcgccgatttcgccgcgcagtttggtcatttccggcttgagcaaatcggccggacgcacgtcgatcacttcttcgctgccgatggcctggcgacgcagtttctcgttcacggtgccgggcgccttgccatagccgccttgtagatagagcttcacttcgttggtgatggtcttgtaacgctcgccggccagcacgttgaagaacgcttgggtgccgacgatctgcgaggtcggggtgaccagcggggggaagcccaggtcttcacgcacacgggggatttcggccagcacttcactcatgcgattgagggcgccctgctctttcaactggttggccaggttggaaatcatcccgcccggcacctggttgacttgcacgcgggtgtcgacggcggtgaattcgctttcgaactggtggtactttttgcgcacggcgtagaagtacaggccgatctcctgcagcagctccagatccaggcccgtgtcgaattcgctgcctttaagcgccgcgaccattgactcggtacccgggtggctggtgccccaggcgaagctggagatggcggtgtcgatatgatcggcaccgttttcgatggccttgagttggcacatcgcagccaaaccggcggtgtcgtgggaatggataaaaatcggcaggttctgttcggctttcagcgccttgaccagttcgccggtggcgtacggggtcagcaggccggccatgtccttgatcgcgatcgagtcgcaacccatggattccaactgcttggcctgggccacgaaggcctcgacggtgtgcaccgggctagtggtgtaggcgatggtgccctgggcatgcttaccagcggctttaacagcttcgatggccacgcgcaggttacgcacgtcgttcatggcgtcgaagatacggaacacgtcgataccgttaaccgccgccttggccacgaaagcccttaccacgtcatcgctgtagtggcggtaacccagcaggttctggccgcgcagcagcatttgcaggcgcgtgttgggcaacgccgcgcgcagttggcgcaggcgctcccacgggtcttccttgaggaagcgcacgcaggcatcgaaggtcgcgccgccccagacttccagggaccagtagccgactttgtcgagcttgtcgcagatcggcagcatgtcgtcggtgcgcatgcgggtggccagcaacgattggtgggcgtcgcgcaggatggtgtcggttacgaagatctttttagtcattggaatgttcctcacaggcctgcgtgggcggcgatggcggcggcgatggccagggccagctcttcgggtttgcgcttaatcgagtagttggtcagctcaggatggctttccacgaaactggtgttgaactggccactgcggaattccgggttgcgcaggatttcctggtagtaggcggcggtggtcttcacgccttgcaggcgcatgtcgtccagggctcgcaggccacggtccatggcctcttcccaggtcaacgcccacaccaccagtttcaggcacatggagtcgtagaacggcgggatggtgtagccggtgtatatcgccgtgtcggtgcgtacgccggggccgccgggtgcgtagtaacgggtgatcttgccgaagctgggcaggaagttgttcttcgggtcctcggcgttgatacggaactgcaacgcaaagccacgatgctggatatcttcctgtttcaccgacagcggcaggcccgacgcgatgcgaatctgctcgcgcacgatatcgatcccggtgatttcttcggtgatggtgtgttccacctgcacccgggtgttcatctccatgaagtacacctcgccctcggcgagcaggaactccacggtgccggcgttctcgtagcccacggccttggcggcgcgcaccgacaggtcgccgatgtaggcgcgctgttcgggggtcagctgagggcttggggcaatttcgatgagcttctggttacgacgctggatcgagcaatcacgctcgaacaaatgcaccacgttgccaaagctgtcaccgaggatctgcgcctcgatgtgcttgggattgacgatgcatttttccaggaacacttccgccgaaccgaacgccttggtggcttcggagataacgcgggggaaggcttgttcaagttcttcgcggctgttgcaacgacggatgccacgaccgccgccaccagaagtggccttgagcatcaccgggtaaccgatgcggtcgccttcagtaagcgcttcgtggatatcggcgacgttgccttcagtaccgggagtgaccggcacaccggccttgatcatgctgcggcgcgcttcggtcttgtcgcccatgcggcgaatcacttcggccgatgggccaatgaacttgatcccgcgttcggcgcaaatgtccgccagttcagcattttctgacaggaagccgtagccggggtgcagggcgtcgcaaccggtttccacggccaggttcaccagcttgcgcgggttcaggtagccggccaggggctcggcaccaatgctgtgagcctcgtcggcacgcttgacgtgcaacgcgtggcggtcggcgtccgagtagaccgcgaccgagcgaatgcccatctcggcgcaggcacgtacgattcgtacggcaatttcaccacggttggcgatcaggatcttttttatcacttggaaattcccttgagccgattgctgcgtcttcgacctgatggaactggtcggcgcgtgaccaaatgtttcatgacagtcgcgagacacacactaagcccgtcaagggattaacaaaaatcaataattattgggtcatgcataagcaaaggcttatagttggccgaatagcctggggtgaagggatctaaataatgcgtaagtcactgatgagactgacattacgtcaattgcagatctttcatgaggtctgcgatctgcgctcctacagccgcgcggccgaggaaatgtccctgacgcaacccgccgtcagcctgcagattcgtcagctggaagagctgatcggccagccgctgttcgattatgtcggtaaaaagctctacatgaccgaggccgccgaagccctgcaacgggccagccgcgatatcttcgggcgcctggaaaacctcgacatgcagctatcggacatgcagggctcgctgcagggccagctgaaactggcggtggaatcgagcgccaagtatttcgtgccgcacctgtttgccgccttcaagcgccagcacccggaggtgcaactgcacttgacggtcgtcaatcgtgcccaggtaatccgcaggctttcagacaaccgcgacgatttggtgatcatgtccatggtgcctcaggacatgggcctggaattcctgccgtttctcaacaacccaattgtcgccgtggcactgccggatcatccgttgagcctgcaagggccgttgcgtctgcaagacctggagccttacacactgctgatccgcgagccaggttccggcacgcggctggcctgcgaggaatacttcaaggaaaaacgcgtgcacttcacccagacagtggaagtggcctcggccgaggcgcagcgtgagtgcgtggccgcaggtttgggcgtggccctgctgacgcgccacgccttgaacctggaactggccaccggcgggctcaaggagctgccggtggaagaactgccgctgtaccgcagctggtgcctggtgcaggccaaggctaaacgcctgtcaccagtggcccatgcgttcctgggctttattcgcagcgaacgggtgcagatcagcgcgctggctgagcgtttcgctgggcggccacgggtgcctgccaatggagttccgggtagtcagtgatgctctggagcaactggcgctcttcgcaacggtcttcgatggcgcgacggaacgccatgcggcgctggtcttcctgctgacgacgggtcttgacggtgctgttgctgtcttcgtagtgccgggtcatttggagtctcccaatgcgagtacaggggagtacagggtggacgcgcgggatgacggggcgatgacagcctcatgaagattctggatgcatggagaatctaatgtgggagggggcttgctcccgatagcggagtttcagtcacagattcattgactgacctactgctatcgggagcaagccccctcccacattgagttctatgtgcaggtatttagtcgtcgagggctttgacggatttgggcgacaggcgcaggctgcgcaagctgcgcttgacgctcttgaggtggttgaccaggctcgggccacgggccatggccacgcccatcgccagcacgtcgatcaccaccaggtgagcgatgcgcgaggtcagcggcgtatagatttcggtgtcttcatgcacgtcgatcgccaggttcaccgtggacagttccgccaatggcgtctggctcgggcacagggtaatcagcgaagcgccgctttcacgcaccaggttggcggtgatcagcaaatctttggaacgaccggactgggatatacagatcgccacgtcagtaggcttcaaggtcactgccgacatcgcctgcatatgcgggtcgctgtaggccgcagccgtcagcaacaggcggaagaacttgtgctgggcatcggccgccaccgcgcccgaggcaccaaagccatagaactcgacgcgctgggcctgggacatagcagtcaccgccttttgcagctccaccgggtcaagcttctcgcgcacttccatcagggtatgcaaggtggtgtcgaagattttcaggctgtagtcggcgacggagtcgtcttcatgaatcgcaaactggccaaagctcgcgccggccgccaggctctgtgccagcttgagtttcagatcctggaacccggagcagccaatggcgcggcagaagcgcacgatggtcggctcactgatgcccacgctgtgggccaggtcggccatggaactgtgcatcacggccgcaggatcaagcagcacatgatcggcaaccttgagttccgatttgcgtaacaggtggcgcgactgggcgatatgttgcaacaggttcaaagggcaggactcttgttattggcaggcgccagggatgtagcaagcttgtagttatactacaagaattctcgttttgcccgttcgatgcatcactatatcgccctgctccccctctggtttcagcgggcaggcgctatgtagccataaattcggcctacgctgcgttaagaaaaatctgcatttttgcgtaacaaatccgccagcccttcggccggcatcggctggctgatcagataaccctgcacttcatcgcactgctcaccgcggagaaactccagctgctgctgatcttccacgccttcggccacgaccttgagcgccaacccatgggccatggcgatgattgcacgggtgatcgccgcatcctcacgcccctggccaaggccacggataaaggtctggtcgatcttcacgtagtccaccggaatgcgcttgaggtagctcaaggacgaataacccgtgccaaagtcatcgatggccagtttcacccccaggtcgcgcaactgctggaaggtggcgatgatgtgttcaacgctgtcgagcaactggctttcagtcagctccagctccaggtattgcgggtccaggccggtttcttccaggacctggcgcaccagactgaccagcttgccctggcgcaactgatgcaccgacaagttgactgatacccgaatcggcgcgagcccctggcgctgccactcacaagcctgccaacacgcctggcgcagcacgaactcgcccaacggcacgatcaagccggtttcttcggccaggccgataaagtcccccggcggcaccatgccccattgcggatgctcccagcggatcagcgcctcggcggcattcagcttgccggtggccaggcacagtttgggctggtagaacacactcaaatgacgctcttcgatggctttacgcaggtgattttccagctgcaaacgctccagggtgctggcttgcaggctgtcggtgtaaaactggaaattattcccgcccaagtgcttggcgtgttgcatggccatatttgattggctgaccaatgcagaaatttcccgcgcattatccggcagcagactgacccccattgaggcgctgaccaccagctcatgcccctccaccgtcaccggtacacgcagttttgccagcagccgcgtcgccacccgtgccaggctcgacaggttgccgtaggcgtcgaagagcacggcaaactcgtcaccggacaggcgcgcaatggtgtcggcttcaggcaacgcgttgatcaaacgccgggccattttctgcaataactggtcggccacttcatggcccaagctgtcattgagcaacttgaagcggtccaggttgatatgcagcagcgccaggctgcgcccgccctgacgcacacgctggtgggcctcgcgcaggcgttcgcgaaacagcgagcggttggccaggccggtcagttcatcgtagtgagtgaggtagcgcatacgctcctcggattcacgccgcgccgaaagatcggcgaaaaaacccacgatatggctgacgtttccccgaacatcgcgcactacgttcagttgcagccactgcgggtagagctcgccgttcttgcgcgtttccaccaactcgccctgccaggtaccgtggctgagcagcgcctggcggatcaccgggaagtggcgtcgcgcatcgcggctgctgggcagttccaccacattgcggccaagcatgtcgtcgatgtcaaaaccggtgacacggctgaatgcctggttcaccgcgatcagcacgtactcgggatcgaggatcacgatgccttcgctggccgcctcgaacaccgtcgaggcgagccgttgctgttcttccagcgccttactcgcgctgatatctcggcgcgtaccgagcatgcgggtcacgcggccgttgggcgcacgctccaccgcacggccacggtcctggatccacacccaatgcccgtcaccatggcgcacccggtattccacctgatagtcctcgctacggcctttgagatgctccaccagcgcacgcttgagcagcggcaggtcgtcggggtgcagccgcggcttgaggtggctgagcatcgccgtgacgtactcgggctccaggccgaacagctccttgagttgggtgtggtggacttcgtcggtttgcaggttccaatcccaaagacccagttcgctggcttgcagggccatggccaggcgcgcttcgcttttattcagggcaaggctggcggcatccagctcctggctgcgtcgcgccataccgtcttggaggccgacctgggcgtcgcgcaagtcctgttcaacctggcggcgctgctcgacttcacgcaccagctccaggttcaactgttcgctgcgctgctgagactgttgcaaatgctcgatcaaggcctggttctgaaatcgtcgcaacagcccgcgctgaatcagccggttgacctgccaggccaccaggctcagggacgccagcaggatcaggccgagcacaccccagccctgctgctgggccgtgccattccagaacagatagacgatggccggcaccaagcacggcaagacaaacgacaggaaggcccacaggctcacggcataggccacgctggccgacaatgaagcggcgccgatcaggccaaacacccaggcctgatgcatgaagctgtcggcaggtaccagggcgatggccgcgacagaaagcgtcaagccactgaccgccgaaccgagcatgaacatgcgccgccacaccggctgggcctgacggctgggcatcgccgaatcaaaggccgccacctgaatcacacgcatcgccaccagggccagtagccagagcaaccaaatgctgtcgagcaggtattgctgggggttccaaagcaaccaggcgcagaccaggccattgaccagcatcagcagcgtcggcagcaatgagccctgatatagcaggcgtgtgcgctcgaccgccatttgggttgcatagtgtttacggatgacctgcgccggcgccgccgaggggccgaacaggtcggtgctaagggtcataggcggtgttcttataatggtgagcccgaaacgtcgacggagcatacacaagcaggcgcctgcaccaaactgctccaggtcataaaaaccccgccaagatcggccgcaaacctttggcccagacggcttgagcgagacgcggcgcgggctgcggccgatgaccaaccggtcatccccctcggcagaatgtctgcccggtcgacagcgctccggatgttttgcgtcgaccacctggcattgggatttgcccgagcccccttaggcccatagaatgcgtcgatgcgcgatgatctctcacttttgttgaactccctcaacgatgcccaacgccaggccgtagcggcccccgttggccgtcagttggtcctggccggtgctggctccggtaaaacccgagtgctggtgcaccgtatcgcctggttgatccaggtcgaaaacgcgtccccgcactccatcttgtcggtgacctttaccaacaaggccgctgccgagatgcgccatcgtatcgagcagttgatgggcatcagcccggccggcatgtgggtgggcactttccacggcctggcgcaccgcctgttgcgggcgcattggcaggaagcggggctgagccagaccttccagattctcgacagcgacgaccagcaacgcctggtcaagcgcgtgatccgcgaactgggcctcgacgaacagcgttggccggcgcgccaggcccaatggtttatcaatggtcagaaggacgagggcctgcgcccgcagcatatccaggccagcggcgatctgttcctggctaccatgcgcagcatttatgaagcctacgaggcggcgtgtttgcgtgcaggcgtgatcgacttctccgaactgttgctgcgcgccctcgacctgtggcgtgacaaccccggtttgctggcccattaccagaagcgcttccgccatatcctggtggacgagttccaagacaccaacgccgtgcagtacgcctggttgcgcctgctggccaagggcggcgacagcctgatggtggtgggtgatgacgaccagtcgatctacggctggcgcggcgcgaaaatcgagaacatctaccagtactccgaagatttcccggacgcggtgaccattcgcctggagcagaactaccgctccaccgccgggatcctcaaggctgccaatgccttgatcgccaacaacaccgggcgcctgggcaaagagctgtggaccgacggcggcgaaggcgaagcgatcaacctgtacgcggcgttcaacgagcacgatgaagcgcgctacgtggtggaaaccatcgaaagcgcgctgaaaaccggcctggcgcgcagcgatatcgcgatcctgtaccgttccaacgcccagtcgcgggtattggaagaagccttgctgcgcgagcgtatcccctaccgcatctacggcggccagcgctttttcgaacgtgccgaaatcaagaacgccatggcctacctgcgcttgctggaaggccgtggcaacgatgcggcgctggagcgggtgatcaatatcccggcccgtggcatcggcgagaaaaccgtcgaagcgatccgcgaccatgcacgccatgccgatgtgtcgatgtgggaagccatgcgtttgctgatcgccaacaaaggcctgaccggccgcgctgccggggctctgggtgtgtttgtcgagttgatcgagaacctcgccgccaagtgcgcagaaatgcccctgcacctgatgacccagaccgtgatcgagcagtccgggctgatcgcttaccacgaagcggaaaaaggcgagaaaggccaggcccgggtagaaaaccttgaggaactggtcagcgccgcccgcgccttcgaaaataccgaggacgacgaagagctgacgccgctcgccgccttcctgggccacgcgtcgctggaagctggcgatacccaggccgatgagcacgaagacagcatccagctgatgaccttgcacagcgccaaaggcctggagtttccgtatgtgttcctggtgggcatggaagaaggcctgttcccccacaagatgagcctggaagaacccggccgcctcgaggaagaacgccgcctggcctatgtgggcattacccgggcgatgcagaacctggtgatgacttacgccgagacccgacgcctgtacggcagcgagacctacaacaaggtgtcgcgctttgtacgtgaagtgccgaaagggctgatccaggaagtgcgcctgtccaacagcgtcagccgcccgttcggcggcggccagcagcagaactccagcaccatgttctcaggttccgagattccggaaaccccgttcagcctgggtcagcaggtcaggcatgcgatcttcggcgagggcgtgattctcaacttcgaaggcgccggtgcccaggcgcgggtgcaggtgaacttcgctgaaggcagcaagtggctgatgatgggctacgcaaagctcgaagcggtctaacaccctcccctgtaggagcgagctcgctcgcgaagaacgtccagacaacgcgttcctccagaatgcccacgttatcgttgacgattttcgcgagcaagctcgctcctacagagaacggttcaacatgaaggttacggctgtgcccttgtatttcacgagcgcgggccaatatctgtaatacgtcctacagacccttcggattcagtcttacgcaaaagcccgaaacattatgccgctagccactgtcacgacacctgtgcaacatggcgcgcgtgcaatccacaaatgggaattccctttatgaaacgttttcttagcatcgccatggcgttgtgcatcggcttgacgatgagtctcgacgccaacgccaaacgcttcggtggcggcaaaagctcaggcgcggcgccgactcaccagaccagccagatggctccaaccgctggtgccggcggtgctgccgcaactgcgggcgcagccggtgccgctggcgctgctgccaaggccggcggtgcttcgcgctggctgggccctctggccggtatcgctgccggtggcctgctcgcctccatgttcatgggcggcggcttcgagggcatgcagatcttcgacatcctgatcctggccgtcatcgctttcgtgatcttccgctttatcgccgcccgtcgtcgcaagcagcaggagcacctggctccagccggcgcgccaatgcagcgtgaagtgttcgagcagaagcctgccatgggttcgatcttcggtggttcggcagcacctgccgctgccgcccgtccggtgatcaacgcaccggcctggttcaacgaagagcgtttcgtcgaagcggcccgcagccacttccagtccctgcaacaacactgggacgccaacgaaatggacaagatctccgagttcgtgaccccacaactgctggagttcctcaagcgcgaacgtgccgagatcggtgacgcgttccagtcgacctacatcgacgacctgcgcgtacaactggacggtgtggatgatcgcgccgacaaaactatcgccaccctgaccttcagcggcgtgtcgaagacctcgcgcttcgaccagggcgaagtgttcagcgaaagctggaacatggaacgcgcccagggcgaggaccagccatggctggtggccggtatccgccagaacggctgaaacctgcacgtttgagcaagcggtaacaaaaaccccggacatgtccggggttttctatttcacggttgcacttatagcgagctactgtataaaacgcccctataaaccgcgccatctagcaagaggatcccggccgtggaagaaatcatcgaacaattgcgtgaagccaacgaaccggtcccggttcctttggagctgcctgacgaagaccaactggtggaaatcgaagaacaactgttcatcgacatcccgtttgtcttccgcgaattcctgctgaccgttagtgatgtggtgtacggcagcctggagccggtgaccgtcaccgacccacaatcccatacctacctgccggacgttgccgccaacgcctgggacgccggcgtcgaccgcagcatgatcccgatctgccaggacggcgatgactactattgcgtcgaggaagacggcaccgtggtgctgtggtccggcgaagaagaactcgttaccgaagaaacctgggaatcggtatggcactgggcgcgggacgtctggctggaaagctgaggcctttgcaggagtcgagcttgctcgcgagaaacctgagggcgccactgggtgtcaggtttcccgcgttatcgctaacgatcttcgcgagcacgctcgctcctactgcgtatccttgtggttatccagggtctccagcaacgccacttgcatccgcgtatgcacacggataaaccagcgccagagcaccgccgccaccgcagccgtgaccacggcaatcagcaccagcaacttgttggtcggcagaatgctggccgacaaggctgccaatagcaggaagatcaccagcagcgacaatagggggatcagctccgcaatcacccgtcgcacgcgctgggtatgccgcccggccatctccggcttcacactcatctctgccaacaacatcgacagcgccttgagcttgcgatacgccgcaatcaggaatggcagcgataacagcagtgccccaccccagatcaatgccttctgccagctcggatcactgatccaaccctccaggtacccgccgatgcgtgcggcgaaataactaccagcgaagaagatcgcgatcaccagtgccaggttgacccctacctgcaggatgatcttgcgaatcatcgaggccagcatcgccccctcgccctggggctggatgctgcgcagccactcgccatacatgccgaagacccggctcatgcgcttgggcatcaccgctgcgatcttcaatgacagtggatcggcgccgcgaatcaggtagggcgtcagcagcgtggtaatcgccgaaacagcaaccgccaccggatacaggaagtcgctggtcacctgcagggtcattcccaatgctgcaatgatgaaagaaaattcgccaatctgtgacagccccatgccgacccgcagcgaagtgcggccatcattgccggcgataaaggctcccaggccgcaggacagcatcttgcccagcaccaccgccacggtgatcaccgcaatcggccaggcgtattgcagcaggatatgagggtcgatcatcaaccctatcgcgacaaagaagattgcactgaacatgtcgcgaaccggctcgatcaggccctcgatcttaatcaattgacgggattcagccatgatcgcgccaatcaaaaaggccccgagcaccatgctgtattccagtttcaccaccaacaggcagaaaccgaagcacaagcccagcacggtgatcagcagcatctcattgctttcaaacttggccacataagccagcaggcgcggcaccagcaaaatgccgatcaccagcgcaacgatcatgaacaaggacagcttgccgaccgtggagaacacctcgccggagctgaccgtgccactgacggcgatgctcgacagcaaggcaatgatgccgatacccaggatgtcctcgacgatcagcacgccaaaaatcagctgggcgaaacgctggtctttcatcttaaggtcattgagggccttgacgatgatggtggtcgaggagatcgccaggatcgcgccgagaaacagcgagtccatggtgctccaatcgaaccagcggccgatctcgtagccgatccagatcatcaggacgatctcaaggaacgccgcgataaacgccgtggcccccactttgaacagcttgcgcaggctgaactccaggcccaggcagaacatcaggaagatcacccccagctcggccagggttttgatggtgtcttcgtcgtggatcaggccaaacggcggagtatgggggccgataatgaagcccgcgacgatatagcccagtaccaccggctgtttgaggcgatgaaacaggatggtgacgacccctgctaccagcatgatcacggccaggtcctggataaagctgatggcgtgcatggcgaggggctccttgagggtactggcgcttttcccacttccggccgcgcctttgtagggtcgcaaagagcggaaggaaaagtctgccttgaacgtaagaaaagccctgagatgggcttttgaaggttaacaccgcgacttctgctgaaaagccggtgcaatatatggaaacagatcgccgagcgcgtgacggcaagccgcccactggcgtcccgttagggatggcgctgcaaagacttcagcacccgcagaggtgccccctcccccaaccaatgcctacaacccgtgagtgtgctatggaacccggaaacgcccagctgtcgatgacggtattgatgacccctgacatggccaacttctcaggcaatgtccacggcggcacgctgctcaagtatctcgacgaagtggcctacgcctgcgccagccgttatgccggccgttacgtggtgacgctgtcggtggaccaggtgatttttcgcgaaccgatccatgtcggtgaactggtgactttcctggcgtcggtcaactacaccggcaatacctcgatggaagtgggcatcaaggtagtgaccgagaacattcgtgaacgctcggtgcgccataccaacagctgcttcttcaccatggtggccgtggacgaccagcgcaaacccgccgccgtgccgcccttgcagccgcagaacagcgaggacaaacgccgctttgtgcaggcccagcaacgtcggcagattcgccaggagctggaaaagcgttatcaggaaatcaaagccgaagcgccttaattcaaaacctgtaaaccctcccacactgttttttgtgtacttagaggctaatgggtgtggcttcaaagcgtacacgaggatgagcaatgcgatcctgggcgcgcaccagttccagttcataactggcgcaggcctgggtttccagcagcacttcatgcactgccgcggcggtgaactcaaaggctgccaccaggctatcgcccagcagcacccgcgcgaggaacaggcccgacgtcaggtcgcccacacccaccggctgacgcgggaacgccagcaacggccgacgcaagtgccagctggcgtcttcggtcaccaacagcatctcgaagccgtccggcagtttgcccgggtaatccaggtgtttgaccagcaccgccttgggcccacgtgccagcaaggccttggccattgcaaggcaatcgaacagcgactgcggcttgcgcccggcaaaactgtccagctccagctgattggggcagaggaaatccgccatggccgcagcctcgtccagcaggaaatcgctgacctcctgtggcacgatgcagcccttttccgggtgacccatcaccgggtcacacaggtacagcgccttggggttgatcgccttgatgcgggctacaccgctaaggatcgcgcggccttgggctgcactgccgaggtagccggacagcaccgcatcgcagttgcccagctcaccaatagcggcaatgccttccaccagcgccggaatttgctgcggcgccaacacttcccccgcccattgtccatactgagtgtggttggagaattgtaccgtgttgagcggccagacattcaccccgacccgctgcatagggaatacggcggcgctgtttccggcgtggccaaagaccacatgagactggatcgcaagcagatgaggtgtgcgtttcatgcgggagatttccgtcaagccgttgaaattctggccgcgcagtatgcgactaaacgcagcctgtacgacagaccggcgacacagttaagctgctctcactttgttggagttcatggaatgctgaccctgggaaacatgttcgtgttgatgctgctggcgaccggcgccgcctgggtctggcacaaccacggcctgcgtgagcgcgcgctggagcgggtcaagcagcattgcgccaagcttgatatcgaactgctcgatggtgcggtggcactcaaacgcatcgggttcgtcaaggatgccaatggccggcggcgcctggcacgtgtctataatttcgagttcactgtgaccggggaaacccgccatgccggaattatcacgcagttcggcgcccacagtgcgcagattgaactggcgccctacccgtttgaggccaaggagccgttgcccagcgccgaggtgatcgaattgagccaatggcgccaggaccacgcgaccaagaaacgtcaataacggcaggccgccagcgcaccctgcaataccgctgcatcctggggctcgctgaagatcaattcaagccgcgaatctcgacgccattcgctgggtcgccaagctagggggctgttatccacagcgttggccgagatccagccatcgacactgtggataaccagtttggcacgcctccattcgagacctgatagccaatgatgcagacggctgacatcgaatcgctggctcgggtgccaacgccaaccgatactccagccgccctcgtggccctggctcagacagatcggcaacccaggatcactccagatggccggcatttgcgccagccccttagggacgtcgaagttatccacagcgcctagggcctgcgcatccaagcctggcaaccgctcaagtggcaattgcgcctggcgtgtccaatatactgcgcatgcgggtaattgcgcttcaatcgcctgacgttgtgcagcatccagcgcctcgtccttgttcagcaccagcaggccggcgctggccaatgcctcttgctgtgcctgcggcaaaggcttccccgccgccaaggcccgggcatccagcaccagaacacagggctgcaccgccagcacgccttgccacggcgcctctcgcagctgtttgagcaactgcgccggatggcccagacccgaaggttcgataaacaaccgatccggcttggctttacgtagcaagcggcccagcccgacctggaacggtgcaccattcacacaacacaggcagcctccggccacttcaccgagggcgatgccgtcgtcgtcttgggtaagcaaggcagcgtccaggccgacttgcccgaactcgttgatcagcaccgcccagcgctcgttggccgggcgctgggcgagcaggtgctggatcaggctggtcttgccggcgcccaacgggccagcaatcacgtgggtgggaatattctgcagcatgggaagcatcattcagaccgtgtagagagcttgatcctacccggttatgccagccaatccagtgtcaggatcagccgccgctcatcggccttaagcgctggcgagcgatggatcagaccatgcccttcattgccgtgccatttcgtccccttcagcaacgccacttcaccgcagtggatctgctcgatgtgctcgatgggctcggcgtctgcctggctcaattggcgccggtccatgacaccttcgcgcaaccattggctgccgatgccggcataggtggtgatcagccggaccggcacatggtcgacgtgaaagcgcgggcacatggccttgtccaatagccgcagacgcacgccaatacgcttggcgccgagcaggcaggcgaatgcgctgatcagccacgacacatcggcaataaacccgtcgtaaccctcaagatcacgacaagtggacgccaaaccctgcaagttcggcacggcgtcttcgttgtcgagctcaatcaccaaggattcggccaacggctcattgagcgctaccagcaaggcgccgaattcggcgatatgcaggggcagttggcgctgccagactgccaggttgacgccatcgtcgagaatgtctgacagcgccagcggggtttccccacaggtctggcggatcacggggcgcaggggaataaccggggccagcatcaggctacctgctcataccaagggccaaaaggatcaggcagcaggcgccagctttcgacgcccagggccatttcttcatcattgagcaagcaggcatccagctcggcacgcatctgggtgaagtcgatgttttgcccgataaacaccagttcctgccggcagtcaccggtgctcaattgccagttagccatgattgccgcgacgctttcttcgtcctggggccattggctttttggcacaaagcgccaccaacgcccggcaaacccatggcgcatcaagccgccggcctgggaccaactgccagcgtcctgatgcttgctggccaaccagaagaagcccttggaacgcagcagcttgccgttcacccacgggcggtcgataaagccgaaaaaacgctgtgggtggaagggccgacgcgcacggtaagcggtggaagcgatcccatactcttcggtttccggcacatgttcaccgcgcaattcctgtaaccaacctggggcctgggcggcgcgttcaaagtcgaaacggccggtgttgaggatcttatgcagcggcacttcgcccatgaccatcgggatgatttccgcctgggcattaaggcgctcaaggatcgccatcaactcttcgcgctcgcggctgctgatcaggtcgatcttgctgatcaggatgacgtcggcgaactcgatctgctcgatcaacaggtcggtgatggagcgctcatcctcttctccgagggtttcgccccgcgaagccaggctttcggcggcctggtagtcgagcaggaagttcataccgtcgaccacggtgaccatggtgtccagccgcgcaatgtcggccaggctttgctcgttttcatcgcgaaaggtgaaggtttcggccacgggcaacggctctgatatgccggtggattcgatcagcaggtaatcaaaccgaccttccttggcgagttttccgacttcttcgagcaagtcttcacgcaaggtgcagcagatgcagccattgctcatctccaccagtttttcttccgaacgattgagcgtgacgtcgcgctgtacctcgctgccgtcgatgttgatttcgctcatgtcattgacgatcaccgctacccgcaggttgtcgcggttacgcaagacgtagttgagcagcgtacttttaccggcaccgagaaagccggataacacggtcacggggagacgattgggcatcaggtattcctcatcaagggtggccggtcaaactgcccgtttatggcgttcgcgcagctcttcacgttctttggcttcaatgcacagggttgcggtggggcgcagcagcaggcgttgcaggccaatgggctcgccggtttcacggcaccagccgtattcaccgcgggccagcagctccagggcgtcgtcgatcttgtccaacagcttcttttcccgctcgagcaagcgcagttgccattgacgttgctcttcggcactgccgatatccgccaggtcgctattggtttcctgctcgcgcagcgcctggaactcagcgtcaatgcgggcttgcagttcattgcgctgagccagcaaaagctcgcagaagaagcgctgttgggcgtcgttcatgtagtcggcaggcggttgggccagaaggtcttgttcggtcatgggaagcggttcacggatcaggctgtgtttttatgttatagtataacaatgcaaataagccaatccccttgttcgacgcgacgaagggcgcaatgcttgatcatcttcttacccagagaaatccgatgagatacctgatgtgcgccctgctcgtggcagccgcagggcctgcctgcgcccaaacgcccagcctgttggccaactgcacacgcagcgccaacctgctggcgtgcgtggacccgttgggcaatgcctatagcgtggcgaccgtgggcagcaccacctatttgcgcggctttgaagtgatcggtaaacgctactgggcgcagaccaacagccgctatgggcagctgacgttctttaccgggttggcatccgatggcgaggcgtgggtcggttacacgcggcgtgtgggctggaccaccctcaaccgcttttccagctcaggtggtgccagtgccaagttcacttgcagccgaatgaccggctgttaagcctgggcgttcttctgttcctgcacccaggccatgtagctgttcatcggcgggttcttctggaagtaacttttcaaaccttcgaaaagtccgtccgccaccgcttgctggtggcgcgcggtgaccagccgctgggcatcccgcgcattggagataaacccggtttccaccaggatcgaaggcacgtccggtgacttgagtaccgcaaaccctgcttgttccacacgcttctgatgcaggctggtgatgctttgcaggctgcccaataccgagctgcccaattgcaggctggaggcgatggtagcgttcatcgacatgtccaggatcaccccggccagcatcgggtccttgtccttcagattgagcaacgtggtggcgcccagcaggtctgcgccgttttcgcgctgagccatgaaacgcgctgtggcggaggtggcaccgccctcagacaatgcatacaccgaagcgcccgatgcggtaagccgtggggcagcgtcggcatgcaccgagataaacatatcggccttgtgctggcgggcgatgtccacacgtttgcgcagcggcacaaagaagtcgtcgttgcgcaccagttttacgtcaaagcccttttcgcgcttcaagcgtttagccagcaactgggcgatcgacagcaccacatccttttcgcgctggcccttggaaccgacagcacccgggtctttgccgccatgcccggggtcgaccaccacgatgatgtcgcgtttgggatgccccttgccccccggcgtcactatcggcggcggttcagcagcaatttgacggggggcacgagtggcgttggtcaggtccagcaccaggcgatggccttggccatcctggggcggcagcacgaaactgttgagctgcatcggcgcggccaggtccaacacgatgcgcgtgtcgctcttgccaaaatgcccggaacggatcgaggtaatcccactgttcttcagcgccaactgagagaagtcgccactgaggccggcgccactcaagtcgatgatcaagcggtctggagccgtcagggaaaaggtcttgtattgcaccgggccgctgaggtcgaacaccagccgcagcttgtcgtccgagcgccacaggcgtgcattgcgaatctgcgtggcataggcgcccaaaggcaaggtgaacaaggggctgaccagcagcaggttgaggagctgacgtctgtgcatgacatataccgcagataaaggagcgtccctgctcgacatgactgaacaaaggctggagtagaaatttcatcgtagtaaatattgttatactataacatgacgaattatttccaacgatggacctgcttatgaatgcgctgactctgccggatatcgccgcgcaggcttcacgccaagccttgccactcgactgggtgggcatgtgcggcatcgccttgcctattttgattgacggtcagtgcctgaccgccactgccgatgccggcgtcagcctggacgacggcacggcccgtggcattcatatgtcacgcctttacctggcgctggaaatgctcgaccagcaaccactcacacctgcacttctgcgtaatgtactgcttcgatttctcgccagtcatgaaggtttatctaagaacgcctacctgcgtatccacaccgatctgctgcttaagcgcccggcgctggtcagcccattagcgggctggaaaagttacccggtgagcatcgaagcgcggttggaaaaacagatgttccacgtggaactaaaaattgacgttacttattcttcaacctgcccatgttctgctgccctcgccaggcagctgattcagcagcaatttctcgaggacttcaccaactcaccgttgcagcacgaagacgtgttggcctggctcggcagcgccaatggcattgtcgccacgcctcatagccagcgcagcagtgcgcagttacacgttcacctgcaaggtaatgagctggcgatagtcgacttgatcaacagtgccgaagccgccctcggcaccgctgtgcaaaccgcagtgaaacgtgcggacgaacaagccttcgccctggccaacgggcagaacctgatgttctgcgaagacgccgctcgccgcctgaacctcgccttgaagcgctcggatgcggtcaaagccttccacatcaaagtgatccacgccgaaagcctgcacgcgcatgatgccgtggctgaaagccgctggacgagtgacctggcatgatcacctgtaacgctctgcgctggggtgctcccggtcaaccactgacgccggcactggatttgacgctggaaaaaggcagcctcaccggcatcatcggcgccaacggcacgggcaagagcagtttgctcaaagtcattgctggcctgcaaaagccattgtcgggaaaggtcagcatggatgttccacgccgtggtggcctgtcgttcctgccccagcagcaacacttggatcgccagttccccatcagcttgcaagaattggtcgccgccggtttttggcgtacccggtacaccagcgaggaacgcagccaacgcctgcaagcggtactggacgactggtgcctcagtggcctggaacatcgaccgttgatggcgttgtccggaggtgaactgcaacgtgccctgctcgcccgcatgagcttggccgacgcgccgatcctgttgcttgacgaaccccacgccgccctcgacgaggacggccaggccctgtgctggcaacatatccacgcctggcatagtgagggccgcacgctgatcgtcgtctgtcatgacctggcatctgtgcgatatcacacccagcaggtggtgcagatcaagaacaccggctgcgtcttcggccccagcaaggcgctgatccgcccgcaaccacagatgcaggtggcctgatgcaccttagcgcccacctgtggatgccgttccatgaattcgtgtttatgcgccgtgcacttatcggcgggttggtgctcgcctgcagcaccgcgccgctgggggtgtttctgatcctgcggcgcatgagcctgatcggtgacgcggtggcacacggcatcttgcccggcgccgccctgggcttctggttcgcaggcttgagcctgcccgcgctgaccattggcggcctcggcgccggcctgagcatggccggcctggccgcgtggatcacccgtcgcaccggcctgcgcgaagacgccagcctcgccgccatctatcccatttccctcgctgccggcgtactgatcctgggccttgccggcaaacgcctggacctgctgcacctgctgttcggttcagccctggcggtggatcaaaccaccctcaccggcatgctctgggtctcaggtttcagcctgatcgccatggcgctgatctacaaaccgctgctgctcgacacccttgacccgctgtttctgcagactgtcagccgtctcggcccgcttgcccatggcgtgttcctgaccctggtggtgctgaacctggtgatcggttttcaggccatcggcgccttgatggtggtgggcttgatgatgctgccggccatcgcttcacgcttctggagccgacgcctgccggtactgatggcggtagcggcagtgctgggatgcctatcggtatggctagggttgttgctgtcgttctactactcactgcccagcggcccggccattgtgctggtggcaggcgccgggtatctgctgtccgtggtgttcggtccggtgcacggcttgttgcgccgcccgcctttgctttcatcccaatgaggtgtttcccgatgcgcgccctactcgtgctgttcagtctgctactgccgctttcgatggctcacgctgcggacaaactccaggtggtcaccagcttcagtattctcgatgacatcacccaccagatcggaggcgaccatatccagatcagcaacatggtcggcccggacgctgacgcccatacctatgaacccaccccggatgatgccaaggcactgctcaaggcccgggtcatcatcaagaacgggcttggtttcgagccatggctggatcgcctggtgaccagcaccgaaaccaaggccactgtggtcaccgctagcaaaggcgtgatttcccacaccatggacgaagatggcgaaaccattcccgacccacacgcctggcacaacctggccaacgccgaaatctatgtgagcaacatcaccaaggcgctggcagccgccgacccggacaacgccaacgcctacctgagtaatagccaggcctacctgaaacagatccatagcctgctggccgacgccaaggccaagttcagcgccctgccgccgggcaaccgtcgcatcgtcacctcccatgacgccttcggttacctgggccaggcctatggtatccagttcctcgcgccccaaggcttgtccaccgagcgtgacccttcggccgccgaagtcgccgcgctgatcacccagattcgcaaggacaaggtcaaagccgtattcatggaaaacatcaaggatgcgcgcctgctcaaacagatcgctgatgaaagcggcgcacagatcggcggcacgctgtactccgacgccctcgccgcagaaggcccggccagcacctttaccggcctattcgaatacaacctcaacaccctctacgcagccttgagcaagccatgatccgcaagaacccttccggcgacctgccggtgattgctgaatcggcctacgtggacaaaaccgcgatcatctgcggcaaagtcattatcggcgagaacgtgttcgtcggcccctatgccgtgatccgcgcagacgaagtcgacgccagcggcgccatggacccgattaccatcggcgccaactccaacatccaggacggcgtggtcatccattccaagtccggcgcagcggtgaccatcggcgagttcacctccatcgcccaccgctccatcgtccatggcccctgtacagtcggcgatcgcgtgtttatcggtttcaacagcgtgctgttcaactgcggcgtgggcgatggttgcgtggtgcgccacaactcagtggtcgacggccgcgacctgcccgccgccttctacgtgccctccaccactcgcattgggcccaacaccgacttgtcgcaattcccgccggtgagtgtcagtgcctcggagttttccgaagacgtggcgcgcaccaacgtcgacctcgtgcgcggctacaaagccctgcaaaacgagttctgagccagcacgcgctggtttccgggcacctggcctgtcacaacggccagggccgtcccgcatgttctgcgttaagcgcggggtttgaccgtaccgcaatcgttgcccagccattgggcgtggctgtccaggctgcctttctgctggatgccggtggcattgaacgtaccgttgacggtggtggtgaattctttctggctctggaacgtcgctacgcctgtgccttgtgctttcgggcagctgaaacggaatttccactggttgccgctcttgtcagtcacttcctgtttgcaacccgattgagggtcggtcagcgggatagagtcggaggcaacctgggcaggggtaaggcacacctgcacacccttaccggccatgttgatgccttgcttttcgagcatggcgcgctgttcaggggtcatctgttgcttgagctgaccgaggatcagcgacaggtccggcaggtcctggttatcgaccttcatattgctggtggtcaattcccacaagcccggcgccagcatctgcgcctgcgccgccaccggcagcgacaacccaacaaccatggccaaacctagcagacgagcattcatcgggtaactcctgggtaattgtcggcattagacgtcgtaaagcagccagtgttgcacggcaaataaaatagcgacattcgccgtcgttcatggtctgttacgcactggactgcctggagttacgtcgttcatggatttctttggcccgcacctgctcgcctacttcattgccacgctgcacgttctcgggagcctcgccgcaattcacgcggtactgaccgtccgcaccgcccagggctcgatcgcctgggccttgtcgctgatgttcatgccttacctgacgctgatcccctacctgattttcggccgcagcaccttcgacgcgtacatccaggcccggcgccaggccaaccaggaaatgcacacggcgatcaccgagctgaactggcgcccatgggtagaggaagccctcgcggcacgcaactccagcgcctatgcctccctgcgcgccatgcccaagctggggcgcatgccatgcctagccaataacgaagtgcgtttgctgatcaatggcgatgccacgttcggcgcgatcttcgaggccattcgcaacgccaacaccgccgtgctgttccaattcttcatcattcatgacgatgaactgggccgccagttgcaggccctgttgaagcaaaaggccgcccaaggcgtggcgatctacgtgctgtacgaccgcatcggcagccatgccctgccccatcgctacgtgcaatcgctgcgcgacgccggggtgcaggtcaaggccttcgccacccgcagcggctggcttaatcgtttccaggtcaactttcgcaaccaccgtaagatcgtggtggtggacggcctcaccgggtttgtcggcgggcataacgtcggcgatgaatacctgggcaagaaaccaccgttggcgccatggcgcgacacccatgtgcaggtcaccggcccggtagtggcgtgtctgcaggaatcgtttgccgaggactggttctgggctgcgcgggagctgccaccactgattctgccggacgcttatcctgaagacggcgtgctctgccaactgctcgccagcggcccggccgacccctatgaaacctgctcgctgtttttcgtcgaggccatccacgcggcgaccgaacgagtctggatcaccagcccctacttcgttcccgacgaagccgtatttgccgccctgcgcctggcggtgctgcgtggggtggacgtgcgcctgctgctgccatcgcggcccgaccaccgcattgtgtacgccgcgtccagcctgtacgccatcgaagcggtgcgcgcaggcgtgcgggtgttccgctacacgccagggtttctgcatcagaaggtggtgttggtggacagggaaatcagcgccattggcagcgcaaatatggacaaccgttcattccggctgaatttcgaagtgatgttgctgacggtggatgaagccttcgccagccaggttgaacacatgctgctggacgatttcgccctgtcccatgaggtcagccaggaggaaagccgtgagactcgccgcctgcagcaattggggatgcgggtggcgcgcttgatctcaccgatcctctaacaaacaacacagggaaaatgtgggaggggattgctccctcccacatatggatcttcagtgttctggaaaacgggttagcgatagagatcttcccgcgtccagggcagttcatggctgccatcggcgtgaggtttcaccgccaggatctggtgcaggttgatccagccccgggcaaacgcataagcgcaaccggccaggtacagacgccagatgcgcaacgcctgctccggcaccatcttcgccgccgcttccaggttgtcttccaggcgctcgctccaatgatccagagtgcgtgcgtagtgcaaacgcaggctttcgacatcgaccacttcgagcccggcttcactgatctcagcggtcatcatcgccaggtgcggcagctcaccattgggaaatacgtagcgttcgataaagtccccggcgccacggcctactgggcggccatcggtgtgcttggcggtaatgccatggttcatcaccaggccaccttcgcgtacggcgccaaacagggttcggcaatattgcgccaggttggcatggccgacgtgttcgaacatgcccacgctcaccactttgtcgaaacgaccgtcctggggcaggtcgcggtagtcgagcagttgcaggtcgacctgatcttccaggccttcggctttcacgcgctccttggccagcgccagttgttccttgctcagggtgatgccaaacaccttgaccccgaattcccgcgccgcaaaccgcgcaagtccgccccaaccacaacctacatcaagcaaatactcacccggctgcagccgcaacttgcggcacaggtggcggaatttgtcttgctgggcctggtcgatggattcgctgccggtttcgaaataaccgcaggagtacgccatgtcctggtccagccagagctggtagaactcgttggacaagtcgtagtgataggaaatggctgctgcgtcggtggccttgtcatggatagagcgcaccggacggctgccctcgtcgtcatcgaccaaggcgtgactcagttcgtcacaaacccggatcacttcggcgatggagccttccagctccagtttgccttcgacgaaagcttcgcccagagagtcgagcgttggatggctcagcttggacacgaccgtgggatccttgaccacgatggtcacactgggctcggggcccaagttgaattcatggccgtcccagagtcgaagacgcagcggtagctgaagattctgtaaggccggtggaagttgcgcgagcatgagtagtccccccttgtttcagacgtctgctgtgagggtagaccatcctaaacaaagtaggaagctatcgatcgatagcacctttctatggcactcgtcgctcgagcaaaccgtcctggatccactgcttcagccatgtggccgcttgcagtggtgcgccctcttcataagtgactgccaactgcgcacacagttctgaaaaactccaaccggtggtcaccatccccgccagagcacaggcttcttcgggctccaggctgcggtagtggcacacattctcatggcgccacaccaggcagatttgcgccagattcagagcttggctgccggggaaatccaattgctccttgctggcgcgccagatcgccaccgtattgaaacggcaaagcaactgctgcactgagggcgcgagggtgacctgcaacgccggccagtcttcaggcgccagttgcgccatgtcattcaaggtcagcggcgcaccctggggcgcatcaaacgccagggtgaacgcccactccaagcgcgccatttcagccagcggcgcactttgttctgcgaccaggtgctcaaggataaacactgcaaagcgttcacccagccagcgcaggctgtagtgggccgagggatatcgacggatataggcttgggtcagcaaggcaaactcatcatctcccagccaataccagatggcgccgaagtcatggcgcagcacttcctgcaatcgcgacaggtaggcgttgtgataaatggccagccccgtgtctacatccagcgtcggcccacccagcaaggtggcggcaaagccactgttggcgatggacgtttcggacaacagatgctgctcaaaagccaactgccagtcgatcaggcgcataacgatctccgggccaaggcgctggtcccaagttcacgtgctttgctcaattcggtgagtaactcttcgaacggcgggaaatggtcatcgcgttccaacagtgtcgacaccggccccaagtgctccagggtctgctgatacagcgcccataccggatcgcacaccggatggtcatgggtgtcgaccacatagtcgccgtagtccatatgccctgccaggtgcagttggcgaatgctctggagcggcaggttgcgaataaacgtccaggcgtcgaacccatggttacgcgaactgacgtagacattgttgacgtccaacaacaactggcatccgctcaggtgggccagggcgttgaggaattcccactcggtaaagtcatcggccttggagcgcacatagctggagacgttttccagtaccagcgggcgctgcaacacatcctgtacctgacgcacacggccggccacgtgatagagactttcttcggtgtagggtagaggcagcaggtcatgcaactggtgcgcgttgccgcggctccagcacaggtgatcggaaatccactccggctggatgcgctcggcgagctgtttgatttgctccaggtaatcggtatcgagggcatggggcccgccgatggacaaggacaccccgtgcatcaccatgggatagcgctcggctatggcatccaggtagtacaaggctttgccgcccggcaccagataattctcggagatcacttcgaaccaatccaccgcaggggattgcgccaggatctgctcatagtattcgttgcgtaaacccaggccgtaacccagggaggggaaggaactgctcatcatgaactcccgcaaaagtgtccgcagcggtggagcgggaccgctgcggttgcactcggttgtcgcttactcgccgactttgccgccagcctcgtcgcaagcagccttggtcatagccttgaagccgtggcctttgcagacagcctggcctttgcaggcgttttcggcggtcttgcaatcgttcatgcctttgcaggaggtgacgccgtaacaatgaacggatgcatcggcagcctgtacctgagtggcgacaccggcaaacatggaggcggcagcgatagccagggcagcaccggaaacagcgtgtttgatgttcattgtgtagtcctcatagatctgtagtggagtcggtctgaacggattgcgcagtctcgacacaccactagagtgaggccccttatcagcgttacagctgtgagcaaatttttccgaaattaatcctcaagcttcaacagcggctcctggaagcgcaataaacgcccggcgttacccagcaccagcaaggtgctgagattatgtaacaccgccgcgatcatggcgcccgccgcacccagccagccaaacgctgcgaacactacgatggccagggtccagcccaagccgatgatcacgttcacctgcaacgtctgccggcaccggcgactcaagcgcacgcaggtgcccaggcggcgcaagtcgctgccgatcaacaccacgtcagccgacgccagggcgatgtccgcaccgcccgcgcccatcgccacgccgaccacaccggccttgagcgccagggagtcgttgatgccatcgcccaccaccatcggccggaagccgctgctgatttcccccagcacgcggttgagcttgtcttccggcagggcctgggcttcgacatcactgatgcccacatccagcgccaggctatcggccacgctctggcggtcaccggtcagtagcaattggcggcccaggcccaagtcccgcagttcttgcagggcctggcgcgcttccggcttgacgctgtcggccagcaacatccaggccaggaactcgccgttcaacgccagcccggcgatcgggccgtcatgggtgggaacgccggtagtgacgatgcccaactgttcgaacaattccgggcgcccgagcgccgcttcgccctgctcggtctgcgctaccacacccaggccctggcgctcgcggatgtcggtgagtgccagcatttgttcctgggtcgccaaccccgccaacgctcggctgaccgggtgactgctcgcggagccgaggctggccgccaggttcagcagcgtctggcgatccggcgcggtggtgtcgatagactgcaggcgcaaagtgccaaaggtcagggtgccggtcttgtcgaccaccagcgacgtcaggtcagccagctcttcgaggaacgccgagctgcgaatcagaatcccgtgacgcgccgccacggcgatcccggcaatcgccgtggccggcgccgacaacaccagggcgcacgggcatgccgccaccagcacggcgagcatggcctgggcgtcattggtaacaaaccaggtcaccgccgccagcaacagcaccagcaccatatagctgccggcataacgctccagcagccgggtgatcggcggcttggaacgctcggcgttctgcatcagagcgatgactttgcccagggtcgactcattgccgatgcgcgtcacttcaaggcgtaacaaaccatcgaggttgatcgcacctccaaacacctgcacgccgacgccggcttccaatggcaccgactcgccggtaatcggcgccgtatccaggctcgcctggccggatagcactacaccatcggccggcacgcggtcaccggcgcgcacttcgacgatatcgccggtgttcagggtgccgttatccacttcggtgatggtgccgtccgcgtgcaccaggcgggcgtggctgcgggtgagtttgcccagggcatggatcgcttcctgggagccgatcacgctgcgctcttccagcacatgcccgaagatcatgatgatcggcaacagcgccgcggtcagcaggtcgccggtggcccaggcgcccagcatggccagggcgatcaattggtcagtgatgccgtgcaggctcgggaagcgcaggctgtaccaggccgaacgcatcaccggcaccgccaccaacagcgaagccacgcccagcagcaactggctcacgccgctctggtccggcgccagccagcgccataccagacccagtaccaacagccccaaggcgagcatggccagggtcaattgccgggcagcgctacgctgttcggcggaagtcagcatgggtgcgctcattgttcggctccctggatgatcaagcgggagtcgtccttggggtcgacggtggtgacagaaccggcctggccgagaatcttcggcatgcgctcgcggtacagccgcaatagcaagccaggatcttttacctgggccaggctggcgacagtagcggtttgcgcctgggcattggccaagcgttcgctggcctgggcgtgggcgacttgcacctggcggtcagcttcctgattggcgctctgggtgagtttttccgcttcggtgcgcgcattggccacggctttatcggcttgctggctggcggtcagtaccgcattgaaagcattcaccgccgggcccggcaggcttgattgcacatcgacgcgggtgacttcgacgcccaggcccaaaccgttggcggccaactgcgccaggcgtttgttgatgccttgcaccagatcgccgcgcagccgctcacggcgttcggcggcgccgttgtcgctgccgatcagttccgggcgggctaccaggatggtgtccagatcccgcgccgcggtgagggccacagcgctgcgggtcaccagccgatccagggcaggcaacacatgctcgccttgcaatacgaaagcgtagggctcggtcaccttatagaaaacccgcacgtccaactgcactaccccggcatcgcccgtcagcagataaccggagccagccaaggcatcgctcaacggcgtagcgaaactggccacgcgatcagcctgcagcgccgcgtcggaacgtagcaggttttctacccggcgctcgatcacccggtccgctgccggcagcaacaccacctgctcgaagggctgcggccaggccagcaacagcccggcgttctgaatgcgatcaagggcgccgaagtgcaggaccacggcgcgattctgcgggtcgatctggcgcacattggaaaaggcccaggccaacgccgccaacacggtgaccgcgtacagcgccaggaacgtcaggcgcccggcctggatccatgggctgtccgggctgtcacgctcgctcatggctggatgtccttcggcccatccaccaaggcgcggaacggcgcagcatcggtgcgcaggatgatcttggtgcccggcgtaaccacggtgcccaaggtgtccagcgagcgcagcaggttgtacagctgcggattaccggcgtaggcacggccataaatctgcgcggcttcgacccgcgattgtgcttcgatatcggcggctttcaccgtggcatcggcctgcacgatgcgcgcatcacgctcggcggcagagcggatctgcgctgcttcgcgcttgcccacggcagtgcgctcggtggcgatggtttcacgctcggcacgcatgcggtcaacggtggcggtgagggtcaccgaaggcaacgtcaggcgctcgatgccgacttgggccacacgcacgccataggtggtgagcaattgttgatcaatctgctggcgcaactgcgcttcgaaatcagcaatgcgcacttggctggcatcggtattgatcaggctggacaggtcaaagctggccgcggtggtctccagcgccgaaccgacgaaggtgcggatctgccgtgccgcttcatccggctggttctgcaccgcgcgcataaagcgctgcacattgtcggcatcgccctgcacctgccacgccacataagcctgcacaataatccgcaggccatcgcgggtgcccacgtcctgcaggccgctggacgtggtgcgcaggcgcaggtccaccgggatcgccgcttcgaacggcgctggccagcgccagcccaggccaggttccaacagcacccgtgcggggttgccgaagcgggtaatcaccgtggcctcgccggagcgcacctgcacaaggcttgccgctgccacggcaaacagcaccagcaacaccgcccaggccatacgacgccaaggaaaaggcccgctcgcctgctcatcgccgtgatggtgatggtggtggccgtgatgatggtgatgaccgtgatcgtgagaatgagcgctcaacagacagactccttattgaacggctttgcgcggcaccgacggatcggcgggcaaggtaaaagaacgcagatcaatcgtcggcgcactgccggcacccaaacgatgatccagaattagcagcttggcgtgggccaggccctggctcagttggcccaggtactgttccagcacgaaggcctggccagcggcggcataggctttttgttcggcggcaaagcgcaggttcgccgcttgcgcgccagcattcacctcgcgggcgttggcctgggcttgatcccgggcagtgctggcttgcaacagcgcttggttggtctgctcgctggcggcgccgcgttcccgggcgatcagggcctgggcgccgatctgcgcggcttgcacaccgtggtaagcgttggcggctccagcgggcgggtgaatcgcttcgaccaccgtggcaaggatctccacaccactgtcgagtgtttgcagatcggcttgcacactgcgaccaatttcgtcggcgaggctggtgcgttgttcaccgagcaattcgtcaagggtgcgcgaggcgaagtcatgcaccaggatgcggctggcggtactgcggatcagggtcgggatatcagcgctgttataggtggcggcgagcgcggcctggtcggtaaggccgatacggtagacaaaacgcacgtccatattgacgatctggaagccctgcttatcgccgctgctgctggcgatgacctgggatttgtcatttacatggctggcgtcccacaggcggttggcgatcaacggcgccgggccttcggcagcggccaacggcgcagtggcggcttcactgacgctggtcgccagctcatgcaccacgccgttttcgatgttcagcacacggcccaacggccacggtaaacccgcatgcaggccggggccgaacacctcgaccggtttgccaaagcgctcataaatcccacggccttgcaggggcacctcatgcacgccggtcagcgcccaaccgaccgccagcaccaccagcagcaccggcaaaaacgcccggcgcatgtaggtaaaggcccagatctggcgcaggtcgataccgaaacggttgtgcaattcatgctgcaacgccagcaagggttgtggcggccaacgcagcaggccggcgataaaactctgggccatcaagcgcggttcgagacgcggctggcgcgggctgaacagcgacagcacacccctgagcaggaactccagcgccaccagtgccggcagcaggccgatcagtgtcgccaggcgcagtggccaaaccgactcggcattggcaaacagcaggcagattgcactgatcaccaggcagataattgccacccggctcaactgcgccagctgtgacgcttccggccattgggcggcggtttcctgggcgaggcgacgttcaaacaccagcagaccgaacgccagcgccaacgccagcgccgcgccgatgcttgccgattgaccgacggccgcagcgggcaaggccaggttccagaactgggtaacactgatcaacgccagcagcgaccagccacccaaccacaacaccggcgcgccgacctgggccagcagaccattgccgaaacgattgatcagacccttgtgccaagtggtgggctctctgggttcttcgaccagttcaacgcttggcgcctccagcgcctgggcgcgccaatcggccacccaccaggccgactgcaagccggcgaccagtaccaacaaggccgaagcgcagttgatcaacaccaccggccagatcgacagtggcgcaaacaacgccacgaacaacgccagtacccaagcactgatggccagggtcgtcaggctgatgccggcctggcgcagtcgacgggcatggaacaacccttgctggaaacgcgcaaggccctctaccgaagcgccgtcagcttctagatccacttgcatccactcaacgcccgcgtgtacataattcgttacgatataacacgaagcgtgaaatttttgttcgcttttgaactcagcctggatccctgtgggagggggcttgctcccgatggcattgggtcagtaagtagatgggttggctgatgcactgctatcgggagcaagccccctcccacatttgcctcacggtgttctctggattgtgactacccccctataaacacgagctatcactagtgtcggcggcaataagtcggcacactcctgaacagtttttcgcgggttcacggacaaggaagcgccaccccccatgatttccatctaccaactcaaaccgcggttccagaacatgctgcgccccctcgtgcagcgtctctacgacaacggcaccaccgccaaccagatcaccctgctggcgggggtgatttccttgctggtcggcttgctgattgctgctttcgcccagcagctctggctgtttgcactgatcccgctgtggatgattgtgcgcatggccctcaacgccatcgacggcatgctcgcccgggaattcggccagcagtcaaggctcggcgcctacctcaatgagctatgcgatgtgatcgccgacagcgcgttgatcctgccctttgccttgatacccggcgtgagcctggcgccggtattactggtgacgctgctggcggtattcagcgagtacgccggggtgctggggccgatggtgggtgcatcgcgtcgctatgacgggccgatgggcaagagtgatcgggccttcgtactcggtgtgctggccaccggcgtggcgctgggctggctcggcgccggctgggtcgagtcggtgatgtggctggtggctgccctgctcgcctacaccttggtcaaccgggtgcgtcagggcctcaaagaacaacaacacactcccccttctgcataaggattttgcgatgcgcgaacagcaacagcacacctgcagtacccatgatggcgtcgagcttttctaccggcactggccggctacggcaggcgccgggccgcgcaaggcaatcctgttgttccatcgcggccatgagcactccgggcgtattgcccacctggtagatgaactgggcttgccggagtttgattttttcgcctgggacgcccgcggccacggccaatcgcccggcgagcgcggcgacagtcccagctttgccaccagtgcccgtgatgtgcagaccttctgtgaccacatcggcgccacctacggcatcgaagagcaaaacctcgccgtgatcgcccaaagcgtcggcgcggtgatcgcggccacctgggtccacgactatgcgccgaagatccgcgccctggtgcttgcctcgccggccttcaaggtcaagctgtacgtgcccttcgcccgcccaggcctggccttgatgcgcaggttccggggcaactttttcgtcaacagctacgtcaaggccaagttcctcagccacgacccggagcgcgtagcgtcctacgacagcgatccgttgatcaccaaggccatttcggtgaatgtgctattgggcctctacgaagcagcggatagggttgtagccgatgcacaagcgattcaggtgccgacccaactgctggtctccggctccgattttgtggtgcaccgtaaaccccagcagcagtttttcgaccgcctcggcagcctgaaaaaagagctgcatatcctccccgggttcttccacgacacccttggcgaacgtgaccgtgccgtggccgtgaacagcgccaagcgctttatcctgcagaacttcgcccacccgctggatcgcgcctctctgctggacgctgacaaactcggcgccacctgtgccgaatccgaatcccttgccgcaccgctgccacgcaattccctgcgcgacctgtactggcgaatgacccgcgccagcatgggcctgggcaagaacctgtcggacggagtaaagctgggcttcgacaccggtttcgactccggcagcaccctggactacgtgtaccgcaacaaacccaccggcaagggcggcctggggcggatgatcgacaccaactacctcaactccatcggctggcgcggtattcgtcagcgcaagctgaacgtcgaagagctgctgcgcctggcgatggccaagctgcgtgaggatgatcgccaagtacgcattgtcgatatcgccgccggccacggccgttacattctggaggccttgcagggcgtgtcgccgttgccggaatccatcctgctgcgcgactacagcgacatcaacgtgcgcgacggtggcgcactgatcctcgagaagggcttgggggacatcgcccggttcgtcaaagccgatgcgttcgaccgcgccgacctggccgccctggaacccaagccgaccttggccgtggtgtcgggcctgtatgaattgttcgccgataacgccatggtcggcggctcactggcaggcttggccgaagccttggagccaggcggttacctggtgtataccggccagccatggcacccgcaacttgagctgattgcccgtgcacttaccagccaccgccagggccaggcctgggtgatgcgtcggcgcagccaggcggaaatggaccagcttgtcgaagccgcgggctttcgcaagatcacccagcgcgtggatgagtggggcatctttacggtatccctggcacagaagatctgaacatgcgcgaacccggtctattgaaaccagcggccctctggctgctgctattggcgccgctgttcttcagcacctatggcttcgccacctgggtcaccagccaacgcagcgatgtcggcacgctggtgtttggctgggaaacccatataccgttctgggcctggaccatcgtgccctactggtccatcgacctgctctacggcttctccctgctgttacccaatacacgccatgaactgaaacaacatgcactgcgcctgctgagtgcgcaggtcatagccgtcagttgcttcctgatctggccgctgcgcttcacattcgagcggccggaactggacggcgtgttcggctggctgttcgcggtgctggccggttttgacaaacccttcaaccaggcgccgtcactgcatatcgcgctgctggtgatcctgtgggtcatgtatcagcggcacacccagggtttctggcgttgggtagtgcatggctggttcaccctgatcggtctctcggtgctgaccacttatcaacatcactttatcgacttacccacaggcgccctcgcggggtggttgtgcgtgtggttatggcctgtggaacacccgagcccattgttgaatgcccgactgacgcgggacccccaacgctggcggatgggagtgcgctatgggctgggtgcattgatactggcggtgcttgccttcgtgctcggcgacggctggctgtggctgctgtggccggcggtgtccctggcgttgatcaaggccaactacctcgtgctaggcgcgtcaggctttcaaaaacgcgaagatggccgtcttactcccgccgcgcgctggctatatgcaccctatctagctggtgcgtggatcaattcgcgcctgtggacacgcaaacatccacagcccgacctgattgtggataacgtctggctcggacgcatccccacatcgcgccagcaaggttcattcaaggccattgtcgatctgtgcgccgaactgccgattaatccacagggcggcgcgtatgcctgcgtgccagtgcttgacctgatcgcaccgacacccgacgaatgcatcaaagccgcgcacgctatcgagcaactgcgccagcacgggcccttgctggtgtgctgtgccctcggttactcccgcagcgctaccgccgttgccgcctggctgctgaacacagggcgcgccgccacgctagatcaagcgctggctatcattcgtacagcacgggccaatgtggtcctgcaccccgcacatcgtgaagctttggagggtctgccccatgcccgctgatatggaactccaggtggtcgccagcctgctgcgccgtggccgctcactggatcagttatccacaggcctgacgctgctcggcgtactgttcggccttgcccagctattgttggccagtatctcgacgatctgcctgctgctggccctgtggatgatcgtactgggcctgctgcaaaaatactgggcattacgcgtggccctcgacgccgacctgtttgccctgctcgcccgcgacaccgcacgtacaccggacctcgaccaggccctgcaaacccttggcctgcaatcacctaaacgggccggccggccctggagcgaacgccgtcgtggcgcgctcaaactgttgcgcaaacaagcctggctgctgggcgcgcaagcgctgctgaccctgggcgtcatcctcgccagcccttggctgcctttcgccggataaggaatccccatgttcgaacccgtggtcgccacgctgattacttccatggcccgcaccgtcaccggcgctcgcagcctgtggctggggtgcgcgccggtgccggtgcaacgcatctatttcgccaaccacagcagccacggcgacttcgtgctggtatgggcgtcgctgccgcagaacctgcgcaagttcacgcgcccggtggcgggcagtgattactggaacaagagcgccctgcgccgctacatcatcaaccgtgtgttcaatggcgtgctgatcgaccgcgagcgcagggagcctgtggataaccctttgcaacccatgctcgctgcgttggaaggcggtgactcgctgattatttttccggaaggcacgcgcaatctggaggatggcttgctgcccttcaagagcggcttgtaccacttggcaaaaagttacccacaggccgaactggtgcccgtgtggatagccaaccttaaccgggtcatgcccaagggccgagtgctgccactgcccttgttatgcacaaccagcttcggtgctcccctgcaattggaagagggcgaagacaaagccgcattccttgcccgtacccgcgacgccctgctcgcccttgccccggagcattcctgaaatggatagccaaaccctgatgttattcggtggcatcggcgcgattctggtcatcgcctcgctgatcggcctgatcctcaagctgcgcacccgtggcagccccaatgccgtgatcgacaacctcaacgcccgcatcaacgcctggtgggtgatggtggtggtgatcggcatcgccttctggctcggcaccggcgcggtgatcctgttgttctatgccgtgtcgttctacgccctgcgagaattcctcaccctcaccccgacccggcgcagcgactacccggccctggtggccgcgttctacctcgccctgccgctgcaatatgtgctgatctacgccgactggtatgggctgttctcgatctttatcccggtgtacgtgtttttgctgctaccgatcctcgcctcccttggcggcgacagcacacacttcctggaacgtgcctcgaaggtgcaatgggggctgatgatcgcggtgttctgcgtatccttcgtcccagccctgctgacgctggacatccccgggtacgaaggccgcaacctgttgctgatcgcctacctggtgatcgtggtgcaactgtcagacgtattgcagtacgtatgcggcaagctgttcggcaaacacaagatcgcgcccaatctgtcaccgtcgaaaaccgtggaagggttcgtaggcggaattctgctgtcatccctgatcggcgcggcgctgtggtggaccacaccgtttaatccctggcagtcgttcctgattgcgctgttgatcaacttgctgggctttgccggtgggattgtgatgtcagcgatcaagcgtgaccgcggcgtaaaagactggggacatatgatcgaagggcacggcgggatgctggatcggctggattcggtgtgcttcgcggcgccgatctttttccatcttgtgcgttactggtggacctgatggttgaccagagcaccagccctcgatactgacaaagaacaaaatgtgggagggggcttgctcccgattgcggtggaccagtcaaggtatctgatgcctgtcacaccgctatcgggagcaagcccccctcccaccttggttcttgtgtgctttcaagaccattaggcagtgatctcgacgtagcgggactccccgcctcctgtcgcacccgatagccagccccaatcaaaactcagcgttgtgcgcccgtcacgatccacgcctaccgtgccacgtgaccaccccgcgagcagttccccttccagggtcacgcattgataaagcagctcgatggtatctgtaccggtcactcgcccgacctgcgtgcccaggcgaatccggccaccttggtaagtgcttgaaatgacgccatcttcaacttggtagtgaaatactgtccccgtgccggacagcccttgagtattgttcgcgaccgcaaaacggcggttatgcaaacgtgcgtgaacggtcgctgaagggctttgcattattggcatccttgagtggagcgaattcaaaaccataaaaaaggggctgttaaaaacagcccctcttcttcaggtacgcgagacagccttactccaccgtcaccgacttcgccaggttacgcggttggtcaacgtcggtgcccttgagcacggcgacgtagtacgacagcaactgcagcgggattgtgtagaggatcggcgacagggtgtcgtggatgtgtggcatgttgatcacgtgggtgccctcgccattggtcatgcccgccttctcgtctgcgaagacgatcagttggccgccacgggcgcgtacttcctgcaggttggacttgagcttctccagcagttcgttgtttggtgccacggtaaccactggcatatcgtcatccaccagggccaatgggccgtgtttcagctcaccggccggataggcttcggcgtggatgtacgagatttccttgagtttcagcgagccttccatcgccaccgggtattgcgcgccacggcccaggaacagggtgtggttcttgtcagcgaacagttcggcgactttttccacggtgctgtccatggccagggcttcgccaaggcgggttggcaggcggcgcagttcttccaccagggtggcttcgacgccctcggcgagggtgccgcgtacttggcccagggacagggtcagcagcagcaggcccaccagttgagtcgtgaaggctttggtggaggctacgccgatttcgcgaccggcttgggtcagcagggtcaggtcggattcacgtaccagggagctgatgctgacgttgcagattgccaggctgccgaggaagcccagttccttggcattgcgcagggcggccagggtgtcggcggtttcgccggactgggagatggtcacgaacagggtgtcgggctgcaccaccaccttgcggtagcggaattcgctggcgacttcgacctggcacgggatgcccgccagttcttccaaccagtaacgggcgaccatgccggcgtggtagctggtgccgcaggccacgatctgtacattgcgcaccttggcgaataactcggcggcttgcgggccgaaagcgttgaccaacacttggttctggctcaggcgaccttccagggtgcgttgcaccacagacggctgctcgtggatttccttgagcatgaagtggcggaactcgcccttgtcagcggcttcggcaccgtcgcggtattgcacggcttcgcgctcgacggactggccgttaacgtcccagatctgcacgctttcacgacggatgtcggcaatatcgccttcttccagatacatgaagcggtcggtcacttggcgcagggccagttggtcggaggcgaggaagttctcgcccagccccaggccgatcaccagcgggctgccactgcgtgcagcaaccaggcgatcaggctggctggcgctgatcacggccaggccgtaggcgccatgcagttccttgaccgtggccttgagggcggtggtcagatcgctgtggtccttgagcttgtggttgagcaggtgggcgatgacttcggtgtcggtgtccgaggtgaacacataacccaggcccttgagttgttcgcgcagcacttcgtggttttcgataatgccgttgtgcaccaccgccaggtcaccggagaagtgtgggtgagcgttacgctcgcatggcgcaccgtgggtggcccaacgggtgtgggcaatgcccaggcggcctatgagcggctcgccggccaaggcctggtccaactcgctcaccttgcccggccggcgcatgcgctccagcttgccggcattggtgaaaaccgccacgccagcgctgtcataaccgcggtactcgaggcgcttgaggccctcgataaggatggcagtaacgttacgttcggcgactgcgccaacaattccacacatggtatttctcctagatgacggccgcgcatatcagcgtaatgccgcgggcttggatctggtcgcgggcctcaagcggcaggcgatcatcggtaataagggtatggacgctgctccagggcagttccaggttgggaatcttgcggccgatcttgtcggactcgaccatcactacgacttcacgggcgacctcggccatgacgcggctcaggcccaggagttcgttgaaggtggtagtgccgcgctgcagatcgatgccatcggcaccgataaagagctgatcaaaatcataggagcgcagcacctgctcggcgacctggccctggaacgagtccgaatgcgggtcccaggtgccgcccgtcatcaacaacaccggttcgtgttccagttcgctcagggcgcgggccacgttcagggagttggtcatcactaccaggccgggctgatggcccagttcggggatcatggcggcggttgtgctgccgctgtcgatgatgatgcgtgcgtgttcgcgcaaacgcaccactgccgcacgcgcgatggcgcgcttgtaagccgagatgggttgtgcggcgtcgcctacaagctcctggggcatcgtgattgcgccaccgtagcgacgcaggagcaggccattgctttcgagggcggccagatccttgcggatggttacttccgaagtttcgaaacgcttggccaattcgtccacactgacttcgccctgctcattgagcagagtgaggatattgtggcgtcgttgaggtgtatttcgtttcgacatggtgatgataagtttcgtttcgaaagataacgaaggcaatcaaaacctattggcgaaagatcgtcaagtgagatctctaaataatgcaggcaaaatgtgggagggggcttgctcccgatggcggtgtgtcagccaatgtatatgtgactgaaccaccgctatcgggggcaagccccctcccaaattggagttttgctgctggcgaggctgtggataaatcaggttttcttgattttcaccgggcgcttccaaccgtcgatgttgcgttgacgggcgcgggcgacggccagctgcgacttatccacatcctggttgatggtggaacctgccgcggtgtttgaaccatcacctatggtgaccggcgcaatcaacgagttgttggagccgatgaatacatcctcaccgatagtcgtctggtacttattggcgccgtcgtagttgcaggtaatggcaccggcgccgatgttgctgcgggcaccgatcactgcatcaccgaggtaagccaagtggccggccttcgcgtcgtcacccattctcgcgtttttcagctcgacgaaattgccaacgtgcgctctcacgcccatcactgtacccggacgcaaccgtgcaaacggccccgcatcgctaccctcgcccatcacggcaccgtcgatatggctgttagccttgaccaccacgcctttgcgcaaggtgctgtccttgatcacgcagttcgggccgatgaccacgttgtcttcaatgatcacgcggccttcgaggatcacgttgatatcgatcagcacgtcgcggcccaccgtcacttcgccacgcacatcgaaacgcgccgggtcacgcagggtcaccccctgggccatcaggcgcagaccttcgcgcagttggtagtgacgctccagctctgcgagctgcttgcggtcgttggcgccctgcacttccatcgggtcgtggggctgctcggtggcgaccagcaggccgtcactcaccgccatttcgatcacatcggtgaggtagtactcgccctgggcgttgttgttggacagacggctcatccagtcgcccagcttatcggcaggcacggcaagaatgcccgtgttgccttcagtaatggcgcgctgggcttcgctggcatccttatgctcgacgatagcggcaaccttgccgtcggcattacgcacgatgcggccgtaaccggtagggtcgtccagctcaacggtgagcagccccatctgtccaggcacgacatgcttgagcagacgttgcagggtttcgacttcgatcagcggtacgtcgccatataggatcagcacggtatcagctgtgatgaagggtacagcctgcgcagtggcgtggccggtgccgagttgtttgtcttgtagaacgaaattcaagtcgtctgcggcgaggcgttcacgcaccacatcggcaccgtggccgatcaccacgtgaatgcgctgcggatccagctggcgggcgctgtggataacatggcccagcatggaattgccggcaaccgggtgcagcaccttgggcagggccgaacgcatgcgagtgccctggcctgcggcgagaatgacgatttcaagagacatgaatggctaccaatcctgggcggtccgggttcagaccaaagaagtgttttgcaaaaaaagaaaaagggtagccgaggctaccctttttaatcaatcacacatgaagcgtaacggcatggccgcttacttcttgcggatctgctggagcgtgcgcagctgggctgcagcttcggccagacgaactgcagcagcgctgtagtcgaagtctgcgcctttttcgttcagcgccttctcggcagccttgacggcttcctgagcggaggcttcatccaggtcgccagcacgttgcacggtgtcggcaagtaccttgaccatgttcggctgaacctcgaggaaaccaccggagatgtaaaacacctcacgttccccgccttgcttggtcagagtgatcggacctggcttcaagctggtaatcaacggagcgtgacccatggcgataccaagatcacccaagtcaccgtgcgctgttacaaactcgaccagaccggagaagatttccccttccgcgctgacgatatcgcaatggactgtcatagccatctgattgcctcaacctgatgagcgcccgttgccgggcgcctggattacagtttcttggctttctcgatcgcttcttcgatgccgccgaccatgtagaacgcttgttctggcaggtggtcgtagtcaccgttgaggatgcctttgaagccagcaatggtgtctttcagggaaacgtatttacccgaggcaccggtgaagacttcagccacgaagaacggctgcgacaagaaacgctggatcttacgagcacggtttaccaactgtttgtcggcttccgacagctcgtccatacccaggatcgcaatgatgtccttcagttctttgtagcgctgcagcacgtactgaacgccgcgagcggtgtcgtagtgctcctggccgatcacgttcgggtccagctggcgcgaagtcgagtcgagtggatcgaccgctgggtagatacccagggaagcgatgtcacgggacagaacgacggtggcgtccaagtgggcgaaggtggtggctggcgacgggtcggtcaagtcatccgcaggtacgtataccgcttggatcgaggtgatcgaaccttccttggtcgaagtgatacgttcttgcagaacgcccatctcttcagccagggtcggctggtaacctactgccgaaggcatacggcccagcagtgcggatacttcagtaccggccagggtgtaacggtagatgttgtcgacgaacagcagaacgtcgttaccttcgtcacggaacttctcggccatggtcaggccagtcagggctacgcgcagacggtttcccggcggctcgttcatctgaccgtaaaccagtgccactttgtccagaacgttggagtccttcatctcgtggtagaagtcgttaccctcacgggtacgctcacccacaccggcgaacacggaataaccgctgtgctcgatggcgatgttacggatcagttccatcatgtttacggtcttgcctacaccggcaccaccgaacagaccgactttaccgcccttggcgaacgggcaaaccaggtcgataaccttgataccggtttccagcaggtcgttgccgcctgcttgctcggcgaacgaaggcgcggcgcggtgaatgccccagcgctcttcggtggcaatcgggccagcttcgtcgatcgggttgcccagtacgtccatgatccggcccagggtcgctttaccgaccggtacggagatggcagcgccagtgtcgacaacgtccagaccgcgcttcaagccttcggtagaacccatcgcaatggtacgaactacgccgtcgcccagctgctgctggacttccagggtagtttccgcgccttgtactttcagcgcgttgtagatgctcggtacgctgtcgcgtggaaattccacgtcgataacggcgccgatgatttgaacgatacgtccgctgctcatagctggatcctctgaatatttgaaccgttaaaccgcggcagcgccgccgacgatttccgagatctcttgggtgatcgcagcctgacgcgccttgttgtagatcagctgcaaatcgctgatcagatcaccggcgttatcggtagcgtttttcatcgcgatcatccgcgccgcttgttcagctgcgttgttctcgaccaccgcctggtacacctgcgactccacgtagcgcaccatcaagccatcaagcagctctttggcgtctggttcgtagaggtagtcccagtggtgcttgagttcctgatccggggtcgccaccagtggaatcaattgctccacggttggctgctgggtcatggtgttgatgaacttgttggataccacggacaggcggtcaatccggccttccaggtacgcatccagcatcaccttcacactgccgatcaaatcattgatcgacggctcttcacccaggtggctgatagctgcaacgacgttaccgccgaagttacggaaaaaggccgcacccttgctaccaacaacacacagatcgatctcgacgccgttttcgcggtttaccgccatgtccttgaccagggccttgaacaggttggtattcagaccaccacacaaaccacggtcactgctcactaccacataacctgcacgcttgacggcgcgctcgatcatgaacgggtggcggtattccgggttggcgttggccagatgcccaattacctggcggatacgctccgcataaggacggctagcagccatgcgcatttgtgccttgcgcattttgcttaccgccactttttccatggcgctggtaattttttgcgtgcttttgatgctcgcaatcttactgcgaatctcttttgcgcctgccatgtaacacctatcaggttagcaagcgggagccttgcggctcccgctgcggcttaccaggtttgggtggccttgaacttctcgataccggctttcatgccagcgtcgatatcgtcattgaagtcacccttcacgttgatcttcgccatcaattcggcgtgatcgcggttgaagtaagcaatcagcgcttgttcaaagctgccgaccttggcgatttcaacgtcggtcaggaacccacgctcagcggcatacagcgacaacgccatgtcagcgatcgacatcggggcgtattgcttctgcttcatcagctcggtaacgcgctgaccatgctcaagttgcttacgggtcgcttcgtccaggtcagaagcgaactgggcgaatgccgccagttcacggtactgagccagagcggtacggataccaccggagagcttcttgatgatcttggtctgagcggcaccacccacacgggataccgaaacaccggcgttcacagcaggacggatgcctgagttgaacatggccgattccaggaagatctgaccgtcggtgatggaaatcacgttggtcggaacgaacgcggaaacgtcgccagcctgggtttcaatgatcggcagtgcggtcagggaaccggttttgccggtcactgcgccgttggtgaacttctctacgtactcttccgaaacgcgggatgcgcgctccagcagacgggagtggagatagaacacgtcgcctgggtaagcttcacggcctggtggacggcgcagcagcagggaaatctggcggtaagccactgcctgctttgacagatcgtcataaacgatcagcgcgtcttcaccgcggtcgcggaagaattcacccatggtgcaaccggagtacggtgccaggaattgcagcgcaggagattccgaagcactggcagccacgatgatcgtgttggccagggcgccgttttcttccagcttgcgaaccacgttagcgatggtcgattgcttctgaccaatggctacgtagacgcagaaaatgccgctgtctttctggttgatgatcgcgtcgatcgccagggcggttttaccgatctgacggtcaccgatgatcagctcacgctggccacggccgaccgggatcatggcatcgacagccttgtagccagtctgtacaggctggtctaccgacttacgccagatcacgcctggagcaactttctcgaccgcgtcggtctcggtgttgcccagtggacctttgccgtcaactggattacccagtgcgtcgactacgcgacccagcagttccttaccaaccggaacttccaggatgcggccggtgcacttggcgctcatgccttcagccagactggtgtacgcgcccaatacaacggcacctacggagtcttgctccaggttgagggccataccgtagacgccgcccggaaactcgatcatctcgccgtacatgacgtcggccagaccgtgaatccgcacgatgccgtcagatacgctgacgacagtgccttcgttacgggcttgggaggtcacatcgagcttgtcgatgcggcccttgataatttcacttatttcggaaggattgagttgctgcattgctctgctgccccttcaaactcaagatttcaatgcttcggcaagtttcgcgattttgccgcgaatcgagccatcgataaccaggtcgccggcacggataacgacaccaccaatcagggatgcgtcctccgaagcttgcaggcgcacttcccgattgagtcgtgcactgagaaccttggcgagtttgtcttgctgttcttggttcaatgcgaaagcactggtcacttcaacgtctaccgatttctctgcttcggccttgtacaggtcgaacagagcggcgatctccggcaataacgggagacggtcgttttcggcaatgacgtgaatgaagttctgcaccttcacatcaaacttgtcgccgcacacttcaataaaagtggcggccttgtctgcgctcgtcaggcgcggggccttgagcacgcgctgcatggtgtcgtcttgcgacactgctgcagccaggccgagcatggctgaccaagaggccagctgctggtgggcctgggcgtgctcgaaggctgccttagcataaggtcgggccaacgtggtcagttctgccatgatcgccctcgcttaaatttcagcagccagtttgtcaaccagctccgcgtgcgcgttttgatcgattgtggcaccaaggatcttctcagcgccgccgaccgccagggcacccagttgggcacgcagcgcgtctttgacaccgttcagttcctgttcgatctcggcatgagccgaagccttcacacggtcagcttcgacgcgggctttttcaacagcctcttcgacgatctggttaccgcgtttcttggcttgctcaatgatttcagctgcctgtgctttagcttcgcgcagttgaagacccactttctcttgggccaactccaagtcgcgagctgcacggctggcagcgtccaaaccatccgcgatcttcttctgacgttcgtgcaaagccgcgatgaccggaggccacacgaacttcatgcaaaacactacaaaaatgaagaacgcaacggattggccaatcagggttgcattaatgttcacgccaacacctcgctcattcgttgtccatcaccccaatcactcgaaaagtcgagtgattagccagcgagttgaccaacgaaggggttcgcgaaggtgaagaacagtgcgataccaacgccgatcatggtcacagcgtcgagcaggccggcgacgatgaacattttaacttgcagcattgggaccatttctggctgacgcgctgcgccttccaggaatttgccgcccagcaggccgaaaccaatggcagtacccagggcgcccaggccgatcaacagtgcaacagcgatagcggttagaccaactacagtttccatctttcctcccgacttttacgtcgtatggtttaggttttttagattttaaagcggtaaaacaaatcgtttcatagccctggtgggccaccttcccgtttgaccgggaaggacatcagactagtcgagactggtcttaatggttctcttcgtgcgccatcgacaggtagacaatggtcagcatcatgaagatgaaggcctgcagggtaatgatcaggatgtggaacacagcccacgcccactgcagaactacgcccaggccgctaagccagagcaggccgctgccgaacatcacagcgatcaggatgaacaccagctcgccggcatacatgttgccgaacagtcgcagggccagggagatcggcttggcgaccagggtcacgaattccagcaggaagttcaccggaatcagcagggcttgaacgaaaatgttcttgctgccgaacgggtgcagggtcagttcgccgatgaagccaccgatacccttgaccttgatgctgtagaaaatgatcaacgcgaacaccgacagggccatgcccagggtggcgttcgggtcagtggtcgacacggcgcggaatggaatgtgcgcatcgccggagatcaggatggccaactgaggaatccagtccaccgggatcaggtcgacggcgttcatcaggaacacccagacgaagatggtcagcgccagcggtgcgatcaccgggctacggccatggaagctgtctttcacgctgccatcgacgaattcgaccagtacttcaacgaagttctgcaaggcacctggctgaccggaggtcgccttctttgccgccatgcggaaaatcaggacgaagatcagacccaatgcgaccgaccaacccagagtatccaggtggaaagcccagaaacccatttctttggcctctgctgcggtgtgggcaaagccccagccgccgttgggaagctgaccgaaggtcaggttctgcaagtggtgctggatatagcccgaagcggttgtttctgccatggttgcctcaaacgccctaaggtttcgaaagtcttgttttcattagcaggggagcgaaccagctgaccagttgggtcaacacgaagacgccgaatacagccagcggcgccaatggcttcacacctgcaaaggtcagtgcaaacagcactgccgtcaaaatcagtttccccgcctcgccggcataaaaagaccggacgatagcctgggctgctcgggcgccggaaaaccgaaaggccctgtgagcgaaatacatattgggcagcaaggctatcaggcctccgcagagtcctgaatatccggctacgactccatgccaataccaaagcgccaaagcggcgatcagcagaatgacaaattgagccaataaaaccgggaaaacagccaagcgatggaacggcaacgtgtttggcgtgcgggtttccatcactcttgctcctcaatggtcggctgccggaaatcaataacttggcataatttgtgccgacaaaatgcgcgcagagtataggggcggttctgcccctattcaactgtcgggtagtgatttccgatcacacgctacataagcaaatgtttcagcggatgtgggcaaggacgccctgcagctcatcgagagagttatatccgatgaccaattgccctttgcccttcttgccgtgacgaatttgcaccgcagagcccaggcgctcggccaggcgctgctcgagtcgtgcgatatccggatcaggtttggccgcttccaccggtgcaggtttgccgctgagccactggcgaaccagggcttcggtctgacgtacagtcagacctcgtgcgacaacgtgtcgcgccccttcaacctgttgattttccggcaaaccgagcaaagcacgggcgtggcccatttccaggtcaccgtgggacaacatggtcttgatgacttccggcagtgcgatcaggcgcagcaagttggacacggtgacgcgggatttccccaccgcgtcggccacttgttgctgggtcagctggaattcgtgctgcaaacgctgcaacgcaatcgcttcttcgatcgggttgaggtcttcgcgctggatattctcaatcaacgccatggcgatggcggtttcatccgacacatcgcgcaccatcgccgggatggtgtccttgccggcctgttggctggcgcgccagcgacgttcaccggcgatgatctcaaagcggccagcgccaatcgggcgcaccacaatcggttgcatcacgccctgggccttgatcgagttagccagttcttccagcgcctggggatccatgtcccgccgtggctggtatttgccgcgctggatcaggtccaggggcaggtgctgcagctcgcgctcgtcggcctgcaccgcttgctcttcaagcgatgtgacggtcggaccactcagcagtgcatccagtccacgtccgagacctcgtttcttgacggccatggggattccttaagttggctgggcggcagcggtgcgtgaattgcggcgttgacggcgaaccatctcgccggccagcgccaggtaggcaatggcaccacgcgaggacttgtcgtacgccagcgcaggcatgccatagcttggcgcttcagccaggcggatgttgcgtgggatgacggtgtcgtacaactggtcgccaaaatgttccttaagctgcgccgacacatcgttcatcaggctcagacgcggatcgtacatggtccgcagcaggccttcgactttcaggttcgggttgagcaactcggcgatacgcttgatgttatccacaaggtcgctcaagccttcgagggcgaagtactcgcactgcattgggataatcaccccatcagcggccaccagggcgttgagcgtgagcatcgacagcgacggtgggcagtcgatcagaatgtagtcgtaattctctcgaatgggcgccagggcgctacgcagacggctttctttcatctgcatttccagcagcaccacttccgccgcggtcaaatcgcggttggctggcagcagttggtaaccaccatgctcggaatagtgcatggcctgcgccaggtcgcattcgccaatcagcaaatcatagaccgagttttccaggccgtgtttatccacaccgctacccatggtggcgttgccctgtggatcgagatcgatcaacagcacccgacgcttggtggcgaccagggatgctgcgaggttgatacaggtggtggtcttacccacgccacctttctggttcgcaatcgcgaataccttagccattcttgcttgtgttcccaatcatgccgtgcggcgcagtatcagcagatggcgttggccttggcaaccgggtacggccaaggcgtgttcgctatcgaggtggaagtctgccggcaatgctaacagctcgtcgcttggatggacgcccttcattgccagccagcgggtgtcacggtcgccgagatggcgggtccagttgctgaaattctccatgctgctgaacgcccgggacacaatgccgttgaaaggctgttcaggcgtgaaggcctccacgcggctgtggataacctgcaggttatccagcttgagttcaagtttgacctgggtcaggaagcgggttttcttgccgttgctgtccaggcaggtcacttgagactcgggaaacaggatcgccaatggaatgccaggcatcccgccgccactgccgacgtcgagccagcggccgttttcgatgaacggcatcacgctgaggctgtcgagcagatgccgtgacaccatctcatctggatcacgcacagcggtgaggttgtaagccttgttccatttgatcaacagggccagatagctcagcaataactcttgctgggcttcggtgagggccacacccaactggcgcgctcctgtggataactcttcggcgtgttgcgaggtgaccaacgaactcaagcgctttgctccaactgacggcccgcgccgcgttttttcaaatgaatcatcaacagcgaaatggctgcaggagtgacgcctggaatgcgtgaagcctggccaagtgtttccggccgagttatccccagcttgctttgaatttctttcgacagcccggaaatcccggtgtagtcgatatccacaggtaacttggtatcttcactggcgcgcaggcgagcgatttcgtcctgctggcgatcaatgtaaccggcgtacttggtcttgatctcgacctgttcggcaacctgtggatcttccgcgccctggcctgttacttcgaccaagccagcgtagtcgatttccggacgggacagcaggttcagcaggttgtactcatgggtcagaggcgtgccgaatttttccgcaatcgcatcgccttgttcggtgcccgggcgaacccaggtacttttcaggcgttgctcttcgagcgtgatgctttcgcgtttcttgcagaacgcagcccaacgcgcgtcatcaaccaggcccaattcacgacctttttcggtcaagcgcaggtccgcgttgtcctcgcgcaggatcaggcggtattcggcccgggaagtgaacatccggtacggttcctgggtaccgagggtaatcaggtcgtcgaccaatacaccgatataggcttcatcgcgacgcgggcaccagctgtctttgccttgtgcgcgcaatgcagcgttggttccggccagcaaaccctgggccccggcttcttcgtaaccggtggtgccattgatttgcccggcaaagaacaatccgccaattaccttggtttccaggctgtatttcaagtcacgcgggtcgaagtaatcgtactcaatggcgtagcccggccgcacgatgtgcgcattttccataccgcggatcgactgcacgatctggatttgcacgtcgaacggcaaggaagtggaaatcccgttcgggtacagctcatgcgtggtcaggccttcgggctcgatgaagacctggtggctttccttgtcggcaaagcggtggatcttgtcttcgatcgacgggcaataacgcggaccaatgccttcgatcaccccggaatacattggcgaacggtcgaggttcgcggcaatgatttcgtgggtccgggcgttcgtgtgggtaatccagcaactgacctgcttcggatgctgctccttggagcccatgaacgacatgaccggaatcggcgtgtcaccggcttgctcggtcatcaccgagaaatccacagaacgcccgtcaatacgtggcggggtcccggttttcaggcgaccaactcgcagaggcaattcacgcaagcgttttgccagggcgatcgacggcggatcaccggcgcgaccaccggaatagttctgcatgccaatgtggataagcccaccgaggaaggtaccggtggtcagcacgacggattctgcgaagaaacgcaggcccatttgggtgaccacgcctttcacgacgtcctgttcgacgatcagatcatcggcggcttgctgaaatatccacaggttcggctggttttccagggtttcacgtacggccgccttgtacaggatgcggtcagcttgagcccgggttgcacgcaccgccgggcctttgcggctgttgagcacgcgaaattgaataccacctttgtcggtagccatggccatcacgccgccaagggcgtcgatttccttgaccaggtggcttttgccaatcccgccgatagcggggttgcaactcatggcaccgagggtttccacgttgtgcgtgagcaacagggtttttacgcccatgcgtgctgacgccagtgctgcctcggtaccggcatgaccgccgccgatgacgatcacttcaaaacgggaagggaaatccaccacgcacctcgtgcctgcttatgtaggtaatcaggaattgtttgttgaaagagttttggagctttggcggcaagtatagggacttcgcccttcctaaagaaccctttgcacaaaatttaaccagctgtggatgaatcacaggcaatagagattaaaagagagaaatttattaaatctttgtttttatgtttatttctactgagctacttttctgtggatagatttctataggcctttattttcaatgtgtacagagcttcaaaagtctgtggtcatgtgccaatgaggcccttggataagtgctttaagcctgtggattaaacaggtggttatccacagagggttttttgctcaggtttcaggccctgttatcaactgggcacaagggcggttattcacagggcttaatccacagaaaaccgcagatccgctggtatttcctcctgcacgaaggcagccgcatcctttacccggggtggtgagtgcttcaaaaagagatctattgtgagaaaacggctgggcagttaataatagcgattatcattaacctgccttgtcataccctatgtcccttccatcacacacggctgcggtccagaatatctatgagcaacaccattcctggttgcacgggtggctcaaaggtaagttgcataacgcctgcgatgcggccgatgtggcgcacgatacattcgtgcgtattctgggcgggcggcatgcggggctgatcattgagccgcgggactatctggcaaccattgccaggggcctggtgattgatcgttaccgtcgacacgccatcgagcaggcttacaagcaatccttggctgaacgtcctgaagccaacgccatcagcgaagaagacaaggccatcatcattgagaccctggtggctgtggataaagccttggccacactcggcgagcgagcacggcgaatctttatgctgtcgcagctcgaggggctgacttatcaacagatcgcagatcagctgcaggtctcactgaccacagtgaagaagcacatgatccgtgcattgactgaatgttcgctgatcgtggccagcctgtaatggcggtccccgatcgcaagaccttcgaagccgctgccagctggtatgtacagttccagtcccagatacctacagccgctgaccgcctggcctggcaacaatggctgaacggcgatccgtcccaccaggctgcgtgggaccagatggagcaattgcagcgcagccttggcgcgctgccccaggatttcacccgccgtgcattgtcgaccacgcaacaacggcgccaagtactgaagtggatgctggtgttgggcagtaccggctatctaggctggaatgttcagcaacgcacgcccctggcccatgtatgggccgattaccggacttccgtgggtgagcgccggcgtgtcgaattggctgacggtacgcgggttgatcttaataccagcaccgctattgacgtggtttttgatgggcgccagcgcttgatccgtttgcgcgaaggtgaagtacttatccacaccggcaagttcggcgggcaaacgcctttttatgtcgaaacccttcaaggccgcgtccaggcattgggtactcggttcagcgtgcgccagttgccaggctccacacgtgtcggcgtcctggaggatcgggtgagcgtgtatccaggtgaccagcccaaccacgcgcggctgctcggtgccggtgagagcgctgactttgatcgccaaaacgtgggtcccaacacgagttatcgcggctcccaggctgcctgggtcgatgggcagttaatcgtattggatgctcgcctcgcagaggtgatggacgaactcgcccgctatcgcccaggtgtcctgaaatacgattcggcttcggcgcgcttgcctatctccggcacgttccgactggattcaaccgatgcagtactggctaacctacaggcaaccctgccgattcaggtgaagtacttcacgcgctattgggtttcagtgacgcgaatcggttaaaaaattcgcacaccgggggttatctttttttcacctgatgcggccctacaggtaatcacgaccaccttcagggcttacccacctatgcgcctccccaccaagctccgcttgcgactttcctgccacggtatgatgtacggcctgctgctcggtaccgcaaacatcgccagtgccttgcttgcccctggcgccatggccgccaatggggtgcagcatttcgtcatcgcggctggcccgctggacaatgccttgagtcaattcgctgccagagcgaatgtgattctgtctttctcgcctcagcaaaccgcgcagctgactacagcagggctggaaggcgattattcggtggaacaaggctttgcgctgttgctgcagaactcggggctacaagtgctatcccaggcgccaggcagttatgttctgcaggccattcccgcagggcaactagtgctcgcccctaccacggtcagcggttatcaacaggcagggttcaaccaagacatcgccggggatgtgggctacaaggcgcaaaacagtcgcatcggtaccaaaaccagcacgcctttgtccgaaacgccacgctcggtatcggtcgtcaccggccagcgcataaaggaccagaagtcgcaaaccctgactgaagtgttggggtatgtgccgggaatcttcgcgccaccttttgccgccggtgacggcctggcaggcgacctgttctttattcgcggctttaatgccacggattacggctacggccttctgcgagatgggctacgggtacaaggcaatcgctacgatacgaccagtgagccttatggcttggaacgcgtcgaaatctttcgcggcccctcgtccctgctctacggtgagaacgcgcctggcggcttggtgaatctggtgagcaaacaccccaccgccaccccgcaaggtgaggtgcaagtggggtatggctcgaataatcggcgtcaattgggtgtggatatctcgggtccgctcaacgacagcgacaacatccttgggcgcgtggtgatgctcggccgcaaatccgacacgcaaactgaccatgttccagatgatcgcctgtatatcgcgccctccctgaccctgaatttcgacgattacaacaacctgaccttgttggccaattaccaaaaagaccacactaatctcgagctaggcctacccgccgccggcaccttgcttaccaaccccaatggcaaactgtccaagcacaccatgctcggcaacccggactggaatacgttcgaacgtgaagcctggagcactggctacgagttcagccatagtttcaacgacgattggcagttccgccagaactcacgctatatgcagtcgcgcatcaaccgccatgaaacttggcctggcgcgctgaataaccgtggcttcggcactcagttgaacatgactgcctatgaccgctacaacaagtcgatggtctattccctggataaccaggtggaaggcaaattccagctcggtggtctcgacaatactgtgctcctcggcgccagctacgaccgcacctcgttcaatcaggattgggacgctggctctgccggcaccatcaatgtgtataaccccgtctacctgcgtgatccactgaccccgattgccgtgcaaaacaccttgctcgaacaacagatgaaaggcgtctatgcacaaatccagagcaagtacgaccattggctgttcctgctcggaggccgccaggactgggtggacagtcatttccgtgacaaggtcaacaagaccagcaataccgacgccgaggaccgcaagttcacttaccagggcggggtgatgtaccagttcgacaacggtctgacgccgtatgtcagctattccaccgccttcgttcccgtgcagcaaatctccaacgccggttcacccttgaagccgatcaccagcagtcagtacgaagtgggggtgaagtacgagccgatcggctgggataccgcgatgaccctgtcgctgtatgacttgcgcaagcaggacgatacctacctggacgccaccaccaacagttaccgccaggtgggcgagagccgggccaagggtgtagaagtcgaggtgaacagcaatctcacgcccaatctcaatctgacggcggcttacacctatacggacgctcggattaccaaggattcggctacctcactggtcgaggggcaccagatgacgggagtgccgcgcaaccaggcctcgatctggggcaagtaccgtttcctcgatggccaactcaagggcttatccctgggtggcggtgtgcgttatttcgacagtacctttgcttacaccgcacctacgctgtacgggaagttggacgccggtagcgtcaccttggtggacgcagcggttggctatcagatcgataaacactggtcagtcgacctgaacgccaagaacctgttcgataaggaatatgtagccggctgcaacgacgccggccgttgctactggggggacagccgtaccctgctcggtacggtgtcgtacaactggtagaggcctgtggataaccaggctatttgccgatacagaaactggaaaagatccgccccaataaatcatcggagctgaatgcgccggtgatttcccccaagagctgctgcgcctgacgcagatcctctgccagcagctctcccgcccccgctagggtcagctgcgcacgaccgtgttccaacgccgcgctcgcatggcgcaacgcctccaaatgcctgcggcgtgcactgaagctgctttccgaggtctgttcgtagcccatgcaggccttgaggtgctcacgcagcaattccaggccctcacctgccgatttggcgctcaagctgatcgtgacatgcccgtcctcactggtttcaagggtgattgcttcacctgtcaggtcggccttgttacgaatcaaagtgactttggccgggtccgggcgttgctcgaggaattcaggccacagtgcaaaaggatccacagcttccggtgctgtggcatcaacgaccagcaacacccgatctgcttcgctgatagccttgagcgcacgctccacgccgattttttccacctggtcatcggtgtcgcgtaggccggcggtgtcgaccacgtgcagcggcatgccgtcgatgtggatatgttcgcgcaggatatcccgggtagtgccggcaatctcggtgacaatcgccgcctcgcgtcctgccaaggcattgagcaggctggatttaccggcattgggccggccggcaatcaccactgtcataccatcgcgcaacagcgcgccctgcccggcttcacgcaacactgtggataattcctcgcggactttatccaacatggctaggacgtggccatccgcgaggaagtcgatttcttcttccggaaaatcaattgccgcttcgacgtaaatacgcagactgatcagttgctcggtcaagttatgcacacgcagggaaaaagctccctgtaacgagcgtaatgcattgcgcgcagcctgggcagaactggcttcgatcaaatcggcgatcgcttcggcctgggcgaggtcgagcttatcgttcaaaaacgcgcgttcgctgaactccccaggtcgcgccaagcggcaacccagttgcaggcaacgctgcaagagcatatccagcacgacagggccgccatggccctgtaactccagaacgtcttctccggtgaaggagttcggcccagggaagtagatagccagcccttcatccaatacgctttggtcggcatccaggaactggccgtaatgggcatagcggggtttcagctctcggccattgatagccttggctgctacacccgcaagcggcccggaaattcgaacgatacccacaccgcctcgaccttgagcggtagccacagcagcgatggtttcacggggagcactcatcagcaggttccagaacaaaagtgacggaaagcaaaacgccccactagggggcgtcttgagtggttacccacagagtaaattacgcctcggcttttttggtagccgcttcgattttacgtgtgatgtaccactgttgagagatcgacaacacgttgttgacaacccagtacagtaccaaaccggctgggaaccacaggaagaagaaggtgaagatgattggcatcattttcattaccttggcctgcatcggatccggcggggttgggttcagacgctgctggatgaacatggtcgcgcccatgatgatcggcaggataaagaacgggtctttgatcgacaggtcagttatccacagcatgaacggcgcctggcgcatttccacgctttccaggagtacccaatacagcgacaggaataccggcatctgcaccagaatcggcaagcatccacccagcgggttgatcttctctttcttgtacagctccatcatggcctgcgacattttctgccggtcgtcaccatgttgttctttcaatgcggccagtttcggggccacggcacgcatacgcgccatcgatttgtagctggcagccgacagagggaagaagatccccttgatcagcatggtcaggaagatgatcgaccaaccccagttaccgacgatgctgtggatatgttgcagcaaccagaagatcggctgggcaatgaaccacagaatgccgtaatcgacagtcagttccaggcctggggataactccttcaggacggcctggcttttcgggccggcgtacagtgtagcgctggtttcagccttggcacccggagcgacgttcaacgccgggccagtaaaaccaatgatgtagttgccttggctgtctttacgggtctgaaccaggttggcttcacccttgttcgggatccaggcggtcacgaagtagtgttgcaaccaggcaacccagccgccttgcacggtttctttcagcgaacccttgtcgatatctttcatcgacacttttttgtacggctcaccacttgtccacagggctgcgcccaggtaagtcgcggtgccggtggcagtgctggaagaaggatcggagctgccatcacgcttgagctgggcaaacaggttgccactccaaggcttgtcgctttcgttgtcgatcaggtaagtgaccttcaagtcgtacaaaccacgggtaaagctgaaacgcttgatgtagttgacgccgtcgaggctgaatttcaggtcgacgttcaactggttctggccgtcagccagttgataagtcttctgttcggtcgaataaaccggacgaccggtagcacgtgcatccggaccgttggtgccggtcaggccactttgtgccagataaacacgctcgccaccgttatcaaacagttggaacggaacatccggatggtcttggcgacgtggatacagcggcagtttcaactgcgcgatatcaccaccttccgggtcgatggccaggtcgagcacatccgttttcacgtggatgaggtctttattggtgaccactggcgtttctaaaggggcgctggtctcgccattcgcgctgggaacatcggcactcgcggacgcattattattacccagcggggcgtccggaatagccggcgcggcctgattggtagcaacattctgagtcggcagggcagcctggccgtagtcctggttccacttaagaaccatgacgtaggacacgattgccagggcgacgatcaggatcgtgcgtttaatatccatgattactcggccatcgaagaagaacgggaggtagggataggtggaaccgggtcataaccaccgggattccacggatgacagcgacctaaacgacgaaaggtcagccagccaccgcgcagaagaccatgattttctatggcttctaacgcgtagcaggaacagctggggtagaaacgacagtggctggccatcaggggactaatggcatagcgataaaactggatcggaacgattgccagtttacgcatcaagactgtctacccctacagtttcggtgctgactgctggtgttggcttgttggtacgcgccaaacgtttccagagcttgccgaaatgctgaatcaattcggggttttctacatcacccaagcctttgcgcgcgacgataacaatatcccaaccaaccagagtgtcctggtggaggcgaaacgattcgcgcatcagacgcttgaggcgattgcgctcaacggagagctttacgctcttcttgccgatcaccaacccgagacgagggtgatcaagatcgttgttacgcgcaaggagcaggagatttttccccggaaccttgccggtgggggagtcaaagactgccttgaaatgccggggggttagcagacgcttttcccgactgaagtcctgactcaccaccagtaccggattatcaaactgccagacgcgcacgacctttggcgcggcgacgcgacaggacagcacggccgttcttggtagccatgcgagcacggaagccgtgagtacgggcgcgtttgatggtgcttggttggaaagtacgtttcatggcgttgttacctggttcgtccacaacgggccggaatggcccccgttttaagagaccggcgattctagagaaagcaagcctctaggtcaatttccaaccagcttttcctttaattagttcttcgtggcgtcacgacgcacttcgggtcgtccggcttccatcagccttgcgttagatataaaaataaagaaggaagttatttaaagcttttctgtaaagcttataaaagctagggccgcgatcttctgtggataactacctttagcccttgttctacgtgatgtacagagaatgacaacacgggggagaagcggtgctctgcctgtgctgcgctgtcggataagctgtgcgtggaatgggttgttatccacaggccagttacccacagagtttcgaccccacttgtacaacgagctcagggtggcttatccacagagcttatgcacagaccattggtcgccttttttgcagttaagacgttgattttggctgggctgtgagcaacctacatgtggataagtgtgcggctggccgctacaatggcggctgtttttgcctcaccggctttcaacttaggggatatccgtgtcagtggaactttggcagcagtgcgtggagcttttgcgcgatgagctgcctgcccagcaattcaacacctggatccgtccgctacaggtcgaagccgaaggcgacgagttgcgtgtctacgcacccaatcgttttgttctcgactgggtcaacgagaagtacctgagccgcgttctcgaattgctcgatgaacatggcaacggcctcgcgcccgtgctctccttattaataggcagcaaacgtagctcggtaccacgggccgcgccgaatgcgcctttggctgccgcggcgtcgcaagcccaggccgcagcggcgccggttgccgcttccccggtgcctgcggcgacgccttccaaatcttcagcgcaaaaaaatgcgccagagaatgaagagccatcccgtgacagcttcgacccgatggcgggtgccagctcccagcaggcgccgatccgcgccgaacagcgcactgttcaggttgaaggtgcgctcaagcacaccagctacctgaaccgcaccttcacctttgaaaacttcgtcgaaggtaagtcgaaccagctggctcgggcggccgcctggcaggtcgccgataatcccaagcacgggtacaacccgctcttcctttatgggggcgttggcttgggtaagacgcacttgatgcacgccgtgggtaaccacctgttaaagaagaacccgaatgccaaggtcgtgtacctgcactcggagcgcttcgtggcggatatggtcaaggccttgcagctcaatgcaatcaacgaattcaagcgcttctaccgttccgttgacgccttgctgatcgatgacattcagtttttcgcgcgcaaggaacgctcccaggaggagtttttccataccttcaacgccctgcttgaaggtggccagcaggtcatcttgaccagtgaccgttacccgaaggaaatcgaaggccttgaggaacgtttgaagtcgcgcttcggttggggcctgaccgttgcggtggaaccgccggagctggaaacccgcgtcgcgatcctgatgaagaaggccgaccaggccaaagtcgacctgccccacgacgccgcgttcttcattgcccaacgtattcgttccaacgtgcgtgagctggagggtgcgctcaagcgggtcatcgctcactcgcacttcatgggccgcgatatcaccatcgagttgattcgcgaatccctgaaagacttgttggccttgcaggacaaactggtgagtgtggataacatccagcgcaccgtggccgagtactacaagatcaagatttccgacctgctgtccaagcgtcggtcgcgctcggttgcgcgcccccgtcaggtagccatggctctctccaaggagttgactaaccacagcctgccggaaatcggtgatgtatttggcggacgcgaccacaccacggtcctgcacgcatgccgcaagatcaacgaacttaaggaatccgacgcggatattcgcgaggactacaagaacctgctgcgtacactgactacgtgatgacaccagcgcagcttattaaggcaagggactagaccatgcatttcaccattcaacgcgaagccctgttgaaacccctgcaactggtcgcaggcgtcgtcgagcgccgacagaccttgccggtgctttccaacgtattactggtagtcgaaggccagcagttgtccttgaccggtaccgatctggaagtcgagctggtgggtcgcgtacagctcgaagagcccgccgaacccggcgagatcaccgtaccggcgcgcaagctgatggatatctgcaaaagcctgccgaacgacgcgctgattgatatcaaggtcgatgagcaaaagctggtggtcaaggctggccgcagccgttttaccctgtcgaccttgccggccaatgatttccctaccgtggaagaaggcccgggctcgctgacctgcagcctggagcagagcaagctgcgtcgcttgatcgagcgcaccagcttcgccatggcccagcaggacgtgcgttactacctcaacggcatgctgctggaagtgtcggaaggcatcatccgtgccgtggccactgatggccaccgcctggcaatgtgctcgatgcgcgccgatatcggccagccggatcgccaccaggtgatcgtgccgcgcaaaggtatcctcgaattggcccgcctgctcaccgagccggacggcaacgtaagcatcgtgttggggcagcatcacatccgcgcaaccactggcgagttcaccttcacttccaagctggttgacggcaagttcccggattacgaacgcgtgttgcctaaaggtggtgacaagctggtaatcggtgatcgccaggcgctgcgtgaggcgttcagccgtactgccattctatcgaacgaaaagtaccgcggtattcgcctgcaactggccaacggccaattgaaaatccaggccaacaacccggaacaggaagaggcggaagaagaagtcggcgtcgactacaacggcggttcactggaaatcggcttcaacgtgagctacttgttggacgtactgggggtgatgacgactgaacaggttcgcctgattctgtctgactccaacagcagcgccctggtgcaagaatccgacaacgacgactcggcttacgttgtcatgccgatgcgcctgtaaccatgctcagcagaagctagatgtccctcagtcgcgtctcggtcaccgcggtgcgcaatctgcacccggtgactttctccccttcccctcgcatcaatatcctccatggcgccaacggcagtggcaaaaccagcgtgctggaagcgatccacttgttggggcttgctcgttctttccgcagtgcccgcctgctgcccgtaattcaatacgaacaattggcttgcacagtgtttggccaagttgaactggctgagggcggtcatagcagcctggggatatcccgtgatcgtggcggtgagtttcaaatccgaattgacgggcaaaatgctcgcagcgcagcgcaattggcggaaatattgccattgcagctaatcaacccagacagtttccgattgttggaaggcgcaccgaaaattcggcggcaattcctcgattggggcgtgttccacgtggaaccacgctttatggccacctggcaacgcctgcagaaggccctgaggcagcggaactcatggctgcggcatggtacacttgacgccgcttcgcaagcagcctgggaccgggagctgtgcctggccagtgatgaaatagatgagtaccgtcgcgcctatatcaaagccttgaaaccagtctttgagcagaccttgagcgagttgttggatctcgaggggctgacgctgagttactaccgcggctgggacaaagaacgcgagctgagcgcagtgctcgccacctctttgcagcgggatcagcaaattggccacacccaggccggaccccaacgcgctgacttgcgtcttagattaggcgcacacaatgctgcggatatcttgtcccgcggccagcagaaattggtggtctgtgcattgcgtatcgcgcaggggcatctggttagccaggcccgtcgcggccagtgtatttatctggtggatgacctgccgtcggaactcgacgagcagcaccgccgttcgctatgccgcttgttggaagacttacgctgccaggtgtttatcacctgtgtagaccacgaattattgagggaaggctggcagacggaaacgccagtcgctttgttccacgtggaacaaggccgtatcacccagacccacgaccatcgggagtgaaggcatgagcgaagaaaacacgtacgactcgaccagcattaaagtgctgaaaggtttggatgccgtacgcaaacgtcccggtatgtacattggcgacaccgatgatggtagcggtctgcaccacatggtgttcgaggtggtcgataactccatcgacgaagctctggccggtcactgcgacgacatcagcattatcatccacccggatgagtctattaccgtgcgtgacaacggtcgtggcatcccggtagacgtacacaaagaagaaggcgtttcggcggcagaggtcatcatgaccgtgctccacgctggcggtaagttcgacgacaactcctataaagtatccggtggtttgcacggtgtaggtgtgtcggtagtgaacgcgctgtccgaagagttgattctcaccgttcgccgcagcggcaagatctgggaacagacctacgtccacggtgtgccacaggagccgatgaaaatcgttggcgacagtgaaaccactggcacccagatccacttcaagccatcggctgaaaccttcaagaacatccacttcagctgggacatcctggccaagcggattcgtgaactgtccttcctcaactccggtgtcggtatcgtcctcaaggatgaacgcagcggcaaggaagaactgttcaagtacgaaggcggcctgcgtgcattcgttgaatacctgaacaccaacaagactgcggtcaaccaggtgttccacttcaacatacagcgtgaagatggcattggtgtggaaatcgccttgcagtggaacgacagtttcaacgaaaacctgttgtgcttcaccaacaacatcccgcagcgcgatggcggtactcacttggtgggtttccgttctgcgctgacgcgtaacctgaacacctacattgaagcggaaggcctggcgaagaagcataaagtcgccaccaccggtgacgacgcccgtgaaggtttgaccgcgatcatctcggtcaaggtgccggatccgaagttcagttcccagaccaaagacaagctggtgtcttccgaagtgaagaccgctgttgaacaggaaatgggcaagtacttctccgacttcctgttggaaaacccgaacgaagccaagctggtcgttggcaagatgatcgatgctgcccgtgcccgtgaagccgcacgtaaagcccgtgagatgacccgtcgtaaaggcgcgttggatatcgccggcttgccaggcaaactggctgactgccaggagaaggaccctgccctctccgaactgtacctggtggaaggtgactctgctggcggttccgccaagcagggtcgcaaccgtcgcacccaggccatcctgccgttgaagggtaagatcctcaacgtcgagaaggctcgcttcgacaagatgatttcctcccaggaagtcggcaccttgatcactgctctcggctgcggtattggccgtgatgagtacaacattgacaagctgcgttaccacaacatcatcatcatgaccgatgctgacgtcgacggttcgcacattcgtaccctgctgctgacgttcttcttccgtcagctgccagagctgatcgagcgtggctatatctacatcgcccagcctcctttgtacaaagtgaagaaaggcaagcaagagcaatacatcaaagacgacgacgccatggaagaatacatgacgcagtcggccctggaagatgccagcctgcacctgaacgacgaagccccgggcatctccggtgaggcgcttgagcgcctggtcaacgacttccgcatggtaatgaagacgctcaagcgtttgtcgcgcctgtaccctcaggagttgaccgagcacttcatctacctgccttccgtgagcctggaacagttgggtgaccatgcacacatgcaggattggctggcccagtacgaagtgcgcctgcgtaccgtcgagaagtctggcctggtgtacaaagccagtctgcgcgaagaccgtgaacgtaacgtctggctgccagaggtcgaactgatctcccacggcttatcgaactacgtcaccttcaaccgcgacttcttcggtagcaacgattacaagacggtagttaccctcggtgcgcaactgagcacgctgctggacgacggtgcttatattcaacgtggtgagcgtaagaaggcagtcaaggagttcaaggaagcattggactggttgatggctgaaagcaccaagcgccataccattcagcgatacaaaggtctgggcgagatgaacccggaccagctgtgggaaaccaccatggacccagctcagcgtcgcatgctgcgcgtgaccatcgaagacgccattggcgcagaccagatcttcaacaccctgatgggtgatgcggtcgagcctcgccgtgacttcatcgagagcaatgctttggcggtgtctaacctggacttctgatcaggcaaatcggctaaaaccaaaaaggccaacgcttagcgttggccttttttattgggtgcattctgaaaatgctccacgtggaacatcacgaaatttaactttgggagttcgttgccacactctccaaccgatacccgtatccataaatcgtcaacagctgccatccgcgatccgccgtcagccccagcttattgcgcagacggtagatgtgcgtatccaaaggccgcgaagaaaccatttcttcgtggctccagaatcgctcatacaggtactcgcgagacagcggtcgggccaaattggcgaacaggcaactggcaaggcggtattcccgttccgtcaggttgataggtttgcctgcgcgggtgacggtcaattcagcatcgtcgaatgtcagatcgttgaagctctgcacttcctgagtagccgacttctgcaggccatggcgccgcaagactgcactgactcgggctttgagttcattaggtcgaaagggcttgctgacgtaatcgtccgcgccgctatttaacgctgtgacgatatcgctctccgcatcacgactggtgagcatgatgacagcgggaggggattccatatgttcgcgggtccagcgtaacagtgcgatccccgagatatccggcagttgccaatcgagtatcagcaggtcaaaggtttcccggcgcagttggcgcaacaggtcctcaccgcgctcgaagaaatgcagggaccagggctgttccgcttggctggggatctgtcgcagtgtctgttccacccgtctcaattcggcgggctcgtcatccaatattgcgacacgcatgggtgggtccttcctacaaaaatacaagcgcttgaatgggaggcactgctgtgcaaatgccggcctctgaatctgaataattatggacggattctacgcttcgggaatctctcgatacgctgatatcaaagggctgttaacttgacgcactcttgatgctcaatggaaagataccggctcctgtgtataaggaaaagccgcgatgccgatagcctccctggtacgtctgtttggcgggcctacacaaagccctccgatgagaccgaaataagcttcactggtttcagagcattgtatgcgcttcatcgtaaccacctgagagggagcctgggcctatggcagctttacctgcaaaccatcttcgcttttgtataagtgcggcggtagccctgtgaaactatggcgcaaagccgagaaacgccaacctacccgagcacaactgttgttccatgggctggtgcgggaatggctactgatcggcttggtactgctgcccttcaccgtgtacttgtccttgagcccaggcctggccctcaataacccgctctacgatagcttgcgtcggctggcgcctttgccggtagatccacggatcctgctggtgaccattgacgcccacagccttgaagcactcggcccatggccttggccgcgcaacgtgcatgccgacctgattggacgcctgagtgccgcccagcctgcagccattttgtttgatgtcattttcagtgagtccggcgaggacgccgatggccggcgattggctgatgccgtgtgtaaagccggaaatgtattgttgcctatcatcggtgatagcagcgggagcccgagctcgccgcaagagccgttatcgccattgctcaaatgcgccaaaggtgtcgggcatatcaacgtcgaggcggataacgacggcgtggtgcgcagtgtgtatctgcgtgaaggcccccccggaagtacgcttgagcaattggcctggctggcattcacgctgagtgggcaagccccgaccatgcctggattgtctcaagcgcccagcaatgtgcgatggcaccaggagcatgagattcgtgttccgttcacctccgaggccgagcactttcccagtgtctcctatgtcagcgtattacgcggtgaagtacctccagagtcgctgcgtggccgcttgattctgataggtgccacagcctacggaatggccgatcgtttcgtgacgccgctctcctccaccgttggtactacagcgggtgtggagatccaagccgacgtgctcaatggcttattgcagggccgcagcattgtcgacttgcccggatggcaggcagcgctgttggcaacatcattggtaacgctgctgttgggtcttttgctttatcgcccacgttacgccctatggatgaccttggcaggcatggccgccgcgttgctggggtcttgggcgttgttgcgcttgggacattggtggtcccctgcggcctgcctgattggtttgttgctcagttatctgatctggaactggcgacgcttgagcgtgatcctcgcctactttggctgggaattggcccgcctggataacgaaccgaaggtgcttcctgagcgtcgccgtgcgcctgccagtaagggcgatgtactgcagggacggatctttgcccttgagcaagccgtcagccgcacgcgagatacacggcgctttatggctgacggactcgaatgcctgccggtcgcgacgctgatcaccgacccccagggtaatattctgttggccaaccgtgtggcccgtgacgtattcggcaatgacctggtgggcgaaaacctcgtcgaacaactcgccgaattgggttatcccccgttgcataacggcgtacgccctgccctgtcagcactggaactggtggaattccgcgacatccaccaacgcagtctgcgcatggagcttgctcctttgcttcctgccgaaggtgattttgccctcggctggttgctcagcctgactgatctgagcaaagagcgcgaagcccagcagcaccgcgagaccatgttgcgtttcctttcccatgatttgcgtgcaccgcattcggcgatccttgccttgctggatgtgcataacggcgaatcgccggtttttgcccagatcgagcagcaggtccgccgggccttgagccttaccgaatcctttgtgcaattggccaaggccgaggctgacgggtatcagttccaaccgaccctgttcgccatgctggtgatggatgcctttgatcaggtagcggtgattgcgcagctcaagggcattcatctggtccacgatctggatgaggccgatgaggccatggtctacgccgaccaatcactgctcacgcgagcgttgttcaatgtgctggagaacgcgatcaaatattccccatccggtactaccgtcagactgaggcatgccagcgcacaaggttggttggaatgccgtatcagcgaccaggggccggggattgcacctaaggatttaccggagctgttcagtcaataccggcgtttcgattccgcccagggcagtgacggtcttgggcttggcctgagcatggtcaaagccgtggtagaacggcatggcgggcgcatcgtttgtgaaagtgaacaaggcaaaggctccacgttcatcctgcaactgccgcagttggacgattgaaaaacggaatttcctgctgtgcataaaaaaccggtcacaaggaccggtttttttatgaagaaaaaacttatgcacgtttttcctgattttatgaggtcaagaaatatgtagtcaaatcagcatgttatgcatcaaaaaagctaattcgccaacaaagcgtacacaggttatccacagatgctcaaacgacgggcgtctctacaactacgggttccggaggcaaggagcccatggcctgctgttgcgcttggttccacgctgcagcgcggtcattcagcgcggcaatggcacgcggcccttcgccttctgcgtacatgggttcgccgattaccacggtgatggtgcctgcgcgtttagcccagccggtcttgggccagaacttgccggcgttatgtgcgataggcaaaacaggcaagttggcgttgaccgccagtgcggtgccgccacgtgagaatttgcccaccgtaccgtagggcacccgcgtgccctccgggaagatcagtacccatacgccatccttgagcagctcatcacccttcttggcgacatgcttgagcgctgccttggggttgtcgcggtcgatggcgatcggccggagcatagccatggcccacccgaagaacggcacatacagcagttcgcgcttgagcacttggctcaacggcgagaaataggccgagaggaagaacgtttcccaggtgctctggtggttcgacagaatcacacagggctgctccgggacgttttcagcgcccttgatctcgaaacggatattgaggaataccttgctcagccacaacgcgcagcggcaccaataaacgttgatgaaacgatagcgcgccttgaaaggcaggaacggtgcgataaaaaagctcagggtgcaccagagaaacgaactggtgcccagcagcaggtaaaagaaaaaggttctgatggcctgcaagatcgacatggcggcatttaccgttgcgggacacggcccgcctgttaaaagcgcactcccgaacaatccttggtcaggaagtcgagggcggctagttgttgataagttctgcggcaacggccgccagatcgtcaaaaatcaaagtgccaaccggcaaggctttcgcctgggtcttttcgccttttccggtcttaaccaaaactggctgagagtcgacggccttggccgcctccaggtcaccgaggctgtccccgacgaaccatatcccagctaacggcaccttgtaatgttctgcaatgattttcaacatgccaggcttgggcttgcggcaatcgcagccctcatccggcccgtgggggcagtagaccaccaaccccacctcaccgccctgctcggccaccaacgcgcgcaggcgcgcgtgcatggcgtccagggtggcgatgtcgtaataaccccgggcgatgccggactggttggtggcaatggccaccgtccagccggctttgctcaactgcgcgatggcctcgatcgagccaggcagtgggatccactcatccaccgatttgatgtaagcgtcggagtcgtaattgatcaccccgtcccgatcaagaatcagcagtttcaacatcatcagcccagtacggaaatgtcagcgatattgatgaacagaccacgcaggcgcgcgagcatggcgtagcggtttttccgcacgccggcatcgtcggcattgatcatcactgcttcgaagaacgcatccaccggctcacgcaacgacgccaggcgggccaacgcttcatcgtagttacgctctgcgatcagcggcttcacggcgttttcggccttggcaatggccgagttcagcgagaactccttggcatcggcaaacaggccagggtcgacttcggcgttgccgaggttgtcggccttgctcagcaggttcgacacgcgcttgttcacggcggccagggcatcagcttccggcagcttgcggaatgcctgtacggcttgtacacgctggtcgaagtccaaggcagaacccggttgcagggcacgcaccgacaggtagaccgaaacgtccacgccttcgtcttcataacgcgcacgcaggcggtcgaacacgaactccagcacttgctcggccaggccggcttgcttgaccttggcgccgaactggccgacggcgaacaccacggcctgggtcaggtcgaggtccagcttcttgtcgatcaggatgcgcaacacgcccaaggccgcacgacgtagggcataggggtctttactgccggtgggcagcatgccgatgccgaagatgccaaccaacgtatccagcttgtcggcgatggccactgccgcaccggtcagggtggtcggcagctctgcaccggcaccgcgcggcatgtactgctcgttcagggccagggcgacttcttgcggctcaccgtcgttgagggcgtagtaataaccggcaacgccttgcatctcggggaactcgccgaccatctcggtggccaggtcgcacttggacagcaagccggcacgtgcggcccaagctgcgtcgccaccaatacgcggggcgatgtaggccgccagcttggaaacccgtgcggccttgtcatagacactgccgagtttttcctggaacaccacgttttgcaggcgcaggttgaagtcttcgagcttctgcttcttgtcttgtttgaagaagaactcggcgtcggtcaggcgcgggcgaacgactttttcgttaccggcgatgatctgctgcgggtccttgctttcgatgttggccacggtgataaaacgcggcagcaacttgccgtccgcgtcgagcaggcagaagtacttctggttgtcctgcatggtggtgatcaacgcttcttgcggcacctcaaggaaacgctcttcgaacgagcacaccagcggcaccggccattccaccagggcggtcacttcgtccagcaggctttgcgggacgatggcggtgccttcctgcaggcgcgccagctcttcggtgcgcttgctgatcagctcgcgacgctcattggcatcggcgagcacataagcagcgcgcaggtcgttgaggtagttggccggcgaggtgatacgcacgctttctggatggtggaagcggtgcccacgggaatcacgaccggctttctgggcgaggatggtgcagtcgatgacctgatcgccgagcagcatcaccagccattgggtcggacgcacgaactcttccttgcgtgcaccccagcgcatgcgcttggggatcggcaggtcgttcagggaatcttcgacgatggtcggcagcaggctggcggtcggcttgccggtgatgacctggctgaaacgcagtttcggaccgctctggtcgatctcgctcagctctacgccacatttcttggcaaagccaagggcggcctgggtcgggttgccttcggcatcgaaagccgcctggcgcggcgggccgtcgaggttgatgctgcggtccggctgctgggtttccagcgcggtcagcaacacggccaggcgacgtggcgcggcgtagacttttttcgcttcgaacttcaggccagcgctgtgcaggcctttttcgataccggccaggaacgcatcggccagggtattgagtgccttgggtggcaactcttcggtgcccagttcaaccaggaaatcttgagcactcattgtgcagcctccagcttagccaacacttcatcacgcaggtccggggttgccatcgggaagcccagcttggcgcgagccagcaggtaggcttgggcgacggaacgcgccagggtgcgtacacgcaggatgtattgctgacgcgcagttaccgagatggcacggcgcgcgtccagcaggttgaaggtatgggacgccttcaacaccatttcatagcttggcaacggcagcggctggtcgagttcgatcaggcgcttggcttcgctttcatagaagtcgaacagttcgaacagcttgtcgacgttggcgtgctcgaagttataagtggactgctccacttcgttctggtggaacacatcgccgtaggtgactttgccgaacgggccgtcagcccacaccaggtcgtagaccgagtccacgccttgcaggtacatggccaggcgctccaggccgtaggtgatctcgccggtcaccgggtagcactcgatgccgccggcttgctggaagtaggtgaattgcgtcacttccatgccattgagccagacttcccagcccaggccccaggcgcccagggttggcgattcccagttgtcttcgacaaaacggatgtcgtgcaccagtgggtcgaggccgacgtgtttcagcgagcccaggtacagctcctggaaattatccgggttgggcttcaataccacctggaactggtagtagtgctgcagacggttcgggttttcgccgtagcggccgtcagtcgggcgacgactgggctgcacataagcggcgttccaggtttccgggccgatggcccgcaggaatgtagcggtgtggaaagtgccggcgcctacttccatatcgtagggctgaagtaccacacaaccttgctcggcccagtattgctggagggcgaggatcaagtcttggaaggtacgcacggctggcgtaggctggctcacgaaattcacctgttacttgggctgcgatttaaagagcgggagtatacccgattcggccctgccaccaccccctggagccttatgccacgctgcttttggtgttctgaagatccgctgtacatggcttatcacgatcaggagtggggaacgccgctgcgcgatgcgcagggtttgttcgagttgcttttgctcgaagggttccaggcaggcctgtcctggatcaccgttttacgcaaacgcgagcattatcgaaaggtgttgtttggctttgatgcgcagcgtctggcgcaactgagcgatgacgagatcgaggtgttgatgcaggatccaggcatcgtgcgcaatcgcttgaagctcaacgctactcggcgcaatgccgcggcctggctggcgttggaggatccggtgggtctgctctggtcgtttgtcggcggcaaacccaaggtcaatcacttcaaggatcgcagcgaagtcccggcgattaccgccgaggccgaagccatgagccgcgccttgaaaaaagccggcttcactttcgtcggcccgaccatctgctacgccttcatgcaggcctcgggcatggtcatggaccacacccaagactgcgaccgctacgcggacttggccaacgccggttagaatgccggctttgcgcacacacgatcaggagtgacctgtggaaaagtttaaaggcgccttgctggtaggcgctctccggttgtttgccctgctgccctggcgcgccgtacaggccgtcggcacgggcatcggctggatcatgtggaaaacccccaatcgttcccgcgacacggtgcggatcaacctctccaaatgcttcccggacatggacccggccgagcgtgagcgcctggtgggccgcagcctgatggacatcggcaaatccctgaccgaaagcgcctgtgcgtggatctggccggcgcagcgttccatcgacctggtacgcgaagtcgagggccttgaagtgctgcacgaagccctggcctccggcaaaggcgtggtggggatcaccagccacctgggcaactgggaagtgttgaaccacttctattgcagccagtgcaagccgatcattttctatcgcccgcccaagctcaaggcagtggacgaattgttgcgcaaacagcgtgtgcaactgggtaaccgcgtggcagcgtcgaccaaggaaggtatcctcagcgtgatcaaggaagtgcgcaaaggcggccaggtgggcattcctgccgacccggagccggctgagtcggccggcatcttcgtgccattctttgccacccaggcactcaccagcaaattcgtgccgaacatgctcgccggccacaaggcggtgggcgtattcctgcatgccctgcgcctgccggacggctcgggctacaaggtcattctggaagcggcgccggaagacatgtacagcacagacaccgccacctcctgcgcggcgatgagcaaggtggtggagcgctatgtcggcgcctacccgagccagtacatgtggagcatgaagcgcttcaagaagcgcccgccgggtgaggcgcggtggtactgattcacagctgactcaagaccgatatagaaacaatgtgggagggggcttgctcccgatagcggtggttcagccaaatatgcattggctgacacactgccatcgggagcaagccccctcccacatttagtcctgtatcaagcctggcggtcgagttttttcaggaacacggtcatctctttttcggcttgtttgtcgccatgggcctgggccgcttcgatgcccctctcccaagccagtcgtgctgcggcgttatcacccaacccttgctgcgccttgcccaacagcttccacgctgccgaatacttcggatcgaactcgacgcatttgcctagatgctccgccgctttgacattgtccttcaagtccagataacccttgcccaacccgaagcgtagcagcgaattatccacacccttggcgagcattttttccagggattcgagcacgtcggtcactccgtctgatcagaaaaagctcaagcccacgtggaacagtttctccacgtcgcggatatgttttttatccacaaggaacagaatcacatggtcaccggtggcgatcaccgtgtcgtcgtgggcaatgatcacttcttcatcacgaataattgcgccaatagtggtgcccggcggcaggccgatatcgcgaatggccttgccgatgactttgctcgacttcgagtcaccgtgggcgatcgcctcgatggcttccgccgcgccccggcgcaatgagtgcacgctgacgatatcgccacggcgcacgtgggcgagcaaggtgccgatggtggccagctgcgggctgatggcgatatcgatatcgccgccctggatcaggtcgacgtaggccgggttgttgatgatggtcatcacctttttcgcccccagccgcttggccagcagcgacgacatgatgttggcttcgtcatcgttggtcagggccaggaagatgtcggcgtcggcgatgttctcttccatcagcaggtcgcggtccgaggcgctgccttgcagcacgacggtgctgtcgagggtgtcggacaaatgccggcaacgcgccggactcatctcgatgatcttcacctggtagcggctttcgatggcttcggccagacgttcgccaatctgcccaccgccagcgatgacaatgcgtttgtagctttcatcgagcctgcgcatttcgctcatgacggcgcgaatattcgctttggcggcgatgaaaaacacttcgtcgtcggcttcaatcaccgtatcgccctggggcaggatcggccggtctcgacggaaaattgccgctacgcgggtttctacattcggcatgtgttcgcgcaactggcgcagttgctggcccaccaacggcccaccgtagtaagccttcaccgccaccaattgcgccttgccttcggcgaagtcgatcacctgcaaggcgcccggaatctcgatcaggcgcttgatgtagtgggtcactacctgttccgggctgatcagtacgtcgacgggaatggcatcgttatcgaacaagccggcgcgggtcaggtaggccgcctcgcgcacacgggcgatcttggtcggggtatggaacaaggtatgggccacttggcaggcgaccatgttggtttcgtcgctgttggtcaccgcgaccagcatgtcggcatcgtcggcacccgcctgacgcagcaccgtcggaaacgatgcgcggccttgcaccgtacggatatccaggcggtcgcccaggttacgcaggcgctcggcatcagtgtcgaccacggtaatgtcgttggcttcgccggccagatgttcggccagtgtgccaccaacctgccctgccccaaggatgatgattttcatccggtcactcccttaaaaccattcagccgcgcgcggcggcgatcttgatcagtttggcgtagtagaaaccatcgtgcccgccttcctgcgcgagcagttggcggccgtggggctgcttgatgcctgcggtagtcgcgaggtcaagctcacgcgcgccgctggtgcgggcgaggaaggcctggatgacctcggtattctcggtgggcaaggtggagcaggtggcgtaaagcaggatgccaccgacttcaagggtaggccacagtgcgtcgagcagttcgccttgcagtacggccagggcggcgatgtcgtcgggctggcgggtcagcttgatgtccgggtgccggcgtatgaccccggtggcagagcacggtgcgtccagcaggatgcgctggaacggcttgccgtcccaccaagtggcggtgtcgcggccgtcggcggcaatcagttcggcgctcaagcccaggcgtgcgaggttttcccgtacgcgtacaaggcgcttggcttcaagatccacggccactacatcggccaggtctttttcgacttcaagaatgtggcacgtcttaccgcccggcgcacaacaggcgtcgagtacacgctggccgggcgccaagtcgagcaagtccgcggccagttgcgcggcctcgtcctgcacgctgatccagccttcggcaaagcccggcaggccgcgcacatcggcggcggcttccagcatgatgccgtccgtgctgtacacgcacggggtggcgttgatggccgcgtcggcgagtaattgtaggtacacgtcacggctgtggtggcgacggttgacccgcaggatcatcggcgggtgcgcgttgttggccgcgcagatagcctcccattgctcgggccagaaggctttaagggacttttgcagccagcgcgggtgggcggtgcgcaccaccggatcatgttccagctcggccagcagtgcttcgctttcacgctgggcgcggcgcaacacggcattgagcagggccttggcccagggctttttaagtttgtcggcgcacccgacggtttcaccgatggctgcgtgggctggtacccgggtgtagagcaattgataaaggcccaccagcaacagcgcctcgacatcagcgtctgccgctttgaacggcttttgcagcagcttggccgccagcgcagacaaccgaggctgccaacgggcggtgccaaaggccaggtcctgggtgaagccgcggtcgcggtcttcgactttatccagctgggttggcagtgaactgttcagcgaagccttgccgttgaggacggcggcgagagccttggaggcggccagacgcgggttcattgagcggccaccccaaggatggtgccgagggcaaatttctcacggcgactgttgaacaaatcgctgaagttcagcgctttgccgccgggcaattgcaggcgagtcaggcacagcgcctgttcaccacacgccaccagcaggccatctttgctggcgccgatgatttcgccgggagtgcctttgccgtcggccaaggatgcggcgagtactttcaaggcttcgccgttgaggctgctgtggcagatcggccacgggttgaacgcacgcaccaggcgctccaactccacggcggggcggctccagtcgatgcgcgcttcgtccttgttcagcttgtgggcgtaggtggccaggctgtcgtcctgtacttcgccttcaagggtgcccgacgcgaggccggcgatggcctggatcacggcggacggccccaactcagccaggcggtcatgcaggctgccgccggtgtcttgggcggtgatgggcgtggtgaccttgagcagcatcgggccggtgtccaaacccgcctccatgcgcatcacggtcacaccgctttccccgtcgcccgcttcaacggcgcgctggataggcgccgcaccgcgccagcgaggcagcagcgacgcatggctattaatgcaacccaggcgcgggatatccagcaccgcctggggcaggatcaagccgtaggccaccaccaccagcaagtccggcttcagcgcagccatttcggcctgggcctcggcattacgcagggtcggtggctgcagcaccgggatattgtgctccagtgccaattgcttgaccgggctcggcatcagtttttgcccgcgaccggccgggcgatccggctgggtgtacaccgcgacgatgtcataagggctggcaagcagcgccttgaggtgttcggcggcgaattcaggggtgccggcaaaaacaatgcgcaatggctcggtcatgggcgttctcggttaaaagcagtcacaaaagaaaaaggcttgccgcagcaagcctttggaagaagggtatcaagcttgctggcgatgctttttttccagcttcttcttgatccggtcacgcttgagcgtggacagataatcgacaaacagcttgccgttgaggtggtcgcattcatgctggatgcataccgccaacaggccttcggcaaccatttcgaacggcttgccatcacggtccaaggccttgatcttcacgcgcagcgggcgttcgacgttctcgtagaactccggcaccgacaggcagccttcctggtattcacccatctcgtcggtcagcggttcgaactcgggattgatgtatacccggggttcgctgcgatcttcagacaggtccatgaccacgacgcgcaggtgcacgttgacctgggtggcggcgagaccgatacccggggcttcatacattgtttcaaacatgtcatcgaccaactgacgaaccttgtcgtccactacggccaccggcttggcgatcgtgcgcaggcgcgagtcgggaaattcgaggatgttcaaaatagccataagcgtaattgctgcacatgtgaagtagagaccaatcggcggtgggatggacccacacggccggtgtgaaacgctcggaagccgcgaaggccatgacatttcacgcgaacgcacataataaaggagattgaccccatgaggaaatcgctactcgtcttgctgctatgggccccacttgccacggcactgattgcgcagcccaccgagcgcctgggccaggcgccgcaacaggccatccagcacttcctgctgcataaccgtattctcgattcaccccaggacctggataacgcaccttacattgtcgcagtacaaggcggtcgtgtgctgggcgccaacggcgagcgtatacatgctcgcggtagcttggacccggcccagcccagctacgggatctttcgtcggggcaaggcttacatcgaccctgatacccaggaactactgggaatcaacgccaatgacatcggcaccgcgcgctttttgctcgccgacaacctcactaccttggctgtgcagagggttacccaggaaatccgcccgggcgaccgtttgctccgtgccgaaccgcctgtcgagctggccaacctgcaagcagccaaatcagcacccttcatcgaagggcacattattgatattcccaggggcatcactcagttcggcgtgctggatgccgtgaccctgaataaggggcgccgcgatggcctggtagaaggtcagttgctcacggtgatcaaggctggcgccactgtgcgagacgcccttaccgacatgccgagccagcttcccgatgagcgggccggcaccctgcaggtctttcgcacctatgaaaagctcagttacgccttggtgctcagcgcttcacgcgccttggcagtgcaggatcgttttgagacagctcaacaagcgcaataaatagcctgctaaataagttaccaacagagttatccacagcttgttccggtcaaggatgatcaaatgaatccgataaacagcagtgaaatttctccggcagagctggaagcccgactacgcttgcacaggctgccggaactgggccccaagcgttttcatacgttgattgaagccttcggcagcgcctccaaggccatcagtgcccccgccagtgcctggcgttccctcggcttgcccgccatcagtgccgatgcccgacgtagcccgcaaatccgtgatggtgccagtgaggcgttggcgtggctgggccacccggcccagcatttgctgatgtgggaccagcctgactaccctgcactgctcgcccagatcgatgacgcgccgccgctgttatttgtcgcgggcaatccaggcattctggaaaaaccccagttggccatggtcggtagtcggcgggcgtcgcgcccgggaatggacacggccgctgcgttttcccgcagtctggcgagcgccggttttgtcatcaccagcggtctcgcactgggcattgacggcgcggcgcatcaggcggcactggaggtgggcggtcatacaatcggcgtgctcggcactggcctggaaaatttttatccacagcgccatagcaagctcgcggcgacgatgattgcccagggcagcgcggtggtttccgagtttccgctggatgcgccgccccaggccggcaatttcccacggcgcaatcggatcatcagcgggctctcgctgggcgtcctggtggtggaagccagcatggcgagcggttcgctgatcactgcacggctggcggcggaacaagggcgtgaggtgtatgcgatcccgggttccatccatcatcccggagccaagggctgtcatcagctgattcgcgatggcgcagtgctggtggaaaccatcgaacacattcttgaaggcttgcgcggttggcaagcgttgtcgtgccccgctccgctgccggttattcacccattggtggcgctgctgcatgcagcgccgcatagcagcgaagccctggcgattgccagcggccggccgttgtctcaggtgctggcaacccttacggaactggagctggaaggccaggtgacctgcgaaagcggacgctggcttgcgcgttgccagcttttgtagctgccagttctttggagctgggttttgtaacgaagatcggtaaactgcccagagctttagttcggagagtaaacaatggtcaacaggtggcgtgtgctggaagccgcacgggaaattcgcgcaggcgcggtgattgcctatccgaccgaagcggtctggggcctgggctgcgacccgtggaatgaagaagcggtggatcggctgctggcgatcaagaaccggtcagtggacaagggcctgatcctggtggcggacaatatccgtcagttcgactttctgtttgaagacttcccggacacttggatcgaacgcatggccagcacctggcctgggcctaacacctggctggtgccccatcaggacttgctgccggaatgggtcacaggtatgcatgacaccgtggccttgcgggtcacggaccacccgttggtgcgggacttgtgcgcacaggtcgggccgctgatttccacgtcggccaatcctcaggggcgtccggcggcgcgcacgcggattcgcgtggagcagtatttccgcgggcaactggacctggtgttgggtggtgccctgggtgggcgcaagaacccgagcctgattcgggacctggtaacgggggatgtggtgcggccctcctaagaccgaggtgcggccatcgcgggcaagccccctcccacatgttgaccgcgttgtcatgacggacacagatcaaatgtgggagtgggcttgcccgcgatgactcgcttaaggcaacaggattgttgagccggttgtacggcgccccgacaactctgtctgcgccttggctgcatccgccaacgaaaaccgctggttgatatcaatgcgcaccttgccgctcttgatcatcgaaaacaggtcatcggccatcgcctgcaaggcctgcgggttgctggcataggtcgccagcgtcggccgcgtcacgtacagcgagcccttggccgacaagatgcccaggttcacgccatctaccgcgcctgacgcgttgccgaagctgacgaccaaaccccttggcgccgtgctgtccagggaggtcagccaggtgtccttgccgacgccgtcgtacaccactgggcacttcttgctgtcagttaattccagcacgcgttgtgcgacattttccttgctgtagtcgatggtctcccaggcgccgagggatttggccagggcggccttttccggggagctgaccgtaccaatcaacttcacacccagggccttggcccactgacaggccagggaaccgacgccaccggcagcggcgtgaaacaggatagtctcgccgcctttcaactcgtaggtctggcgcagcaggtactgcacggtcaggcccttgagcatggcgccggcggcctgttcaaagctgatgtcctccggcaagtgcaccaggttggcggcgggcagcacatgcaactcgctgtaggcccccagtgggccgctgccgtaggcaacgcggtcgccgaccttgaactgggtgacttcactgccaacggcatccaccaccccggcgccttccgcgcccaggcccgatggcagggcgggcggtgcgtagaggccactgcggaaataggtgtcgatgaaattcaggccgatcgcctcgttacgcacgcgaacctgctgcgggccaggctctgccggcgtgtagtccacatattcgagaacttcggggccgccatgggcgctgaactggatacgtttggccatctgcacttctcctgaggttgcattcgcgtagccccctatcccactcctaagcttgatcttcgtcaactgcgacgcaacggaatgcagtggtatcctgtgcgcccatttgccgccgacgcccagtggcctcgcgtagctttgcccgattcaaggtgatgccatgactacccgcaccgaggctgttaaagcctacctgcttgacctgcaagatcgtatttgcagcgccctggaaaccttcgagacggacactcgctttatcgaagacgcctggacccggcctgccggcggcggcggtcgcacccgtgtgatcgagaacggtgcggtgatcgaaaagggcggcgtcaacttttcccacgtgtttggcagtggcctgccaccgtcggccagcgcccatcgccctgaactggccggtcgcggcttcgaggctctgggcgtgtcgttggtgatccatccgcacaacccgcatgtaccgacttcccacgccaatgtgcgctttttcatcgcagaaaaagacggcgaagaaccggtgtggtggtttggtggcggctttgacctcaccccgtactacggcaatgaagaagattgcgtccactggcaccgcgtggccgagcaggcctgtgcgccgtttggcccggacgtctattcgcgctacaaagcctggtgcgacacctactttcacatcaagcatcgcaatgagccccgtggcatcggtggcctgttcttcgatgacttgaacgagtggggcttcgacacctgctttgccttcattcgcgccatcggcgatgcctatatcgacgcttacctgccgattgtgcagcgccgcaaggccatggcctataccgagcagcagcgccagttccaggagttccgccgcggccgctacgttgagttcaacctggtctatgaccgtggcaccttgtttggcctgcaatcgggtgggcgcactgagtcgatcctgatgtcgctgcctccccaggtacgttggagctatgactggaaagccgaggtcggcagcgaagaagcgcgccttaccgactactttttgcaagaccgcgactggctcggcgttgtcgcgcccaaggcggcggtgtgatggatcggtatgtcgtgttcggcaatcccatcggccacagcaaatcgccgctgattcaccgtatgttcgccgagcagactggcgaacaactggactacagcaccttgcttgcgccgcttgaggatttcaccaattgcgcccgtgagtttttccaacagggccgtggcgccaacgtcaccgtacccttcaaggaagaagcctaccgtctggccaacaccttgaccgaacgtgcccagcgcgccggggcggtgaacaccctgagcaaattggctgacggcacattgctgggcgagaacaccgacggcgccggcctggtgcgcgacctgacggtgaacgccgggcttaacctgcacggcaagcgcatcctgttgctgggtgccggcggtgcggtgcgcggtgcgctggagccgttgctggcgcagcaaccctcatcgttgatcattgccaaccgcaccgtggaaaaggccgagctgctcgctgagctgttcgacgacctgggcccggtgtctgccagtggtttcgactggttgcgtgagccggtggatgtgatcatcaacgctacctcggccagcctggcaggcgatgtaccgccgattgccggcagcctggtcgaaccgggcaagacgttctgctacgacatgatgtacgccaaagagcccaccgcgttttgtcggtgggccacggaacacggcgcagcggtggtaatggatggcttgggcatgctggtggagcaggcggccgaagctttcttcctgtggcgcggggtgcgccctgattctgcgccggtactggccgaactgcgccgtcagttggcctgatacagatacaaaatatgggagggggcttgcccccgattgctgcctgtcagctaccgatatgttggctgacacaccgctatcgggggcaagccccctcccacattttgatcgtgttcagtcttcgaaatggatggggcaactgttggccccttccaattttcttaactcctcgattacctgcggcctggcccgacgcaatgtcaggctgcgtccctgccccgccaaccgccgcgcctcctgatgcagcatctccaccccggaatagtcgataaagttgatctgctgcgcctcgatcaccacccgttcgccctgcaagctttgcagtcgcacttgcaggtaatggctagcaccaaaaaagatcgagccgcccactcgcaacacatcctcctcaccgtcgcgccattgctgaacccgtggttgcgaggtgcgcttgagatagaaaaacagcgacgccagcaccccggcataaatggccgtttgcagttccagcagcaaggtggcgacacacgtcaggctcatcaccacgaattcggcgcgactgactcggaataatgctcgaatgccccggtggtctatcaggccccagcaaatcagcaggatgctcgccgccatgcttgggattgggatatgtgcgatcaacgccgcgccaaataacgcgaataacgccacccacagtgccgaaaacacccccgccaacggcgagcaggcgcccgcctcgtagctgaggcccgagcgggtgaaggagcccgccgacaggtagccggagaaaaatccgccgatgatgttggataaaccctgggcgcgcacttcctggttggcgtcgagcaactgttgcgagcgggctgacagcgaacgggcgatcgacaggctggtcaccaaccccagcatccccaccgctacagcgctgggcagcaagcgcaagaccaggtccaggtccatcggcaacgggctgaacggcggcagcttgccgataaacgcactgaccaatgccacatgcccgaacattgccggccacagccatgctgcgacgctgcccagggtcagggcgatcagcagcgttggccagcgtggcatcagatacttgagcaatgcaccagccagtaaagtgccaagccccagggcgagggaagcgtggtcccactctgccccatggtcgatcagcgccagcaggctattgatggctgtggcctggctcggcaaatccagccccatcagattgggcaactgccccagggcgatgaccacggccgcgcccagggtgaaacccagcaccaccgaatgggagacaaaattcaccagcgcgccgaagcgcagcaagccgagcagccactggaaaaccccggcgaggaaggtcagtaacaggatcagcgtgatgtagtcctgggagcccggcacggccagggggctgatgctggcgtaaagcacaatggaaatggccgccgtaggcccgcagatcaggtgccaggacgagccccacaggcatgcgatcaacaccgggatgatcgcggcatagagcccgtattccggcggcaggccggcgatcagcgcgtaggcaatcgactgcggcaaggcaagcacggcgccactgaggccgacgatcgcatcccggccgacgctggcgcgggtttggcgcgggagccagctgaggaaggggaagagtgtatggcggttgggccggggcatcgcaggctcgggtaggaggtttggcttagagtatcagtacacaccggctccctgtgggagggggcttgctcccgatagcggtgtttgagccaatacattcatagctgataggccgtcatcgggggcagtcccctaccacatttggatcgaggcgcatcttagagttgagcttttaccgcgggcaacgcatcctggccatccagggttttcacgccgtcgagccacttgtccaacaccgccgggttggccttgacccacgccttggctgcctcggcattgctgaccttgttattggccacctcagccatgacgctgttctccatctcctgggtaaaactcaggttggtgagcagttttcccacattcgggcaggcctgtgcgtaacccttgcgggtcaaggtatacacgctgccggtgtcgccaaagtacttttcgccgcccttgaggtaacgcattttcaactgcacgttcatcgggtgcggcgtccagccgaggaaggtgacaaaacgctgtctcttcaccgcccgcgagacttcggcgagcatcgcctgttcgctggattcgatcagtttccactggccaagatcaaagtcatttttcttgatgatctcctgcagcgagagattcgctggcgcgccagagccgatgccgtagattttcttatcgaacttgtcggcaaacttgttcaggtcggaaaactcatgcaccccggcgtcccatacgtaatccggcacggcgagggtgaactcggtgccgtcgaggttcttcgccagttgcaccacatcgccgttgaccacgaacttgtcgtagaaaccctgttgcgccggcatccagttgccgaggaatacatctacctggccgtccttgaggccgccaaagataatcggcaccgccagagtgtctaccttgggtttgtaacccatgcccgtcagcaaaaagccagtaatggcgttggtggcggcaatgtcgctccagcctggatcggccatctttaccgtgtcacaactggcgtccgcgtatacgttggcgctggtcagcgccagcatgcccagcacaaccgtcaacttttgcatggccttccctctgtctatttattggttttggcagggttgtggataacgtgccttgcgctccaggtcgtcgaggtcgatatggttgcgcatgtactgctgactggcgtccaccagtggctggtggtcccagctcttcagcttgccttgggtcagcgcctcgaacaccaggcggcgacggcgttggctggcgagcacctgctggtggatcgccgggatgtcccatttagcccgcgcttcacgcaaaaacgcttcgaacaacgcccggtgttccggtgactcgctgaggtcctcccgctcgtgcgggtcgttgtgcacatcgaacagtagacaaggatcgtcttcgctgtagatgaatttgtaggcgccccggcgaatcatcatcaacgggctgatagtgccttcggccatgtattcgccaaacacttcgtcgtgcccgccctgcccctgcaagtgcgggaccagcgaacggccgtccagtggcaggcatgggtccagctcgccaccggccagttctaccagggttggcaacaggtcagcagtggacacggcctgagtgacgcggccagcggcgaactgccccggcgcactgatcagcagcggtacgcgggcagccatttcgaaccagtgcattttgtaccagaggccgcgttcgccgagcatatcgccatggtcgccggagaagatgatgagggtgtcgtcggccaggccggtgtcttccagagtttgcaagagcttgccgacattgctgtcgatgtagctgcacgccccgaagtaggcgcggcgcgcatcgcggatcttgtccacaggcagcggtttgtcccacaagtcatagaccttgagtaaacgctgggagtgtggatccaaatctccttgcgccggcgctgcaggcaaagggatgtcggcgtcttcgtacagatcccagaacggcttgggaatggtgtaggggtcgtggggatgggtcatcgacacggtcaggcagaacggctggtcaccgtcctcacggatatgatcgaacaggtactgctgggccttgaacaccacctcttcgtcgaaatccagctggttggtgcgcacacacgggcccgcttgcagcaccgaggacatgttgtggtaccaggtggggcgtacgtccggttcatcccagttcactgcccagccatagtcggccgggtagatgtcgctggtcaggcgttcttcgtagccgtgcaattggtcggggccgcaaaagtgcatcttgcccgacaatgcggtgcggtagccgaggcgtcgcagatagtgggcataggtcggcacatcggcggggaaatcggcggcgttgtcgtaggcgccgatcttgctcggcaactggccgctgaccagggtgaagcgcgacggtgcgcacaacgggctgttgcagtaagcggcgtcgaataccacgccttgagcagcgaggcggctgaggttgggcaacttgatcggggacggcccgtagaacggcagcattggcgcggccatttgatcagccatgatgaaaagaatgttcttgcgcttcatgggttctcggcattccataggcggtgtttatgcgaacgatcatgcagcccaagaaatattgggtaaagcccatgaagagcaatgtctaggataagtaaaacttatgtatgaagcgctgggtgacctttccctcgatctgctgcgtgcctttgaagccgcggcgcgccaccgcagtttcaccgccgccgcgatggaactgggcaccacccagccggccgtcagccagcagatcaagcgtcttgaagagcaattggcaatccgcctgtttgaccgcatttatcgcggtatcgaactgaccgacgccggcgcgctgctgttcgagcatgtgcaaagcggcttgcagagcatcaaccagggccttagcgccatttcccagcaagaccagcatgaagtgctgcaggtggccaccgacttcgccttcgcggcctattggctgatgccgcgcctgcaccgtttccaccaagccaacccgcaggtggatgtcagcctggtgaccagtgagcgcaaccacgccaccctgcgcagcgatatcgatgtggcggtactgtttggcgatggtcgcttcaagcagggcgacagcctctggctgttcaatgaggaggtgttcccggtgtgcagtccgcaatggctcaagggccaggctgcgccactgacggtgcagaccttgcaggactacccgttgctgcacctgcgccaggaaaacaacagccagtggttcgactggagcggggtattccgtgaactgggcatcaccgctgcgccgactcctggccaactgcgtttcgacaactacaccttgctgatccaggccgcgattgctggtcaaggtgtggccatcggctggcgccacttggtggataacctgctggagcaaaactggctgtgtcgaccaatcagcgacaccgtgacctcgcggttcggctattacgtggtgcagccccagcgcaagcgccgggggcgattggtcgagcgctttgtcgagtggctggtggctgagcaggccagcagtgcgcagtcgttgaccgggctggccctgccatcgattgcggtctaggatcggcgcatattggatccggagtccgtcatgcaacgtatcaagggctaccacgcccacatctacttcgatgccagcactatcgaacaggcccgtaccctatgtgaagacgcggccaggctgtttcccctgcgcatgggccgtgtgcacgagaagcctgtgggtccgcacccggattggagctgccagctggcgttcgagccggaatacatcggtgtggtattaccgtggctggcgctgcatcgcaatggcttggtggtgttcctgcaccctgaaaccggcgatgacttgaaggatcacaccgactacgcggtctggatgggggccatgcgcgaattgaatttgtcggttttttaaccttccttatcagataaagccttgcgtctccgtcgcaaaaatccgggagagctgtaggacttatcttgtcttgtctcattatgtgggattgatatttatatattgagatatccctggacgtaggtttatattcgcccatctgcttttttcagcacccacacatttcaggtgaagcgatgcaggcgcaattgatcgcgctcgattgggggaccagctcccttcgtgcttacaaactcggccccgcaggcgtagtgctggaacaacgctcgctggcctcgggcatcatgcatttgcccagcgaaccccgaagcatcgccggcgttgactgcactaacggctttgagttggcgttcgataccgcctgtggcgattggctcgacgcccaaccgggtttgccggtgatcgcctgcggcatggtcggcagcgcccagggttggagcgaagcggcttatcgcagcacccctgtagatgtcgccggcctcggccaagcgttgcactgcgtacgcagcttgcgcgcagtggatgtgcatatcgtgccgggggtgattgaacaggttggcctgcccaatgtgatgcgtggcgaagaaacccaggtgctcggcgtgttgcaaggccttggtgcccaggtgttgattgggctgcccggcagccattccaaatgggtcgaggtggtcgaaggtcgcattactcatttcgacaccttcatgacaggtgaactgtttgcgatattgagcaagcacagcatcctgggtcgcacccaacagccgtgcgagcagttccaggccgaggctttcgatcgcggtgtgcaggtggcgctttcaaaagacggcgagcgtggcgtgctgtcgacgctgttcagtgcccgtaccctggggctgaccgctgaactggcgcccgagcagcagcccgactacctgtccggcctgctgattggccacgaactcgccggcttgccagacagcgccaaacataaacccatcatcctggtgggcgcggcacccctctgcgtccgctatcaacgcgccctcgccctttgcggttttgcccacgtgagcctggcgcaggaagccaccgaacgcggcctgtggcaattggccgtggcggctgggctcattcaacctgtaacggaggcctgacatgctcaagcaagcactcgcgcaaaacggtttgatcgcaatcctgcgcggcatacgcccggatgaagctcaggctatcggtaaggtgctgtacgacgcgggttttcgggtgatcgaagtcccgctcaattcgcccgacccgtacaccagtatccgcaccctgcgcgacagcctgcccgccgattgcctgatcggcgccggcacggtgttgacgccggaacaggtcgagcaggtcaaggctgcgggtggtcaggtgatcgtcatgccccatagcgatgccaaggtcttgcgtgccgccaaggcggcgggcctgtatttgtcgcctggcgtggccactcccacagaagcttttgctgcactggccgaaggcgccgatgtattgaagctgttcccggccgagcaaatcggcccggcagtgatcaaggcatggctggcggtattgccggctggcaccttgttgctaccggtgggcggcgttaccccggacaacatgcaggtgttcatcgacgccggtgccaaggggttcgggttgggttccgggctgttcaagccgggaatgacagtggatcaggtcgcgagccatgcccaggcttatgtcgccgcctggaaagccctgagctgatatcaaattccgcgcccacaggcgctgcatctataagagagacaagagatgaaaatcaccaaactgacgacctttatcgtcccgccgcgctggtgcttcctcaagattgaaaccgaccagggtgtgactggctggggtgagcctgtggtcgaaggccgcgctcacaccgtcgcggccgccgtcgaagaactgtccgactacctgatcggcaaagacccacgcaatatcgaagacatctggaccgtgctctatcgcggcggcttctaccgtggcggagccgtgcacatgagcgccctcgccggcatcgaccaggccctgtgggatatcaagggcaaggccctcggcgtgtcggtcagcgatctgctgggcggccaggtgcgcgacaagatccgcgtgtactcgtggatcggcggtgaccgccccgccgacaccgcccgcgccgccaaagaggccgtggcccgtggtttcactgcggtaaaaatgaacggtaccgaagaattgcagttcgtcgacagcttcgaaaaagtcgacctggccctggccaacgtcgcggccgtgcgtgatgcggtcggccctaacgtgggtatcggtgtcgacttccatggccgtgtgcacaagcccatggccaaggtgctgatgaaagagctcgacccctacaagctgatgttcatcgaagagccggtgctcagcgaaaactacgaagcgttgaaagaattggcaccgctcaccagtacgccgattgccctgggcgagcgcctgttctcgcgttgggatttcaagcgcgtactcagcgaaggttatgtcgacatcatccagccggacgcttctcacgcgggcggtattaccgaaacccgcaagatcgccaacatggccgaggcctacgacgtggccttggccctgcattgcccgctcggcccaatcgcgctggcggcgtgcctgcagttggatgcagtttgctacaacgcgtttatccaggagcagagcctgggtattcactacaacgagagcaatgacctgctcgactatgtgcgtgaccctggggtatttgactatgaccagggctttgtgaagattccgaacgggccgggccttggcatcgagatcaacgaggaatatgtggttgagcgcgcggctatcggccatcgctggcgtaacccgatctggcgtcatgccgatggcagttttgccgagtggtgatttctgactgacgcaactgaggttcaaaaatgtgggagggggcttgctcccgatatcggtaaatctgccaccgacgatgtcgactgacactcagccatcgggtgcaagtcgaatcgtcgcaccgcccctcccacatttctaaccgcgtttattcagttagacctatcctcaataaacataagaagaggcacccccccatgcatcctgaatccctccccgggcaggcttctttagtcacgcccagccgaaagcgtttcttcatcatggtgctgctgtttatcaccgtggttatcaactacctcgaccgcagcaacctgtcgattgccgccccggcgctgaccagcgacctgggtatcgacccggtgcaggtcgggctgattttctcggcgttcggctggacttacgcggccatgcaaatccccggcggctggctggtagaccgcgtgccgccgcgtattctgtatacggtcgccctgctgctgtggtcgattgccaccgtcatgctcggtttcgccgccagcttcatcgcgctgttcgtgttgcgcatggcggtgggcgcattggaagcaccggcctatccgatcaacagtcgtgtggtcaccacttggtttcctgagcgcgagcgcgcgaccgcgattggcgtctacacctccgggcaattcgttggcctggcgttcctcacgccggtcctggcctggctgcaacaccaatacggttggcacatggtgtttgtcgtcactgggggtgtcggcatcctgtgggccgcgatctggtacgcggtgtatcgcgagccgaaggatttcaagggcgccaatgcggctgaaatccaattgatccgtgacggcggtggcctggtagacatgcaggcacaaaccgccaaggcgcctttcagttgggtcgacctggggatcgtgctgagcaagcgcaaactctggggcatctacctgggccagttctgcctgaactccacgctgtggttcttcctgacctggttcccgacgtacctggtgaagtatcgcggcatggacttcatccagtcaggcttgctggcatcattgccgttcctcgccgcgtttgtgggcgtgctgtgttctggagtgttttccgattggctgattcgccgtggagcctcggtgggctttgcgcgcaagctgccgatcatcagcggcctgctgatttctacggcgatcatcggcgccaactacgtagactccatggcgtgggtcatcgcgttcctggcggtggcgtttttcggcaatggcctggcatcgatcacctggtcattggtgtcgaccctggcgcctgcgcggttgctggggctgaccgggggcgtgttcaacttcatcggtaacctggcagcgattgccacgcctatcgtgattggctttctagccagcggcgattcgtttgcgccggcgattacctatattgcggtactggcattgcttggtgcgctttcctacatattgctcgtaggcaaagtcgagcggatcgagctgtaaaagcgggcgaccttagggtcgccctttttcgagctacggcaccgacatctcgttacgaaaaatatggcgtgggtcccagcgctgcttggtacgccgtaatcggctttcgatgatcaggtcggggaagaaggtttggtaccactgagggtttttaccgttggccgggttgcctcccacgtaggtcatatcgaggtcggggtagttgatgtagcaaccttcgaactcattgttgatcggtacgccctggtcagtggcaaacgcgttgaaatacagcccttggatccagtcggcatgagcttgatccgaggcggcgctgtcatcgcgccagtaacattgtggctgccacttgaggtaggaggagcgctgtgctgctgaggattccctgcgcacaggcccgctggcggcattgatctggccaccgaaagactgaatctggacaaggctttgtgtcaggtgcttgtctgggtctggccagttcaatgtggaccagatggcgtccagtacctgaggggtgaatgggcccttttggtaagccgacttatagcgcccgcgctggttgtcccctgagccattcaacgtctgttggcacaccagccaatccaggcgctgctcggctgccttcgcggtcgagactgagtcgatggtgcgaccagtggcggtgccgggcggcagatggatgacatgaaacggcaccagcgattcggtggcgggcaggccaatggcggtgagcatcctgctcacaaagtcattgaagggtgcccggtcgttcagttccccatccttgtccacatagtgaatgcccaaggtcatgttgcccgtgtgccggtggcgcatctccaatttggtcgccagcccccaggtgtccgggttggcttgattactggcgaaccatgactgataggccaccagcaggttatcgagtgcaggcttggtcagtacggaccagtcccattccagcaccagccacagcacctccttcggtgccggtggcaggtctttgaagtagtagctggtgatgatgccgaactgcccgccgcccgcaccacagcacgcagcgaacaggtccagttcatcctggctggcgctgtccctggaaacgtgacgcgcttccaggcctatgccttggctgtcaggcaccaggatgtccacaccgctcagccagtcacacaccagaccatatttgcgcgacagcagcccatagccgcccccgcaaatgtgcccgcccaggcccaccgaataacacgatccccctggcagggtcttgttggccagtttgtataacgccacgtagacatcccagttttgggcaccggcttccaggcgaaagctatagcgttcagttgctgcggggtccagatcggaaccgatttgcccgtcagcgtcgtagaccacttggttcagcgcactgatgtccaggatcgacagcacctcatgggggctgtcgggcatcttgttggcgacaaaaccttcgtagcaatggcccccgctgcgcacggtaatgcgcccgtcgggttgggccaatgcctgtgcggcggcgtcaatgatgtcttgcggactgtgacagaggtagatcaggttggcgccgttgggcgaggactggccctgcacgttgccgagcggccagcgcaggttgaaacctttttgcaacgttgaatgacggcggtctgaaggggtgatgagatcaaatgccatgatgtactcctgaagagacaaagatgacttctgatgcggctaacttaacgaccgggggcaaggactgcgtggcctgcgagggtggttagacgacaaagggcacgaagcgcgttaaaagaaggcgggcaacatgcccgcctccgttgaagcctagctgattagccgaaaggcgctcggatggaggaattacatttacgtgcgggcgttacgcacaccttccgacagcgccgcgcacaggctcaatacgccatcaatggcttgctggtcattttcggcgttggcgatgtgatcaatcagcgccgaccccaccactacaccgtcggccaggcgcgcaatggccgctgcctggtccggcgtgcgtatgccaaagccgatgctgatcggcaggtcggtatgacgacgcaggcgcgtcacggcttcttcgacgtgctccagtgtggcggcaccggcaccggtcacaccggccaccgacacgtaatatacaaagccggagctgccgttgagcactgtgggcaggcgtatgtcatcggtggtcggggtggtcaggcggataaaatcgatgcccgcggcctgggccgggtcgcacagttcgccgttatgctcaggcggcatgtcgaccacgatcaggccgtcgacgccggctgccttggcatcggcaatgaactgcggcactccgtatttgtggatcgggttgaaatagcccatcaacaccagtggggtgtcgttgttgtcctggcgaaattcgcggaccatttgcagggttttcaccaggttctgcttggcggtcagcgcacggatattggccagttgaatagccgggccgtcagccatcgggtcagtgaagggcatgcccagctcgatcacatcggcgccggcggccggcaggcccttgaggatcgccagcgaggtgtcataacccgggtcgccggcggtgacgaaggtcaccagggcggcgcggttttgttccttgagttgcgcgaagcgggtttgcaggcggctcatttagtgtttctcctgctgagactgttccatgtggtgcatcacggtctgcatgtctttgtcgccacggccggacaggttgaccaccatcaggtgatccttcggcaaggtcggtgcgcgcttgaatacttctgccagggcgtgggcgctttccagcgcagggataatcccttccaggcggcagcacttgtggaaggcgtccaaggcttcgtcgtcggttaccgaggtgtactggacgcggccgatatcatgcaaccaggcgtgttcagggcctatgcctgggtagtcgaggccagcggaaattgagtgggcgtcgatgatctggccgtcgtcgtcctgcagcaggaaggtgcggttgccgtgcagcacgcccggtacgccgccattgaggctggcggcgtgcttgccggtttcgatgccatggccggccgcttcaacaccgatgatctcgacgctggtgtcatccaggaacgggtggaacaggcccatggcgttggagccgccgccgatgcatgccaccaggctatccggcaggcggccttcctgggcttgcagctgggtacgggtttccttgccgatcacggcctggaagtcgcgcaccatcgccgggtaagggtgtgggccggccacggtgccgatcaggtagaaggtgctgtcgacgttggttacccaatcacgcagggcttcgttcatcgcatctttcagagtaccggtgccggcgaccaccggaatcacttcggcgcccagcaacttcatgcggaacacgttggcctgctggcgctcgatgtcagtggtgcccatgtagattacacattgcaggccaaagcgtgcggcgacagtggcagtggccacgccgtgcatgccggcgccggtctcggcgatgatgcgtttcttgcccatgcgccgcgccagcaggatctggccgatgcaattgttgatcttgtgcgcgccggtgtggttgagctcttcgcgcttgaggtagatcttggcgccgccacagaactcggtcaggcgttcggcgaagtacagcgggctggggcgtccgacgtagtcgcgctggaagtaggccagttcttcattgaacgccggatccaccttggcagcttcgtattcacgggccaggtcgagaatcaacggcatcaaggtttcagcgacgtagcggccaccgaacccaccaaacaggccgttggcgtcagggccgttgcgtagatcggtctgggactgagtcatgggacgctccagggaagaatgtgtttaagaggcaatgacggccactctacccctgacgctgtagcctgaaaaccgataagatcgcctcaacctgtcaggaaaactcacagatgagccgcgaccttccacccctcaacgccttgcgcgcatttgaagccaccgcccgcctcaacagcgtcagccaggccgccgagcaattgcacgtgacacatggtgcggtgagccgccagttaaaagtgcttgaagaacacttgggggtaagcctgttcgtcaaggaaggacgaggcctcaaactcacagatgcgggcgtgaggctgcgagatgccagcgccgaggcgttcgagcgtttgcgggacgtgtgcgctgagctcacccagagcagcgccgatgcgcctttcgtgctcggttgttcgggcagtttgctggcgcgttggtttattccgcgcctggggcgattgaatgcggatttgccggacttgcgcttgcacctgtctgccggcgaaggtgaccttgaccctcgtcgccctgggttggacgcgctgctggtatttgccgagccgccgtggccggcggatatgcaggtgtatgaactggccagcgaacgcatcggtccggtcatgagcccgcgttttgacggttatgaacagttgcgcctggcaccggcatcggccttggctgatgaagcgctgttgcacaccacgtcgcggccccaagcctggcccagttgggcgcgtcaacacgatatcgagcccggcgcgttgaaattcggccagggattcgagcatttgtattatttgctcgaagcggcagttgcaggattgggagtggcgattgcgccagagccgctggtggcagaggacctgcgtgcgggtcgcctggtggcgccgtggggtttcagcgaaaccccggcgcacctggcgttgtggctacccaagcgcgccgcggatgggcgcgccgggcagttggcgcaatggctcaaggccgagctgatgcgccaaccgctatagccggtaaatcagtcgccgcgcttgcacagcaggtaagccgccagcagacccagcgcgccaacggcgacgccggcggtggtccatggatgctcttgtgcgtagtcccgggtggcaacaccggtttcgcggattttgactttgctttcttcataggcatcgctgatcagatgacgagagtgcttgagggcgttctcggcattgcttttcagggccttcagcgttttgcgcgactcatcggatgcatcatccttgaggctctcaagggacttgagcaggctcgagatctcggcttccatgctttccagcgacgctttgcgtaaagaagtgttggccatgtgaacatctcctgaagtgattgagtggcgtgtgtagataccgactgcggcggtttcagaaagtgcagtaattctgaactttcacctctcaacggtcgccagaagcagtacgagtattcactgctagtcttgattaacgacccctaggagaaacgccatgagtgatcatcacacctacaagaaagtcgaactggtgggttcttccaccaccagcattgaagatgcgatcaacaatgccctggccgaggccaataaaagcatcaagcacctggagtggtttgaggtgaccgaaacccgtggtcacatcaaggatggcaaggccgcgcactttcaggtcacgcttaaggtgggattccgaattgccagtagttaatcggctgagttgaactttgaccgctggccgattgccataacctgcgctacaaacaacgggtgccgacgcgatgagcgtcggcacgctctttcgatcagcgcaaggaaagtaacggatgaagaagtttctgttggcggtaggtttgttgagcattgcgggcacggccctggcggcgggcaagccttgtgaagagctgaaaagcgaaattgcagcgaaaatcgacgccaagggcgcgtcgggttattcgctggaagtggtggataaaggcgcttcgaccgacgctgaagtggtcggcacctgcgaaggtggcaccaaggaaatcgtctacaaacgcggttaatcccgtgttgcagacataaaaaaccgacgcaggtgcgtcggttttttttcgtctgggttcagcctttcataacctgtgccagcaactcgtaggaatgaatccggtcggcgtgctcgtacaggtcactggtgaagatcagctcatcggcgccggtctgctcgatcaacacctccagcttggcgcggatcttcgccgggctgccgaccatggccaggccgaggaagcttgcgaccgcgtctttttcatggggcaaccacaggccatccatggtttttaccggtgggcgctgtaccaggctctggccgcgcatcagcgcgaggatacgctgatacaccgaggtggccaggtaatcggcctgttcatcggtatccgccgccaccagaggaatgccgagcatcacgtagggcttgtccaacactgccgacggcttgaagtgattgcggtacacgcgaatcgcctcatgcatcaagcgcggtgcgaaatgggaggcgaaggcgtagggcaaaccccgctcaccggccaattgcgcgctgaacaggcttgaacccagcagccacaccggcacgttggtgccggtacccggtacggcgatcacccgttgatcgggcgtacgtgggcccaggtaggccatcaattcggccacatcctcggggaaatcatcggcactgcctgagcgttcacggcgcagggcgcgggcagtcatctggtcggagccgggcgcacggcccaggcccaggtcaatacggccggggtagaggctttccagggtgccgaactgctcggcgatcaccagcggtgcgtggttaggcagcatgaccccgccggaacccacgcggatggtcgaagtgccgccggccaggtagccgagcagtaccgaggtggccgaactggcgatgccgtccatattgtggtgctcagctacccagaaacggtggaagccgaatttttccacgtgctgggccaggtccagggaattgcgcagcgactgcgctgggttgccgtcggcgcgcacgggcaccaggtcgagggtcgaaaattttacgtcggacagcgatttcataagcctgcttctccaaaggggcgcacaggctttttttatcgagccaaaacctgccgcggcatgtgcatgccctatgcaatgagggcatatacccgagattcaatagtacgcgagaaatttcctacttaatcactaggtttttcttacgagtgaactttgccgtggcgtctatcctcagaacccttactgacacaaaaccaccgttcgaggagaaagctatgagcatcgttaaaaaggcatccgcgcattgggaaggtgatctgaagactggcctgggttccatttccacggaaaccggcgtactgcgcgaagcgccctacggcttcaaggcccgtttcgagggcggcaagggtaccaaccctgaagaactgatcggcgcggctcacgccggctgtttctccatggcgttttccatgattctcggcgatgcagggctcaaagccgacagcatcgacacccaggctgacgtaaccctggaccaggtcgatggcggctttgcgattactgcagtgcatctgaccctgaaagccaagatcccaggcgccagccaggcacagttcgatgaactgagcaaaaaggccaaggaagggtgcccggtttccaaggtgctgaatgcgacaatcaccctggatggcacgctggttaactaactcagcactgcctgtgtgggagggggcttgcccccgatagtggtgggtcagccaatagttggatggcggatacacctttatcgggcacaagccccctcctcatttagttctgcgttaaatcagaactcgtgtttcccctatgtggtcctatagcctatgcagccttaggcgcacactcgtgcgcatgcattcagggagctacacacatgaaacgttttgccttggcgatcatctgcggtgtattggccacttcggccgtggccgctccaaaagattgtgaagagctcaggaaggaaattgaagtacaactccaggccaaggcgattccgtcctataccttggaaatcatcactgccgaagaagccaagaaccatgacgaagccatgattgtcggttcgtgcgaaaacggcaccaagcgcatcatctatcagaagaacaacgactgatcagatgcagttaacgctgcgttcttcggccagcaactgccgtgctgagtcatacagccggatattgggcgtgaacgccagcgagcggccttcgagcacatagcgctggccggcctggaaatggtcgtactgcaaggtcatgaagcaggttcgatacatcatctggctgaggccccccaaaccaccgccggcgggcacttcaaaatcaaagcgcaccatcagctcgtgagggccggggggcatctggaaaaagcgcccgtcgtcgaggttcttcccatccaggcgctgggccatgaccaacttggagcccggggtcggcgtagtgaagtcgacccaggcctgctgcggatcaacgggtgggatgggcgtcgaaacgcaggcgctgagcaccagggtggcgaccggcaacacaaactgacgcatggcaagtactcaacgcgaggagaggcttgagtataaacatgcagcgccgtggaaaaatccccttcaagcgcgatagtctcgcgcatcaatcacccaggagcagtcggggcatgatcaggcgttttcttccagggctgatggttgtgctactcagcggttgttccagcgtcagttattacagccagttggcgagcggccagtggcagttgttacgcgccagggagccggttgccgaggtcattgccgacccctctcgcccgccattgctgcgcgagcatctgattcaatcgcagaaagccagagcctttgccagtgagcacctgcatctgcccgacaaccaaagttaccggctatatgccgatatcggtcggccctatgtggtgtggaatgtctttgccacgcaggagttttctctgtctgctgaaaaccactgctttcccattgccggatgcgtcgcctatcgcggctactacagccaaagtgcggcgcgtggcgaagcggcgttgttgcggcaacggggcatggacgtatcgatcggtggcgtcgaggcttattccaccttgggttggttcaacgacccgatcatgagttcgatgatgagctggggcgacgagcgcctggccacgcttatttttcatgaactggcccaccagcgtttttacgtgaaagacgacaccgagttcaatgagtcctatgccagcttcgtcgagcaggaaggcactcgtcaatggcgggcggtacgaggcctggcgcctgtcagcgattcggcgttgaagcaacgtgatcagtttatccggctgattctcgatacccgcaaacgcctggaagcgttgtatgcgcagccgttggcagcggatgtgatgcggcaggccaaagcggcgcagttcgagcgcttgcgcagtgaataccggcagatgcgtgatagccaatggggcggcgacaagcgttatgacgcctggatcaaccagccgatgaataacgcacggctgttgccgttcgggctgtatgaccagtgggtgccggcgtttgcggcgttgtttgcccaggaaggtggggattgggtgaagttttatgcggctgtggaaaggctgggtgggttgccagtggcgcagcgtaaagcggagttgaggcagttggagggtgctggccgttagggcctaatcgggggcttgcccccgatagcggtttcaagcgcgctgcaaaaacgcctgatgcatctgcgccaacgtctcgaaatgccaggtcggcgcctcggcattgagctcttcaaaactgccaaacccataccccaccgccgccgaatccagctcgttgctgcgtgcgccgatcaggtcatgcttgcgatcaccaatcatcaaggtggtggccgggtccagcccttcctcacgcatcaagtgggcgatcaactcgatcttgttggtgcgcgtgccgtccagctcgctgccgtagatcaccttgaagtgcttggcgaagtcgaaatgccgcgcaatctcacgggcaaattcccacggcttagaggtggctacgtatagctggcggccctggctgttcagctcttccagcaatggcatgacgccgtcgaatacgcggttttcatacagcccggtgaccttgaagcgttcgcgatagaaattcaccgcttcccaggccttggcctcgtcgaagccgtagaactgcatgaacgcctgcagcaggggcggaccgatgaagtgttcgagcttggtcagatcgggctcctcgatgcccaatttgccgagggcatactggatcgaccgggtaatgccctcacgtgggtcggtcagggtgccgtccaggtcgaacaggacggtggagtggtttagattcattgatcgaagccttcagccaggtgcaggtccttgagcttcacgtagttcgcggcgctgtaggtgaaaaaggcacgctccttgtcagtcagggcgcggacctgtttaaccgggctgcccacgtacaagaagccgctgtcgagtttcttgcctggcggcaccaggctgccggcgccgatgatcacgtcgtcttcgaccacggcaccgtccatcacgatgctgcccatgccgatcaggatgcggttacccacggtgcagccatgcagcatgaccttgtgggcgatggtcacgtcgtcaccgaccagcagcgggaaaccgtcaggattgaacggccctgcatgggtaatgtgcagcacgcagccgtcctgcacgctggtacgtgcaccgatgcggatgcggtgcatgtcgccgcgtatcactgtcagcggccataccgagctgtcggcgccgatttcgacatcgccgatcaccaccgccgaaatatcgacaaaagccccggcgcccagggatggcgtgtggttctgataggtgcgaagggtcacgatagtgtctctctcttctgctgatagctgcggtgggtgttgattgtaattaagatggccccatctttgttcttacatgtttcttcagccaaggtgccaaccgtgagcgcgaacaaccctcttttgcagtcctacgacctgccgccgttctcggcgatccgtgccgagcacgtccagccggccatcgaacagatcctcgccgacaaccgtgtggctatcgcagacatcctgcaaagccagggtaaaaatccgacatgggccggtctggtccttgccatggatgaactcaatgatcgtcttggcgctgcctggagcccggtcagccacctcaatgccgtgtgcaacagcgccgagctgcgcgaagcctatgaggcctgcttgccggcattgagcgcctactccaccgaaatgggccagaaccgcgaactgttccaagccttcgaagccttggccaacagcccagaggccgccggtttcgacgtggcgcagaaaaccatcctggaacacgccctgcgcgatttccgcctgtcgggcatcgacctgccgccggagcagcaaaagcgctacgccgaagtgcagagcaagctttccgagctgggcagcaaattctccaaccagctgctggacgccacccaggcctggaccaagcacgtcaccgatgaaaccaccctcgctgggctgactgactcggccaaggcgcagatggctgctgcggcccaggccaagggccttgatggctggctgatcaccctggaattccccagctactacgcggtaatgacctacgcccaggaccgcgccttgcgtgaagaggtgtacgccgcttactgcacccgtgcatcggaccaaggtccgaacgccggccagaacgataacggcccggtgatggagcagatcctcgacctgcgtcaggaactggcccagttgttgggttttgcatccttctccgagctgagcctcgcgaccaagatggccgagtccagtgaccaggtgctgagcttcctgcgcgacctggccaagcgcagcaaaccgtttgccgcccaggatctgcaacagctcaaggcctacgccgcggaacaaggctgcgccgacctgcagagctgggacagcggtttctacggcgaaaaactgcgcgagcagcgctacagcgtgtcccaggaagccctgcgcgcctacttccccatcgacaaggtgctgggtgggctgtttgccatcgttcagcgcctgtatggcattgagatcgccgagctcaaaggcttcgacacctggcacccggatgtccgtctgtttgagatcagggaaaacggcgagcacgtcgggcgcttcttcttcgacctgtatgctcgcgccaacaagcgcggcggcgcctggatggacggagcccgtgaccgccgccgcaccgtcgatggcgtgctgcaaagccccgtggccaacctggtgtgcaacttcactccggccgacagcggcaagccggccctgctgactcacgatgaagtcaccacgctgtttcacgaattcggccacggcctgcatcacctgctgacccgcgtcgaacatgccggcgtatccggtatcaacggcgtggcgtgggatgcggtggagttgccgagccaattcatggagaactggtgctgggagcccgagggcctggaactgatctccggccactatgaaaccggcgagccgctgccccaggacctgctggaaaaaatgctcgccgcgaaaaacttccagtccggcctgatgatggtgcgccagctggagttctcgctatttgacttcgaactgcacgccacccatggcgatggccgcagcgtggcgcaggtgctcgaaggcgtgcgtgacgaagtatcggtgatgcgtccaccggcctacaaccgcttccctaacagcttcgcgcacatctttgccggtggttatgcggcgggctactacagctacaagtgggcggaagtgctgtccgcggacgcattttccaagtttgaagaagacggcgtgctcaacgcccagaccggtcgtgcgttccgtgaagcaatcctggcccgtggcggctcccaggcaccgatggtgctgttcgtcgacttccgcggacgagcgccgtcgattgacgcactcttgcgccacagcggcctgagtgaggatgcggcagcatgagtgaagggcctgtgattaccaaaaagcaatttatcgccggggcagtctgcccggcgtgcagcgagccggacaagttgaagatgtggaccgaagacagcgtgccgcaccgtgagtgcgtggcctgcggctataccgatacgttgaatgatcaaggcttgtctgtgcccaaggaattgggcacgcgggtcaatacgtcggcgttgaaagcgcctgcggatccaaaagtgcaagctgtgcagttctttcccaaccccaagttgaaaaaagactaacaacctgtacgcataccgaaatgtgggaggggcttggccccccactttctatgcgacttaggtcgctgaatctctcctctacatccttagcctgctatcatttgtaactattgattgcggctgcgctctatttcattggatcgtttggatccaatgtgccgctaaaaaaagacaaaccgttctcagaagcggctgccaaacccgtgcccacatgatgaggtgtacccatgtctgatcaagatcaagacaacccccggcgtgactttctacgcaaatccttgaccttgatcccggtggtcacggttgccagcaccggcctgggcggttcgatgctgatggccacgccggagcctgcccaggccgcaccggtcaagccggccccaaacgaaaagacctatgagccaagctatttcacggctgaggaatgggcctttatcaacgccgccgtggagcgcttgattcccgctgacgcacagggccctggcgccttggaagctggtgcgccggaatacatcgaccgtcagatgaatacgccatatgccagtggcgcgctgtggtacatgcagggaccgttcaatgccgatgcggcgccggagatgggctggcagagcaaattagtgcccaaggacatctaccgcctgggtattgctgcgacggatgcatggtcgaaggcgttcaacggtaaagtttttgctgcgcaagacagcgctacccgagacgatatgctgcggcgcctggaggctggcggcagtgaagtcgcagcgcatttcgaggcggtgccagcgaagatattcttcaacctgttgctgcaaaacactaaggagggtttcttctgcgatcccatccacggcggcaataaagggatggtcggctggaccatgatcggcttccccggcgcccgcgccgactttatggattgggtggaacgcaacgagcaataccccttcccggctgtttccattcgcggcgagagggcataaacgtggcgaccatcatgaagaaagtggatgcggtgattgttggcttcggctggaccggcgcgatcatggccaaggagctgacggaagcgggcctcaacgtggtagcgctggagcgcggcccgatgcaggacacttatccggacggcaactatccccaggtcatcgacgaactgacctacagcgtgcgtaaaaagctgttccaggatatctccaaagaaacggtgaccattcgccacagcgtgaatgatgttgccctgcccaatcgtcagctcggtgcgtttttgccgggtaacggcgtagggggcgcgggcctgcattggtcaggtgtgcattttcgtgtcgaccccatcgaactgcgcatgcgtagccattacgaagagcgctatgggaagaactttattcccaaggacatgaccatccaggatttcggtgtcagctacgaagagctggagccatttttcgactatgcggaaaaagtcttcggcacctccggtcaggcgtggaccgtcaaggggcagttggtaggcgaaggtcgtgggggcaacccgtatgcgccggatcgctccaacccgttcccgttggaggcgcagaaaaatacggtctccgcacagctgtttcagaaagccgcggctgaagtgggatacaaaccctacaacctgccgtcggccaatacttcggggccctacaccaacccttatggcgcgcagatgggcccgtgcaatttctgcggtttttgcagtggttacgtgtgctacatgtattccaaggcgtcaccgaacgtgaacatcctgccggcccttcgccaagtgccgaacttcgagctgcgaccgaactcccacgtgctcaaggtcaacctcgacagcacccagaaaaaagccaccggcgtgacctatatcgacgcccagggccgcgaatgcgagcagccggcagacctggtgattcttggcgcgttccagttccacaatgtgcgcctgatgctgctgtcgggcatcggcaaaccctacgacccgatcaccaatgagggcgtggtgggccgcaacttcgcctaccagaacatgggcaccatcaaggcgttcttcgacaaggacactcacaccaacaacttcatcggcgcgggcggcaatggcgtggccatcgacgacttcaacgccgacaacttcgaccacggcccccatggcttcgtgggtggctcaccgatgtgggtcaaccaggcgggcagccggccgattgccggtacctccaacccgccgggcacgccggcctggggcagcgcctggaagcgcgccactgccgattactacacccatcaggtgtcgatggatgcccacggcgcccatcagtcctaccgcagtaactacctggacctggatccggtttaccgcgatgcctacggcctgccgctgctgcgcatgaccttcgactggcaagaaaacgacatcaagatgaaccgcttcatgatcgagaaaatgggcaaggttgcccaggctatgaaccccaaggctatcgcggtgttgggtaaaaaagtcggtgaccacttcaataccgcctcataccagaccacccaccttaacggtggcgcgatcatgggcaccgatccaaaaaccagtgcgttgaaccgctacctgcagtgctgggatgtacacaacgtgtttgtcccaggtgcctctgccttcccacaagggttgggttacaaccctacgggcctggtggcagcgttgacctattggtctgcgcgggcgatccgcgagcagtacctgaaaaaccccggcccactggttcaggcataaggagcgatgaccatgaaagcattcgttatcgcctccctggcgctcttcagcagttgctcggtcagcgctgccgaagccgacttgatcaagcagggtgaatacctggcgcgtgccggtgactgcgtggcttgccataccgccaagggtggcaaacccttcgctggcggcttgcctatggaaacccccatcggcgtgatctattccaccaacatcactccggacaagactggcctgggtgactacagcttcgaagacttcgacaaggccgtgcgccatggcatcgccaagaacggtagtacgctttacccggcgatgccctatccgtcttacgcgcgtgtcagcgacagcgatatgcaggcgttgtatgcgtatttcatgaagggcgttgagccggttgctcaagagaacaaggacagcgatattccttggcccttgagcatgcgctggcctttggcggcttggcgctggatgttcgcgccagcggtcgaggagcatcaggcgcaaaccgctgctgatccggtgatcaatcgtggtgcttatctggttgaaggcctcggccactgcggcgcctgccatacgcctcgtgcccttaccatgcaggaaaaagccctgagtgccgctgatggcaacgccttcctgtccggcagtgcaccgttggaaggttggatcgcgaaaagcctgcgcggtgaccacaaggatggcctcggcagctggagcgaggagcaattggtgcagttcctcaagaccggtcgcagtgaccgcagcgcggtgttcggtggcatgagcgatgttgtcgtccatagcatgcagtacatgtcgcaagacgacctgaccgctattgcccgttacctcaagagcctgccggcggtcgaccccaaggaccagccacaccagtacgacaagcaggtagcccaagcgctctggaaaggcgatgacagcaagccaggcgcgtcggtgtatatcgacaactgcgcggcctgccatcgtaccgatggccatggctatacgcgtgtgttcccagcgctggcgggtaacccggtattgcagacggcggatgccacatcgttgattaacattgtgttgaacggcggtactttgcctgcgacccatacggcgccatcgaccttcaccatgccggcgttcgcctggcgcctgtcggaccaggaagtggcggacgtggtcagtttcatccgtggcagctggggcaataaagggacgccagttaatgccagtgacgtggcggacctgcgcaaaagcaatatgcgcacgacctcgggggatgacttggggcaggtgacgcaaaagcactgatctctccctcgccgcccaatggcactggtcagaaacctcacgcctcggtactgtatataaaaacagtatcgaggcgttttcatgtctactgcgttgccgccccgtggccggggcacggccaccaacctgcacaaccggtttgcacctactgtcagcgtgactgaggacgacggctggtatcaggaggtgcccgagacccaaggcaccgaggtgcgtattgaaacggccaagtccatcatcacgcgcaataactcgccggacttgccctttgatcgttccatcaacccttatcgcggctgcgagcatggttgcatctactgctatgcgcggcccagtcatgcctattgggacatgtccccggggctggacttcgaaaccaggttgatcgccaagaccaacgcagctgatgtgctggagcagcagctgtcgaagcctggctatgtgtgtgcgccgatcaacctgggctccaataccgatccgtaccagcctatcgagcgtgaatacaagatcactcggcaaaccctggaagtgctgctgcgctaccggcacccggtgactatcatcaccaaggggtcgttaatattgcgcgatctcgacctgctgaccgagctggcccgccaacggctggtggcggtgatgatcagcctcaccagcctggacgatgaactcaagcgcatcctggagccacgcacagcggcgcccaaggcgcggctgagggcgattcgggtgatgcgcgaggcgggtatcccggtgggcgtgttgtgctcgccgatgattccgatgatcaacgacagcgaattggagagcctgctcgccgaggctcacgcggccggggcacaaagcgcggcgtatatgatgctgcgcttgccgctggaggttgcgccgctgttcgaggaatggctggcggcccattatcctcagcgtgccgcccatgtcatgagcctggtgcgccaggtgcgcggtggtcaggtgtatgacagccgcttcggtgtgcgaatgcgtggtgaagggccatttgcggacctgctggcgcaacgcttcagcaaggcgatcaagcgcctggggctgaatcgtcgtgaaggtttcaatctcgattgtgcggcgttctgcccgccgggcaggcaaatggcattgttgtagactgatgagtaagacggcaccattactgtatgagtggtcgcgttttgatatcactgaaagccccgagctagagcggttcattcagtttgagttaagtttcgacggttaccttgttcagcgagtgactcataagtcgccgccgtgggttgtgggggtctcaactattccactcgcccggcgtcgaatgggggtgaacactcccctgcattaatcaagaggatgaatcatgagtgacaaggataaacagccgttggctgcgtcggcttcagcccctggggcggagtccgccgatgcagcgttgcaacatatcgttgacggctttttgcatttccatcacgacgtcttcccccagcaggaagaactcttcaagaaactcgccacggcgcagagcccgcgggcgatgttcattacctgtgccgattcgcgcatcgtacctgagctgattacccaaagctcccccggcgacctgttcgtaacccgtaacgttggtaacgtggtgcctccctacggccagatgaacggtggcgtgtccacggccatcgagtacgcggtgctcgcccttggcgtacagcacatcatcgtgtgcgggcactccgactgcggcgccatgcgcgcggtactcaaccccgacagcctggaaaagatgccgactgtcagggcctggttgcgtcacgccgaggtcgccaaggccatggtccatgacaactgcgactgcgccaatgaaggcgagagcatgaaggtgttgaccgaagaaaacgtcatcgcgcagttgcagcatttgcgcacccacccctcggtggcttcgcgcatggccaacggtcatttgtttatccatggctggatctacaacatcgagaccagcgaaattcgggcctacgatgcggaaaaggcagcgtttcgaccgttgaacggcaccgagccgatcccgtccgcgacgcctagagcgcgcttctaaaccacttccccgccgggtaaagcggtggctgccatggatgcagccaggctttgccgtgcccggcgaatgcctcgggagagccatcatgcgtgctgctcaattgaaagctgtactgccgcgggagctgctcgcctccgtggttgtgtttctggtcgccctgcccttgtgcatggggattgcgatcgcgtccggcatgccgccggccaaagggctgatcaccggtatcatcggtggcctggtggtgggctggttggcgggatcgccgctgcaggtcagcggcccggcagcgggtctggcggtgctggtgttcgagctggtgcgccagcacggcatgctgatgctggggccgatcctgttgctggcgggcttcctgcaactgatggccgggcgtctacgcctgggctgctggttccgcgtcacggcaccggcagtggtctacggcatgttggcggggatcggcgtattgattgtgttatcgcagatccatgtgatgctcgatggggcgcccaagccgtctgggctggataaccttgcaggtttcccggcggctgtggctgaagcaattccgaccttcggcggcgggctgggttggcaagccggcctgctcggtctgtcgaccatgttggtgatgtacctgtgggataaactccgtccgcaacggctacgtttcgtaccgggcgccttgctcggcgtgggccttgcgaccgtcaccagcctggtgctggcgttgcaggtcaagcgtgtggaagtcccggaaaatcttgcggatgccatcgactggctgcgccccagcgacctgctcaacctggctgacccacagctgttgatcgcggcattcgccgtcgcgtttattgccagtgccgaaaccctgctgtctgccgccgcggtcgaccgtatgcacagcggccagcgttccgattttgataaggagttgtctgcccaaggtgtcggcaacatgctttgcggcctggtgggcgccttgccgatgaccggcgtgattgtgcgcagctcagccaacgtccaggccggtgccaccacgcgtttgtcggcgatgttccacggcctgtggctgctgggctttgtactcttgctgtcgagcgtgctgcaaagcattccggtcgcaagcctggcgggtgtgctggtgtataccgggatcaagctggtggacctcaaggcgttcaaggcattggggcgttatgggcggatgccgatgtttacctatgcggccacggcgctggcgatcatcttcactgacctgctgaccggcgtattggtgggcttcggactgactctggtcaagctggcattcaaggcgtcacgattgaaagtcagcctggtcgacctgcctcaggacggtgaaatggagttgcgtctgaccggtgccgcgacctttctcaaagtgccggcgctgactcaggtgctgtcggcggtgcctgcgggtaccacgttgcacgtgccgctgagtaatttgagttatatcgaccactcttgcctggagttgcttgaggagtggggccgggccaatgcggccaagggctcgacgctggtgattgaggcgcgtgggctcaagcgccggttggaaggccgggtacgcacaacggtggggataggttcggcgccgtccgttacctgacgaaaccgcatcaaaatgtgggagggggcaagccccctcccacatttgatctttgtaaaccggacgatttacgccggctgatccagcgtcagttcaaccccaagctggcgcgacaggcacggccagcgtttccatgccgcttcggtgctcgggctcttcagtgtctcgcggtacgcctcgaccgactccagcgcaaagctgtcttcgttaagcatttcatctaccgcgtggtgtacggcttcatccaactggttggcgaatgtttcgccgatcaatcggtgagcaatcacattggccacggtggtatccgcgggaatcaacggctggccgaaatgtttgatatacagatcgttgacctcctccaccagacgatgggccaggtaagcttcgtccagtaggccgtcgaggccctcgtgcccaaccatgatcgcgggcggttgcaggaagaagtgttcggcgattttcagcaccggcttgatttggctttcaattccggcctcgcgggctacgtcattggcggcgtccagcaaatcgggaaccagatcgatataagcggtgacaaagcgcgtcatgacaatgttgctatcaccgtcagccaaggaaatagccgaatgcaggtgcggcaattgtttttccagctgtgtggcaagctggccagtgctggcttcgtgttgatgggcacgggaaatctgctcgcgcaatgcggcggtgttcatgaaggctccagtgaaacaggtgtaggaaaagggagaggataaggtagttcgtttatacgagcgcctaagacgcatttgtcataattatttcatggttatgcaggtgtgttatatcgaaatgccatcgttcgtcggataaacgtttgcgcccccggttttattgggcccgctggtctgttttcgctcatttgcccctacacattgcggggttgccctggctgtctatactcgggtttgtacgcaattagctgatgacgcccaactgcatgacgcaggcaaggcttggcggttgtaagcagtatggaagccgctcccttcgccgcaggtgcaaaccggcgggataacaagaaacataaaggggaacccgcaatgacgcgacatccacacgtttggatgggcctactgttgtggtcggtattcggccaggcgcacgccgcctggacaacgaatatggcgccaggggctactgaagtcagtcacgccgtgtttgacctgcacatgaccattttctggatctgtgtggtgatcggcatcgtcgtgtttggcgccatgttctggtcgatgatcctgcaccgccggtccacgggccaggttgcggccaagttccacgagagcactaccgtggagattctctggactgtggtgcccctgctgatcctggtggccatggccattccggcgaccaagaccctgatcaacatctacgacagcagtgagtcggatatcgatatccaggtcaccggctaccagtggaagtggcactacaagtacctgggccaggatgtggagttcttcagcaacctggccacacccgccgagcagatccataaccaggcgaccaaaggcgaacattacttgctggaagtcgatcagccgctggtgttgccggtgggcgccaaggtgcgcttcctggtgaccgccgccgatgtgatccactcctggtgggtgccggcctttgcggtcaagcgtgacgccattccaggcttcgtcaacgaggcttggacccgcgtcgagaaaccggggatctaccgtggccagtgcgccgaactgtgcggcaaggaccacggcttcatgcccatcgtggtcgaggtcaaatccaaggccgactacgacacttggctcggcgagcgcaaggaagaggctgtcaagctcaaggagctgacctccaaagagtggacgctcgatgagctggtagcccgtggcgacaaggtctaccacaccacctgcgtggcttgtcaccaggctgaaggccaaggtttgccgccaatgttcccggcgctcaagggctcgaaaatcgccaccggcccagcagccgatcacttgggcattgtctatcacggcaagcccggtaccgcgatggcagccttcggcaaacaactttcggaagtggatatcgccgctgtcgtgacctacgagcgtaacgcctggggcaataacaaaggcgacatggtcacgcccaaagacgtgctggctctgaaacaggcggaaagcaaatgactactttcgttgcgaatgccctgaaacgccccgctgactcgcttgcaggagaacggccatgagcactgtgatcgaccatggtcatgccgaccatgcccacggccccgccaaaggcttgatgcgttgggtgctgaccaccaatcacaaagacatcggcacgatgtacctgtggttcgccttcaccatgttcctgctcggcggctcgttcgccatggtgatccgtgccgagctgttccagccgggcctgcagatcgtcgaaccggcgttcttcaaccagatgaccaccatgcatggcctgatcatggtgttcggcgcggtgatgccggccttcgttggcctggccaactggatgatcccgttgatgatcggcgcgccggacatggccctgccgcgcatgaacaacttcagcttctggctgctgccggcggcattcctgctgctggtgtccaccctgttcagccccggtggcgggccgaatttcggctggaccttctatgcgccgctctccaccacctacgcaccggagagcgtgacgttcttcatcttcgccatccacctgatgggcatcagttcgatcatgggcgcgatcaatgtggttgccaccatcctcaacctgcgcgcgccgggcatgaccctgatgaagatgccgctgttcgtgtggacctggctgatcaccgcgttcctgctgattgcggtgatgccggtgctggcgggctgcgtgaccatgatgctgatggatatccacttcggcaccagcttcttcagtgctgccggcggcggtgacccggtgctgttccagcacgtgttctggttcttcggccaccccgaggtctacatcatgatcctgccggccttcggtgccgtcagctcgatcatcccgaccttctctcgcaagccattattcggctacacctcgatggtctacgcaaccgccagcattgcgttcctgtcgttcatcgtgtgggcgcaccatatgtttgtggtcggtatcccgctggtgggtgagttgttcttcatgtatgccacgctgttgatcgccgtgcccacgggggtgaaggtgttcaactgggtcagcaccatgtggcagggatcactgacgttcgagacgccgatgctgtttgccgtggcgttcgtgatcctgttcaccattggcggtttctccgggctgatgctggcgattgccccggcggacttccagtaccacgacacctacttcgtggtggcgcacttccattacgtgctggtgcctggggcgatcttcgggatcttcgcctcggcctactactggctgccgaaatggaccggccacatgtacgacgaaaccctgggcaaattgcacttctggctgtccttcgtgggcatgaacctggcgttcttccctatgcactttgtggggttggccggtatgccgcgccggataccggactacaacctgcagttcgccgacttcaacatggtctcgtccgtgggcgcctttatgttcggtgctacgcagatattcttcctgttcattgtgatcaagtgcatccgtggcggcacaccggcacccgccaagccgtgggatggggccgaagggctggaatggagcgtgccctcgcccgcgccttatcacaccttcaccacgccgccggaggtcaaatgaacaagccccctcccacacttttctggttcgtctcgggtgatcgtcatgtctgactctgtgccgatcaaacgcctggtcacccgcctgctgatcctggtgctggcgatgttcgccttcggcttcgccctggtgccgatctacgacgtgatgtgcaaggcattcggcatcaacggcaagaccgccgggcagtacgagggtgagcaaatcgttgacccgtcgcgccaggtgcgggtgcagtttctgtcaaccaatgccatcgacatggtctgggagtttcattccaaggccgatgagattgtggtcaaccccggggcggtcaacgagatgctgttcgtggcccacaaccccaccaataagccgatgacggcccaggcgatcccgagcatttccccggccgaagcggcgatgtatttccacaagaccgaatgcttttgctttacccagcaggtgctgcagccaggcgagcgtatcgaaatgccggtgcgttttatcgtcgaccgcgccatgcccaaggatgtgaagcatttgaccctggcgtacacgctgtttgacatcactgcgcggcaagcgccggtggccgcgaacagcggcggctagctactgtttgccccctcaatcaggagagcgaatacatgtcgactcatgatacgtactacgtaccagcgcaaagcaaatggccgataattgccacgattggcctgctggtcacggtgtatggcctggccgtatggttcaacgacttaaaggcggcgcgcccggaatcacatggcccgtggatctttttcgtcggcgggttgttgctggcctacatgctgttcggctggttcggcgcggtaatcaaggaaagccgcgccgggttgtacagcgcgcagatggatcgctcgtttcgctggggcatgacctggttcatcttttccgaggtgatgttcttcatcgccttttttggtgcgctgttctatgtacgcgtgtgggcgggcccctggctggcgggcgaaggccccaaaggcatcgcccatatgctgtggccgaatttcgaatttgcctggccgctgctcaacaaccccgatcccaagctctaccctgcgcccaaaggcaccatcagcccttggggcctgcccttggtgaacaccattttgctggtgagctccagcgtgaccatcaccatcgcccaccatgccctgcgtaaaggtcatcgcggtgcgctgaagatctggctggcgatcaccgtgctgctgggcctggcgtttctcggttttcaggctgaggagtacatccacgcctataaagagctgggcttgaccttgggctctggcgtgtacggcgcaaccttcttcatgctcacgggctttcacggtgcccacgtgaccatcggcaccatcattttgtttgtgatgctgatgcgcatcctgcgcgggcatttcaacgccgagcatcagtttggtttcgaggcggccagttggtattggcactttgtggatgtggtgtggatcgggctgtttttcttcgtctatgtgctgtgaggtggtttaccacggcacatgagagaccagttggccgctgaaaaagccccaggcgatcaagcccacggtgatcacggccagtaccacgcgcacggtcaaggcagtgacgaggcggttggagttgccctcgtccttgaccaggaagaacaagccactgaacaggctcacgacagtcgcgatcagcatcagggcaatggctgctttgagcatggtttggctccagggctatagggggaggggcgatgagatccagtatagccagtgccgtgcagcgctttcgtccgggtatcgcgccgacgctggtggtgctggtgttgctgccattgatggtgagcctgggattctggcaactggctcgagggcatgaaaaacagctgctggtggacagctatgccgagcgccgcgccgccgagccggtgaacagcgtgcagctcaacgacatggccgatcctgcctttcgccgcgtccatcttcgtggtcaattcgatgccgagcacagcgtgctgctggacaaccgtatgcgcgacggcaaggcaggtgtcgagctactgcagcccttccacgaccaggccagcggcctatggttattgctcaaccgcggctggctgccatggcctgaccggcgtactccgccggctttttccacccctgaacaggcagtgaatctctacgcctgggtgtacgtcgcccccggcgagactttccaactgcatgccgaccctgcgagcgcgcaatggccacgtctgctcaccgcgctgcatcccgccgcgctgtgggacgagttggggcgtagcggttttgcctacgaactgcgcgctgaagcgggtcctggtacgtacgacaccacttggccaatcgtcgccatgggcccggaaaaacacttggcctatgcggtgcagtggtttgccatggcactggcgttgctggtgctttacctctacttcggatggcacaacaaaaaggagaagccccatgggagcggccatgaatccacccaacatgtctgaggtgcctgaccgccgcaaaggtcgctggcaactggtcctgatcctgctcatggtggtcggcccgatggtgctggcgaccctgatgtacaagctgcaattctgggttccagacagtcgcagctaccatggcgaactgattggcaacggccagacccgtgccgacataggcgtacaggcagatgaagatcgctggcagctgctggttactgcccctgccacgtgcgctgccgattgccaacaattggtctacctcgctcggcaactgcagatcggcctcggtcgcgacgcctcccgtgccagccacgccttggccagcgcgcagcctgtcgctgcgcaatacgacgccaagctcaaggccgaatacccacaactgcagcgttacccgctggatctgccgacctttaccaagagcgctgccgcccccggtgaggcgcagctgtggatcgtcgacccccacggtaacctggtgctgcgctacgacgccaaggtcaagggcaaggacttgctcaacgacctgcgcctgctgctgaaactctcgaatatcggataagggcatcgtcatggccaagcctggatttcgcctcgcgctgtttgccacgttgctggcgctggttgtcgtactgctcggtgcctacacgcgcctgactcacgccggcctgggctgcccggattggccgggttgctacggttttatcagcgtgcccaacagcgaagcccagctggcccatgccgaactgcattttcccgacacaccggtagaggctgacaaaggctgggccgagatgacccatcgctacttcgctggcagcctggggctattgattgcgctgttggcggcgcgctcgtggagccatcggcgtgacccgggccagccggtgaaattgcccttgtttgtgttggcggtggtatttgcccaggccgcctttggcatgtggacggtgaccttgaagctgtggccgcaagtcgtcaccgggcatctgctgggtggctttgcgaccttgagcctgctgtttttgctgaccctgcgtttatctggcgtgctgccggcgctgatcgtgcccaagcgcctgcaatattgggcgacggcgggcttggtgctggtgatcgggcagatcgcgctgggtggttgggtcagttccaactacgcggccgtggcctgtgtcgatctgccgacctgccacggccaatggtggccggcggcggattttgccaatgggtttcacctgacccagcacatcggccccaattacctgggcggccagctcgacagcgaggcgcgcacggcgatccacctgacccatcgcatcggcgccgtactggtgaccctggtgctgctgggcctggcctggcaactgggtgtcgtgggcatgacgcggctggcgggtttgctgttgatcgccctggctgcgcaaatcagcctgggggtgagcaatgtggctttcggcctgccgttgcccgtggcggtggggcataacgcgggtggagcggcgttgttactgaccttggtactggtcaattaccacgcccgtaccagcctggtccgggttcgccacccgctaccgttcggctggcgtttcagtccgcgcaaacgggtttcaggcctgatcacccttaaaggagagatgccatggcgaccttgatcggcgcacgtcaggatcaggcgatctggcgtgactacctggagctgaccaagccgaaggtagtggtgctgatgctgatcacctcgctggtgggcatgttcctcgccacccgcgccggggtgccatggacggtgctggtgtttggcaacctgggcattgccctgtgtgcgggcggtgcggcggcggtgaaccatgtagtcgatcggcgaattgatgcggtgatggcgcgaacgcataaacgcccgatggccgaggggcgtgtatcgccaattgcggcgttagcctttgcattgtttctggctgttgccggattggccctgctgctggcattcaccaacccgctggcggcctggttaacgttggcttcgctgcttggttacgcggtgatctacaccggttttctcaagcgtgcgacgccgcagaatatcgttatcggtggcctggccggtgctgcaccgccgctgctgggttgggttgccgttaccgggcacgtcagcgccgaacccttgctgctggtactgatcatcttcgcctggaccccgccacatttctgggccctggccatccaccgaaaagaggaatatgccaaggctgacattccgatgctgccggtcacccatggcgagcactacaccaaggtgcatatcctgctgtatacctttgctttgctggcggtgagcctgttgccctacgtcattcatatgagcggcttgctctacctggcttgtgccttggtattgggagcgcgctttctgcaatgggcctgggtgctgtaccgtggcagcaagccgcacgcggcgatcaacacgttcaagtactctatctggtacctgttcctgttgtttatcgccctgctcgtagaccactacctactgttgaacctatgactcgaactcaaaaaaccgtcttcatcctcgtggccctggtggcgttgatcatgggcctgaccgtcaacaaagtgctctcgggcaaaggccagggcgatcccaccgcgctgatcgacgctggcatcatcctgttgccgcagagccgccagttaccgccggtgagcatgaccaaccaggacggccagccggtgctggtcaatgagttgaaaggcaagtggagcctgctgttcttcggctataccttctgcccggatatttgcccgaccaccctcgcccaactgcgccagatcaagagcgagctgcccaaagaggctgtggataagtttcaggtgatcctggtcagcgtcgatccgaaccgcgataccccgacgcagctcaagcaatacctgggctacttcgatccgcaattcgagggcctgaccggcgctactgtagaggatgtgcagaaggtctcgaatgccgtgagcattcccttcattccggcggataccagcaagccgaactacaccgtcgaccacagcggcaacctggcgctgatcggcccggacggtacccagcgtgggtttatccgtgcgccgttgaacaaccagaagctggtggcgcagttgccaggcttgctacaacgcaaataaagacaacacaaagcaaatgtgggagggggcttgctcccgatagcggtggaccggtcagctcatgcatcgactgacactctgctatcgggggcaagccccctcccacatttttgattttcagtgttttggagatcgaggcggattagaacgctggcttgatcgcgcctttgtacttctcttcgatgaattttttcacttcaggcgtgtgcagggctgcaaccagcttcttcaccgcgtccgaatccttgttgtcttcgcgggtcaccaggatgttcacgtaaggcgagtcgctgccttcgattatcagggcgtccttggatggatccagcttggcttccagggcgtagttggtgttgatcagcgccaggtcgacctgggtcagcacgcgtggcaaggtggcggcttccagttcgcggaatttcaggtttttcgggttctcggtgatgtcctttatggtcgacaggatgtcggtcgggtccttcagggtgatcaggccgttcttggccagcagcaacagcgcacgaccgccgttggtggcgtcgttcgggatcaccacattggcgccgcttggcagctcgtccagtttcttgtacttgctggagtaggcgcccagaggttccaggtgcacgccgccaacgctcaccaggtgagtacccttggccttattgaactcatccaggtacggctggtgctggaagaagttggcgtcaaggcgcttttcggcgacttgcacgttgggttgcacgtagtcggtgaagactttgacctgcaagtccacgccttctttggcaagggcaggcttcacgaattcgaggatttccgcatgaggcaccggcgaggccgcgaccttgatagtctcggcgtgggcggaaaacgcggcaacggcagcgaaggcaaccagtagttttttcatccagcaagctccttgttcgggcatctgccggctctgggccggcaatggccgttattttcgagaaaagtgcaccaccagcctgtcgccgacggtttgcagaatttgcaccaggatcaacagcatcaccacggtaaccaccatcacatcagtctggaaacgctggtagccgaagcggatcgccaggtcacccaggcccccggcacctacgacaccggccatggccgtgtaggaaaccagtgtaatcgccgtgacggtaatcgctgcgaaaatgccggggcgggcttcgggcagcagggcgttagtgatgatttggcgcgtgctggcgcccatggattgggtggcttcgatgatgccacggtccacttcacgcagggcggtttccaccaggcgcgcaaagaatggggtggcacccacgaccagtggcggaattgctccggcgacacccagcgacgtgccggtgatcagtacggtgaacgggatcatcacgatcagcaggatgatgaacggcagcgagcgcaggatattcacgatcagcgacagcagcgcatacaggcctttctgttcgaacagttggcgcgggctggtcaggaacagcagtacgcccaggggcaggcccagcagcacggtgaagaacagcgagccgaacagcatggtcatggtgtcgccggtggcgagccagatttccgaccagtcgatgttggcaaagaaactcaggaaaacgtccatcagcgcaggacctccatgtgaacgtccgcggcggtgaagcgcgcaaacgcggcttccatatcaccaccggtgacagcgagggtcagttgcccgtaggggatgtctttgatgcggtcgatacggccagcaagaatgctgtagtccacgcctgtttcccgggcgacagtacccaacaatggcgcgtaggtcgcttcgccctggaatgtcaggcgcacgatgcgacccggtacatgggcgaagtcgtcatgctgctcgccttcgtcgacctgttcggcttcttgcacgaagcgtttggtggtcgggtgcttggggtgcaggaacacctcagccaccgagccttgctcgacgatcacgcccgcgtccatcacggcgacctggtcgcacacgcggcggatcacatccatttcatgagtgatcagtacgatggtcaggttcagctcgcggttgatttcggccagcagttgcaggaccgacgcggtggtttgcggatccagggcactggtggcttcgtcgcacagcaggatttttggtttggtcgccaaggcacgtgcgatgccgacgcgctgcttctggccaccggacaactgcgccgggtactttttggcatggtccgacaggccgacgcgcgcgagcagttcggcgacgcgttggtcgatggccttgcgcgacagctcaccggccagggtcagtggcagcgccacgttatcggcgacggtcttggacgccagcaggttgaagtgctggaagatcatgccgacctgctggcggaaacggcgcaggccgttggcgtccagggcggtgacttcttcgccatccacggtgatctgaccaccgctgggctcttccaggcggtttatcaggcgcagcagggtgcttttacctgcacccgaatggccaatcaggccaaacacctggccgttctcgacgcgcaggctggtggagtgcagtgcggggatatccttaccggcgacgcggtaggttttatgaacgttttgaaactcgatcacgtagcgaaccttgtggggcgcattgaaaagggatcagcggttagccgggcgcgcattttagcctgtccgtatagcgtttcttagcatttatttcgcattcatccagtcatttggcaataacgcgatcaaaggtcataaaaaaggaacggtgcaaaaccgcgtcagtcattacttaagcaactcgatttcccaggtgccgtgcctggggttttgctcaaacgagccggggaccgctctggccactttgaataaggagttttgactgatgagtatcaacaagccagccaccccggcaaagagtgaagtcgcgggtactgataccctggatcgtggcaacaccaacgccaagctgcaggccctggaagaattccgttccgatgcgaccggccaggccttgcgcaccaaccaaggcgtaaagattgccgataaccagaacaccctcaaagtcggcgcccgtggcccttcgttgctggaagacttcatcatgcgtgaaaaaatcacgcattttgaccatgaacgtatcccggagcgcatcgtgcatgctcgcggtacgggtgctcacggttatttccaatcctatggggaccattcggcactgaccaaggcgggtttcctacgtaccccggagcacaagaccccggtgttcgcgcgattttccacggtgcagggcccgcgtggctctggtgataccgtacgtgatgtacgtggctttgccgtgaaattcttcaccgaggaaggcaactttgatctggtcggcaacaacatgccggtattcttcatccaggacgcgatcaagtttcccgactttgtacatgcggtaaaacctgaaccccacaacgaaattcctaccggcggctcggcccacgatacgttctgggatttcgtttctctgcagccggagtcggcgcacatggtgatctgggccatgtctgaccgggccattccgaagagcctgcgggccatgcagggatttggcgtgcacaccttccgcctgatcaataccgagggcaaatccagcttcgtcaaattccactggcggccgaaggtgggcacctgctccctggtgtgggacgaagcgcagaagcttgccggtaaagataccgactaccaccgtcgtgacctatgggaatcgattgaaagcggcgactatcccgagtgggaactgggtgtacagatcgtggcggaagaagacgaacacaagttcgatttcgacctgctcgaccccaccaagattattcccgaggagctggtgccgatcacgccgctgggcaagatggtactcaaccgcaacccggataacttcttcgctgaggtagagcaggtcgcgttctgcccaggccatatcgtgccgggcatcgactttaccaacgacccgctgctgcaaggccgtctcttctcctacacggatacccagatcagccgtctgggcgggccgaacttccacgagattccgatcaaccggcctgtggtgcctttccataacggccagcgcgacgcacagcatcgtacggtcatcgacaaaggccgtgcttcgtacgagccgaactcgatcgacggcggttggccgaaagaaaccccgcctgcgccacaggatggtggtttcgaaacctattacgagcgtgtcgacgccaacaaagtacgtgagcgcagtgaatcgtttggtgatcacttctcccaggccacgctgttttacaacagcatgagtcatcacgagaaggagcacatcatcgcggcctatagcttcgagttgggcaaggtggagcgtgagttcatccgtgcccgccaggtgaatgaaattctggccaatatcgatctggaactggccaagcgcgttgcgcagaacctgggcgtgccggtgccgactaaaggcacagtccctgcgcgtgagacatcgctgaaggaatcaccagcgttgagccaggtgaacttgctgtcgggtgatatcaagacgcgcaaagtggcgattcttgcagccaatggcgtggacggcgcagcgattgccgcgttaaccaaggcgctggaggctgagggcgcacacgccaagctgctggggcctacctcggcgccggtgacgactgccgatggcaagagcctgaaagtggatgcatcgatggaaggcatgccgtccattgcctttgatgcggtgtttatcccaggcggcgcagagtcggtcaaagcactgagcggtgatggtgtggcgttgcattacgtgctcgaagcttacaagcacctgaaggcgattgcggcggccagcgacgcgaagccattgctggacctgctgaaactggaggcggatgcggggttgatcgtgggggcggatgccaaggcgttcaaggcgttctttgctgcgattgctcagcatcgggtttgggagcgggagcctaaggccaaggcgattccggcttaagttatctgctgtaggttagaccgctatcgtcgcaccgcccctcccacacttgaatgtattcacaattcaaatgtgggaggggcggtgcgacgattcgacttgcccccgatgcttttagtccgccttgcgcggaatcagcacaacttgcgctggaatatgtttcaaaatctgccggtgaatctttaggtcataccccgaatcaatccgcttcacccgcttggtcaataacgtggccaaccacgggtaatcctgggtgcgcggcacctgaatgctgacgtcgcactggtaattcaccacgtcggtagcgatggcatccaattgatgacgcatgtcgtcgatatccgcgaggttcagcgccacagtggtgctgggcgccgccgggtcgatgaccttggccgcgggcttggcttcggcggctttcagcgcggcttctgcctgatccaattcagctttgcgcgcatggctgatggcgctgttgacgccaccggtcagtgcgggcgccttgggcatcagcgcacgggcacgactcagggctgttgcggcggcgttgacgtcgcctttttgcagcacgatctggctgcgttgcaagtaggcttcggccagttgccgttggtaaggctcaagggctgggtcgttgggcgactgcgcctgcaacgccgcgagctggtcttcggcggtggccagctcgttgctggccaggttttgctccagctgtgcgatagccgcagcgcgtgcgtccggcgcctcgggggcggcgggcggtgtgctttgacaggcgcccagcagcagggaaaatgcggcaaggagcagataacgggaggtgaacggcttcattcctgcgactctctatttgcgcaaaaagcgagcaagtctacacccctcgacggggcaggacaaaactcagcagaaacagggcggccgccgtcaccacaatcgacggtccggccggggtgtccttgaaccatgacagcgccaggcccccgcacactgccagcatccccaggaagctggcgccgattgccatctgctccggggagcgagcatggcgctgggcggcggcggcgggaatgatcagcagcgacgtgatcaacaatacgccgactatcttcatcgcgacagcaatcaccaccgcaatcaacaacatcagggccatgcgcagggcaggcaccggcaagccttctaccgtggccagctcttcatgcacggtgatcgccagcaacggtcgccacaggatcagcagcaggatcagcacggccgcgctaccgccgaggatccaggccaggtcggtcgggctgatcgccagcaagtccccgaatagataagccatcaggtctatgcgcacttcatgcatgaagctcagcaccaccaggcccagggacagggtgctcggcgcgaggatgcccagcaacgtgtcggaggccagtggctggcgctgttgcagggttaccagcagcaccgccagcaataggcagcccacggtcacggcgatggtcgggcttacatccagcaagaagcccatggccacgcccagcagcgcggcatgggacaaggtgtcgccgaaataggccatgcgccgccagaccacgaacgagcccaatgggcccgccaccagcgccagagccaagcctgccagcagggcgtagagcagaaaatcagccatgcttgcagctatctccgtgaacgtggggagtatcgacgacggcaccatgcaggtcatgagcgtggtcgtgatggtggtggtagatcgccaggctctgggcattcttgccgaacagctcgacgaaagccgggtcgctactgacctgctccgggtgcccggagcagcatacgtggcggttgaggcagacaacctggtcggtggtgctcatcaccaggtgcaggtcgtgggagaccatcagcacgccgcagccatggcggtcgcgcaggcgggtgatcaggctgtacagctcggcctgaccggcgacgtcgacgccttgtacgggttcatcgagcaccagcaactctggctcgcgcaacaaggcgcgggccagcagcacacgctgcatttcgccgcctgagatgctttgtaccgggctgtcgatcacttgctcggcacccacttccttgagcgcggcctgtgctcgggcgcggtcgacaccgggcaccaggcgcaggaagcgcaatacggacagcggcaatgtcgggtccacatgcagcttttgcggcatatagcccacgcgcagctttggcttgcgccacacacttccgttgtcgggcttgagcaagccgagtacggcgcgcaccagggtggtcttgccggcgccattggggccgatcaaggtgacgatttgccccggctccacgctcagtgcgatgttgtccagcaccttttgcccggcgaatgtgacgccgacctgctccaggcggattaaggcgttgctcatcaagccccctggcagcccgcgcacaggccgactacttcgaccgtttgcccttcgaccttgaagccgacctcggcagaactattgataatggcgtcactgatgcttttttgttcaagctcgatggcggcgtggcattcgcggcagatcaggaactgaccctgatgcgcgtgctccgggtggttgcaaccgacgaaggcgttgagcgaggcgatacggtgcaccaggccgttttccagcaggaaatccagcgcgcggtatacggtaggcggcgcggcgcgacggccgtcctgctcgctgagtacgccaagaatgtcgtatgcgcccagcggcttgtggctctgccacaccagctccaatacccggcgacgcaaggcggtcaggcgtaagcccttctgcgcgcacagggtatcggcctccgacaatgcggtgtgcacgcagtgagagtggtcgtggggacggctggcaagcggtgttttaggcatgagcggcgacagatatttgatagagacgttattatgttacccgttcctacgccatcgagtggtcatcgtgtcccgactttttgccgtttttgtcgtatttgtcaccagtttgttcgtcgcgagtgccgcccaggccgaggtcaaggtgctgacgagcatcaagccgttgcagctgattgccgctgccgtgcaggatggagtagccgttccagaggtgttgctgccgccgggcgcatcgccgcataacttcgctttgcgcccatccgacgtacggcgcgtacagtcggtggacctgttgtattggatcgggccggatatggagacctttctgccccgcgtgttgaaaggccgtacgaccgctaccgtggccgtccaggacctgccagggatgaaattacgtattttcggcgaagatagccattcccacgccgacgatgccgacgagcatgaccatgatcatcgacctggcagcgtcgatgcgcatttatggttgtcaacggtgaacgcgcgggtaatcgccacgcgcatggctgcggacctcagtgcggctgatcctgcaaacgccgagcgttatcagagcaatgccaaagcttttggtgagcgcctggatgcgttggatgcgcgcttgaaaaagcgactggcgagcgtcgatggcaagccttacttcgtattccatgaggcgtttgactacttcgaagaggcttacggcctcaagcacaccggcgtattcagcgtggccgccgaagtgcagccaggcgcccagcatgtagcggcgatgcgcacgcgcttgcaggaggtgggtaagacctgcgtgttcagcgagccgccgttgcggccgcgattggccgagacgctggttgccgggttgccggtgaagttggcggagctggatgcgttgggtggctataccccggctacggcccagggctatgagcaggtgttggaaaagttgggcaatgacctggccggctgcctggaatcgctttaaatgtgggagggagcttgcccccccctcccacatttctttagagcgcgaacggcaggtggacggtgacctgctggcgttgcagcagccggtgctcgaactccgccgggtcatggatcaacacatcctgcccggcaaacgattcggctgcgatcaaccgcgacaaccagaaccgtacgcacgccacgcgcagcatggtcggccatagctcggcttccttcgcagtaaacggccgcagccctgcataagcgcccagcagcgcccgggcgcgttgccggtcgatcgcgccatcggtgtccgaacaccagtcattcaaggcaatcgccacgtcgtagagcatcggccccgagcaggcgttgtagaagtcgatcaagcccgtcaagtgcgtgccttcgaacatcgcattgtcgcgaaacaggtcggcgtgcacgttagcccgtggcagggcgaggatgtcggccttgtgggtttcgatctcgctcaacgcgtcctgcagcaagcgctgttgtgcgtcgttgaggtgcgaaatcagctgcgcgccctcactgagcatccaatccaacccacggtcggtcttgcgctccagcacctttgcgccctgggtggccaggtgcaggtggccgagcagctcgccgacctggacgcaatgctgggcgttggcgtccttgatgtgcttgccggccaggcgaggttgcagcagtgccggcttgcccttgagctcgcgcaaagcgatgccatcggtggtgcgcagagcgtaaggcacgggcaggtcagcatcgtggagcacgtcaagcagttcgatgaagaacggcatttccgccaccgggccgcgttcaaccagggtcaggacgaactcgccctgttccaggctgatgaagaaattagtgttttcgctgccggcggcaatcccctggaaatcaagcaggcgaccgagcccgtagggtgcgagaaaagtttccagctcgggccgagccaggggggtaaacacagacatggttaaaactgccgttacgggcgcggccgtgggcggcgccggttaaaattaagaaatcatttccattcgaagatcttccatgacgggatcagcatatccggctggtcagaacggatgaagttcgcatcggttccgtcggcgcgtaccaggaagtacggcggcgctcctttgggcgtgaccttgatcgcgtataggaagccgttctggcggtattcctggatcgtcttgtcgccttccgtgcgaatggtaacttccggatcacctccaggggcactgtctgccgccatggcagccatcggagcgagtgcaatcaaaccggtcaacagcaggcgattgaatgtacgcatgataaccttgtccctttgttttcattggtccggctattctagcgcctgacccgccgaaaaggttgatcctgctcatgagccaatcgcccctcgtcctggtggacggttcttcttatctgtaccgcgccttccatgcgctgccaccgctgaccacctccaaaggcctgccgaccggtgcggtcaagggcgtgttgaacatgctcaaaagcctgcgcaagcagtacccggacagccccttcgcggtggtgttcgacgccaagggcgggacctttcgcgatgagatgtacgccgaatacaaggccaaccgcccgagcatgcccgatgacatgcgcctgcagatcgagccgctgcaccagagcgtgattgccctgggctttcctttactgtgcgtcgaaggcgtcgaggccgatgacgtgatcggcaccctggcccgcagcagcgcggccgccagccgcccagtggtgatttctaccggtgacaaggacatggcgcagctggtcgacggtcacattaccttggtcaacaccatgaccggtagctcgatggatgttgagggcgtaaaggagaaattcggcgtcgctccggagcagatcatcgactatctggcgctgatgggcgattcgtccgacaacatcccaggcgttccgggcattggcccgaagaccgcttccggtttgctggtgggggtcaatggcggcctcaaagagctttacgaacaattggatatcgtgccgaccttgcctatccgtggggccaagaccctgcgggccaagctggaagagcacaaggagatggcattcctgtcctatcagttggcgacgatcaaggtcgatgtgccgctggaagtgggcctggatgatctgcatctgatcgagccggatcgcgagaagctgctggagctgtacacgctgcttgagttcaagagctggtacgaagagatcctgcgcgatgccaagcgcgtggagctcaagtcggcgagcgaggttgtgcctgtcgccgaaacgctggttgaggctgttatatcggtaccggtagaggcggtttacaccaccatcctggaccaggccacgttcgacgtatggctgaagaaactccacgatgcgccgttgtttgccttcgacaccgaaaccaccggtatcgatgcccagcaggcgcaattggtcgggctctcgtttgctgtgcggccccacgaagccgcctacatcccgctgacccattgctatatcggcgcgccggatcaattggaccgggacaccgtgctgctggccctgaaaccgctgctggaagacccgaccaaactcaaggttggccagcacgccaagttcgatatgaacatcctcgccaactgcgccatcggtggcgaccctgcacagggcatcactgtgcgtggtatcgccttcgacaccatgctcgaatcctacgtgctgaactccacggcgacccgccacgacatggacagcctggcgaagaagtatctggaccacgacacggtcagcttccaggacatcgccggcaagggtgccaagcagttgaccttcgaccagattgccctcgagcaggccggcccttacgccgccgaagatgccgatgtgaccttgcgcctgcatcaggaactgcacgcgaagctgaccgcgatcccgagcctggccagtgtactgacggatatcgagataccgttggtgccggtactggcgcatatcgagcgccagggcgcattggtggacaaggagttgctgggtatccagagcattgagctgggtaacaagatggttgaactggagcgccaggcgttcgagatcgccggtgaagcgttcaacctgggttcacccaagcagcttggggcgatcctctatgaaaaactgggcttgccggtgttgaagaagaccggcaagggccaggcgtccaccgccgaggaagtgctggccaagctggccgaagatgattttctgttgcccaaggtgctgatgcagtaccgcagcatgagcaagctcaaaagcacctacaccgaccgcctgcctgaacagatcaacccgcgtaccgggcgcatccacacctcttatcatcaggccgtggcggcgaccgggcggttgtcctccagtgacccgaacttgcagaacatcccggtgcgcactgccgaaggacggcggattcgccaggcgtttgtcgcgcctaagggctacaaactgctggcggcggactattcgcagatcgaactgcggatcatggcgcacctgtccaaggacgaaggcttgatgaatgccttccgcaataatctggatgtgcacacggccacggcggccgaggtgttcaaggtcgagctgggccaagtcacatccgatcagcgccgtagcgccaaggccattaactttggcctgatctatggcatgggcgcccagaagctcggcaaggacattggtgtcgataccaagacagccaaggcttatatcgatgtctactttgcccgttatcccggagttcgcgagtacatggagcgcacccgtgcccaggctgccgaccaggggtatgtggaaaccttcttcgggcgccggttgtacttgccggatatcaactccaacaagcctcaggagcgcgcagcggcagaacgcacagcgatcaacgcgccgatgcagggcacggcggcggacatcatcaagaaagccatggtattggtggatagctggctgaccgaatcgggcctggatgccaaggtgatcctgcaggtgcacgatgaactggtacttgaggtgcgggaagacttggtggcgcaggtcggcgagaagattcgcgaacatatgagcgccgcggcacagctggatgtgccgttggtggtggatgtgggcgtgggcgacaactgggacgaagcacactgatcctgcagctgcaccactactgcgtggggcggtgcagcgctttagatcggaaatcggcgtcagttatttccaatagttttcgggcctgccggaacttaacccgtgaattgcgactcagagttactgaatgggtggtgaagcccttcaatgctcctatgttgtgttaagtgttggcagatatctggaccccgccctagcggtccggaacttggaccccgaacttccctccccatacgaagtccggggttttttttgcccgcaggaaagttactcggtaacttctgcgcccttgtccgccaattccatccagtcggccagtacggtgtaagcctcttccagccccatgcgttttggcgctgagaacagctggatactgatcgcgtcgccccagcccttacggatttcggactgcactttgagcaaggtgttcttggctgcgccgtaggtgagcttgtcggccttggtcagcagaatatgcatcggcatgccgctggcgacagcccagtcgagcatcagtaggtcgaaatcggtcattggatgacggatgtccatcatcaggatcaagcccttcaaactctcgcgaccacccaggtaagcctcgaggtgacgctgccagtgcagcttcagcgggataggtacttttgcataaccgtagcccggcaggtcgaccagacgccgatcatcgtctagcttgaagaaattgagcagttgcgtgcggcccggggttttcgaggtgcgtgccaggctggcgtgggtcagggtgttcagtgcgctggatttaccggcgttggagcggcccgcaaaggcgacttcaaagccctcgtcatcggggcattggtccactttggcggcgctgagcataaacgtggactgttggcacaggccgaggatgggattcttgagttgcatgagatttccgatgtgggcggtgccgaaaaagggtgcggcaagcggtgtcgtttccgtttcagtagcgccagtatataatgccgcagattttgtgtgtgctttgtcccagcgaaggatgaagttcacgggagcgatagacctttattgcgcattagaacgcaaaacgctctcaaaccctgaaaaggtcgatgtatggcctcaatggttgccgcttctggtgtcctggacccgctttatggcgctcaggctacacaggatacggaagcgctgtacaaccgagtttgcgtggtcgcgctgttggcacgcatgacccagggtttcaaggcaatgccgccgcgtggtttgtgcatggactgcagtactgaggattaccaggccgtcattgagttgatggtgagtaaacccggtagataactcttaaacccttagccgtagttggattagctgatgaacaaactgatcgtgagtctgctgttgaccttgggcatcacaggcgctgccgtcgctgcagagggccccgtcaaaggtgatgccactgccggtcaagcgaaggccgccgtgtgtggtgcctgccacgggccggatggcaacagcccggcgccgaactttcccaaactggcaggccagggtgaacgctacctgagcaagcagatgcacgacatcaaggatggcaagcgcacggtgctggaaatgaccggtttgctgaccaacctcaacgatcaggacctggcggacctcgcggcgtattttgccagtcagaaaggcagtgtgggagctgctgatcctaaactggtcgcccgtggagagaagctgttccgtggcggcgatctggaaaagggcctgcctgcctgcacgggttgccactcgccgaacggcgctggtaatgcggcagctggttttccgcatttgagtggccagcacgctcaatacattgccaagcagttgaccgatttccgtaaggaagaagccggccgggccaacgatggcgacgcgatgactatgcgtaccatcgctcgcaagctgagtgacgaagacattgcagccgtctccagctacatccagggtctgcattaagttgcacgcaacgttaacactcgattaatcccgcgatgcaagcataaaaagggtggcccaggccgcccttttttgtggccggtgccgttacactaacgaactcatgcccgcgcagacctgtcacacctaaaggtcgcgtgaggcgactttatttgtccaggagtaaagcatgcgtaatctgatcctcagcgccgctctcgtcactgccagcctcttcggcatgaccgcgcaagcagccgatgtgccgcttgaagccggtaaaacctatgtcgaactgagcaatccggttccagtatcggtgccaggcaagatcgaagtagtagagctgttctggtacggctgcccgcattgctacgcctttgagccgaccatcaatccatgggctgagaaactgccttcggacgtgaacttcaagcgcattcctgccatgttcggcggcccatgggatgcccacggccaactgttcctgaccctggaagccatgggtgtggagcacaaggtccacaacgccgtcttcgaagcgatccagaaacaaggcaagcgcctgaccaagccagaagaaatggctgacttcgtcgccacccagggtgtcgacaaggacaagttcctggccaccttcaattccttcgccatccagggccagatcaagcaggccaaggaactcgcacagaagtacggcgtgcagggcgttccgaccctgatcgtcaacggcaagtaccgtttcgacctgggctctactggtggtcctgagcagaccctcaatgtcgccgaccagctgatcgccaaagagcgggcagccaagtaaggggctcgttatgcgccgctggcgtaccgaacgcgctgttggcctgcatgacccgcaggtcaacgagcaccacctggagtccacggggctgccgccggacagccgtctgcgcctgctcagcttcaatatccaggtcggtatcagtaccgagaagtatcggcactacctcacccggggctggcaacacctgctaccccacaacggtcgggccggtaacctgcagaaaatcggcaccctgctcaacgacttcgacctggtcgccttgcaggaggccgatggcggcagcatgcgctccggttatatcaatcaggtggaacaccttgcccagctcggtgctttcccttattggtaccagcaactcaaccgcaaccttgggcgcctggcgcagcacagcaatggcgtgctcagccgcctgaagcccaccgccatcgaagatcatccgttaccaggccccaaagggcgcggggcgatcctcgtgcgtttcggcgaaggcccggaggccttggtggtggtgatgatgcacctggcgctcggcgggcgcacgcgcaacctgcaactggcctacgtgcgtgacatgattggcaactacaagcatcaggtgctgatgggtgacatgaacacccatgccaatgacctgttgcagaattccccgctacgcgacctcggactattggcgccgcaagtcgaggccacgttccccagctggcgcccacagcgttgtcttgatcatattttgctcagcccgacccttacgctcgaaagcgtgcaggtactggcgcagcctatttccgatcacctgccggtcgcggtagagattcgtctgccgggttcgctcacggctgatgcgttccccgcattgagcccaggcaccagcggaccccttgcatgagcgacgacgcccagcgttggaaagagaaatacctcaagagcattgagcagcaagacaagctcgaacgccgctgggctgcccgcctcgacctgctgcgccgcgggctggtacgcagcacgctggccgctgaaggcaccgatcgcgccgtcgatcaatgcatgaaggaaatgcgtgacgtcgtgcgtaccgacgatatggacgctgccctcgccgccttgctgccacgcctggaaaaggccgtgctcgattccgagcagcgtcgcgaaacccgggtcgaccagatcagcaccgcgctcaccgccttggttgcccagttgcaaaagctcccgctgccccgcgaagtggcgcggccgctgaaaaccttcgccaagcagctcgatggccgcgtcgggcaagcccgggagataccactgctgctcagtgagctgagcagcctgcaagggcaggcgctgaataacctggagcctgagagcgaaaccgcgcgttcggggccgggcctgctgcagcgtttgtttggtagtaaagacgcctcgagtgaagccccagaggctgacgtcgcgccactgtttccaccagaagtgtcgccgtcaaagcctgttgtgccaaaaccggtgcctgagttccaagagcccgcgcaatcggaagaattgacacaagccttgcgtgcctttgcgccagcgccgcaaacacccgtcgcctttaagccagcggctgttgcgcaggccaaggtggaagaggccaccagtgacacatttgtattcgaggcctccgctcaagggcaacctacggtagcgcctgcgccagtaattgagcccgacgtgcaggagcctccgagtgcggagcctgcgcatgaaagtgcactcgccgcctttatcgaagcaccgcaggttcaagtagacatacccgatgaaaccaccatcggcagcctgtctctgccgcccgtactggaaagccccgagccagacgacctgcaatcaggcgggatatacgccctgcctgattcgcccgaaccgtcctacagctcggtggccaagcacatcgaagacactttactcggcttgctggaagacttgtcgctgcccgagcgtcaccggccccaggccgaggccatgcgtgagcgcctcgcccatggcctgaactggtacgaactgctgccgatcctcgatgacttggcggtgctgatgctggcgatcactgacagcggccagcatgagttcgaggcttatctcaagcagctcaacgagcgcctcgaggcattccagggccatctgcaggtcgccagcgaagaccacgccgatagcagcctggctgcgcgggaactggatacgcagatccgtgaacaggtcgacgggctgcaaagcagcgtgcaggaagccgccgatctggacagcctcaagcaagtgctcgaaagccacctcgaaggcttgctcggcaccatggacgcccatcagcagcagcgcgaccagcgcgaacaggaagtggctgcacgcctcaaaggcctggcggagcgggtggccaacatggaacaggaagccctgggttaccgcgagcacttggaagtgcagcgccagaaggccttgctcgacccgctcactggcttgcccaaccgagccgcgtggagcgagcgcctcgattatgaggtcaacgcctggcatcagcgtggaaacagcctttcgctcgccatgctcgacctggatcacttcaagcgtatcaacgacggctacggacacctggcgggcgacaaggtcttgaagatcattgccaatgtgctgagcaagcgcctgcggcccaccgacttcatcgcacgcttcggcggcgaagagttcgtgctgttgatgcccgattcaacgttagcggatgccttggccgtgggtgaggtgttgcgcggcgccatcgccgcctgcccgttccatttcaagggcgaaccggtgacgatcacggtgtccatgggtgtggcgcagtttcagcccggcgagcgcagcgacctggcactcaaacgcgccgacggagcgctgtataaggcgaaggcggcgggacgcaaccaggtacaggcggcataaaagatgttccattttgtaatttgacggcctgggcatacacgttacgttacactgttgcattatcgactttcagtgtaatgcttctgccatgaaatctttgtatatcgcttttgcgtttctgctgctcaccggctgcgccagcggcccgcgcctgaacaccagccatccttcggtgaaccacgacaaccgcatacagttcgttgtcgtgcattacacctccgccaaccttgaacgctccctggcgttgttgacccatggccaggtcagcagccattacctgatcggcgacgacgcctcaggcaccatctacaagctggtggatgaaagccagcgcgcctggcatgccggtgaaagcgagtggatggggcgcacctggctcaactccagctccatcggcattgagatcgtcaacccagggttcagcgatacgccgacggggcgtgtgtggtacccgtattccgaagcgcaggtaaagtcactgatcgtgctgctcaaggacatcagcaagcgtaatggcatcgaccccaagaacatcattgggcatagcgacattgccccgctgcgcaagctggacccgggcccgttgttcccttggaagcgcttggccgcggaaggcctcgctgtctggccggatgcccaggcggtggcccgattccaggtgcagtacgccgcacagctgccgagtattacctggttccaagaagaattggctcgcctgggctaccagacaccgcagaccggagagttggatgtagccacgcgtcatgtgatcgcagcgttccagatgcgctttcgtccatcattgttcgatggcaccccggatgctgaaagcgccgcgatcctgcgggccctgaatcagcgctgatcgtgtacatgtaggagcgagcttcctcgcgaagaatctcaacgctgtcaggcagcccgcgtcgttcatgcctttttcgcgagcaagctcgctcctacaacggcagcgccatatagaactgcgtgccctgccccggccgtgaatacacacccatgcggccgccatgcagttgcacgatctccttgcacagtgccaaccccaggcccgccccgcctttcttgcggccgacctgcacaaagggctcgaagatgcgcccttgctggccataggcgatgccttcgccgttatcttcaacgctgataatcacccgctcgccatgacgtcgcgcctgcaggcgaatctgcccgccttcggcggtatggcgcagggcattgcccagcagattgtcgagcacgcgctccagttggacctggtcggcatacaggcgcggtaagtctggctgggtttccaccagcaactcaatgctctgcgcgttggcaggctcgacgaaccgggcccgtgcgtgctccagcaggtcggtcacatcgcaggccccaagggtgagcttttgcaggccgttctggtagcgcgagaaattgagcaggtcgttgatcagctgcatcaggcgctgcatttcttcattgaccgtatccagcaggtccgcttcgcgggaatccgccgggaatttggcccgttcgcgaaacaggccgaaggccatgtgcataccggtcaccggcgtgcgcagctcatgggaggcgcgcagcacaaactcgctgcgcacccgctcaaaggcgcgttgttcggtgacgtcatgcagcaccatcaccgcgccgagaatatgcccctgtgtatggctgacaggcgtcaggctgtaggtcagcagacgcagctcgccctcgacttccacctccaggtcgtccggcgcccgctccagattaccgccgcgcagcaccagttgcagttgttcatccatttccgcacggcccagggcttcccccagaccttgtccgagtcgttcctcatcccagcccagttggcgctgtgcgacggggttgaggtgctcaaggcagccttggcgatcaatcatcagcaagccgtcatcgatactgtcgagtaccgcttgcaggcgctgctgaccggccagcaactcatcaacattggtggcctgatgttggcgcaatgcttcggccatgatgccgaaacggcgggtcaactgattcatttccgccgccgaagagataggcagcgtaacctcgaaatcgccctgaccgatcttgtcggcggccttggcgagcgcctcgatggggccaccgaaacgccgcgcgatgccgtgggcggtgacgaagccgataatcagcaccgcaagccccaccaacccgagaaggccggcgatcaataacgcccgctcgcgggatttatgctcgctggtgctgatgttttccagcgcccgcttgtgatcggcgatcaggccgttgcgcaacacgttgaaagtttcagtcagcttttccttgctgcctgcaggcggcgaggcttgttgagattggtcgaacgcctcgagaaggttctggtaatcagcctttgcctggctgaaaccatggcttcttccatcgagctgctcatgggcgacgccttcgtccagcagctcgaaatagtgacgcttggaggcttgcagggcctcggggtcgggtcgtttttccagcatcatgatcagctggtcgcccaggctctggcgcaacttgagccccaggtccagggtgatgaaattgctgcggatcaacgattcctgggtcttggccatttgcatgacgctgaccaggcccaggatcaaccccagcaaggccacggtgatcagcgctgagatgctcaggaataaccgagtgcgcagtttcatcgcgagcttcataaagtcctgctcacaggttgtactgtttgcgtttgcggtacagggtcgacgcgtcgatgccgagagtgcgggctgcttggtccagggtgtcactggtagcgagtaccgcgccgatgtgggctttttccagttcgtccaggctcagtgcggcgccgatacgcggcgcattgttggtcggttgttcggccatccccaagtggctgatctcgaccttctcctgcgggcagatgatgctggcgcgctccaccacgttgcgcagctcgcggatattgccgggccagcgatagttgagcagcgcttctcgagcgtcatcactgaagccgcgagcgggacgggcgtattccttgacgaagcgcgccaggaagcggtcggccagggccaggatgtcctcactgcgttcgcgcaacggcggcaggtgcaaggtgatgacgttgaggcggtacagcaagtcttcacggaagcggccatcacgcaccatgtcttccagattcaagttggtggctgcaaggatacgtacatcggcgcgacgggtgaccgggtcgcccacacgctcatactctttatcttgaatgaaacgcagcaattttggctgcaacgtgagcggaaagtcgccgatttcgtcgagaaacagtgtgccgccgtccgcctggttgactcggcccagcgtgctttcactggcgccggtgaacgcgccgcggctgtggccgaacagctcgctctccatcagttcggcggtcagcgatgggcagttgatggttacgcaggattttttcgagcgtttgctccagccatggatagcccgggccagctcccctttaccggtgccggactcgccgaggatcagaatgttggcatcggtgccagccacttggcgcgcggtctccaacaccaccatcattgatgggctgtgggagtccaggccatccttggactggcgcaccgcaccttccaaggcttccaggcgcgccgaaagctggcgcacttccagttgcttggcggtggccaggcgcaattgatccgggctgcagggcttgaccagatagtcggcggcaccggcctggatcgcgtctacggcggtatccacggcggaatgagcagtgacaatcaccacacgcatccacggtgcctggatacgcatctgtgccagtacatccaggccgttatcttcgccaaggcgcaaatcgagaaagcacaggtcgaacacctggcgctgcatcagcgcgtcagcctgggccgcgctgttggcggtggctacggtgtagccctcatcctccaggcaataacggaaggtgcgcaggatcgcggactcgtcatccactaaaagaatgcggccttgaagttccttggctgatcccatctgtcccgcgctccttaactataaatgtgatggtgtttagtcccggaataatcgggcaagttgcatggtttattctgattcataaaaggcatgtccgtgcaggtatctgcacactcccgacacaagtaccggctgatggcgttttcataccctgctgccacttcggcaacgaggtctgcggatttgatccgtcgatccgaccattggccatcgtgcatttcgcacgggtaacgcaggggcatcgtgcaggatgctaggtgatagatctgtgtgtggcatttaactcgttgattttattgagttttattttgcaataaagctggcatgcagtctgcaatatctctcccaagagtgtcatgaacgaataaacagaatgcgggagaaaagcagcatgactcgccaaagcctcagccaattgcgtgtatccccgcttcgtatgcagcagggcttgtttgccagtttggcattgatggtcacgctgattgccggccagcaaatgcagcattggcaagagagtgcgcagcaaaccccgcaatttgaacgtccggtcatgacccagacccacttccgttccattggcagcgccagcgctaatgtaactgccccgcaattgagcttggtcgaccaggattccactctggacgaactgccaacccaagagcgctgggtgttctaggcaagacaaggtcgcttgaattgagcggctgtacggcactaccgctgttacccctatagaagcataaggagaatcaccatgttgagttgggcaatcacatttctgatcatcgccattgtggctgcagtcctaggctttggtggtatcgcgggcaccgccaccggtatcgccaagattctctttgtggtcttcctggtgatgtttatcgcttcgttcttctttggtcgtaaaggccgaggctgaatatgaccactctgccttttaaagccattgctgccgccctgctcttgggcggcagcagcctggccatggccgccaatgacggccagtcccgggctaacgaattgctcagcgcggacccgcagtaccgtgagacctggcaagacgtggtgaagaaagaacagcgcctgccggaatgggtgatgaacctgtcgggcaccgccgaacaaatgaatgctgttgaagaggacggtgacaagtatctggtgggcccgctttgcgaaactgcggatacctgcttgaacaagcgcctcattgtggccttcagtttcgataaggaagatgcctacgcgatgttggtggaagtcccagccggtctgccggccgacaagtccccgacacggcatgccgattaccgtttcctcggtaagccggatgaaggcatgcaaaagctgttgatggaacaactgaagaaagatccgaattggtactaggttccgtctgaaacggagcctgcgtccatagaaagaagcccctgcgcttctttctgtttgcatcgctcgccaacagtgatgcatgaccagggggccgggttgctctgatccaccgagatcggcgtgacctacgggcacagggagtgcctgcgcaagggccgggtcaggcgaaaagctgcgacgcaagttcacaagccctcaagcttgctgaacttgcggcgggcttatgactctcatcccccgcgcttcatgcctttcatagccgtcatttcagtttttgccttacaccaaccattactgggtatgtcagcgtgaccatctatctagaaattttcgtcctcgccagaggacttttctggcgctaggtggtggatttctcaagcatttctgccaatcacttcaagtcgtcctgcttcgctaagcgagcctgatttggcagcttcacggcatattcacccgcctcaatggcgtattcgaactgaccgtttggacaattattttcaaaaaaagccatgccgattcggcatagggtaggcgtttacggcattagacgtcgctcccttgcatgggaatagttgcgccttttttcgcctgccagtaagccatttcggccacgctgcggtgaccttccatggaggctgatgctcacactttttcgctttcgggcgttccagctggcgcattcgccttaagtccacttgaagtaagggtaatgacatgaagaaggcaaagctaagcctcgcctggcagatcctcatcggtttggtactggggatcgcaatcggtgcagtgctcaaccatttcagtgctgaaaaggcctggtggatcagcaatgtgttgcagccggcaggcgatatctttatccgcctgatcaagatgatcgtgatcccgattgtgatttcctcgctgatcgtcggcattgccggtgtaggcgatgcgaaaaagctcggacgtatcggcgtcaaaaccatcctttacttcgaagtggtcaccaccatcgccatcgtggtcggcctgttgctggccaacctgttccacccgggcgccggcatcgatatgagtaccctgggtaccgtcgatatctctaagtaccaggcgaccgccgccgaggtacagcatgaacacgcgttcatcgaaaccatcctcaacctgatcccatcgaatatttttgcagcggtggcccgtggcgagatgctgccgatcatcttcttctccgtgctgttcggcctgggcttgtcgagcctcaagcctgagctgcgcgagcctctggtgaccatgttccagggcgtttccgagagcatgttcaaagttacccacatgatcatgaagtacgcccctatcggcgtctttgccctgatcgcggtgaccgtcgccaacttcggctttgcttcattgctgccgctggccaagctggtgatcctggtttacgtggccatcctgttctttgcctttgcggtactgggcttgatcgctcgcctgtttggcttctcgatcctgaaagtgatgcgcatcttcaaggacgagctggtgctggcgtactccactgccagttccgaaaccgtgttgccacgtgtgatcgagaaaatggaagcctacggtgcgccgaaggcgatctgcagcttcgtggtgccgaccggttactcgttcaacctcgacggttcgaccctgtaccagagcatcgccgcgatctttatcgcacagctgtatggcatcgatctgtcgatcggccagcaactgatgctggtcctgactctgatggtgacctccaaaggtatcgccggcgtgccgggcgtgtccttcgtggtattgctggccaccctgggcagtgtgggcatcccgctggaaggcttggcgttcattgccggtgtcgaccgtgtaatggacatggcgcgtactgcactgaacgtgatcggtaatgccttggccgtactggttatctcccgctgggaaggcatgtacgacgatgccaagggcgagcgctactggaattccctgccgcactggcgcagcaaggaagcgctgccggccggcgagatcactcgcggctgatcgctcgattgcgctgacacaaaccccggataattccggggtttgtcgtttctgccagccccgttatcattcgccccatctttcgggggatttaactgatgctcaatggcctgtggcttggcttctttgtcgtggcaatggtgtcagcactggcgcaatggctggtgggcggtaacgccgggattttcgcagcgatggtggaaagcattttcgccatggctaaattgtcggtggaagtcatggtgctgctgttcggcaccctgaccttgtggctgggctttttgcgcatcgccgagaaagccgggatcgtcgactggctggccaaggcccttggcccgttgtttcgccgcctgatgccggaagtgcccgccggccaccccgccatcggcttgatcaccctcaacttcgctgccaacggcctgggcctggacaacgccgccacgcccatcgggctgaaggccatgaaggcgctgcaggaactcaatccgatccccaatacggcgagtaacgcacaaatcctgttcctggtgcttaacgcgtcgtcgctgacgctgttgccggtgaccatcttcatgtaccgcgcccagcaaggcgccgcagacccgaccctggtgttcctgccgatcctgctggccaccagcgcgtcgaccctggtgggcctgctgtcggtggcggtgatgcagcgcctgcggttgtgggacccggtagtgctggcctacctgatccccggagcattgatactgggcggcttcatggcgctgctggcgaccctgtctgccacggcgctggccggcttgtcgtcgatcctgggtaacctcacactgtttggcttgatcatgctgttcctagtgatcggtgccctgcgcaaggtcaaggtgtacgaagccttcgtcgaaggggccaaggaaggcttcgacgtggccaagaacctgttgccctatctggtggcgatgctgtgtgcggtgggtgtgctacgtgcctcgggagctttggacttcgggctggaagggattcgccatgtggtggcctggaccggcatggatacgcgtttcgtcgacgcgctgccaacggcgatggtcaagccattctccggcagtgcggcgcgggcgatgctgatcgagactatgcagacccagggggtggatagcttccctgcgttggtggcggcgacgattcagggcagtactgaaacgacgttttatgtgttggcggtttatttcggctcggtgggcatccagcgggcgcggcatgcggtgggctgtgcgttgctggcggagtttgccggtgtcgtggcggctattgcggtgtgctactggttcttcggttaagccttagattgctatcgggggcaagccccctcccacacttgatctgcgaatgcattcaaaatgtgggagggagcttgcccccgatgaggccgtcagcgttttaaggcagccttgccctgctgcaccacccaattcaccacctgcccattcaactgatcccccgccttaccaaaggctgccaccaccgcgggcaccttggtgtcacccaccggctgccttacctcaaaccgccggctggcgataatccgctggtcactgccgcgcaccaaccgtgcgtcgaggcgaatcacgacatctaccgctttgccactgtactcactctgaaacgcctgcaattgcccgcccagctcatagtcggcttgcaggttggtctcgtcggtactcaacaacgtcactcgcccgtcccgttggaagccgtccagcaggcggttgcgtaaaagcactggcgccgggtcgctccagcgtgagtttgcataactgctgatcaggttgccgtcaggcaccacggcaatgcgtgggctgtcgaggaattcgctggtctggggcttgctcacccgcaatgaccaacttaccggtgtgccttgagtggttggctgtgcagataccaggcggtatacgtccgatggatccggcttgggcaggattgaacacgcactgaccagtgccagagccacaggggcgatcatttggtaagcacgcttcatggcgtgaactccttgttcttgtcactgcccagcaggtaaccgctggggttggcttccaggcgacgagagatggcgcgcagcgaaccaagggtttcacgcaattcgcgcaccgccggcgccagttcgttaaggccctgcatgccgctgttcaccgagtcctggttgttggtcagcaagctgttaatggtggcggtgctttgctccagggatttcatcgcctgctcggcgctgccgaaggcttgcttgccttgctcgttgagcaggccattggcgctacgcatcagtacggtggtttgctcgagagcggcgccggcctgtttgctcacctgcatcagttgctgcatcaccaccttgatatcgcctcgttgctcggcgatggccccggtggtttgttgcaggttgtccagggtgttgctcaggcgttcgacgttttcccgggagaacatgtggttggcgttgtgcagcagcaagttgacgctggtcatcaggtcgttgctgttgttgagcaggcgagcgatgggcgatggggatgcgatgatttccggcaggttgccgtccttgcccttgagctccgggctctgtggggtgccgccgctgagctggatgatcgaggtgccggtgatgccggtcagcgccagcttggcctgggtgtcttccttgatcggcgtctgcccggccaggcggatgcgcgccaggacgcggcgcgggtctctggggtccaggcgcaggctggtgacgtcgcccaccttgatcccgctgtactgcaccgcactgccctgggacaggccgctgaccgcctcgttgaagatcacttcgtaatcctggaaggcgctgtcgacgctggacttggccagccacaggccaaacagcatcgcgccgaccaccactattacgctgaacagtccgatcatcacatgatgggctcgggtttccatgtcatacctcgttgagcgattgagcggcatccaatgccgcgcggccccgggggccgtggaaatattcgtgaatccaggcgtcgtcggtttccgagacgacatcgatggcgtcggccaccagcactttcttctgcgccagcaccgccacgcggtcggtgatggtgtacagcgtgtccaggtcgtgggtgaccaggaacacactcaagcccaacgcgtcgcgcagggtcaggatcagttggtcgaactgcgcggcgccaatcggatcgaggccagcggtgggttcatcgaggaacaggatgtccgggtccaatgccagcgcacgggccagggccgcgcgcttgatcatgccgccggacaatgaggccgggtatttgtcggccgccgacagtggcagcccggccagcgccagcttgaccgccgccaagtgctcggcgtcggcgcggctgaggccggcgtgttcaatcaacggcagggcgacgttctcggtgacggtcagcgaggaaaacagcgcgcccttctggaacagcacgccaaagcgtcgttccaccagcgagcgttcatgctcaggcaggctcggcaggttcttgccgaacacccgcacttcaccctcactggggcgccgcaggccgacgatgctgcgcaacagcaccgacttgccgctgccggagccgccgaccaccgccaggatttcgcccttgtacaaatccaggtcgaggttctcgtgcacgctctggctgccaaagcggttgcacaagccgcgcacttcaatcaccgcctcagtgggcgcacggtgtagacgactcaccagcccatctccatgaagaacatcgcggcgaccgcatccagcacgatcaccacaaagatcgattgcaccacgctggaagtggtgtgcgcgccgacggattcggcactgccgctgaccttgaagccttccaggcagccaatggccgcgatcaggaaggcgaagatcggcgccttcaccatgcctaccagaaagtgctgcacgccaatgtccgattgcaacagcgagaggaacatcgccggtgaaatatccagggccaccgcacacaccacgccaccgccgacgatccccgagagcatcgccaggaaggtcagcatcggcagcgccaccagcagcgccaagacccgcggcaataccaacagctccatggggtccaggcccaaggtacggatggcgtcgatttcttcgttggccttcattgagccgatttgcgcggtgaacgcactggcggtacggccagcaatcaggattgcagtgagcaatacgccgaactcccgcaggaaggagaacgctaccaggtccacggtaaaaatcgtcgcgccgaagctcttgagcaccgtggcgccgagaaatgccaccaccgcgccgaccaggaaggtcagcaaggcgacgataggcgctgcgtcgagaccggtctgttcgatatgcgcgaccatcggcgtcaggcgccagcgcttgggccgcaggatgccacgggcgaaagtttcgaggatcaggccgataaagcccagcagcttcatcgcgtcttgccagacggtgtccacggcacggccgatgcgtgccagcacttggatgccgacagcctcttccggctctttgatcggcacgcagaaatcattcagggagcggtagaccgtcttgagcaatgcgcggtctgcggctggcaggctgcaatcggtctgctcggcggagtgttcgatgcgctcggggcccagcagctccaccagcagcgaggcgccggcggtatccaatgcgccgaggccgttgaggtcgatgcgggcgccagcgtcgtattggccgtcgagcttgtccgacaacttcttcagcgtggtgtagtgggcaagcgtccagtcgccggtaatccggagcaaaggtggagtgatggacgtatcaaggtgggccgcgccggccgtcgtgcgagtggtcataagctccgagcttgtttggctatccacaatggctacgtaatagcacacactcgcctactttgggttgtccgcttgtgctgtgtctatcaccttgaagcgcaatacaccgatgacttgcccgtcttcggtcagcacctggacctgccagcgccctgctgagtcacccgggaaattctgcttgtgagtccaggcgcggtaaccctccttgcgaccgccatggatatccagggcaatgcggtcgacttcctggccattgaatttccacacatggtagatccgctcatccagcccgcgcggtgcgttgatcgcggtgtaggcgtacagcccaccactgcgcaactgggcggcagtgacttccttgaggtggtcgccaggtgtgcggtcttgcagctgggtgctgatcgccacttcggtcatccacagggtggcgggcggcacccagctgcgcaggaaccaaccggcgcagccgatggcggcggtgacgcccagcagcatcgcccagcctttgagactgcgcagcggcaggctgacggccaggctgggaatcgacaaggccatcgccacgcccagtgccagtttgtagctctcggcagtggtcaggtgcaggatgatcggcaacgcggtcaacagtgcggcgaataaggtcagggtatgcagcgcgaggaacagcgaacgcttgggcgccagccacttgtagtacagcgggtcgatgatcgacaccagcgcggccgcgccgagcaggccggtaaacaccgattggccgctgttccaggctgtggtgatgaagaagaacggcagtacgaaaaacagactttcctggtggatcatctgggtggcgtagcgcagcagcggttcggggatttcacgcttgaagagcttggtgaacagctgcgtgaagctgttttccagcatcagccacagccagctcaccagcatgatgactgcgatccagctggccatgccctgctggcggtccaccaggataaagctgcccacgcccgagatgaaaccgccgagtgcgattacccctgggtagcgcttcatcagttcgaggatgcgctggattaagtgggtcaggtttggcatcggcggttcgcagtctttatatgaaaaatcccagacagaataacgtcttagccctgggtccggtgcctcattccacgatccgtttgcgataacgccgaacgccaatcaacactatgacgatcagccccagcacgcccgcaccgatccacgtcagggcgtcatagctcaacagtggcttctcgatgcgccaatagcccggttgcttgagcacttcgcgcatggcctggttggtttgcgccaggctcacggccttgatgcgtttgaccgggtcgctgaaatgaccatcggcgtagtcaccggaagcactccaataatagtccgccagcgcgctgttgccctgcacagcccaggcttggcgcgcgatagccgcgtgttgcagtcgggcaaatgccgttgggtccagcccatccttgagcagttgtgccttgaggtcttgcaggacgtgctccgcttcagggagattttcccgttcgaggtcggcgttcaggctcaggaaaccgacaccgccgagcacttcgcgctcagtccaggggccgtaggacaagccgtgcttgaggcgcagttgccggtacagcgcccagtccaggtaatccttgagcaggtcgtaggtttcgtcatgctggtcatccagtaccggctcggggaacagccagtgcagcttggcgccatcgccgacccagccgtggatcaggtcgcggtggctggcggcagtgtgccgtatttccggcagcggccgatgttcgctgggctccaccgggtcgagttggccgtaggtgcgttccagataggcgggcagcagtttgtcgaggtcaccgacgatgatcagggtcatgttgttcggcgcgtaccagttcttgcgcaccgcttccagctgatcgcgggtcaggtgattggcctcggcgcgttcggcgcatttgaggcccagctcgacagccagttggttgctggcgttgtggccgaggtcctggcggtccagcaggcgttgcaaatgggagtaatggcccccgtcttcacgttcgaccacccgcttggccgcatcgatattggcgtcggttagttgcgtgcgggtgaagatggccagtaacaggtccagtaccttgcgttggttttgcgcaggggcctcgatcacgaaagtggtgtcggcgttgctggtgtaggcgttccactcgccgcccagggcttgcatgcggtcttccagatcgccctctccgccaccgtcgataccgctgaacagcaagtgttcgagcaggtgcggcagttccttgtcttcgcagccgaagtcatccaggcccacgcccaccaccaggcgaatcgctacgtgcccgcgttcggtgcccggcttgagcagcagttgcaggccgttgggcaaggtatagccttcgacttgcaggcggtcaaaggcaaaagtatgtgccgagcccaggagcaggcaggcgagtaacaggcgacgcataacgagcttcctggcgaatgaggtccattgttaactgacttcactcgccgtcgtacgttcagggtgaatgggtgatgtcggcaatatcttcggcggagagtgcgccagtgtcggatgtttccaacactacataagcgctgctacaaaacaacgaattcaagcgtttcatgtcggcaatcagctccagatgcagtgagctggtctccaggctctgcacgatcttgcgttgcaggcggctgacgtgtgcgtgggccaggcgacgctcctgggcgcgaaagcggcgtttttcacgcagtaattgacgggcgctttccgggtcgccgctgaggaacaccgagagccccaggcgcaggttggcaatcaactggctgtgcaggccgctgagttcttccaggcctacttcggaaaattgtcggcgctgcgaggttttctgctgctggactttacgcagcatgcgctcgatcaggtcacccgccagtttcaggttgatcgacagctcgatgatttctgcccaacggcggttgtcttgttcgccgaggtcttcacggggcatttgcgcgaggtagagcttgatcgcgctgtagagcgcctcgacgtcatcgctgaggctgcgcatttgctgggtgattgcagtttgattgccgcgcaggacctcttgcatcgaagtgagcatattgtcgatcaggtcgcccaggcgcagggtttctcgcgcggcgttggccagggccaggctcggcgtggtgagcgcggccaggtcaaggtggcgaggtttggccttgccattggtttcttcgcgctcgggcagcagccaggcgcacagtcgcgccatagggccaatggtgggcagtagaatcaagcagcgcgtgacgttgtagagcaggtggaaggtgatgaccatgccttgggcgctgtagtccaggccgtccatccagaggacgagtgggtcaagcacaggaatgatcagcaacaggccgatcaatttgtacaacaggctgcccagggccacttggcgcccggcagtgttttgcatgctggtgctgaggaaggccagtacgccgctgccgatgttggcgccgatcaccaggccgatagccacatgcaacccgatcacgccagcgccggccagggttgaggtgagtagcacagccgcaaggctggagtaggaaatcatggcgaacagcgcgccgaccagggcgtccagcaagatatcgccggtcagcgaggcgaagatgactttgacaccctgggcatgggtaatcggcccggcggcttcgacgatcaattgcagcgcgaggatgatcagccccaagccgattccgacccggcccagttgcccggcgcgcgtctgtttgcgcgacaggaagaaaatcaccccgaggaagatcagcagcggcgacagccaggacaagtcgaaagtcagcacccgggccatcaacgcagtaccgacgtcggcgccaagcatggtggccaaggccggcgtgaggctcatcagcccttggccgacaaaggacgtcaccagcatcgcggtagcgttactgctttgcaccatggccgtcaccaggataccggcgacaaaggccagccagcgcttggacatgttctgcccgatgacttggcgcaaattggacccgtagacccgcaggatgccggtacggacgatatgcgtgccccagataagcagggtcacggcggaaagcagattgagcaaggtcagcatgctcggccccccgtgtgggtgcgctccagcaggagcgaaggaaaattgccgcgtgccgctctacgtcttgtacttaagctgtagttggcgaatgggctctgcgccagcatcgcatagctaaagtggggattgaaacaaaactgtcatgaaatcagctttttgcagatgaaaaaatggggcgcaagcgccccatttcagcagcggagtcatgtttattgacccggcatgtccttacgcagtttcaccggatcctgctgttttttctttttcgccatggcggtgcgcatcttgatgttcaccgcttccactgccagggagaacgccatggcgaagtagacgtagccttttggcacgtgcacatcgaaggattcggcgatcagcacggtacccaccaccagcaggaacgacagcgccaacattttcagcgacgggtgcttgtcgatgaactcgctgatggtgccggcggccagcatcatcaccaataccgcaacgatgatcgcggcaaccatgaccggtacgtgggaaaccatgccgacggcggtgatcaccgagtcgagggagaacacgatgtcgatgatcgcgatctggatgatggtgtagatgaacttgccaccggcgcccttgggctcgtcgtgggtttcatcttcgccttccagggcgtggtacatctcctgagagcttttccacagcaggaacaggccgccgaagaacaggatcaagtcacggccggaaataccctggccaagcaccacgaacaggtccgcggtcagttgcatgacccaggtgatcgacagcagcaacaggatgcgcgtgaccatggccagcgccagcccgaagatccgggtgcgcgcctgcatatgcttgggcatacggctgaccaggatcgaaatcatgatgatgttatcgatgcccaggacgatctcgagggccgtcagggtgaagaaggcaatccagatttccggattggtcagccattccatgtgtattcctttgagcaagtgttaaaccgcgcaagctgtagcgccgcgcggtgagtcagtacgattatagagtgctgaacagcggaaaaatccccatcagcagtgcggcgaacattatgcacaggcataccagcactgcccacttcaaggtgaagcgttggtggtcgccgaactcaatacccgccagcgccaccagcaagtaagtcgagggtaccagcgggctgagcaggtgcacgggttgcccgacgatcgacgcacgggccatttcgaccgcggtgatgccgtagtggctggccgcttcggccaatactggcagtacgccgtaatagaacgcatcgttggacatgaagaaggtaaacggcatgctcaccagcgcagtgatcactgccaggtacgggcccatggcttccgggatgaccgccagcaggctttttgacatggcgtcgaccatgccggtgcccgacaggatgcctgtgaagatcccggcggcgaagatcaatccgacgaccgccaagacgctgccggcgtgggccgcgacgcggtctttctgctgttgcaggcacgggtagttgacgatcatcgcgatactgaacgccaccatgaacagcactggcagcggcaacaagccggcgatcagggtgcacatcagcgccagggtcagggcgccgttgaaccagatcaacttcggacggcgagcgtcagggaactgcgacacgctgatttcgctgtggtcgatctcgtcgccctgcaggtgcagttcacccaggcgcgcacgctcgcgcttgccgtacatgtaggcaatcaccaggatcgccacgacgccggcggccatggccgggatcatcggcacgaagatgtccgaggggtccacatgcaacgcactggcagcgcgggccgtcgggccaccccaaggggtcatgttcatcacgccaccggcgagaatgatcaggcccgccatgattcgtgggctcatgccgatgcgttggtaaagcggcagcatggcggcgacgcagatcatgtaggtagtggcgccgtcaccgtccagggataccaccagggccagcacggcagtgccgaccgagaccttcagcgggtcgcccttgaccatcttgaggatcttgcgcacggctgggtcaaacaggccggagtcgatcatcaaggcaaagtagaggatggcgaacatcagcatcacgccggtcggcgcgagcttggtgatgccttcaagcatcatcgggccaatcttcggcgcgaaaccgccgaacaacgcgaacaggatgggcacgatgatcagggcgatcagcgcggacaggcgcttggtcatgatcaggaacatgaacgtgatgaccatggcaaagccaaggaaagtcagcatagggatactccaggcgtagcgcggctagggaatggcagaccggtcgagggtcagcgcagaacgaaaggcacgagacgtacgggtggagttgcagcgaacaggcgggtacgagcggacatcgggaatcaccattgttgttgttaacagccggtctgttgccggcagtgagggcgatcctagacggggaagctttcagccagctttcgccgggaaaagacgggacgcacggtcatgagacttatgcagataaaaatgtgggagggggtttgctcccgatagcggtgtatcagtcactgaagatattgactgaaccaaggctatcgggagcaagccccctcccacaatttgattgtgtgtaccgctaagtctttagggcagttccaggccaccagccgctttatgcagcgcacgcagatgctcgcccagctgcttgagattggcttcactggccgcaatctcggcagcgcgggacggatcgagcagagccctcacctctttatccagctcgccggtcaacgattgcagttgcttctggcgctcggcgctttccgattccaggcgcttggcttccgaaggctgcggcaggccatagccgccactgtccagcaactcggccgggcgactgaggaagccactgttggcgaggatctgttgcagcgtgttgttggctttctccatgccgccgtttttcaactcgcgggcattgaggtagcgctgcttgacttcatcctgggcgagcatcagctgcctgcgatagctggcctgctccagcagcagcagcgcggcgctggtgcgcaggtcggcctggctgaaccactggcgacgcgcttgcgcatccagggccaaccagtcttcgacctgggtctgcttgatcggcaggcgcttgcgcagcacatcgaacatggcctggtaacgctcgcggaacgagtcgaagtgataccccaggcgcagcgcctcgcgtttgtcattcaacacgctggtgtcggccaggccgcgcgcgctgaggacttcgagcaaaccgttgggggtgatgttgtccaggccggtcaattgcgggttggcactgccactgcgcaacagtttcaggctctccaccgcacagttgttggagatgaagaagtagttgccgtcatagctccagtgcatttcagcggcatgttcgacggtgtcgttgatttcctggcgattgagcttcagcggcaccgacgcgaggccacgcagttcggtcttggtgtattcgtcgatgacctgggccagcggcagtacgaacagtcgtgatgggtacttgcccaccaggccgtcccagctcgacaactgtacgtcaccgacgaaggcgcggtaggacaacaccaggtgtcggtccaggtccagccgacaatccgggccacgcgggcgacctggggcgcaaatcaccaggcgcagcatgctatggccccagcggctgaccagattctggttggcctcggcgagcaggtaatcgatttcatacacccgttccgggtcaatctggcccaggggcgtcttggcgaaatcgttgccggcgttcaggaacggataggtcgtggcacaggtgtcctgcacgggcggtgcccagccgaaatgctccttgtaatagcggaacagcgcggggcggcggcaggcgtagctggggtcgaggaggaaatactccatgttgaccgccacgaactccaacgggctggtggtttcgtagatatccgggctgcgcaccacctgattattgtgctgttcgcgttcgccgcggcggccgacgtattgcggccagccggcgaggtccagcaggcgcggatcgtcacttagggtaaagcgacggtcgttctggccacggcattggtcgggcaaaccaatcaagccggtgatgttgttttggcggctgcagcgttggatcagggcgcgttcatctttgggccacaggcgcgcacggtcatagatgtgggtcagttcatgcagcacggtggctagcatttcccggcgcacggtgccgtgggggcgattggttttctgggtggcggcgctgccgtcggtcaggctggcgagcaggttttggttcaagtccagttcggacacaagagaggcttggccgtaagcgtttgctggcatcttgtcggtccagccgacatcgatgcggcgatccaactgctcgatgaagcgtggcggcaaggcgcgcatcgcatcatcgagcaatgcctggctggcctgctgttcagccgggctcaagccatcggtcttgagccgcaattgcaggctggcctgggctgtagttgcacacagcagcacagccccggccaggagccaggctttgatacgcctcacagagcgagaatagcttcagcgagggtctggtcactggcatcacgggcttgcggtacgcgggtgcgcagggtgtcgaaggcagcttcgagttgcgcgccgcgaatctcgccattggtggcgacgaaactggcggcatcatcgtgggcttcacgcacgattttggaatcgcggatggaggtggtggtgtccgaggtgaaatcaatggtacgcgccgatgcacgcacgacgatgttactggtggccttcaaggtttgcgcctgggcgacatcggccaaaaacagcaggccgagggcggcgacgatcaacgggctacgcattgcggtgactccaaatacaaagatgattattggacgagaattgcttgcgccagttcaaggtcgcttgcatgaagttttggttgggtgcggcgcagataatccagtgcggactccaggcgcgcgccccgccattggccatcagtggcaatgaaagtggcagcatcatcctgggcggccatgaccaacttgttgtcgaacggtgcagaggtcaccttgctggtggcgtacacgctgacaacggtgctctgggtggacacatcaagggccgaagccaggggtgaccagcaggcggaaaacaatatagagacaacaaacagacggtatgaaaaagccatgggactcgacaactgaaagcgagcgccaaggctagcgcaatgcccgggcgagagccagcgcgcaggcatccgggagcgtctggcgctcccttctggttgccgtggatcagatcgccaggatggcctgtgccaactgtgcatcggttgcggtgttcagttgcggcgcttgttggcggatgtgggccagggcactttccagcttcacgcctcggatggcgccttcactggcgacaaagctggccgcgtcgtcacgtgcggcctgtaccactttgttatcgcgcagggaggaggtggcatctgaggttgcgtcggaagtggctttcagcgcgccgacgatcgagtcggtggtcatgataaagctgctcgcatgggcattggcagccagggtcaacacagcagcagtgcataacaggcgaagacgggacatggggaaactcctgtagacgaataataaggtggcgcgaagcggccactgcgaaacggactgggactgttgagcatcagacgcacgctctacaaggttcgccacgtggtgagtggatattagtcttgcgattgtctattcggaagcctgcaattaactgtacctgtcatttgttgcattgataaatctgtaccggtaagcagaaatcccgcggcttcaagcccctatcgcagaaacaacaaagcccgcctccggttacccggggcgggctttgttttgataaatctgggtgctggcggtggacccggcgggtcagggccagcgggcgcctattagcgccagaacggcttgctcagctcttcgtagcgttgagcttcgcttataccggcgtcagccagcagacgcgaatccaggcgagccaattggtggcggctggagatgcggcgctgccacaacatcaggttggcgagaacgcgcaaaggcagggaagcgttggtgtttacagctttatcttcgaagaacagttcggaactgagtgtacgttccatgatgacatccttccgcttgtggcgggattaggtagtggtttaactgatgccaatgatcctcctccggcgcaagactctctagatacagttcacctgtattgtgagaggccagttaactgtttaataaggctgtacggtacgaaaatgggacaactgtacctatctgcaccttaaaggtgcgaaattggtgtttttgagggaaagcgtgggatatttcagtaggatttgaccagtacagtagtacagtttttacttggatgcccattggatcttcgagctgatgaaactgtatttgcatcagcccggatctgtatcgatcaacccttgagcatatgcccggtctcttcaagattgatgtgccaactgagggcttcacgcaggatatgcggcgtgtgcccgccgatggcacatgcggcctcaaagtaggtattgagcgcgtcgcggtaggccggatgcacacagttgtcgatgatcacccgtgcgcgctcccgtggtgccaggccgcgcagatcggcaaggcccacttcggtgacgagaatgtccacgtcatgctcggtgtggtccacatgactgaccatcggtaccacgctggaaatcgcgccgcccttggcaatcgattttgtgacgaagatcgccaggtgcgcattgcgcgcgaagtcaccggagccgccaatgccgttcatcatccgcgtgccgcacacatgcgtggagttgacgttgccgtagatatcgaactccagcgcggtgttgataccgatgatgcccaggcgtcgcaccacttcagggtggttggagatttcctgcgggcgcagcaccagtttgtccttgtagtgctccaggttgccgaatacgtcggcgttgcgtcgctccgacaaggtgatcgagctgccggaggcgaagctcagcttgccggcgtcgatcaggtcgaacgtggagtcctgcagcacttccgagtacatggtcaggtcttcaaacggcgagtcgatcaagccacacattaccgcgttggcaatgttgccgatccccgcctgcagcggaccgagcttgttggtcatgcgcccggcgtccacctcttgcttgaggaagttgatcagatggttggcaatgccttgggtgtcgctgtcaggcggcgtcaccgtggaggcggagtcggcctggttggtgatcacgatggcgacgatcttctccggcgggatcggaatggcagtgctgccaatgcggtcgtcgaccttcaccagcgggatcggcgtacgggttggccggtaggtcgggatatagatgtcatgcaaaccttccaggttcgggttgtgcgccaggttgatctcgacgattacctgcttggcaaaaatcgcgaaactggccgagttgcctacggaggtggtgggcacgatgtgcccttgctcagtgatcgcgacggcttcaatcaccgcaatgtccggcagtttgagctggttgttgcgcaattgctcgacggtttccgacaggtgctggtcgataaacatgacttcgccggcgttgatcgccttgcgcagggtgctgtcgacctggaatggcatgcgtcgcgacagcaccccggcttcggtcagttgcttgtccaggtcattgcccaggctggcgccggtcatcagggtgattttcaggggcgaagtcttggcgcgttcggccagggcgtgggggacggccttggcttcaccggcgcgggtgaagccgctcatgccgacggtcatgccgtcctcgatcagtgcggcggcttctgccgcgctcatgaccttgttcaacaacgaaggcaagcggatacgatcacggtacatgaattgttatctcaggctacggaagcaaggtgggcagtgtagtgatttcaaaaagtttcggcccgctaccatggtcgaatgccaggtagcgatttagagcctttggtcgggtttcatcccgtaataaaaaaccccagcctacgggaggccagggtttggggtattgcgctggcgcagtgttattcgacggccttgaccatgtcttcgatgaccttcttggcatcgccgaagaccatcatggtcttgtccaggtagaacaattcgttatccaggcccgcgtagccgctggccatcgagcgcttgttaacgatgatggtcttggccttgaacgcttcgaggatcggcatgccggcaatcggcgagttcggatcgttcttcgcagccgggttgaccacatcgttggcgcccaacaccagaactacgtcggcctggccgaactcggagttgatgtcttccatctcgaacacctggtcgtaaggcacttctgcctcggccagcagtacgttcatatgcccaggcatacggcccgccacggggtgaatcgcgtacttcacagtgaccccgcggtgagtaagcttttcagtcagctctttaagcgcgtgttgggcccgggcgactgccaagccatagcctggcacgatgatcaccgtgtcggcattggtcagcaagaaggtggcgtcgtcggccgaaccggacttcaccgggcgcgcttccttggagccgactgccgcgccggcatctactgtgttgccgaaaccgcccagcagcacattaaagaaggagcggttcatcgccttgcacatgatgtacgacaggatcgcgccgctggagcccaccagggagcccgcgatgatcaacatcgagttgttcagcgagaagccaatgcccgccgctgcccagccggagtaactgttaagcatcgacactactactggcatgtcagcgccgccgatcgggatgatgatcagcacacccagtacgaaggccagggccagcatcactgcgaacgcggtgaggttgccggtgaacatgaacgccaggcccaggcccagggttgccaggccaagcaccaggttgagcttatgttgcccgccgaattgtactggtgcgccttggaacagacggaacttgtacttgcccgacagcttgccgaacgcaatcaccgaaccggagaaggtgatagcaccgatggcggcaccgaggaacagctccaggcggttaccggcagggatcgagtcgcccaggtgcttgacgatgcccagggattgcggctcgaccaccgcagcaatcgcgataaacaccgcggccaggccgatcatgctgtgcataaacgccaccagctccggcatcttggtcatttcaacgcgcttggccatgatcgaaccggcggtgccgccgaccagcaggccaacgatcacgtagccgataccggcggtggccagctcagccccaagcttatagatgaggcccacggtggtcagcaccgccagcgccatgccgagcatgccgaacaggttgccgcgtcgcgaggtggtggggtgcgacaggcctttaagggcctggatgaagcagatcgacgcgatcaggtagagcgtcgtcaccagattcatgctcattacttctgcacctcttctttcacagctttgggcgctttcttcttgaacatctcaagcatcctacgcgtaaccaggaaaccaccgaatacgttaaccgccgccagggctactgccagggtgcccatggtcttgcccaacggcgtcacggtgagggcggcggccagcatggcgcccacaatcacgatcgcggaaatcgcgtttgtcaccgccatcaaaggcgtgtgcagcgcgggcgttacgttccagaccacgtgataaccgacataaatcgccagcacaaagatgatcaggttgtagataccgggggagataagctcttccatcgtctgaatccctgcttaggcgtttttgcggatgacttggccgtcgcggcacatcaggcacgcggcgacgatgtcgtcttcgaggttgatttcaaactgcccttccttggtgaagaccagcttcaggaagtccagcaggttgcgcgcatacaaggccgatgcatcggcggcgacagcgccggccaggttggtcgggccgcagatgatcacgccgttttccaccaccacctggtcggcgacggtcagcgggcagttgccgccttgggcggcggcgaggtcaatgaccaccgaaccgggcttcatttgcgccacggtatcggcactgagcagggttggtgccttacggcctgggatcaacgctgtggtgataacgatgtcggcctgtttggcgcgctcgtgtacagccagggcctggcgctgcatccagctggtcggcatcgggcgtgcgtaaccaccgacaccaacggcgcattcgcgctcttcatcggtttcgtagggaacgtcgacaaatttcgcaccgagggattcgatctgctctttaaccgccgggcgtacgtcggacgcttcgatcaccgcgcccaggcgtttcgccgtggcaatggcctgcaggcccgcaacgccggcgccgaggatcagcacacgtgcagcttttacggtgccggcggcggtcatcagcatcggcatgaagcgcgggtagtgatgagcggccagtaacacggccttgtaaccggcgatgttggcctgggaggacagtacgtccaggctttgggctcgtgaagtacgtggcgcagcttccagggcgaaggcggtgacgccacgctctgcgagcttggcgatggtttcgttgctgaacggattgagcatgcccaccaacacggtgccacttttgatcagcgccagttcgctgtcgctgggggcaaccaccttgaggatcagctcggcgccaaatgcatcgttggcgctgccaatggttgcgcctgctgtttcataggcactgtcgacgatgctggcgttgatgccggcaccgctttgtacagtgaccttatggccctggccgatcagtttcttgatggtttccggggtggcagccacccgcgtttcaccggtctgggtttcgagaggaacaccaatgtgcacgtcaaatctcctgcatgatctttttgcttttgatctttttgtaaaaaggccagtgcaccgcgagtggcgcagctggggcggccgatcagcacgatcccgctgaaatgacagcggggcgcggcattttgcaggcgaactttacggccttcaagggattatgacgggtgacgaaaaattaactacaagtcaccctgtgactgattgtcgcaacgtcatggaataacctcattaaatacaagtaattaaagggctgcagctgttttccgctgctttttccatctttggcgtgaatagtcggttattggctggtaatagtcggttattggctggtaagtgtcgctccaagccatgaaaatcatggcttggagccgtatttttgtttgatgagtacagtctgttcaaatgcgacatatatttatatctgtaggtttaaaactaatctgactacagggtcaataattcgaattttttccctcaggtgctgggactgtagcgctgtgattggtcgaccagccaatccctgaaagcgtgtagtgaggctgattcgacctttttgtcgggaatcatcaggtaataagccttttcgctgcttaacgcttcattgctggcaatgaccagctgctgctccttcagctcccgctgaatgaggaagggcggaatcagcgcaacgcccatgtcatgcgtggccgcttgggacaacatcgagaatagctcgtatctagggcctgtcatgtcgcggggaacgttcagctgtcgggcgttgaaccattgcctccaggcatagggacgtgtggtctgctgcagcagcggcaattcggcgatctcctggggggtgaaatgcgtgcggccatcgagtaagcatgggctacacacgggtacagggttttcgcccatgagtctgtgggactctgtaccggaccaatcggcatcgccgaaatagatcgcagcgtcgaactccgtgtcggcgaataggaaggggcgtgtgcggttggtcaggttgaccgttacttccgggtgctgacgttgaaagtccttgaggcgcgggatcagccattgcgtgccaaaagtcggtaccactgccagttcgatgacgttggcaccctgctggcccatgacggacaaggtgtctcgctccacagcgtctagctgtgttgccactctgcggctataagacaggccagcctccgtcaacttcacaccgcgtcgtgagcggcgaaacagttcgacacttaaaaactcctctaggctggcgatctgtcggcagatggcgccctgggtgatcgaaagctcttgcgccgccttggtaaagctctcgtgacgggctgctgcttcaaagcttatcagcgcggtggtgctgggaatttttctgcgcatgtacattgccctcacagataaaacgcatttctggcctggttgagtgttacgaagtgacaaattagcacaagcctatgcgcaaacctcgtttgccctctgggccgacccggcctagtctgcatccacgacttctgatgttttgcgcgaggacttattcatggctggcaaggcaagcttcaactggatcgatccgctgctgctggatcaacagctcaccgaagaagagcgcatggtgcgcgacagcgctgagcaatttgctcaagacaagctggccccacgtgtgctcgaagccttccgtcatgaaaagactgacccagcgatcttccgtgagatgggggaaaccggtttgctgggtgcaatgattcccgagcagtacggtggcagtggcttgaattacgtcagctatgggttgattgcgcgtgaagtggagcgtgtcgattctggctatcgctcgatgatgagtgtgcagtcgtcactggtcatggtgccgatcaacgaatttggtactgaggcgcagaagcaaaagtacctgccgaagctggcctctggcgaatggatcggctgcttcggcctgaccgaacccgaccatggctccgacccgggcgcgatgattacccgggcgcgcaaagtagatggcggctatagcctgaccggcgcgaagatgtggatcaccaacagtccgatcgcggatgtgtttgtggtgtggggcaaagacgatgcgggcgatatccgtggcttcgtcctggagaaaggttggaaaggcctgagcgcacctgccattcacggcaaggtcggcctgcgggcctccatcaccggtgaaatcgtcatggataacgtattcgtgccagaagagaatatttttccggatgtgcgtggtttgaaaggtccttttacctgtcttaattcggcacggtacgggatttcctggggggcgctgggggctgcggagttctgttggcacacggcgcgtcagtacacccttgatcgtcagcagtttggtcggccattagccgccacgcagttgatccagaagaagctggccgatatgcagaccgaaatcaccctggctcttcaaggttgcctgcgtctgggcaggatgaaagacgaaggtacggcggcggttgaaattacttcgatcatgaagcgcaactcctgtggcaagtccctggacatcgcacgcatggcccgggacatgttgggtggcaacggcatctccgatgaattcggggtggcgcgtcacctggtcaacctggaagtggtcaatacctatgaagggacccatgacgtgcatgccttgattctggggcgcgcacaaaccggtcttcaggcgttctattaataggagcatgggcatgggcgcgctttcgcatctgcgggtactggatttgtcgcgagtactggcgggaccctggtccgggcagatccttgcagaccttggggccgaggtgatcaaggtcgaaagacccggcagtggtgatgacacgcgcgcctgggggccgcccttcctgaaagatgctgatggcgagaacaccagtgaggcagcgtattacctttcggctaaccgcaataaagagtcggtgactatcgacttcacgcgaccggaggggcaaaagttggtgcgcgatctggctgccaagtcggacatcttgatcgagaacttcaaggtcggggggcttgcagcctatggcttggactatgagtcgctcaaggaggccaacccggagctgatttattgttcaatcaccgggtttggccagacggggccctatgcgacgcgtgccggctatgacttcatgatccaggggctgggtgggctcatgagtctgacaggcaagcctgagggggatcagggggccgggccggtcaaggttggcgtcgccctgacggacatccttacagggctctattcaaccgtggcgatcctggcggcgctggcgcatcgcgatcatgatggtggtggccaacatatcgatatggcactgctggatgtacaggtggcttgcctggcaaaccaggcgatgaattacctgacaaccggagcgtcgccgaagcgcctggggaatgcccatcctaatatagtgccctatcaggactttcccacagccgatggggatttcattcttaccgtgggtaatgacagccaattccgtaaattcgccgaagtcgctgggcagccacagtgggcggatgacccgcgtttctccaccaacagggctcgagtagccaatcgtgcggtgcttattcctttgatccgccaggctacggtcttcaagaccactgctgaatgggtggcagggttggagcgagtgggggtgccgtgcggaccgattaatgatctggcgcaggtatttgctgatcctcaggtcaaggcgcggggcttggcgatggagctgcctcacgcgctggcggggatggtgcctcaggttgccagcccgatacgtttatccaagacacctgtggagtaccgtagtgcgcctcctttattgggggagcatacgcttcaggtgttgcagggggttctggggttgggtgcagctaatgtggctgcgttgaaggcggcgggtgtcatctgagttattccctctatatagaagcacgaagagtgtttttctcaagagtgctcgttttttaatcaatcctaacttattgatagaaaagcagaattaagtgttgacggcagattctggaagcctataattcgccccacttccggcgcagtcgaaacggaaaactccttggtaaacaatgagttatgaagttttcggcagcaagttgcttcagttcatcgaagccaaaaggaagttgaaaaagaggtgttgacagcagcgtgtaacgctgtagaattcgcctcccgctaacgagagatcgaaagcgcaagtggttgaagttgttgaagaaatcttcgaaaacttctgaaaataaccacttgacagcaaatgaggctgctgtagaatgcgcgcctcggttgagacgaaagatcttaaccaaccgctctttaacaactgaatcaagcaattcgtgtgggtgcttgtggagtcagactgatagtcaacaagattatcagcatcacaagttactccgcgagaaatcaaagatgtaaccaacgattgctgagccaagtttagggtttcttaaaaacccaaagatgtttgaactgaagagtttgatcatggctcagattgaacgctggcggcaggcctaacacatgcaagtcgagcggtagagagaagcttgcttctcttgagagcggcggacgggtgagtaatgcctaggaatctgcctggtagtgggggataacgttcggaaacggacgctaataccgcatacgtcctacgggagaaagcaggggaccttcgggccttgcgctatcagatgagcctaggtcggattagctagttggtggggtaatggctcaccaaggcgacgatccgtaactggtctgagaggatgatcagtcacactggaactgagacacggtccagactcctacgggaggcagcagtggggaatattggacaatgggcgaaagcctgatccagccatgccgcgtgtgtgaagaaggtcttcggattgtaaagcactttaagttgggaggaaggattgtagattaatactctgcaattttgacgttaccgacagaataagcaccggctaactctgtgccagcagccgcggtaatacagagggtgcaagcgttaatcggaattactgggcgtaaagcgcgcgtaggtggtttgttaagttggatgtgaaatccccgggctcaacctgggaactgcattcaaaactgactgactagagtatggtagagggtggtggaatttcctgtgtagcggtgaaatgcgtagatataggaaggaacaccagtggcgaaggcgaccacctggactaatactgacactgaggtgcgaaagcgtggggagcaaacaggattagataccctggtagtccacgccgtaaacgatgtcaactagccgttgggagccttgagctcttagtggcgcagctaacgcattaagttgaccgcctggggagtacggccgcaaggttaaaactcaaatgaattgacgggggcccgcacaagcggtggagcatgtggtttaattcgaagcaacgcgaagaaccttaccaggccttgacatccaatgaactttctagagatagattggtgccttcgggaacattgagacaggtgctgcatggctgtcgtcagctcgtgtcgtgagatgttgggttaagtcccgtaacgagcgcaacccttgtccttagttaccagcacgtaatggtgggcactctaaggagactgccggtgacaaaccggaggaaggtggggatgacgtcaagtcatcatggcccttacggcctgggctacacacgtgctacaatggtcggtacagagggttgccaagccgcgaggtggagctaatcccagaaaaccgatcgtagtccggatcgcagtctgcaactcgactgcgtgaagtcggaatcgctagtaatcgcgaatcagaatgtcgcggtgaatacgttcccgggccttgtacacaccgcccgtcacaccatgggagtgggttgcaccagaagtagctagtctaaccttcgggaggacggttaccacggtgtgattcatgactggggtgaagtcgtaacaaggtagccgtaggggaacctgcggctggatcacctccttaatcgacgacatcagctgctccataagttcccacacgaattgcttgattcattgaagaagacgatagaagcagctttaagctccaagctgatagctcttagctaatcagttgcgctcgaaattgggtctgtagctcagttggttagagcgcacccctgataagggtgaggtcggcagttcgaatctgcccagacccaccaattttgttatggggccatagctcagctgggagagcgcctgccttgcacgcaggaggtcaacggttcgatcccgtttggctccaccattaactgcttctgctgttagagtttagaaatgaatattctgaagcgaatattgatttctagtctttgattagatcgttctttaaaaatttgggtatgtgatagaaagatagactgaacgttactttcactggtaacggatcaggctaaggtaaaatttgtgagttctcttaactgagaaattcgaattttcggcgaatgtcgtcttcacagtataaccagattgcttggggttatatggtcaagtgaagaagcgcatacggtggatgccttggcagtcagaggcgatgaaagacgtggtagcctgcgaaaagcttcggggagtcggcaaacagactttgatccggagatgtctgaatgggggaacccagccatcataagatggttatcttgtactgaatacataggtgcaagaggcgaaccaggggaactgaaacatctaagtaccctgaggaaaagaaatcaaccgagattcccttagtagtggcgagcgaacggggactagcccttaagtggctttgagattagcggaacgctctggaaagtgcggccatagtgggtgatagccctgtacgcgaaaatctcttagtcatgaaatcgagtaggacggagcacgagaaactttgtctgaatatggggggaccatcctccaaggctaaatactactgactgaccgatagtgaactagtaccgtgagggaaaggcgaaaagaaccccggagaggggagtgaaatagatcctgaaaccgtatgcgtacaagcagtgggagcccactttgttgggtgactgcgtaccttttgtataatgggtcagcgacttattttcagtggcgagcttaaccgaataggggaggcgtagcgaaagcgagtcttaatagggcgtctagtcgctgggaatagacccgaaaccgggcgatctatccatgggcaggttgaaggttgggtaacactaactggaggaccgaaccgactaccgttgaaaagttagcggatgacctgtggatcggagtgaaaggctaatcaagctcggagatagctggttctcctcgaaagctatttaggtagcgcctcatgtatcactgtagggggtagagcactgtttcggctagggggtcatcccgacttaccaaaccgatgcaaactccgaatacctacaagtgccgagcatgggagacacacggcgggtgctaacgtccgtcgtgaaaagggaaacaacccagaccgtcagctaaggtcccaaagttatggttaagtgggaaacgatgtgggaaggcttagacagctaggaggttggcttagaagcagccaccctttaaagaaagcgtaatagctcactagtcgagtcggcctgcgcggaagatgtaacggggctcaaaccatacaccgaagctacgggtatcacgtaagtgatgcggtagaggagcgttctgtaagcctgtgaaggtgagttgagaagcttgctggaggtatcagaagtgcgaatgctgacatgagtaacgacaatgggtgtgaaaaacacccacgccgaaagaccaaggtttcctgcgcaacgttaatcgacgcagggttagtcggtccctaaggcgaggctgaaaagcgtagtcgatggaaaacaggttaatattcctgtacttctggttattgcgatggagggacggagaaggctaggccagcttggcgttggttgtccaagtttaaggtggtaggctgagatcttaggtaaatccgggatcttaaggccgagagctgatgacgagtcatcttttagatgacgaagtggttgatgccatgcttccaagaaaagcttctaagcttcaggtaaccaggaaccgtaccccaaaccgacacaggtggttgggtagagaataccaaggcgcttgagagaactcgggtgaaggaactaggcaaaatggcaccgtaacttcgggagaaggtgcgccggtgagggtgaaggacttgctccgtaagctcatgccggtcgaagataccaggccgctgcgactgtttattaaaaacacagcactctgcaaacacgaaagtggacgtatagggtgtgacgcctgcccggtgccggaaggttaattgatggggttagctaacgcgaagctcttgatcgaagccccggtaaacggcggccgtaactataacggtcctaaggtagcgaaattccttgtcgggtaagttccgacctgcacgaatggcgtaacgatggcggcgctgtctccacccgagactcagtgaaattgaaatcgctgtgaagatgcagtgtatccgcggctagacggaaagaccccgtgaacctttactatagctttgcactggactttgaatttgcttgtgtaggataggtgggaggctttgaagcgtggacgccagtctgcgtggagccaaccttgaaataccaccctggcaactttgaggttctaactcaggtccgttatccggatcgaggacagtgtatggtgggtagtttgactggggcggtctcctcctaaagagtaacggaggagtacgaaggtgcgctcagaccggtcggaaatcggtcgtagagtataaaggcaaaagcgcgcttgactgcgagacagacacgtcgagcaggtacgaaagtaggtcttagtgatccggtggttctgtatggaagggccatcgctcaacggataaaaggtactccggggataacaggctgataccgcccaagagttcatatcgacggcggtgtttggcacctcgatgtcggctcatcacatcctggggctgaagccggtcccaagggtatggctgttcgccatttaaagtggtacgcgagctgggtttagaacgtcgtgagacagttcggtccctatctgccgtggacgtttgagatttgagaggggctgctcctagtacgagaggaccggagtggacgaacctctggtgttccggttgtcacgccagtggcattgccgggtagctatgttcggaatagataaccgctgaaagcatctaagcgggaaactagcctcaagatgagatctcactgggaccttgagtcccctgaagggccgtcgaagactacgacgttgataggttgggtgtgtaagcgctgtgaggcgttgagctaaccaatactaattgcccgtgaggcttgaccatataacacccaagcaatttgactactctaacgagcatcagattgcggtgtgtgaagacgaaatgaaccgaaagttcgacgctcacaaagcaccgaccgctgtcacatacccaatttgctgaagcgaggcctgctggccacgactcagtacccgaatttcttgacgaccatagagcattggaaccacctgatcccatcccgaactcagtagtgaaacgatgcatcgccgatggtagtgtggggtttccccatgtgagagtaggtcatcgtcaagattaaattccagaacccctgtttgctgacgcagacaggggttttgtttatatagaaactcatgaatttcaccggctcgttgccaacgcaacggcctggtacacagaatttcttgacgaccatagagcattggaaccacctgatcccatcccgaactcagcagtgaaacgatgcatcgccgatggtagtgtggggtttccccatgtgagagtaggtcatcgtcaagattgaattccgaaacccctgtctgctaacgcaggcaggggttttgtcgtttagggcgaccctaaacaacaatttcgctaaccagccgtctgtcggtttcctacgctaaaagaagatgcttctcacaaattcctaagatttgtcgaagtttggccgaaaccctgacgagccatgcgtgcaccgaaatagagcgaccgtagagtccgcctatcccgttacatggaatgttccactcggcacgctcaccccctttggcaaaaagaagtcgatgaaatgaatctcaagttcagtcataaaattctgttggccgcgtcaggcgtcgtggttttagccttcgcgttattcacgctgtacaacgactacctgcaacgcaacacgatcaagcaaaacctggcctcgtccattcaacaatccggcgaactcactgccagcagtgtgcagaactggctcagtggtcgtatcctggtcctagagaacctggcgcagaacgtagctcatcagggcaatgcggccgaccttcccgggctggtcgatcagccagcgctcacctccaactttcagttcacctacgtaggtcagaccaacggcgtgttcactcagcgtcctgatgcgaagatgcctgacgactacgaccctcgtcagcgcccttggtacaagcaagcggtagtagcggacaaaaccatgcttactccgccttatatggcggctgtgggcggccagatcgtgacaattgccatgcctgtgaagaagaacggcgagttgttgggtgttgtcggcggcgacctgagtctgcaaaccctggtgaagatcatcaactcggtagacttcggcggcatcggccatgcattcctggtcagcggtgatggtcaagtcatcgtcagccctgaccaggaccaggtgatgaaaaacctcaaggacatctactctggcaacaacgtacgcatcgaaaaggtcaatcaggacgtcgtcctcaatcaccaggatcgcattctgtcgttcacgcctatcagcggtttgcctggcgccgactggtacatcggcctgtcgattgataaagaaaaagcctatgcccctttgggtaaattccgtacctcagcgttgatcgcgatgttgattgctgtcgtggccatcgctgtgctcctgagcttgcttatccaagtattgctgcgtccgttgactaccatgggcgttgccatgaaggacattgcccaaggcgaaggtgatttgacccgccgcctagacgtaaccagcaaagacgaattcggcgaagtcggtagtgcgttcaaccagttcgtcgagcggatccacgcctcgatttccgaggtgtcttcggcaacaaggcaggtgcacgatctatcccagcgtgtaatggcgtcgtccaatgcctcgatcatcggttccgacgaacagagtgcgcgcaccaacagcgtcgcagctgcgatcaacgaactgggtgccgctacccaagaaatcgcgcgcaacgccgcagatgcttcgcaacatgccagcggtgccagcgagcaagctgacgatgggcgtaaggtggtagagcaaaccatccaggcgatgtcggagctgtcgcagaagatcagcctgtcctgcactcagatcgaaaccttgaatgccagtaccgacaacatcggtcatattcttgatgtcatcaaaggtatctcccagcaaaccaacttgctagcccttaacgcggcgatcgaggctgcccgtgccggtgaagccggacgtggatttgcagtggtggctgatgaagtgcgtaacctggcgcatcgtacccaagagtcggctgaagagatccacaagatgatcacttccctgcaagtggggtcccgagaagcagtgaccaccatgaacgccagtcaggtctccagcgaagaaagcgttgaagtggccaaccaggcaggtgagcgcctggtcagcgtgacgcagcgcatcgttgagatcgatggcatgaaccagtcggttgcggcagcaaccgaagaacagaccgcagtcgttgaaaccctcaacgttgacatcaaccagatcaacctgctgaaccagcagggcgtggccaacctcaacgagacgctcaaggactgcgatgcgctgtcccagcaggccagtcgattgaagcaattggtcgatagcttcaaaatctgaacctgattgcaccggagcgagagacctcgctccgactgcttagccaagcatccggcgcacattctccaacgcgctgtcggcgaacgtctgtgcaaactgttcaaactcagcttgagtcgtttcctgcggctcgcccaacagcgtccaggttgccttggaacactgggcgccaagtgcttccacactcattgctgcccataagcgcgccacgcccaaagtgttgtagagggtggtccacgtcatgtacatggcgctttcgtctcggctgttcagttgctccacgacgtaatggccatcgtggaaaaatttagtgcgcaatgcgcctacgccaacacccgtcatctcgatgtgtgacaagcttgggatgaaggtatcaaaactatcaaagcgaccgaccacgtcccacaggcgtttagcctcacacgggactacgacggaagccacaatcggtgtaccgatcggattgcgaattaacgtatcgggttgcagcggtttcatgggggagtcctgaggcagttcagaggaagtcgatggccctgaggtagtcacagcccttgcgtaacagctccgggctctttggcggatagtccatacccatcttttcaaggccccagcgggcattgtcgtaacggatcatcgaagtgtcgccgatgtcttcgccaagcccgtccaggtaaaagcccagcacgcggaacagcgcattatctcgactcaccgtttgcagcgtccgttgccagtgttcaatgcctacccgatcgaaggcgtgcccggcctcgctgaacgcgtcgagatactgatcccagctcaagggctgcgggttgtgcaggttgaatatgttccgcccaggggcaaagcgggcgctgtgaaaggcaatgaacccagccaggaagtccaccggcatcagatcgaagttcacgtccaggcggggtgccacgcccaattgcagggagcccttgagcatcaacatcaatcgatttttctgcggttggcaaacaccgttctgactgttgaagctgatattcccgggccgatggatattcacccaggccccttgctctctcgcccgccctaccagccgttcggccacccacttggaaaggttatagccatttttcacatagagcggtaacgcgtgcccggcaggggcttcaaggacgtacccatcggcgtccacgctgctacaggctgatagcgtcgagatgaagttgagcacctttttacaatgggtctcgcaaagacgcaggcactcaagggccggttcgacgttgtctttggcgagtgacacatagtccatcacatgattgacctgtgccgcgttgtgcacgaccacaccataattgcgagcgaggcggtcgtacacattgcatgccaagcccaggcgaggttggcgaatgtcggcggcgtatacctgcactcggctcagatccagatgttccaaatggtattcgcgcaaggcctgggtaaaccttgctgttgccgattgacctggcagttcccgcacaaggcacgccacctcttgtgctcctgcggccagcagcgcgtggacgatatgcgccccgacaaagctattcgccccggtgacgatcgctttacgcggatcacccgcgcgggcctcgggtagtattttaatttccaatatttgtgatgcatctttctccatttggctgccaggtatatccggcaacacaccaccttccatcagggccgccaatgtgcggattgtcggcgcctcgaaaaagtggctcagagagaggctacggccaaaccgctcgcgcacgcgcagcaataaagtcgacaagaggatggagtggccgcccagattgaaaaagctgtcatcaatcgataattccccagcgggcaactccagcaattgcgcccacaggtccaccaactgcttttgcacatcggtctgagcacagcagcgagtcactgcttgagggatggataagggcatggccagtaatgccttgcgatcaatcttgccgttactcgagccaggcatgcgcgccaactcgctccagatgacgggccgcatatgttcgggcagccactggcgggcatattgctgcaagtcggccagcgtggcgctgggttcgggttgtgtgacaaaagcgatgaccctgaggcccgggtcaatcactacggctacttggcgaaacaatcgactgttgcgcaggcattgttcgatttccaggggctcgactcggaatccgcggattttgacttggtcatcccgacgcccacccaacttgatgccgtcctgagtccatttcgccaggtcgccgctacggtaagcgtgcaacacctgcccatcaggcaatgtcagtgcaacaaaagggctgtcggcccgttgcggtgcattcaaataacccaggcttacccccgggcctgcaatatacaaatcgcccagcacctgttcatccacgggcttcaggttttcgtcgagaatcaacacttggctgttggcaatgggatagccgatgttacgagggctgtcgccatgccggaacaccctatgtgttgccagcaccgtggtttcggtcggcccatagaggttgtgcaactggcattggcctgccagtcgttcgattacatagggctcgcagaaatcgcctccagtgagcaggtgagcaagccccagtggctgatccagcggcaggatgctgagcagcgccggcggtagaaagccatgggtgacgcgttgcccgcgaatcaattcgaccagttgtcgagggtcttggcgttgatcgttgctggggataatcaactcggcgccggctatcaaggcagggaaaatatcgatcaatgaagagtcgaagctcaacggtgaaaactgcaacacgcgactctcttcactcatctctacacaagcgccgagccaggcgctgaaatgcgccaggttgtattggctaagcagcacccccttgggaaacccggtagtgcctgaggtgaaaagcgccatgcacggtgtgtcggcactgggacgttcacgcatcagtggtagtgcacgggtgttggcgcacggttcgatcttgctgacatccaatgaggcgaggcgatctcgcagcggatgcaggccattctccagcaatacacaagcgccggcgctttccagcatctgctgttggcgctgcaccggatggtccggcgccagaggcaaatacaccgcgccaatccccagcaccgcaaggatgcttgcgtacagctccacggactttgccaggcacacgccgatcacgggttgggtttcgatgccctccagcagtggaagcagacgctgctggatcgccaaggcgtgtgcctggagctgctgataagtgagcaggttgcccgcgatattcaacgctgttcgagtggcgaacttgtccaggctggcttgcagccgttccatcatggggggctgggccgcctgcaacagcgctggatccgccgtgcgattgaatcgatgcttgaacgccaaggtttccagcgctggcaaactgtgttcgggccagtcgttaggggtgatcacaacggtgaaggaggctgggtccctggaatacctactaaccaacaaggcgagccattccaccagtgcgttcgttgcctggtgacgcaatcgctgcccattgccgctgggttcctctgcgacgtcatacatagccaacaggcgtcgttcacggtcatagcagcgaaattgcagggctggcagtccatgctcggacaccgggccaatgcctatgcgcaaactcatccagtatgcgtcggtggataattgcgccagcggccggctaccgtcttcaatcaccaggtcgacaggccccgttcccgagacatgaccgtactgttccagcacttgcttgacggggtccaggacgttgctggcagcgccccacgctatcgtcaaacgtttcatgccgacctccccgccacaggcaggtagctgctcagcgcccgagccacgctgggtgtctgcagcacgccgctgtgacgcagcaagctcatgatgttgcctatcagcggatgttggtgggtgatggggaaatccagcgcagagacttcatggcgcagtgccagacgcgtgtcggcgctgatctccaagtgttcgatcaggtgcagatcaaagtccttttgcaggtcgttggtcaggtaatgctcaaggaaaacgggcaaagcttgagcaatgctgtcgcgctcttgcgggcttgccgattgccagtagagacgcaccaactgggtccagaactgtgcgtggcgaccctcatcaaacaggtggtcggccatcaggccgcggatggatgacttgacgctgtcatccttggagaacgctgccacgtcatgtgtcacggtgttttcggcaatggccacgccgatcaactcaacggcgtcgtgcaaatgtgctggcacctgcgcctgtgccgccggcagtgcgcggctcaattcgatttgcccaggcagatcaagcggctggataccggtcatttccacggcttgttgcaggaagtccaacgcgaccaacgcgtgatagtcctcgtccaccacgacggtcatcgcgtcgtaccggcaggcgagcggaaagggcggtgaaaaacggttcttggcgatgttgcgagccgtcttgtcgacgatctcggtttcgaagatcaccacgtcattgatgaatttatagaaactttgtaccagcacgaagtcgcgccactgtgggcactgttcgagaaaggtcgcgctcagcacgaggggttggcgacacagggggaagaagagtttgttgtcgtcctccaacatgcgccgggggcgtgttcggatggttgcgcgctgctcccagtcatcggcaaaggatcgataattgacagcgttcattggcgtaccccttgcatcgaagtcagcactgcgtcccaaaaggtaatgcgactttccacggcgtcgagggccgcattatctgcttgcttctggcgaatcgggtctgctccgaccaggcgcttgagcaattgctccgctgccggcccatggtcgtggctgtccatttcgatgtgacgattgaggtagtgacataaggtgggtgcctcatgatcaatgagcgcatgactgtgcaacagccgctggaacatcgatggaatgacactctcgcggccatgcaggaaagctgccgctacgcagtgggtcggggcgctcaaggcgacttgcaccgtgctgtcgacaaagcgggccaccccaggtggggcatcgatcatttgcaaggcggcactgacctccacgccctcgcgttgcaggtcgatcaggcggttcatcgcgacagtgctggcgccgacctccgtcatggcgtccaggtacagctcgaagtggctgcgatagcctcgcgtcgggtgttcatctgactcctcgcccagcactatttcattgatcaagcgggcagcctgtgagtccgcaggtgggagccagggtaactgggtacaggtcaggtcctgttgcaggcgtttagtcagggtcatgaagtcccagacggaaaatacatggttttccatgaagtgctgtaacttgttaagtgaagttatttctataaataatggatggttgaaaagttgtagttttttttgttcaagcaattcttgatacatggttgacgcctatgaattgttgcaggtgctcaaaagcagtgttggggttttgtagttgtaagatagaaggggaacgttaaatcgagaccgcacgacgcacgcggcgcagcactgacatagacctgcgctgcggatttggaggtgtggtttttcgggaaaggataataaactgattaaacgtttgtgctggcttataaatgtattaaatgttttttctgtgtggcttttattaggtgagttgtctgttgtcagtgtcggatgtttcctcgcgttaattaagtttaagtcggttttccgcatgccaatgtggcaacttcccaaggaagttgccccgcaggggtaaagggagatagagggccgaggatcctattgccgagcttttttttcggcggtttcaagccccttgaggtaggtggctatgacctccatcccacgcatcaagtgattacgcagcgtcaggatgctctcgtcgaccttcttctgtgccaccaggctcagcaattcacggtggtcttcctgggacgtctcgcctagtcccatcgcctcaaggttgaagcgcaggaagcgctcttcttcattcagcccgtgctcgaccaaggtgagcagtcgctggttgggtgccttgccatacagaaccatgtggaacaggcgattgaggcgaccaatctcggtgtagtccttttcgcattccagcgcattgatgcacgcctcggcctcggatagatctgtctcggtgagcaatgggatcgacaagcgcagcgcttcggattccagcagcatgcgcaaggcataggtctcagccgagttgtcctcgatcaagggcgcaaccacggcacccttgtgagtcaccacatgcagcagggattgcgcctccaactggcgcaaggcttcgcgtacgggcatgcggctgacgccgaacaagctggccagctcctgctggcgcatcgcagtaccacagggcaatcgcccatccagtatggcgttgcgcagtgtttcttcaattacggagcgagcaagatgggcgggaataggcccgctgattttgatgctgcttaaagggttcggcttctgcgtcacggttacgctatcctcctttttttgaataatagtttggctaattggatccaatgcacactagagatgggccaggcgcttgtcaaacagcctaagtttccgtttgtaagggcttacgcagcctactttgtgagtcccacaaggggcggttataaacttagtccactgacgaatgattgcactgtgccattgttttttgtagggcgaggcttcaccatcccttgaaattccgtctctttcatggactgaacgccttggcggtaagttttattccctatcgagtcttttgctggtttttatcggcaattttattggctggcctgatgctcggcgggctgcgtgccgattgggatttctcgcagatcagccgcaaggctaccgccctatacgggccgctgggccaaggccagcagcgtatcgatgcctggcagcggctattggcgactgaaaaacaggtcagcgagtcggagcagctcaaggtggttaacttgttcttcaacaagcaaatgacctacgtcgaagacatcgacctctggcatgtcatcgactattgggagacacccgtcgaagccctttggaagggggccggtgactgcgaagattacgcgatcgcaaagtatttcagtttgcgtcatctgggtgtgtccagcgacaagttgcgcatcacctacgtcaaggccttgcgacagaatcgtgcgcacatggtcctgacctattattcgacccccgatgccatcccgctggtgctcgacagcctgatggacgaaatcctgccggctacccgccgcaccgatctggtcccggtgtactcattcaacgccgagggcctgtacttgcccggcgccaagggcaacaagaaagtcggcgataccaaacgcttgtcgcgctggcaggatgtgttgagaaaaatgcgtgcggaaggctttccagccgagcctgccaactaggagtaactgatcggatgtccttgttcaaacaactattgatcgctatctgtctgttcctggtggtcgccttcagcggcagcttcatggtcagcctggaaagctcgcgcacccaatacgtcaaccaactgcgctcccatgcccaggatgcggcgacggccctggcgctgtcgctgaccccgaatatcgatgacccggccatggtggagctgctggtcagctcgatcttcgacagcggctattacgccagcatccgtgtagtggacttggccaccgacaaaaccatcgtcgagcgcagcggtattcctgacaataacggcgtgcccaactggttcgtgaagttgatcggcctggagccggcaggtggcgatgctctggtcagccgaggctgggagcaggcggcgcgggtcgaggtagtcagccatccgatgtttgccctggccaagctctggcagagcgcgttgggtagccttggctggttgttgctgtgcggcgcggtgagcgtggtgctaggtgggctgttgctgcgccggcaattgaagccgttggactatatggtcaaacagtcccatgccattgcccgtcgggagttcctcagcctgcctgatttgccgcgcacgccggaactgcgtcgggtggtgcaggccatgaaccagatggttgaaaagctcaaggcgctgttccaggaacaggccgaacgtagcgaaaaactgcgcaccgaatcctatcaggacaacctgactggcctcgccaatcgacgttatttcgagatgcaactcaacgcccgcgtgagtaaccctgaagagaccaattccggctacctgttgttgctgcgggtcaaggacctggcgggcctcaaccagcgcctgggcggccagcgtaccgaccagctgctgcaagcggtgggcgaacaactgctgcgccagtgcgagccctatccggaaacccataacctcgtcactcgtatccgcggcggcgagttcgccgtgctggcgccgggtttgatgcgtgaggaagcgctgcaattggcgcaaaacctcgaaagcaccttgctcagcctgcaagcgaccggtgccagcgatgttacgccggtcgcctatatcggcctggcgccgttcaaccatggcgacgcgccccaaaccctgctgaccctggccgaccaggccctggcacaggcggaagcgcagggtgacagcagttgggtatgcctggaccacagcgccgccgccagcgtcggtgacgatcatcatgcctggcacaggttgttggaccaggccctgacccaacagcgctttgagctgtacttccaacccgtcgttgccagccaggacacacagttggtcttgcactacaaggtcctgtcgcgcctgcaggacgaagacggccacacaataccggccgggcgcttcctgccctggttggaacgctttggctggtcggcccgcctggaccgcctgatgctcgagcaagtcctcaagcagatggccaaccacagccataacctggcgctgaacctctcagccgcaaccttgcaggacacccaggcgctgaaccggatttatgacttgctacgccagcacagcaacctgggcccgcgcctcactctggaaatcggtgaagagcaactgcctgaacagcacgtactggaacagatgacccagcgcctgcgcgagttgggtttctccctgagcctgcagcgtttcggtgggcgcttcagcatgattggcaacctggcgcgcctgggcctggcgtacttgaagatcgatggcagctatattcgcgccatcgaccaggaaagtgacaaacgcctgtttatcgaagctattcagcgcgcagcccacagcatcgatctgccgttgattgccgagcgtgtggagaccgagggcgagttgaaggtgattcgcgagatggggatttttggtgtgcagggtcagctgtttggcgagcctgcgccctggaaatcacactgacatcaggacattcaaatgtggaagggggcttgccccctcccacatttaaataagggttcggctccagggctcagataagccctttctcgtcatcatcgatcaactggctcaacccacccaacgcttcccgcgcgtggctacggtccatcaacttggcctgggctgccggcggcaggtcggtcacgctgattactcctttgcgggtcagcacctggatcaagtcatccagtacccgaatcatctccaagtcgctctgcttgagctgtgccaggctggtttccaccacttcgttggcgtaccaggcctggatctcatggtgatcggccggcagggtttcggtggactcgacaaaggcggcggcctctacgcgaatcagcgcgcccagcgcatcacgttgcacgtaaaacataagaacccctcgatatgagccacatgcgttcaacagcataggccaacgctgcgtgtatgggcgtgagtatgcgacgcaccgtccgccagggccagcggcccatgaggcaaaaaaatcggccgcctgggaaggcggccgatcaattgcatcttagctatggtcgatcttgatggttgggtcggcgccagtgatcagcgagttgatgctgacatgggaccaatcattgccttccagcttgattgtcacatcggcattggccacgccaccggcagcgttgagcttgccttcgctgctgacttgcagggtcgacacgccatctaccgtagtgatcttcaggtaattgtcgatggtgctatcggtctcacctttcaacaagtcacgcagatcaatacggtcgccttccgaagccttgaagtccttgatcacatcgttgccgatgtcaccggctttccacacaaaggtgtcggcacccgaaccaccgatcaaaatgtcgttgccctggccgccaatcaacgtgtcgttgccggtaccgcccagcaggatgtcattgcctttgccgccgtccaggaggtcgttgccgccctggccgaacaggatgtcatcgccagcgccgcccagcagggtgtcgttggcatccttggcgccggacacatcgaagtccacgtagtgctcggtcacgtactggtgaacgttggaggcggtcaccgaagagacggttacgccggtcttctgcgccacgaacgcctgcagtgcgttgtaaccctcaccgttgatcccgctgaagctcaccaggtcgccgaagaggatgtcgttgccatcgccgccgatgacggtgtctgcgccaggcaacgtcgcctcggtgtggccgaggatcgcgttggccaggtccttcggatcgatgttggcttgcggcttgccatcgctgtcgtacggtgccaactgattcagactgaccccgctgttgaggccgatggcttctacgccacctgtggacaggcctttgagcagtgcgaacgcgctgttggagttgagggtggtggagtagtcggtatcgtacccgaggccgccttgtaccgatatttcataggtgccatccccttgggcatggattgttcccgggttggactgcccccagccccaccagttgttggtccacagggttaccttgccaacagagtcgatatcaattaagtgattcgagtcgatgttgatccgggtggcggtacctatggtgtagttgttcatggtgacaacatcatcgagtctgacgttgccgtacaagtacgggttggtctgctcggccccctggtaaaacgtcggctggccatcggtgatgaagtacgttgtattgattgcgccggtgttgccagtcgcctgggcacttttgaagaagttggacgcggccttgaacacgtcttcgtagttggtcccgccggtagataccatggaatccaggactttctgcagcgaattcagtgcgcctgggtctttcaggtcgactgtcaccgtgcgattgacctggtcactgaagtccgccaggaagatattcacggtgccagaggtgctggagccgatactgtttttcagcgaattgaacgtggtggtcagcgaggctttcgccgctgctattgaggccgagcccatactgcccgatgtatcgatcatgaacgcaatgttgtagttcttgccttgcaccacgttcaggccgccgacatcggcgacgacgatgtcgttgccatcggtgccgttgatggtgtcgctgcccgaggtgccggtaaccgggttataggtcgccgggtgcaccgtgacgggcaattgcgcggtggtggtggccgaaccaccgatgctttcggtggaggtcgaagtgaccgtcaggttgaactggccgctgtagtaggtcggcggcttgatggtcagggtgcccaagtcccagccggtgacattgacttcgcccgtggccttgctcgcggtgaaggtgtgccccgacgcgtcggtgagtaccgagcctgccgggatgccactgatcttcacactcagggtttccgaaccgtcggtatcggtcagcgccgtggtgaccttggacagcttcacggtgccgttttcctggccttcgttgagcttgtagcccacgtagtaaccgtcgccgttgctgccatgcaggtcggacacggtcacgccggcgttggtcaggtcggtgatgccggtgtacaacggcacggtgctggtgctcaggttctgcaccgccccgccgttgatcgacaggttgacgtcaaagctgccaggccccgcctggttggcctggtagatctcaaggctgtagtagccgctgaccgatggcgtgaacgagccgctgaacttgccgctgttggtgccccacagtccgctggcaatgtctttaccgccaacgttgaccaccacgctgtcatcggcgatgccgctgaaggtgtagctcttgccggcttccatgtagatcaggccggaaatcttggagccagagccagcattgacgttatcgacggattcgacattggtcaccacagaagtgctgttcggtgtaccggcgttatcgatggcttttttcagtacgtctggcgcagcgccgttgccgttgttgccgaggccggcaatgctgttccagccctgtttgaccaggccggtcgaggcgacgttgttatcggccacgttcagggtcggtgcgtcggccaccggggtgatatcgactttcaccgtggcggcagtacccagatccttgccgtcgctgggctggaacttgaactgcgcgtaatcggcctgtttgttgccaatgccggtgccgccataaccatcggcgcctgattcgttggcgttaggcataaagcgcaactggccgccgtcgatctgggccttggtgaaggtctggccgctggacacgttggtccaggtgctgccgtccgccgccaggaactgcagtttgccggctaccggcagttcggtgattttcacgctaaggctggcttgtggcgagtccacatcggtcacgccgaagttggcccaggtcaaggccagcgcggtgtcttccgtaccggtcacggcaccgccggtggccactggcgcgtcgttgacggccaccacgttgacggtggtggtcgcgacgttggagtagttgccaccatcggtcacgctcactgtaatcgtgcgtggtgtggtgcttgggtcatggctgttgttggtgaacgtgatgttcttgatctgctgcatgtagtcggccagcgacgccgtgccggtcagggtcaaggtgattttgccggtgacagggtcggtgctcggggtcacgttgatgcccgtcacgccgctgaagttcagcgagtcgcctggctggctgttggtcagtaccacggtggcgccagtcagttgggtgctgtccgggtcggtgatcttgatgtcgctgtcagcaatcgacatgccggtgccgccttcggtgaaggtggtcttgaagtccgccccggtggcgccgctggagttgttggcatccaagtcgatgaccggcggcgcatcgttgtcgatgatgtcggtgctgacgctgccattgcccaccaccaggttttcgaagttgccaccggtggccttgtcgatggtgatgacaatcttttccgtcggctcggtgatcttgtcatcgagcgttcggatatcaaacggcacgctgctggaaccggccggtatcttcacggtgtacacgccgttgaagtccgaaccgtcggtggcggtgccgctgtacttgagcgtcacggttacgtcggtcagcggcgggttgctcagcgtcagggtgtagtgcgccgtgccgccttcagtcaccgacgcgtcgccggtgatgctgatggtggtgttgttgaccacatccgtcaccttggtgaccacggtgctgccatcgaggatcaagtgttcgtacttgtcgccaccgctgactacgccggtgattttggtggtgacgtcattggcgccgacatacgcatcgttaggtgcggtagtggtagtgaagctggtggacttgccattgccgatggtgatggtcgagccgttatccagccttaccaccaggtcggagccaacgttgttgactgccgcgccgttcttatcgaccagggacgcggtatagacgatctgcccgccctcgctgaccgagccagtggccttgagtacaacggtcacgtcatcgatggtgtcgttgatcgtggtggtcgcgccgcccggggtgatgcttacaccctcgaaattaccgccggtagtgccggtgatcttgacggtctgggtgctcttgtcgatgaacacatcatcggtaggtgctgggacggtcacggtgccgacggtcgcgccctgcttgatggtgatgctggaaccgttatcgagctgaaccaccatgtcgctgccggccttgttgctcaaggtcgcggtgtaagtgatctggccaccttcgttgacggccgtcggggcggtcaaggtgacggtggtcagatcggtggagcccggggtatcggtaacggtggtggtcaccgcagtcgtgcctggcaccagattttcgaaatgttcgctgccggtcacgcttttgattgcggtggtgacggtctggtcgcccttgtagacatcgtttggcgcgacggtggtgattgtgccgctggactggttcacgccgatagtgatggtcttgccgttatccagggtgacggtgagcgggttggtgatgttggtcaccggagcgccgtttttatccacaaggctggcggtgtagacgatattgccgccttcgccgacggtggtggtggcggtcagaaccacatcgaccttatcgatggtgtcgttgatggtggtggtcgcgccgttgcctgcaacttccaacttctcgaagttgccgccagtagtctcagtgatctgaacggtctgggtgctcttatcgatgaacacgtcatcggtaggcgccgggacggtcacagtgccgacggtgtcacccgccttgatcgtgatgctcgagccgttgtccagcttcaaggtgacgtcggtgccggccttgttgctcaaggtggcggtgtaggtgatctcgccaccttcgttaacagcacttggtgcagttagcgtcacggtagtggtgttatcggtacccggtgtatccgtaacggtggtgttgaccgccgtagtacccggtaccagattttcaaagtgttcgccgccggtcacgcctttgatggcggtggtgacggtttgatcgcccttgtacacatcatccggt

SEQ ID NO: 5 - DNA, 2811 bp, Pseudomonas fluorescens KENGFT3
accgttatcgagagtgacggtcagcgggttggtgatgttagtcaccggcgcaccgtttttatccacaaggctggcggtgtaaacgatgttgccgccttcgccgacagtggtggtggcggacagcaccacgtcgactttatcgatggtgtcgttgatggtggtggtcgcaccgttgcctgcaacttccagtttttcgaagttgccgccagtggtctcggtgatcttgacggtctgggtgctcttgtcgatgaacacgtcatcagtaggcgccggtacggtcacggtgccgacagtgtcgccagctttgatggtgatcgacgagccgttatccaacttcaacgtaacgtcagtgcccgctttgttggaaagcgtagcggtgtaagtgatctcgccaccttcgttaacagcacttggtgcagtcagcgtcacagtggtggtgttatcagtacccggggtgtcagtcacagtcgtggtgactttatcggtccctggcaccaagttttcaaagtgttcgccaccggtcacgtttgtgatggcggtggtaacagtttggtcgcccttgtacacatcatctggagctacaaccgagatagagctgctggactggttcaccccgatggtaatggtctggccattatccagggtgacggtgagcgggttggtgatgttggttaccggagcgccgtttttatccacaaggctggcggtgtaaacgatgttgccgccttcgccgacagtagatgtggcggtgagcaccacatcgaccttgtcgatggtgtcgttgatcgtggtggtcgcaccattgcccgcaacttccaacttctcgaagttaccgccagtagtctcggtaatcttgacggtctgggtgctcttgtcgatgaacacgtcatcggtaggcgccgggacggtcacggtgccgacagtgtcgcccgccttgatcgtgatgcttgagccgttatccagtttcaaggtgacgtcggtgccggccttgttgctcaaggtggcggtgtaggtgatctgtccaccttcgttagcctcagacggagccgtcagggtcacggtggtggtgttgtcggtacccggtgtgtcagtcactgtcgtggtgactttatcggtacctggaactaggttctcaaaatgctcgccgccggtcacgcctttaatggcggtggtgacggtttgatcacctttgtacacatcatccggggccacaaccgagacagaactgctgctttggttcacgccgatagtgatggactggccgttatccagggtgacggtgagcgggttggtgatgttagttaccggcgcaccgtttttatccacaaggctggcggtgtaaacgatattgccgccttcgcccacggtggtggtagcggacagcaccacatcgaccttgtcgatagtgtcgttgatcgtggtagtcgcgccgttgcctgcaacttccaacttctcgaagttgccgccagtggtctcagtgatctgaacggtctgggtgctcttatcgatgaacacgtcatcggtaggcgcagggacggtcacggtgccgacggtgtcacccgccttgatcgtgatgctcgagccgttgtccagcttcaaggtgacgtcggtgccggccttgttgctcaaggtggcggtgtaggtgatctcgccaccttcgttaacagcacttggtgcagtcagcgtcacggtagtggtgttgtcagtgcccggggtatccgtaacggtggtgttcaccgcggtagtgccagggaccaggttttcgaaatgctcgccgccggtcacgcctttaatggcggtggtgacggtttgatcgcccttgtacacatcatccggtgccacaaccgagacagaaccgctggattggttcacgccgatagtgatggattggccgttatccagggtgacggtgagcgggttggtgatgttagttaccggcgcaccgtttttatccacaaggctggcggtgtaaacgatattgccgccttcgcccacggtggtggtagcggacagcaccacatcgaccttgtcgatagtgtcgttgatcgtggtagtcgcgccgttgcctgcaacttccaacttctcgaagttgccgccagtggtctcagtgatctgaacggtctgggtgctcttgtcgatgaacacgtcatcggtaggcgccggtacggtcacggtgccgacagtgtcgccagccttgatggtgatgctcgaaccgttgtcgagtttcagcgttacatcagtgcccgctttattggagagcgtagcggtataggtgatctggccgccttcgttaacggcacttggtgcagtcagcgtcacggtagtggtgttatcggtgcccggggtgtcagtcacagtcgtggtgactttatcggtcccaggaactaggttctcaaagtgctcgccgccggtgacgcctttgattgcggtggtgacggtttggtcgcctttgtacacatcatccggtgccacaaccgagatagaaccgctgctttggttcacgccaatagtgatggactgaccgttatcgagagtgacggtgagcggattggtgatgttggtcaccggtgcaccgtttttatccacaaggctggcggtgtaaacgatattgccgccttcgcccacagtagtggtggcggacagcaccacatcgaccttgtcgatggtgtcgttgatggtggtggtagcaccgttgcctgcaacttctaacttctcgaagttgccgccagtggtctcagtgatctgaacggtctgggtgctcttatcgatgaacacgtcatcggtcggtgcaggaacggttaccgtgccaac
